United States Patent 11,931,406 (FLAVIVIRUS VACCINE) - sequence listing, part 19

SEQ ID NO: 8892 - RNA, 9879 nt, Artificial Sequence
  derived and/or modified CDS sequence (opt1) from DENV-1__KC762645__SS-prME
agcgugaccaugcugcucaugcugaugcccaccgcccuggccuuccaccucaccacccggggcggggagccccacaugaucgugagcaagcaggagcggggcaagagccugcuguucaagaccagcgccggggugaacaugugcacccucaucgccauggaccugggcgagcugugcgaggacacgcucaccuacaagugcccccggaucaccgaggccgagcccgacgacguggacugcuggugcaacgccaccgacacgugggugaccuacgggaccugcagccagaccggcgagcaccggcgggacaagcgguccguggcccuggcgccccacgugggccuggggcucgagacgcgcaccgagaccuggaugagcuccgagggcgccuggcggcagauccagcgggucgagaccugggcccugcggcaccccggguucacggugaucgcccuguuccucgcgcacgccaucggcaccagcaucacccagaaggggaucaucuucauccugcugaugcucgugacccccuccauggccaugcgcugcgucggcaucggcagccgggacuucguggaggggcuguccggcgccacguggguggacgucgugcuggagcacgggagcugcgugaccaccauggccaaggacaagcccacccucgacaucgagcugcugaagacggaggucaccaaccccgcggugcuccgcaagcugugcaucgaggccaagaucuccaacaccaccacggacagccggugcccgacccagggcgaggccacccugguggaggagcaggacgccaacuucgucugccgccggaccuucguggaccgcggcugggggaacggcugcgggcuguucggcaaggggucccugaucacgugcgccaaguucaagugcgugaccaagcuggagggcaagaucguccaguacgagaaccucaaguacagcgugaucgugaccguccacaccggcgaccagcaccagguggggaacgaguccacggagcacggcaccaccgcgaccaucacgccccaggcccccacgaccgagauccagcugaccgacuacggggcccugacccucgacugcagcccccggacgggccuggacuucaacgagaugguccugcucaccaugaaggagaaguccuggcuggugcacaagcagugguuccuggaccucccccugcccuggaccagcggggccagcaccucccaggagacguggaaccgccaggaccugcucgugaccuucaagaccgcccacgcgaagaagcaggaggucguggugcugggcagccaggagggcgccaugcacaccgcccugacgggggccaccgagauccagaccuccggcaccacgaccaucuucgccgggcaccucaagugccggcugaagauggacaagcugacccucaagggcaugagcuacgucaugugcaccggguccuucaagcuggagaaggagguggcggagacgcagcacggcaccgugcugguccagaucaaguacgagggcaccgacgcccccugcaagauccccuucagcacccaggacgagaagggggugacgcagaacggccgccugaucaccgccaacccgaucgugaccgacaaggagaagcccgucaacaucgaggccgagccgcccuucggggaguccuacaucgugaucggcgcgggcgagaaggcccucaagcugagcugguucaagaagggguccagcaucggcaagauguucgaggccaccgcccgcggggcccgccgcauggcgauccugggcgacacggccugggacuucggguccaucggcggcguguucaccagcgucgggaagcucgugcaccagaucuucggcaccgccuacggggugcuguucuccggcgucagcuggaccaugaagaucgggaucggcgugcugcucacguggcugggccugaacucccggagcaccucccucagcaugaccugcaucgccguggggcuggucacccuguaccucggcgugauggugcaggccgacuccgggugcgucaucaacuggaagggccgcgagcugaagugcgggagcggcaucuucgugacgaacgaggugcacaccuggaccgagcaguacaaguuccaggcggacagcccgaagcggcuguccgccgccaucggcaaggccugggaggagggggucugcggcauccgcagcgccacccggcucgagaacaucauguggaagcagaucuccaacgagcugaaccacauccugcucgagaacgacaugaaguucaccgugguggucggggacguggcgggcauccuggcccaggggaagaagaugauccgcccccagcccauggagcacaaguacagcuggaaguccuggggcaaggccaagaucaucggcgccgacgugcagaacacgaccuucaucaucgacgggcccaacaccccggagugccccgacgaccagcgggcguggaacaucugggaggucgaggacuacggcuucgggaucuucaccacgaacaucuggcugaagcuccgcgacagcuacacccaggugugcgaccaccggcugauguccgccgccaucaaggacagcaaggccgugcacgccgacaugggcuacuggaucgaguccgagaagaacgagaccuggaagcuggcgcgcgccagcuucaucgaggucaagaccugcaucuggcccaagucccacacgcucuggagcaacggcgugcuggaguccgagaugaucauccccaagaucuacgggggcccgaucagccagcacaacuaccggcccggguacuucacccagaccgccggccccuggcaccuggggaagcucgagcuggacuucaaccugugcgagggcaccacgguggucguggacgagcacugcggcaaccgcgggccgucccuccggaccaccaccgugacgggcaagaucauccacgaguggugcugccgcagcugcacccugccgccccugcgguuccgcggggaggacggcugcugguacgggauggagauccggcccgucaaggagaaggaggagaaccucgugaaguccauggugagcgccggcagcggcgaggucgacuccuucagccuggggcugcucugcaucuccaucaugaucgaggaggugaugcgcagccgguggucccgcaagaugcugaugaccggcacccuggccguguucuuccuccugaucauggggcagcugacguggaacgaccucauccgccugugcaucauggucggcgcgaacgccagcgaccggauggggaugggcaccaccuaccuggcccucauggccaccuucaagaugcgcccgauguucgccgugggccugcuguuccggcgccucacgucccgggaggugcugcugcucaccaucgggcugagccuggucgcguccguggagcuccccaacagccuggaggagcugggcgacgggcucgccaugggcaucaugauccugaagcugcucaccgacuuccagucccaccagcugugggccacccugcucagccugacguucaucaagaccaccuucucccugcacuacgccuggaagaccauggcgaugguccucagcaucgugucccuguucccccugugccucagcacgaccucccagaagaccaccuggcugcccgugcugcucggcagccuggggugcaagccgcugacgauguuccucaucgccgagaacaagaucuggggccgcaaguccuggccccugaacgaggggaucauggccgucggcaucgugagcauccugcucagcucccugcugaagaacgacgugccccucgccgggccccugaucgccggcggcaugcugaucgcgugcuacgucaucagcggguccagcgccgaccucucccuggagaaggccgccgaggugagcugggaggaggaggccgagcacuccggcgcgagccacaacauccugguggagguccaggacgacgggaccaugaagaucaaggacgaggagcgggacgacacccucaccauccugcugaaggccacccuccuggccguguccggcguguacccgcugagcauccccgccacccucuucgucugguacuucuggcagaagaagaagcagcgcuccggggugcugugggacacccccagcccgcccgagguggagcgggccguccuggacgacggcaucuaccgcaucaugcagcggggccugcucgggcgcucccaggugggcgugggggucuuccaggagaacguguuccacaccauguggcacgugacccggggcgcgguccugauguaccaggggaagcgccuggagcccagcugggccuccgugaagaaggaccucaucagcuacggcggcggguggcggcugcagggcuccuggaacacgggggaggaggugcaggucaucgccguggagcccggcaagaaccccaagaacgugcagaccgcccccgggaccuucaagacccccgagggcgaggucggcgccaucgcgcuggacuucaagcccgggacgagcggcucccccaucgugaaccgcgaggggaagaucgugggccucuacggcaacggggucgugaccaccagcggcaccuacgugagcgccaucgcccaggccaaggcgucccaggaggggccgcugcccgagaucgaggacgaggucuuccggaagcgcaaccugacgaucauggaccuccaccccggcagcgggaagacccggcgcuaccugccggccaucgugcgggaggccaucaagcgcaagcugcgcacccucauccuggcccccacccggguggucgccuccgagauggcggaggcccugaagggcaugcccauccgcuaccagacgaccgccgucaagagcgagcacaccggcaaggagaucguggaccucaugugccacgccaccuucacgaugcggcugcugucccccguccgcgugccgaacuacaacaugaucaucauggacgaggcccacuucaccgaccccagcuccaucgcggcccggggguacaucagcacccgcgugggcaugggggaggccgccgccaucuucaugaccgcgacgccgcccggcuccgucgaggccuucccgcagagcaacgccgugauccaggacgaggagcgggacauccccgagcgcuccuggaacagcggguacgaguggaucaccgacuuccccggcaagaccgugugguucguccccuccaucaagagcggcaacgacaucgccaacugccuccggaagaacgggaagcgcgugauccagcugucccggaagaccuucgacacggaguaccagaagaccaagaacaacgacugggacuacguggucaccaccgacaucagcgagaugggcgcgaacuuccgcgccgaccgggugaucgacccgcgccggugccugaagcccgugauccucaaggacgggcccgagcgcgucauccuggccggccccaugccggugacggucgccuccgccgcgcagcggcgcgggcgggugggccgcaaccacaacaaggagggcgaccaguacaucuacauggggcagccccugaacaacgacgaggaccacgcccacuggaccgaggccaagaugcuccuggacaacaucaacacccccgagggcaucauccccgcccuguucgagccggagcgcgagaaguccgccgcgaucgacggggaguaccggcuccgcggcgaggcccggaagaccuucguggagcugaugcgccgcggggaccugcccgucuggcucuccuacaagguggccagcgagggcuuccaguacagcgaccgccgguggugcuucgacggcgagcgcaacaaccaggugcuggaggagaacauggacgucgagaucuggacgaaggagggggagcggaagaagcugcgcccccgguggcucgacgcccgcaccuacuccgacccccuggcccugcgggaguucaaggaguucgcggccggccgccggagcguguccggggaccucauccuggagaucggcaagcugccgcagcaccucacccagcgcgcccagaacgcccuggacaaccuggugaugcuccacaacagcgagcagggcgggcgggcguaccgccacgccauggaggagcugcccgacaccaucgagacgcugaugcuccuggcccugaucgccguccucaccggcggggugacccuguucuuccuguccggccgggggcucggcaagaccagcaucggccugcugugcgugauggccuccagcguccuccuguggauggcguccgugcagccccacuggaucgccgccagcaucauccuggaguucuuccucauggugcugcugauccccgagccggaccgccagcggacgccccaggacaaccagcucgccuacgucgugaucgggcugcuguucaugauccucacgguggccgcgaacgagaugggccugcuggagaccaccaagaaggaccucgggaucggccacgucgccguggagaaccaccaccacgccgccaugcuggacguggaccugcaccccgccuccgcguggacccucuacgccgucgccacgaccaucaucaccccgaugaugcgccacaccaucgagaacacgaccgccaacaucagccugaccgccaucgcgaaccaggccgccauccugauggggcucgacaagggcuggcccaucuccaagauggacaucggcgugccccugcuggcccucgggugcuacagccaggugaacccccugacccugacggcggccguccucaugcugguggcccacuacgccaucaucggcccggggcugcaggccaaggcgacccgcgaggcccagaagcggaccgccgccggcaucaugaagaaccccaccguggacgggaucgucgccaucgaccucgaccccgugguguacgacgcgaaguucgagaagcagcugggccagaucaugcugcucauccugugcacgucccagauccugcucaugcgcaccaccugggcccugugcgagagcaucacccuggccacgggcccccucaccacccugugggagggguccccgggcaaguucuggaacaccacgaucgccgucagcauggccaacaucuuccggggguccuaccuggcgggcgccggccucgccuucagccugaugaagucccucgggggcgggcgccgggggaccggggcccagggcgagacccucggcgagaaguggaagcgccagcugaaccagcuguccaagagcgaguucaacaccuacaagcgguccgggaucauggagguggaccgcagcgaggcgaaggagggccucaagcgcggggagacgaccaagcacgccgugucccgcggcaccgccaagcugcggugguucgucgagcgcaaccuggugaagcccgaggggaaggugaucgaccugggcugcggccgcggcggguggagcuacuacugcgccgggcucaagaaggucaccgaggugaagggguacacgaagggcgggcccggccacgaggagcccaucccgauggccaccuacggguggaaccuggugaagcugcacuccggcaaggacgucuucuucaucccgcccgagaagugcgacacccuccugugcgacaucggggagagcucccccaacccgaccaucgaggagggccgcacgcugcgggugcucaagaugguggagcccuggcugcgcgggaaccaguucugcaucaagauccugaaccccuacaugcccagcgucguggagacccucgagcagaugcagcggaagcacggcggcaugcuggugcgcaacccgcugucccggaacagcacccacgagauguacugggucuccugcgggaccggcaacaucgugagcgcggugaacaugaccucccgcaugcuccugaaccgcuucacgauggcccaccggaagcccaccuacgagcgcgacgucgaccugggggccggcacccggcacguggccguggagcccgaggucgccaaccucgacaucaucggccagcgcaucgagaacaucaagcacgagcacaagagcaccuggcacuacgacgaggacaaccccuacaagacgugggcguaccacggguccuacgaggugaagccgagcggcuccgccagcagcauggucaacgggguggugaagcugcugaccaagcccugggacgucauccccauggugacccagaucgccaugaccgacacgacccccuucggccagcagcggguguucaaggagaaggucgacacccgcaccccgaaggccaagcgggggacgacccagaucauggaggugaccgcccgcuggcucuggggcuuccugucccggaacaagaagccccgcaucugcacccgggaggaguucacgcgcaaggugcggagcaacgcggccaucggcgccgucuucguggacgagaaccaguggaacuccgccaaggaggcgguggaggacgagcgcuucugggaccugguccaccgggagcgcgagcuccacaagcaggggaagugcgcgaccugcguguacaacaugaugggcaagcgggagaagaagcugggggaguucggcaaggccaaggggagccgcgccaucugguacauguggcugggcgcccgguuccucgaguucgaggcgcugggcuucaugaacgaggaccacugguucucccgcgagaacagccuguccgggguggagggcgaggggcuccacaagcugggcuacauccugcgggacaucagcaagauccccgggggcaacauguacgccgacgacaccgccggcugggacacccgcaucacggaggacgaccuccagaacgaggccaagaucaccgacaucauggagccggagcacgcccugcuggcgaaggccaucuucaagcucaccuaccagaacaaggucgugcgcgugcagcggcccgccaagaacgggaccgucauggacgugaucucccgccgggaccagcgcggcagcggccaggugggcacguacggccugaacaccuucaccaacauggaggcccagcugauccggcagauggaguccgaggggaucuucagccccuccgagcucgagacccccaaccuggccgagcgcguccuggacuggcucgagaaguacggcguggagcggcugaagcgcauggcgaucagcggggacgacugcguggucaagccgaucgacgaccgguucgccacggcccugaccgcccucaacgacaugggcaaggugcgcaaggacaucccccagugggagcccuccaagggguggaacgacuggcagcagguccccuucugcagccaccacuuccaccagcugaucaugaaggacggccgggagaucgucgugccgugccgcaaccaggacgagcuggugggccgggcccgcgucucccagggggcgggcuggagccuccgggagaccgccugccugggcaagagcuacgcccagauguggcagcugauguacuuccaccgccgggaccuccgccuggccgcgaacgccaucugcuccgccgugcccguggacuggguccccaccagccggacgaccugguccauccacgcccaccaccaguggaugaccaccgaggacaugcugagcguguggaaccgcguguggaucgaggagaaccccuggauggaggacaagacgcacaucuccagcugggaggacgucccguaccucggcaagcgcgaggaccaguggugcgggucccugaucggccugaccgcccgggcgaccugggccaccaacauccagguggccaucaaccaggugcgccggcucaucggcaacgagaacuaccuggacuacaugaccagcaugaagcgcuucaagaacgaguccgaccccgagggggcccugugguga

SEQ ID NO: 8893 - RNA, 9879 nt, Artificial Sequence
  derived and/or modified CDS sequence (opt1) from DENV-1__KC762628__SS-prME
agcgugaccaugcugcucaugcugcugcccaccgcccucgccuuccaccugaccacccgcggcggggagccccacaugaucgugagcaagcaggagcggggcaagagccuccuguucaagaccagcgccggggugaacaugugcacccugaucgccauggaccugggcgagcucugcgaggacaccaugaccuacaagugcccccgcaucaccgagaccgagcccgacgacguggacugcuggugcaacgccaccgagaccugggugaccuacgggaccugcagccagaccggcgagcaccggcgcgacaagcgguccguggcccuggcgccccacgugggccuggggcucgagacccgcaccgagaccuggaugagcuccgagggcgcguggcggcagauccagaagguggagacgugggcccugcgccaccccggguucaccgugaucgcccuguuccucgcccacgcgaucggcaccagcaucacccagaaggggaucaucuucauccugcugaugcucgugacgcccuccauggccaugcggugcgucggcaucggcaaccgcgacuucguggaggggcugagcggcgccaccuggguggacgucgugcuggagcacggguccugcgugaccaccauggccaaggacaagcccacgcucgacaucgagcugcugaagaccgaggucaccaaccccgccgugcuccggaagcugugcaucgaggcgaagaucagcaacaccacgaccgacucccgcugccccacccagggcgaggccacccugguggaggagcaggacacgaacuucgucugccggcgcaccuucguggaccggggcugggggaacggcugcggccuguucggcaaggggagccugaucacgugcgccaaguucaagugcgugaccaagcuggagggcaagaucguccaguacgagaaccucaaguacuccgugaucgugacgguccacaccggcgaccagcaccagguggggaacgagaccaccgagcacggcaccacggccaccaucacgccccaggcccccaccagcgagauccagcugacggacuacggggcgcugacccucgacugcagcccccgcaccggccuggacuucaacgagaugguccugcucaccaugaaggagaaguccuggcuggugcacaagcagugguuccuggaccucccgcugcccuggacguccggggccagcaccagccaggagaccuggaaccggcaggaccugcucgugaccuucaagacggcccacgccaagaagcaggaggucguggugcugggcucccaggagggcgccaugcacaccgcgcugaccggggccaccgagauccagacgagcggcaccaccaccaucuucgccgggcaccucaagugccgccugaagauggacaagcugacgcucaagggcgucuccuacgugaugugcaccgggagcuucaagcuggagaaggagguggccgagacccagcacggcaccguccugguccaggugaaguacgagggcacggacgcccccugcaagauccccuucuccagccaggacgagaagggggucacccagaacggccggcugaucaccgcgaacccgaucgugaccgacaaggagaagcccgugaacaucgaggccgagccgcccuucggggaguccuaccucgucgugggcgccggcgagaaggcccugaagcugagcugguucaagaagggguccagcaucggcaagauguucgaggcgacggcccgcggggcccggcgcauggccauccucggcgacaccgccugggacuucggguccaucggcggcguguucaccagcgucgggaagcugauccaccagaucuucggcaccgcguacggggugcuguucuccggcgugagcuggacgaugaagaucgggaucggcauccuccugaccuggcugggccucaacucccgcagcaccucccugagcaugaccugcaucgccgucgggauggugacgcuguaccucggcgugaugguccaggccgacuccgggugcgugaucaacuggaagggccgggagcugaagugcgggagcggcaucuucgugaccaacgagguccacaccuggaccgagcaguacaaguuccaggccgacagcccgaagcgccuguccgccgcgaucggcaaggccugggaggagggggugugcggcauccggagcgccacccgccucgagaacaucauguggaagcagaucuccaacgagcugaaccacauccugcucgagaacgacaugaaguucacgguggucgugggggaggugaacggcauccuggcccaggggaagaagaugauccggccccagcccauggagcacaaguacagcuggaaguccuggggcaaggccaaggucaucggcgcggacgugcagaacaccaccuucaucaucgacgggcccaacaccccggagugccccgacaaccagcgcgccuggaacaucugggagguggaggacuacggcuucgggaucuucacgaccaacaucuggcugaagcuccgggacagcuacacccaggucugcgaccaccgccugauguccgccgccaucaaggacagcaaggcggugcacgccgacaugggcuacuggaucgaguccgagaagaacgagaccuggaagcuggcccgggccagcuucaucgaggugaagacgugcaucuggcccaagucccacacccucuggagcaacggcguccuggaguccgagaugaucauccccaagaucuacgggggcccgaucagccagcacaacuaccgccccggguacuucacccagaccgccggccccuggcaccuggggaagcucgagcuggacuucgagcugugcgagggcacgaccgugguggucgacgagcacugcggcucccgggggccgagccuccgcaccaccacggugaccggcaagaucauccacgaguggugcugccgguccugcacccugccgccccugcgcuucaagggggaggacggcugcugguacgggauggagauccggcccgugaaggagaaggaggagaaccucgucaagagcauggugagcgcgggcuccggcgagguggacagcuucucccuggggcugcucugcaugagcaucaugaucgaggaggucaugcgcucccgguggagccgcaagaugcugaugaccggcacgcuggccguguuccuccugcugaccauggggcagcucaccuggaacgaccugauccggcugugcaucauggugggcgccaacgccuccgacaagauggggaugggcaccacgcaccucgcccugauggccaccuuccgcaugcgcccgauguucgccgucgggcuccuguuccggcgccugaccagccgggaggugcugcuccugaccgucgggcugucccucguggccagcguggagcugcccaacucccuggaggagcucggcgacgggcuggccaugggcaucaugaugcugaagcuccugacggacuuccagagccaccagcugugggccgcgcuccugucccugaccuucgucaagaccacccucagccugcacuacgccuggaagacgauggccaugauccuguccaucgugagccucuucccccugugccuguccaccaccagccagaagaccacguggcuccccgugcugcugggcucccucgggugcaagccgcugaccauguuccugaucaccgagaacaagaucuggggccgcaagagcuggccccucaacgaggggaucauggccgucggcaucgugagcauccugcuguccagccuccugaagaacgacgugccccuggcggggccccucaucgccggcggcaugcugaucgccugcuacgucaucuccgggagcuccgccgaccugagccucgagaaggccgcggagguguccugggaggaggaggccgagcacagcggcgccucccacaacauccugguggagguccaggacgacgggaccaugaagaucaaggacgaggagcgggacgacacccugacgauccuccugaaggccacccugcucgccaucagcggcguguacccgauguccauccccgcgacccuguucgugugguacuucuggcagaagaagaagcagcgcagcgggguccugugggacacccccagcccgcccgagguggagcgggccgugcuggacgacggcaucuaccgcauccuccagcggggccugcuggggaagucccaggucggcguggggguguuccaggagggcgucuuccacacgauguggcacgugacccgcggggccgugcucauguaccagggcaagcggcuggagcccuccugggccagcgucaagaaggaccugaucuccuacggcgggggcuggcgcuuccaggggagcuggaacaccggcgaggagguccaggugaucgccgucgagcccgggaagaaccccaagaacgugcagaccgcgcccggcacguucaagacccccgagggcgaggugggggccaucgcccucgacuucaagcccggcaccuccgggagccccaucgucaaccgggagggcaagaucgugggccuguacgggaacggcguggucaccacgagcgggaccuacguguccgccaucgcccaggcgaaggccagccaggagggcccgcugcccgagaucgaggacgagguguuccgcaagcggaaccucaccaucauggaccugcaccccggguccggcaagacccgccgguaccugccggccaucguccgcgaggccaucaagcggaagcuccgcacgcuggugcuggcgcccacccggguggucgccagcgagauggccgaggcccucaagggcaugcccauccgcuaccagaccaccgccgugaaguccgagcacacggggaaggagaucguggaccugaugugccacgcgaccuucaccaugcgccugcucagccccguccgggugccgaacuacaacaugaucaucauggacgaggcccacuucaccgaccccgccuccaucgccgcccgcggcuacaucagcacgcggguggggaugggcgaggcggccgccaucuucaugaccgccacgccgcccggguccaucgaggccuucccgcagagcaacgcggccauccaggacgaggagcgcgacauccccgagcgguccuggaacagcggcuacgacuggaucaccgacuuccccggcaagacggucugguucgugcccuccaucaagagcgggaacgacaucgccaacugccugcgcaagaacggcaagcgggugauccagcugucccgcaagaccuucgacaccgaguaccagaagaccaagaacaacgacugggacuacgucgugacgaccgacaucagcgagaugggggccaacuuccgggcggaccgcgugaucgacccgcggcgcugccucaagcccgucauccugaaggacggccccgagcgggugauccuggccgggcccaugccggucaccguggccuccgccgcccagcgccggggccgcaucggccggaaccagaacaaggagggggaccaguacaucuacaugggccagccccucaacaacgacgaggaccacgcgcacuggaccgaggccaagaugcugcuggacaacaucaacacgcccgaggggaucauccccgcccucuucgagccggagcgcgagaaguccgccgccaucgacggcgaguaccggcugcgcggggaggcgcgcaagaccuucguggagcugaugcggcgcggcgaccuccccgucuggcuguccuacaagguggccagcgagggcuuccaguacagcgaccggcgcuggugcuucgacggggagcggaacaaccaggugcuggaggagaacauggacgucgagaucuggaccaaggagggcgagcgcaagaagcuccggccccgcuggcuggacgcccggaccuacuccgacccccuggcccuccgcgaguucaaggaguucgccgcggggcggcgcagcguguccggcgaccugauccuggagaucggcaagcucccgcagcaccugacgcagcgggcccagaacgcccuggacaaccucgugaugcugcacaacagcgagcagggcgggaaggccuaccgccacgcgauggaggagcugcccgacaccaucgagacccucaugcugcuggcccucaucgccguccugaccgggggcgugacccuguucuuccucuccgggcggggccugggcaagacgagcaucgggcugcucugcgugauggccuccagcgcccugcuguggauggcguccgucgagccccacuggaucgccgccagcaucauccucgaguucuuccugauggugcugcucauccccgagccggaccgccagcggacgccccaggacaaccagcuggccuacguggucaucggccuccucuucaugauccugaccguggccgcgaacgagauggggcugcucgagaccacgaagaaggaccugggcaucgggcacgccgccgccgagaaccaccaccacgccgcgaugcuggacguggaccuccaccccgccuccgccuggacccuguacgccgucgccaccaccaucaucacgccgaugaugcgccacaccaucgagaacaccaccgcgaacaucagccugacggccaucgccaaccaggccgcgauccucaugggccuggacaagggcuggcccaucuccaagauggacaucggggugccccugcucgcccugggcugcuacagccaggugaacccccugacccucaccgccgccguccugaugcugguggcccacuacgcgaucaucgggccgggccuccaggccaaggccacccgggaggcccagaagcgcacggccgcggggaucaugaagaaccccaccguggacggcaucgucgccaucgaccuggaccccgugguguacgacgccaaguucgagaagcagcugggccagaucaugcuccugauccugugcaccucccagauccuccugaugcggaccacgugggcccugugcgagagcaucacccucgccaccgggccccugaccacgcugugggagggcuccccggggaaguucuggaacaccaccaucgcggucagcauggccaacaucuuccgcggcuccuaccucgccggcgccgggcuggcguucagccugaugaagucccucggcgggggccgccgggggaccggcgcccagggcgagacgcugggggagaaguggaagcgccagcugaaccagcucuccaagagcgaguucaacaccuacaagcgguccggcaucauggagguggaccgcagcgaggccaaggaggggcugaagcggggcgagaccaccaagcacgccgugucccgcgggacggccaagcugcggugguucgucgagcgcaaccuggugaagcccgagggcaaggugaucgaccucggcugcgggcggggcggguggagcuacuacugcgcgggccugaagaaggucaccgaggugaagggguacaccaagggcggccccgggcacgaggagcccaucccgauggccaccuacggcuggaaccuggugaagcuccacuccgggaaggacgucuucuucacgccgcccgagaagugcgacacccugcugugcgacaucggcgagagcucccccaacccgaccaucgaggaggggcgcacccuccgggugcugcgcaugguggagcccuggcugcggggcaaccaguucugcaucaagguccucaaccccuacaugcccagcgugaucgagacccuggagcagaugcagcgcaagcacggcgggaugcuggugcggaacccgcucucccgcaacagcacgcacgagauguacugggucuccugcggcaccgggaacaucgugagcgccgugaacaugaccucccggaugcugcugaaccgcuucaccauggcccaccggaagcccacguacgagcgcgacgucgaccucggcgccggcacccgccacguggcgguggagcccgaggucgccaaccuggacaucaucgggcagcggaucgagaacaucaagaacgagcacaagagcaccuggcacuacgacgaggacaaccccuacaagaccugggccuaccacggcuccuacgaggugaagccgagcggguccgccagcagcauggugaacggcgucgugcgccugcucacgaagcccugggacgucauccccauggugacccagaucgccaugaccgacaccacgcccuucgggcagcagcggguguucaaggagaaggucgacacccgcaccccgaaggcgaagcggggcaccgcccagaucauggaggugacggcccgcuggcuguggggcuuccugucccggaacaagaagccccgcaucugcacccgggaggaguucacccgcaaggugcggagcaacgccgcgaucggggccgucuucguggacgagaaccaguggaacuccgccaaggaggccguggaggacgagcgcuucugggaccucguccaccgggagcgcgagcugcacaagcagggcaagugcgcgaccugcguguacaacaugauggggaagcgggagaagaagcugggcgaguucgggaaggcgaagggcagccgcgccaucugguacauguggcucggcgcccgguuccuggaguucgaggcccugggguucaugaacgaggaccacugguucucccgcgagaacagccucuccggcguggagggggagggccugcacaagcugggguacauccuccgggacaucagcaagauccccggcggcaacauguacgccgacgacacggcggggugggacacccgcaucaccgaggacgaccugcagaacgaggccaagaucaccgacaucauggagccggagcacgcccugcucgccacguccaucuucaagcugaccuaccagaacaaggucgugcgggugcagcgccccgccaagaacggcaccgucauggacgugaucagccgccgggaccagcgcggguccggccaggugggcaccuacgggcugaacacguucaccaacauggaggcgcagcucauccggcagauggagagcgagggcaucuucacccccuccgagcuggagacccccaaccuggccgagcgcguccucgacuggcuggagaagcacgggaucgagcggcugaagcgcauggccaucagcggcgacgacugcguggugaagccgaucgacgaccgguucgccacggcccucaccgcgcugaacgacauggggaagguccgcaaggacaucccccagugggagcccuccaagggcuggaacgacuggcagcagguccccuucugcagccaccacuuccaccagcugaucaugaaggacggccgggagaucguggucccgugccgcaaccaggacgagcucguggggcgggcccgcgugucccagggcgccggguggagccugcgggagaccgccugccugggcaagagcuacgcgcagauguggcagcucauguacuuccaccgccgggaccugcgccuggccgccaacgccaucugcuccgccguccccguggacugggugcccaccagccggacgaccugguccauccacgcgcaccaccaguggaugaccaccgaggacaugcucagcgucuggaaccgcguguggaucgaggagaaccccuggauggaggacaagacccacguguccagcugggaggacgucccguaccuggggaagcgggaggaccaguggugcggcucccugaucggccucacggcccgcgccaccugggccaccaacauccagguggccaucaaccaggugcgccggcugaucgggaacgagaacuaccuggacuacaugaccagcaugaagcgcuucaagaacgaguccgaccccgagggcgcgcucugguga

SEQ ID NO: 8894 - RNA, 9879 nt, Artificial Sequence
  derived and/or modified CDS sequence (opt1) from DENV-1__KC762624__SS-prME
agcgugaccaugcugcucaugcugaugcccaccgcccuggccuuccaccucaccacccggggcggggagccccacaugaucgugagcaagcaggagcggggcaagagccugcuguucaagaccagcgccggggugaacaugugcacccucaucgccauggaccugggcgagcugugcgaggacacgcucaccuacaagugcccccgcaucaccgaggccgagcccgacgacguggacugcuggugcaacgccaccgacaccugggugaccuacgggaccugcagccagaccggcgagcaccggcgcgacaagcgguccguggcccuggcgccccacgugggccuggggcucgagacgcgcaccgagaccuggaugagcuccgagggcgccuggaagcagauccagcgggucgagaccugggcccugcgccaccccggguucacggugaucgcccuguuccucgcgcacgccaucggcaccagcaucacccagaaggggaucaucuucauccugcugaugcucgugacccccuccauggccaugcggugcgucggcaucggcagccgcgacuucguggaggggcuguccggcgccacguggguggacgucgugcuggagcacgggagcugcgugaccaccauggccaaggacaagcccacccucgacaucgagcugcugaagacggaggucaccaaccccgcggugcuccggaagcugugcaucgaggccaagaucuccaacaccaccacggacagccgcugcccgacccagggcgaggccacccugguggaggagcaggacgccaacuucgucugccggcgcaccuucguggaccggggcugggggaacggcugcgggcuguucggcaaggggucccugaucacgugcgccaaguucaagugcgugaccaagcuggagggcaagaucguccaguacgagaaccucaaguacagcgugaucgugaccguccacaccggcgaccagcaccagguggggaacgaguccacggagcacggcaccaccgcgaccaucacgccccaggcccccacgaccgagauccagcugaccgacuacggggcccugacccucgacugcagcccccgcacgggccuggacuucaacgagaugguccugcucaccaugaaggagaaguccuggcuggugcacaagcagugguuccuggaccucccccugcccuggaccagcggggccagcaccucccaggagacguggaaccggcaggaccugcucgugaccuucaagaccgcccacgcgaagaagcaggaggucguggugcugggcagccaggagggcgccaugcacaccgcccugacgggggccaccgagauccagaccuccggcaccacgaccaucuucgccgggcaccucaagugccgccugaagauggacaagcugacccucaagggcaugagcuacgucaugugcaccggguccuucaagcuggagaaggagguggcggagacgcagcacggcaccgugcugguccagaucaaguacgagggcaccgacgcccccugcaagauccccuucagcacccaggacgagaagggggugacgcagaacggccggcugaucaccgccaacccgaucgugaccgacaaggagaagcccgucaacaucgaggccgagccgcccuucggggaguccuacaucgugaucggcgcgggcgagaaggcccucaagcugagcugguucaagaagggguccagcaucggcaagauguucgaggccaccgcccgcggggcccggcgcauggcgauccugggcgacacggccugggacuucggguccaucggcggcguguucaccagcgucgggaagcucgugcaccagaucuucggcaccgccuacggggugcuguucuccggcgucagcuggaccaugaagaucgggaucggcgugcugcucacguggcugggccugaacucccgcagcaccucccucagcaugaccugcaucgccguggggcuggucacccuguaccucggcgugauggugcaggccgacuccgggugcgucaucaacuggaagggccgggagcugaagugcgggagcggcaucuucgugacgaacgaggugcacaccuggaccgagcaguacaaguuccaggcggacagcccgaagcgccuguccgccgccaucggcaaggccugggaggagggggucugcggcauccggagcgccacccgccucgagaacaucauguggaagcagaucuccaacgagcugaaccacauccugcucgagaacgacaugaaguucaccgugguggucggggacguggcgggcauccuggcccaggggaagaagaugauccggccccagcccauggagcacaaguacagcuggaaguccuggggcaaggccaagaucaucggcgccgacgugcagaacacgaccuucaucaucgacgggcccaacaccccggagugccccgacgaccagcgcgcguggaacaucugggaggucgaggacuacggcuucgggaucuucaccacgaacaucuggcugaagcuccgggacagcuacacccaggugugcgaccaccgccugauguccgccgccaucaaggacagcaaggccgugcacgccgacaugggcuacuggaucgaguccgagaagaacgagaccuggaagcuggcgcgggccagcuucaucgaggucaagaccugcaucuggcccaagucccacacgcucuggagcaacggcgugcuggaguccgagaugaucauccccaagaucuacgggggcccgaccagccagcacaacuaccgccccggguacuucacccagaccgccggccccuggcaccuggggaagcucgagcuggacuucgaccugugcgagggcacgaccguggucguggacgagcacugcggcaaccgggggccgucccuccgcaccaccacggugaccggcaagaucauccacgaguggugcugccggagcugcacccugccgccccugcgcuuccgcggggaggacggcugcugguacgggauggagauccgccccgucaaggagaaggaggagaaccucgugaaguccauggugagcgccggcagcggcgaggucgacuccuucagccuggggcugcucugcaucuccaucaugaucgaggaggugaugcggagccgcuggucccggaagaugcugaugaccggcacgcuggccguguucuuccuccugaucauggggcagcugaccuggaacgaccucauccgccugugcaucauggucggcgcgaacgccagcgaccgcauggggaugggcaccaccuaccuggcccucauggccacguucaagaugcggccgauguucgccgugggccugcuguuccgccggcucaccucccgcgaggugcugcugcucaccaucgggcugagccuggucgcguccguggagcuccccaacagccuggaggagcugggcgacgggcucgccaugggcaucaugauccugaagcugcucaccgacuuccagucccaccagcugugggccacgcugcucagccugaccuucaucaagaccaccuucucccugcacuacgccuggaagacgauggcgaugguccucagcaucgugucccuguucccccugugccucagcaccaccucccagaagaccacguggcugcccgugcugcucggcagccuggggugcaagccgcugaccauguuccucaucgccgagaacaagaucuggggccggaaguccuggccccugaacgaggggaucauggccgucggcaucgugagcauccugcucagcucccugcugaagaacgacgugccccucgccgggccccugaucgccggcggcaugcugaucgcgugcuacgucaucagcggguccagcgccgaccucucccuggagaaggccgccgaggugagcugggaggaggaggccgagcacuccggcgcgagccacaacauccugguggagguccaggacgacgggaccaugaagaucaaggacgaggagcgcgacgacacccucaccauccugcugaaggccacgcuccuggccguguccggcguguacccgcugagcauccccgccacccucuucgucugguacuucuggcagaagaagaagcagcgguccggggugcugugggacacccccagcccgcccgagguggagcgcgccguccuggacgacggcaucuaccggaucaugcagcgcggccugcucgggcggucccaggugggcgugggggucuuccaggagaacguguuccacaccauguggcacgugacgcgcggcgcgguccugauguaccaggggaagcggcuggagcccagcugggccuccgugaagaaggaccucaucagcuacggcggcggguggcgccugcagggcuccuggaacaccggggaggaggugcaggucaucgccguggagcccggcaagaaccccaagaacgugcagaccgcccccgggaccuucaagacgcccgagggcgaggucggcgccaucgcgcuggacuucaagcccgggaccagcggcucccccaucgugaaccgggaggggaagaucgugggccucuacggcaacggggucgugaccaccagcggcacguacgugagcgccaucgcccaggccaaggcgucccaggaggggccgcugcccgagaucgaggacgaggucuuccgcaagcggaaccugaccaucauggaccuccaccccggcagcgggaagacccgccgguaccugccggccaucgugcgcgaggccaucaagcggaagcugcgcacccucauccuggcccccacgcgcguggucgccuccgagauggcggaggcccugaagggcaugcccauccgguaccagaccaccgccgucaagagcgagcacaccggcaaggagaucguggaccucaugugccacgccacguucaccaugcgccugcugucccccguccgggugccgaacuacaacaugaucaucauggacgaggcccacuucaccgaccccagcuccaucgcggcccgcggguacaucagcacccgggugggcaugggggaggccgccgccaucuucaugacggcgacgccgcccggcuccgucgaggccuucccgcagagcaacgccgugauccaggacgaggagcgcgacauccccgagcgguccuggaacagcggguacgaguggaucaccgacuuccccggcaagaccgugugguucguccccuccaucaagagcggcaacgacaucgccaacugccuccgcaagaacgggaagcgggugauccagcugucccgcaagacguucgacaccgaguaccagaagaccaagaacaacgacugggacuacguggucaccacggacaucagcgagaugggcgcgaacuuccgggccgaccgcgugaucgacccgcggcgcugccugaagcccgugauccucaaggacgggcccgagcgggucauccuggccggccccaugccggugaccgucgccuccgccgcgcagcgccgggggcgcgugggccggaaccacaacaaggagggcgaccaguacaucuacauggggcagccccugaacaacgacgaggaccacgcccacuggaccgaggccaagaugcuccuggacaacaucaacacccccgagggcaucauccccgcccuguucgagccggagcgcgagaaguccgccgcgaucgacggggaguaccgccuccggggcgaggcccgcaagacguucguggagcugaugcggcgcggggaccugcccgucuggcucuccuacaagguggccagcgagggcuuccaguacagcgaccggcgcuggugcuucgacggcgagcggaacaaccaggugcuggaggagaacauggacgucgagaucuggaccaaggagggggagcgcaagaagcugcggccccgcuggcucgacgcccggaccuacuccgacccccuggcccugcgcgaguucaaggaguucgcggccggccggcgcagcguguccggggaccucauccuggagaucggcaagcugccgcagcaccucacccagcgggcccagaacgcccuggacaaccuggugaugcuccacaacagcgagcagggcgggcgcgcguaccggcacgccauggaggagcugcccgacacgaucgagacccugaugcuccuggcccugaucgccguccucaccggcggggugacccuguucuuccuguccggccgcgggcucggcaagaccagcaucggccugcugugcgugauggccuccagcguccuccuguggauggcguccguggagccccacuggaucgccgccagcaucauccuggaguucuuccucauggugcugcugauccccgagccggaccggcagcgcacgccccaggacaaccagcucgccuacgucgugaucgggcugcuguucaugauccucaccguggccgcgaacgagaugggccugcuggagaccaccaagaaggaccucgggaucggccacgucgccguggagaaccaccaccacgccgccaugcuggacguggaccugcaccccgccuccgcguggacgcucuacgccgucgccaccaccaucaucaccccgaugaugcggcacacgaucgagaacaccaccgccaacaucagccugaccgccaucgcgaaccaggccgccauccugauggggcucgacaagggcuggcccaucuccaagauggacaucggcgugccccugcuggcccucgggugcuacagccaggugaacccccugacgcugaccgcggccguccucaugcugguggcccacuacgccaucaucggcccggggcugcaggccaaggcgacccgcgaggcccagaagcgcaccgccgccggcaucaugaagaaccccacgguggacgggaucgucgccaucgaccucgaccccgugguguacgacgcgaaguucgagaagcagcugggccagaucaugcugcucauccugugcaccucccagauccugcucaugcggaccaccugggcccugugcgagagcaucacgcuggccaccggcccccucaccacccugugggagggguccccgggcaaguucuggaacacgaccaucgccgucagcauggccaacaucuuccgcggguccuaccuggcgggcgccggccucgccuucagccugaugaagucccucgggggcgggcggcgcgggaccggggcccagggcgagacccucggcgagaaguggaagcggcagcugaaccagcuguccaagagcgaguucaacacguacaagcgcuccgggaucauggagguggaccggagcgaggcgaaggagggccucaagcgcggggagaccaccaagcacgccgugucccggggcaccgccaagcugcgcugguucgucgagcggaaccuggugaagcccgaggggaaggugaucgaccugggcugcggccgcgggggcuggagcuacuacugcgccgggcucaagaaggucacggaggugaagggcuacaccaagggcgggcccggccacgaggagcccaucccgauggccaccuacggguggaaccuggugaagcugcacuccggcaaggacgucuucuucaucccgcccgagaagugcgacacccuccugugcgacaucggggagagcucccccaacccgacgaucgaggagggccggacccugcgcgugcucaagaugguggagcccuggcugcgggggaaccaguucugcaucaagauccugaaccccuacaugcccagcgucguggagacccucgagcagaugcagcgcaagcacggcggcaugcuggugcggaacccgcugucccgcaacagcacccacgagauguacugggucuccugcgggaccggcaacaucgugagcgcggugaacaugacgucccggaugcuccugaaccgcuucaccauggcccaccgcaagcccaccuacgagcgggacgucgaccugggggccggcacccgccacguggccguggagcccgaggucgccaaccucgacaucaucggccagcggaucgagaacaucaagcacgagcacaagagcacguggcacuacgacgaggacaaccccuacaagaccugggcguaccacggguccuacgaggugaagccgagcggcuccgccagcagcauggucaacgggguggugaagcugcugaccaagcccugggacgucauccccauggugacccagaucgccaugacggacaccacccccuucggccagcagcgcguguucaaggagaaggucgacacccggacgccgaaggccaagcgcgggaccacccagaucauggaggugaccgcccgguggcucuggggcuuccugucccgcaacaagaagccccggaucugcacgcgcgaggaguucacccggaaggugcgcagcaacgcggccaucggcgccgucuucguggacgagaaccaguggaacuccgccaaggaggcgguggaggacgagcgguucugggaccugguccaccgcgagcgggagcuccacaagcaggggaagugcgcgaccugcguguacaacaugaugggcaagcgcgagaagaagcugggggaguucggcaaggccaaggggagccgggccaucugguacauguggcugggcgcccgcuuccucgaguucgaggcgcugggcuucaugaacgaggaccacugguucucccgggagaacagccuguccgggguggagggcgaggggcuccacaagcugggcuacauccugcgcgacaucagcaagauccccgggggcaacauguacgccgacgacaccgccggcugggacacgcggaucaccgaggacgaccuccagaacgaggccaagaucaccgacaucauggagccggagcacgcccugcuggcgaaggccaucuucaagcucaccuaccagaacaaggucgugcgcgugcagcgccccgccaagaacgggacggucauggacgugaucucccggcgcgaccagcggggcagcggccagguggggaccuacggccugaacaccuucaccaacauggaggcccagcugauccgccagauggaguccgaggggaucuucagccccuccgagcucgagacgcccaaccuggccgagcggguccuggacuggcucgagaaguacggcguggagcgccugaagcggauggcgaucagcggggacgacugcguggucaagccgaucgacgaccgcuucgccaccgcccugaccgcccucaacgacaugggcaaggugcggaaggacaucccccagugggagcccuccaagggguggaacgacuggcagcagguccccuucugcagccaccacuuccaccagcugaucaugaaggacggccgcgagaucgucgugccgugccggaaccaggacgagcuggugggccgcgcccgggucucccagggggcgggcuggagccuccgcgagaccgccugccugggcaagagcuacgcccagauguggcagcugauguacuuccaccggcgcgaccuccggcuggccgcgaacgccaucugcuccgccgugcccguggacuggguccccacgagccgcaccaccugguccauccacgcccaccaccaguggaugaccacggaggacaugcugagcguguggaaccggguguggaucgaggagaaccccuggauggaggacaagacccacgucuccagcugggaggacgugccguaccucggcaagcgcgaggaccaguggugcgggucccugaucggccugaccgcccgcgcgaccugggccaccaacauccagguggccaucaaccagguccggcgccucaucggcaacgagaacuaccuggacuacaugacgagcaugaagcgguucaagaacgaguccgaccccgagggggcccugugguga

SEQ ID NO: 8895 - RNA, 9879 nt, Artificial Sequence
  derived and/or modified CDS sequence (opt1) from DENV-1__KC762644__SS-prME
agcgugaccaugcugcucaugcugaugcccaccgcccuggccuuccaccucaccacccggggcggggagccccacaugaucgugagcaagcaggagcggggcaagagccugcuguucaagaccagcgccggggugaacaugugcacccucaucgccauggaccugggcgagcugugcgaggacacgcucaccuacaagugcccccgcaucaccgaggccgagcccgacgacguggacugcuggugcaacgccaccgacacgugggugaccuacgggaccugcagccagaccggcgagcaccggcgcgacaagcgguccguggcccuggcgccccacgugggccuggggcucgagacgcgcaccgagaccuggaugagcuccgagggcgccuggaagcagauccagcgggucgagaccugggcccugcgccaccccggguucacggugaucgcccuguuccucgcgcacgccaucggcaccagcaucacccagaaggggaucaucuucauccugcugaugcucgugacccccuccauggccaugcggugcgucggcaucggcagccgcgacuucguggaggggcuguccggcgccacguggguggacgucgugcuggagcacgggagcugcgugaccaccauggccaaggacaagcccacccucgacaucgagcugcugaagacggaggucaccaaccccgcggugcuccggaagcugugcaucgaggccaagaucuccaacaccaccacggacagccgcugcccgacccagggcgaggccacccugguggaggagcaggacgccaacuucgucugccggcgcaccuucguggaccggggcugggggaacggcugcgggcuguucggcaaggggucccugaucacgugcgccaaguucaagugcgugaccaagcuggagggcaagaucguccaguacgagaaccucaaguacagcgugaucgugaccguccacaccggcgaccagcaccagguggggaacgaguccacggagcacggcaccaccgcgaccaucacgccccaggcccccacgaccgagauccagcugaccgacuacggggcccugacccucgacugcagcccccgcacgggccuggacuucaacgagaugguccugcucaccaugaaggagaaguccuggcuggugcacaagcagugguuccuggaccucccccugcccuggaccagcggggccagcaccucccaggagacguggaaccggcaggaccugcucgugaccuucaagaccgcccacgcgaagaagcaggaggucguggugcugggcagccaggagggcgccaugcacaccgcccugacgggggccaccgagauccagaccuccggcaccacgaccaucuucgccgggcaccucaagugccgccugaagauggacaagcugacccucaagggcaugagcuacgucaugugcaccggguccuucaagcuggagaaggagguggcggagacgcagcacggcaccgugcugguccagaucaaguacgagggcaccgacgcccccugcaagauccccuucagcacccaggacgagaagggggugacgcagaacggccggcugaucaccgccaacccgaucgugaccgacaaggagaagcccgucaacaucgaggccgagccgcccuucggggaguccuacaucgugaucggcgcgggcgagaaggcccucaagcugagcugguucaagaagggguccagcaucggcaagauguucgaggccaccgcccgcggggcccggcgcauggcgauccugggcgacacggccugggacuucggguccaucggcggcguguucaccagcgucgggaagcucgugcaccagaucuucggcaccgccuacggggugcuguucuccggcgucagcuggaccaugaagaucgggaucggcgugcugcucacguggcugggccugaacucccgcagcaccucccucagcaugaccugcaucgccguggggcuggucacccuguaccucggcgugauggugcaggccgacuccgggugcgucaucaacuggaagggccgggagcugaagugcgggagcggcaucuucgugacgaacgaggugcacaccuggaccgagcaguacaaguuccaggcggacagcccgaagcgccuguccgccgccaucggcaaggccugggaggagggggucugcggcauccggagcgccacccgccucgagaacaucauguggaagcagaucuccaacgagcugaaccacauccugcucgagaacgacaugaaguucaccgugguggucggggacguggcgggcauccuggcccaggggaagaagaugauccggccccagcccauggagcacaaguacagcuggaaguccuggggcaaggccaagaucaucggcgccgacgugcagaacacgaccuucaucaucgacgggcccaacaccccggagugccccgacgaccagcgcgcguggaacaucugggaggucgaggacuacggcuucgggaucuucaccacgaacaucuggcugaagcuccgggacagcuacacccaggugugcgaccaccgccugauguccgccgccaucaaggacagcaaggccgugcacgccgacaugggcuacuggaucgaguccgagaagaacgagaccuggaagcuggcgcgggccagcuucaucgaggucaagaccugcaucuggcccaagucccacacgcucuggagcaacggcgugcuggaguccgagaugaucauccccaagaucuacgggggcccgaucagccagcacaacuaccgccccggguacuucacccagaccgccggccccuggcaccuggggaagcucgagcuggacuucgaccugugcgagggcaccacgguggucguggacgagcacugcggcaaccgggggccgucccuccgcaccaccaccgugacgggcaagaucauccacgaguggugcugccggagcugcacccugccgccccugcgcuuccgcggggaggacggcugcugguacgggauggagauccgccccgucaaggagaaggaggagaaccucgugaaguccauggugagcgccggcagcggcgaggucgacuccuucagccuggggcugcucugcaucuccaucaugaucgaggaggugaugcggagccgcuggucccggaagaugcugaugaccggcacccuggccguguucuuccuccugaucauggggcagcugacguggaacgaccucauccgccugugcaucauggucggcgcgaacgccagcgaccgcauggggaugggcaccaccuaccuggcccucauggccaccuucaagaugcggccgauguucgccgugggccugcuguuccgccggcucacgucccgcgaggugcugcugcucaccaucgggcugagccuggucgcguccguggagcuccccaacagccuggaggagcugggcgacgggcucgccaugggcaucaugauccugaagcugcucaccgacuuccagucccaccagcugugggccacccugcucagccugacguucaucaagaccaccuucucccugcacuacgccuggaagaccauggcgaugguccucagcaucgugucccuguucccccugugccucagcacgaccucccagaagaccaccuggcugcccgugcugcucggcagccuggggugcaagccgcugacgauguuccucaucgccgagaacaagaucuggggccggaaguccuggccccugaacgaggggaucauggccgucggcaucgugagcauccugcucagcucccugcugaagaacgacgugccccucgccgggccccugaucgccggcggcaugcugaucgcgugcuacgucaucagcggguccagcgccgaccucucccuggagaaggccgccgaggugagcugggaggaggaggccgagcacuccggcgcgagccacaacauccugguggagguccaggacgacgggaccaugaagaucaaggacgaggagcgcgacgacacccucaccauccugcugaaggccacccuccuggccguguccggcguguacccgcugagcauccccgccacccucuucgucugguacuucuggcagaagaagaagcagcgguccggggugcugugggacacccccagcccgcccgagguggagcgcgccguccuggacgacggcaucuaccggaucaugcagcgcggccugcucgggcggucccaggugggcgugggggucuuccaggagaacguguuccacaccauguggcacgugacccgcggcgcgguccugauguaccaggggaagcggcuggagcccagcugggccuccgugaagaaggaccucaucagcuacggcggcggguggcgccugcagggcuccuggaacacgggggaggaggugcaggucaucgccguggagcccggcaagaaccccaagaacgugcagaccgcccccgggaccuucaagacccccgagggcgaggucggcgccaucgcgcuggacuucaagcccgggacgagcggcucccccaucgugaaccgggaggggaagaucgugggccucuacggcaacggggucgugaccaccagcggcaccuacgugagcgccaucgcccaggccaaggcgucccaggaggggccgcugcccgagaucgaggacgaggucuuccgcaagcggaaccugacgaucauggaccuccaccccggcagcgggaagacccgccgguaccugccggccaucgugcgcgaggccaucaagcggaagcugcgcacccucauccuggcccccacccgcguggucgccuccgagauggcggaggcccugaagggcaugcccauccgguaccagacgaccgccgucaagagcgagcacaccggcaaggagaucguggaccucaugugccacgccaccuucacgaugcgccugcugucccccguccgggugccgaacuacaacaugaucaucauggacgaggcccacuucaccgaccccagcuccaucgcggcccgcggguacaucagcacccgggugggcaugggggaggccgccgccaucuucaugaccgcgacgccgcccggcuccgucgaggccuucccgcagagcaacgccgugauccaggacgaggagcgcgacauccccgagcgguccuggaacagcggguacgaguggaucaccgacuuccccggcaagaccgugugguucguccccuccaucaagagcggcaacgacaucgccaacugccuccgcaagaacgggaagcgggugauccagcugucccgcaagaccuucgacacggaguaccagaagaccaagaacaacgacugggacuacguggucaccaccgacaucagcgagaugggcgcgaacuuccgggccgaccgcgugaucgacccgcggcgcugccugaagcccgugauccucaaggacgggcccgagcgggucauccuggccggccccaugccggugacggucgccuccgccgcgcagcgccgggggcgcgugggccggaaccacaacaaggagggcgaccaguacaucuacauggggcagccccugaacaacgacgaggaccacgcccacuggaccgaggccaagaugcuccuggacaacaucaacacccccgagggcaucauccccgcccuguucgagccggagcgcgagaaguccgccgcgaucgacggggaguaccgccuccggggcgaggcccgcaagaccuucguggagcugaugcggcgcggggaccugcccgucuggcucuccuacaagguggccagcgagggcuuccaguacagcgaccggcgcuggugcuucgacggcgagcggaacaaccaggugcuggaggagaacauggacgucgagaucuggacgaaggagggggagcgcaagaagcugcggccccgcuggcucgacgcccggaccuacuccgacccccuggcccugcgcgaguucaaggaguucgcggccggccggcgcagcguguccggggaccucauccuggagaucggcaagcugccgcagcaccucacccagcgggcccagaacgcccuggacaaccuggugaugcuccacaacagcgagcagggcgggcgcgcguaccggcacgccauggaggagcugcccgacaccaucgagacgcugaugcuccuggcccugaucgccguccucaccggcggggugacccuguucuuccuguccggccgcgggcucggcaagaccagcaucggccugcugugcgugauggccuccagcguccuccuguggauggcguccguggagccccacuggaucgccgccagcaucauccuggaguucuuccucauggugcugcugauccccgagccggaccggcagcgcacgccccaggacaaccagcucgccuacgucgugaucgggcugcuguucaugauccucacgguggccgcgaacgagaugggccugcuggagaccaccaagaaggaccucgggaucggccacgucgccguggagaaccaccaccacgccgccaugcuggacguggaccugcaccccgccuccgcguggacccucuacgccgucgccacgaccaucaucaccccgaugaugcggcacaccaucgagaacacgaccgccaacaucagccugaccgccaucgcgaaccaggccgccauccugauggggcucgacaagggcuggcccaucuccaagauggacaucggcgugccccugcuggcccucgggugcuacagccaggugaacccccugacccugacggcggccguccucaugcugguggcccacuacgccaucaucggcccggggcugcaggccaaggcgacccgcgaggcccagaagcgcaccgccgccggcaucaugaagaaccccaccguggacgggaucgucgccaucgaccucgaccccgugguguacgacgcgaaguucgagaagcagcugggccagaucaugcugcucauccugugcacgucccagauccugcucaugcggaccaccugggcccugugcgagagcaucacccuggccacgggcccccucaccacccugugggagggguccccgggcaaguucuggaacaccacgaucgccgucagcauggccaacaucuuccgcggguccuaccuggcgggcgccggccucgccuucagccugaugaagucccucgggggcgggcggcgcgggaccggggcccagggcgagacccucggcgagaaguggaagcggcagcugaaccagcuguccaagagcgaguucaacaccuacaagcgcuccgggaucauggagguggaccggagcgaggcgaaggagggccucaagcgcggggagacgaccaagcacgccgugucccggggcaccgccaagcugcgcugguucgucgagcggaaccuggugaagcccgaggggaaggugaucgaccugggcugcggccgcgggggcuggagcuacuacugcgccgggcucaagaaggucaccgaggugaagggcuacacgaagggcgggcccggccacgaggagcccaucccgauggccaccuacggguggaaccuggugaagcugcacuccggcaaggacgucuucuucaucccgcccgagaagugcgacacccuccugugcgacaucggggagagcucccccaacccgaccaucgaggagggccggacgcugcgcgugcucaagaugguggagcccuggcugcgggggaaccaguucugcaucaagauccugaaccccuacaugcccagcgucguggagacccucgagcagaugcagcgcaagcacggcggcaugcuggugcggaacccgcugucccgcaacagcacccacgagauguacugggucuccugcgggaccggcaacaucgugagcgcggugaacaugaccucccggaugcuccugaaccgcuucacgauggcccaccgcaagcccaccuacgagcgggacgucgaccugggggccggcacccgccacguggccguggagcccgaggucgccaaccucgacaucaucggccagcggaucgagaacaucaagcacgagcacaagagcaccuggcacuacgacgaggacaaccccuacaagacgugggcguaccacggguccuacgaggugaagccgagcggcuccgccagcagcauggucaacgggguggugaagcugcugaccaagcccugggacgucauccccauggugacccagaucgccaugaccgacacgacccccuucggccagcagcgcguguucaaggagaaggucgacacccggaccccgaaggccaagcgcgggacgacccagaucauggaggugaccgcccgguggcucuggggcuuccugucccgcaacaagaagccccggaucugcacccgcgaggaguucacgcggaaggugcgcagcaacgcggccaucggcgccgucuucguggacgagaaccaguggaacuccgccaaggaggcgguggaggacgagcgguucugggaccugguccaccgcgagcgggagcuccacaagcaggggaagugcgcgaccugcguguacaacaugaugggcaagcgcgagaagaagcugggggaguucggcaaggccaaggggagccgggccaucugguacauguggcugggcgcccgcuuccucgaguucgaggcgcugggcuucaugaacgaggaccacugguucucccgggagaacagccuguccgggguggagggcgaggggcuccacaagcugggcuacauccugcgcgacaucagcaagauccccgggggcaacauguacgccgacgacaccgccggcugggacacccggaucacggaggacgaccuccagaacgaggccaagaucaccgacaucauggagccggagcacgcccugcuggcgaaggccaucuucgagcucaccuaccagaacaaggucgugcgcgugcagcgccccgccaagaacgggaccgucauggacgugaucucccggcgcgaccagcggggcagcggccagguggggacguacggccugaacaccuucaccaacauggaggcccagcugauccgccagauggaguccgaggggaucuucagccccuccgagcucgagacccccaaccuggccgagcggguccuggacuggcucgagaaguacggcguggagcgccugaagcggauggcgaucagcggggacgacugcguggucaagccgaucgacgaccgcuucgccacggcccugaccgcccucaacgacaugggcaaggugcggaaggacaucccccagugggagcccuccaagggguggaacgacuggcagcagguccccuucugcagccaccacuuccaccagcugaucaugaaggacggccgcgagaucgucgugccgugccggaaccaggacgagcuggugggccgcgcccgggucucccagggggcgggcuggagccuccgcgagaccgccugccugggcaagagcuacgcccagauguggcagcugauguacuuccaccggcgcgaccuccggcuggccgcgaacgccaucugcuccgccgugcccguggacuggguccccaccagccgcacgaccugguccauccacgcccaccaccaguggaugaccaccgaggacaugcugagcguguggaaccggguguggaucgaggagaaccccuggauggaggacaagacgcacaucuccagcugggaggacgucccguaccucggcaagcgcgaggaccaguggugcgggucccugaucggccugaccgcccgcgcgaccugggccaccaacauccagguggccaucaaccaggugcggcgccucaucggcaacgagaacuaccuggacuacaugaccagcaugaagcgguucaagaacgaguccgaccccgagggggcccugugguga

SEQ ID NO: 8896 - RNA, 9879 nt, Artificial Sequence
  derived and/or modified CDS sequence (opt1) from DENV-1__KC762630__SS-prME
agcgugaccgugcuguucaugcuccugcccaccgcccuggccuuccaccucaccacccggggcggggagccgcacaugaucgugagcaagcaggagcggggcaagagccugcuguucaagaccagcgccggggugaacaugugcacccucaucgccauggaccugggcgagcugugcgaggacaccaugaccuacaagugcccccgcaucaccgagaccgagcccgacgacguggacugcuggugcaacgccaccgagaccugggugaccuacgggaccugcagccagacgggcgagcaccggcgcgacaagcgguccguggcccucgcgccccacgugggccuggggcuggagacccgcaccgagaccuggaugagcuccgagggcgcguggaagcagauccagaagguggagacgugggcccuccggcaccccggguucaccgugaucgcccuguuccuggcccacgcgaucggcaccagcaucacccagaaggggaucaucuucauccuccugaugcuggugacgcccuccauggccaugcgcugcgugggcaucggcaaccgggacuucguggaggggcucagcggcgccaccuggguggacguggugcuggagcacggguccugcgucaccaccauggccaagaacaagcccacgcuggacaucgagcuccugaagaccgaggugaccaaccccgccauccugcgcaagcucugcaucgaggcgaagaucagcaacaccacgaccgacucccggugcccgacccagggcgaggccacccugguggaggagcaggacacgaacuucgucugccgccggaccuucguggaccgcggcugggggaacggcugcgggcuguucggcaaggggagccucaucacgugcgccaaguucaagugcgugaccaagcuggagggcaagaucguccaguacgagaaccugaaguacuccgugaucgugacgguccacaccggcgaccagcaccagguggggaacgagaccaccgagcacggcaccacggccaucaucacgccccaggcccccaccagcgagauccagcucaccgacuacggggcgcugacgcuggacugcagcccccggaccggccucgacuucaacgagaugguccugcugaccaugaaggagaaguccuggcucgugcacaagcagugguuccuggaccugccgcuccccuggaccuccggggccagcacgagccaggagaccuggaaccgccaggaccugcuggugaccuucaagaccgcccacgccaagaagcaggaggucguggugcucggcucccaggagggcgccaugcacacggcgcugaccggggccaccgagauccagaccagcggcacgaccaccaucuucgccgggcaccugaagugccggcucaagauggacaagcugacccugaagggcgucuccuacgugaugugcacggggagcuucaagcucgagaaggagguggccgagacccagcacggcaccguccugguccaggugaaguacgagggcaccgacgcccccugcaagauccccuucuccagccaggacgagaagggggucauccagaacggccgccugaucacggcgaacccgaucgugaccgacaaggagaagcccgugaacaucgaggccgagccgcccuucggggaguccuacaucgucgugggcgccggcgagaaggcccugaagcucagcugguucaagaagggguccagcaucggcaagauguucgaggcgaccgcccgcggggcccgccggauggccauccugggcgacaccgccugggacuucggguccaucggcggcguguucacgagcgucgggaagcuggugcaccagaucuucggcaccgcguacgggguccuguucuccggcgucagcuggaccaugaagaucgggaucggcauccugcugaccuggcucggccugaacucccgcagcacgucccugagcaugaccugcaucgccguggggauggugacccucuaccugggcgucauggugcaggccgacuccgggugcgugaucaacuggaagggccgcgagcugaagugcgggagcggcaucuucgucaccaacgaggugcacacguggaccgagcaguacaaguuccaggccgacagcccgaagcggcucuccgccgcgaucggcaaggccugggaggagggggugugcggcauccgcagcgccacccggcuggagaacaucauguggaagcagaucuccaacgagcugaaccacauccuccuggagaacgacaugaaguucaccgucguggugggggacgucagcggcauccuggcccaggggaagaagaugauccgcccccagcccauggagcacaaguacuccuggaaguccuggggcaaggccaagaucaucggcgcggacgugcagaacaccacguucaucaucgacgggcccaacaccccggagugccccgacaaccagcgggccuggaacaucugggagguggaggacuacggcuucgggaucuucaccaccaacaucuggcucaagcugcgcgacuccuacacgcaggucugcgaccaccggcugaugagcgccgccaucaaggacuccaaggcggugcacgccgacaugggcuacuggaucgagagcgagaagaacgagaccuggaagcucgcccgcgccuccuucaucgaggugaagaccugcaucuggcccaagagccacacccugugguccaacggcguccuggagagcgagaugaucauccccaagaucuacgggggcccggugucccagcacaacuaccggcccggguacuucacgcagaccgccggccccuggcaccucgggaagcuggagcuggacuucgaccucugcgagggcaccaccguggucguggacgagaacugcggcaaccgcgggccgagccugcggacgaccaccgugaccggcaagacgauccacgaguggugcugccgcuccugcacccugccgccccuccgguucaagggggaggacggcugcugguacgggauggagauccgccccgucaaggagaaggaggagaaccuggucaagagcauggugagcgcgggcuccggcgaggucgacagcuucucccuggggcuccugugcaucagcaucaugaucgaggaggugaugcggucccgcuggagccggaagaugcugaugaccggcacccucgccguguuccugcugcucacgauggggcagcugaccuggaacgaccugauccgccucugcaucauggucggcgccaacgccuccgacaugauggggaugggcaccaccuaccuggcccugauggcgacguuccggaugcgcccgauguucgccguggggcuccuguuccgccggcugaccagccgcgagauccuccugcugaccgucgggcucucccugguggccagcguggagcugcccaacucccucgaggagcugggcgacgggcuggccaugggcaucaugaugcucaagcugcugaccgacuuccagccccaccagcucugggccacgcugcugagccucaccuucgucaagaccacccugucccugcacuacgcguggaagacgauggccaugauccucagcaucgugucccugcugccccucugccugagcaccaccucccagaagaccacguggcugccggugcuccugggcagccuggggugcaagccccucaccauguuccugaucaccgagaacaagaucuggggccggcgcuccuggccccugaacgaggggaucauggccaucggcaucgucagcauccuccugagcucccugcucaagaacgacgugccccuggccgggccgcugaucgcgggcggcaugcucaucgccugcuacgugaucagcggguccagcgccgaccugucccuggagaaggccgccgaggucagcugggaggacgaggcggagcacuccggcgccagccacaacauccucguggaggugcaggacgacgggaccaugaagaucaaggacgaggagcgggacgacacccugacgauccugcucaaggccacccugcuggucaucuccggcguguaccccaugagcgugcccgccacccucuucgucugguacuucuggcagaagaagaagcagcgcuccggggugcugugggacacccccagcccgcccgagguggagcgggccguccuggacaacggcaucuaccgcauccugcagcggggccuccuggggcgcucccaggugggcgugggggucuuccaggagggcguguuccacacgauguggcacgugacccgcggggccguccugauguaccagggcaagcggcucgagcccagcugggccuccgugaagaaggaccugaucagcuacggcgggggcuggcgguuccagggguccuggaacaccggcgaggaggugcaggucaucgccguggagcccgggaagaacccgaagaacgugcagaccacgcccggcaccuucaagacccccgagggcgagaucggggccaucgcccuggacuucaagcccggcaccagcggguccccgaucgucaaccgcgagggcaagaucgugggccucuacgggaacggcguggucacgaccagcgggaccuacgugagcgcgaucgcccaggccaaggugucccaggagggcccccugcccgagaucgaggacgaggucuuccggaagcgcaaccugaccaucauggaccuccacccggggagcggcaagacgcggcgcuaccugcccgccaucgugcgggaggccaucaagcgcaagcugcggacccucgugcuggcgcccacccgcgucguggccuccgagauggccgaggcccugaagggcaugcccauccgcuaccagaccacggcggucaagagcgagcacaccgggaaggagaucgucgaccucaugugccacgccaccuucaccaugcggcugcuguccccggugcgcgugcccaacuacaacaugaucaucauggacgaggcccacuucacggaccccgccagcaucgccgcgcggggcuacaucuccacccgcgucgggaugggcgaggccgccgccaucuucaugaccgccacgccgcccgggagcguggaggcguucccccaguccaacgccgugauccaggacgaggagcgggacauccccgagcgcagcuggaacuccggcuacgaguggaucacggacuuccccggcaagaccgucugguucgugcccagcaucaaguccgggaacgacaucgccaacugccuccggaagaacggcaagcgcgugguccagcugagccggaagaccuucgacaccgaguaccagaagacgaagaacaacgacugggacuacguggucaccaccgacaucuccgagaugggggccaacuuccgcgccgaccgggugaucgacccccgccggugccugaagcccgugauccucaaggacggccccgagcgcgucauccuggcggggccgaugcccgugaccguggccagcgccgcccagcggcgcggccggaucggccgcaaccccaacaaggagggggaccaguacgucuacaugggccagccccugaacaacgacgaggaccacgcgcacuggacggaggccaagaugcuccuggacaacaucaacaccccggaggggaucauccccgcccuguucgagcccgagcgggagaaguccgccgccaucgacggcgaguaccgccuccgcggggaggcgcggaagaccuucguggagcugaugcgccggggcgaccugcccguguggcucagcuacaaggucgccuccgagggcuuccaguacagcgaccgccgguggugcuucgacggggagcgcaacaaccaggugcuggaggagaacauggacguggagaucuggaccaaggagggcgagcggaagaagcugcgcccgcgguggcucgacgcccgcacguacagcgacccccuggcccugcgggaguucaaggaguucgccgcggggcgccgguccgucagcggcgaccucauccuggagaucggcaagcugccccagcaccucacccugaaggcccagaacgcccuggacaaccucgugaugcugcacaacuccgagcagggcgggaaggccuaccgccacgccauggaggagcugcccgacaccaucgagacccucaugcugcuggcgcucaucgccgugcugaccgggggcgucacgcuguucuuccucagcgggcggggccugggcaagaccuccaucgggcugcucugcgugauggccagcuccgcccugcuguggauggcgagcguggagccgcacuggaucgccgccuccaucauccucgaguucuuccugaugguccugcucauccccgagcccgaccgccagcggaccccgcaggacaaccagcuggccuacguggugaucggccuccucuucaugauccugaccgucgccgcgaacgagauggggcugcucgagacgaccaagaaggaccugggcaucgggcacgccgccgccgagaaccaccaccacgccgcgaugcuggacguggaccuccaccccgccagcgccuggacccuguacgccguggccaccacgaucaucacccccaugaugcgccacaccaucgagaacaccacggcgaacaucucccugaccgccaucgccaaccaggccgccauccucaugggccuggacaagggcuggcccaucagcaagauggacaucggggucccgcugcucgcgcugggcugcuacucccaggugaacccccugacccucaccgccgccgugcugaugcuggucgcccacuacgcgaucaucgggcccggccuccaggccaaggccacgcgggaggcccagaagcgcaccgccgcggggaucaugaagaaccccaccguggacggcaucguggccaucgaccuggacccggucaucuacgacgccaaguucgagaagcagcugggccagaucaugcuccugauccugugcaccagccagauccuccugaugcggacgaccugggcccugugcgaguccaucacccucgccaccgggccccugacgacccugugggagggcagccccgggaaguucuggaacaccaccaucgcgguguccauggccaacaucuuccgcggcagcuaccucgccggcgccgggcuggccuucucccugaugaagucccucggcgggggccgccgggggacgggcgcgcagggcgagacccugggggagaaguggaagcgccagcugaaccagcucagcaaguccgaguucaacaucuacaagcggagcggcaucaucgagguggaccgcuccgaggccaaggaggggcugaagcggggcgagaccaccaagcacgccgucagccgcgggacggccaagcugcggugguucguggagcgcaaccuggugaagcccgagggcaaggucaucgaccucggcugcgggcggggcgggugguccuacuacugcgcgggccugaagaaggugaccgaggugaagggguacaccaagggcggcccggggcacgaggagcccauccccauggccaccuacggcuggaaccuggucaagcuccacagcgggaaggacguguucuucacgcccccggagaagugcgacacccugcugugcgacaucggcgaguccagccccaaccccaccaucgaggaggggcgcacccuccgggugcugaagauggucgagcccuggcugcgcggcaaccaguucugcaucaagauccucaacccguacaugcccuccgugguggagacccuggagcagaugcagcggaagcacggcgggaugcugguccgcaacccccucagccggaacuccacgcacgagauguacugggugagcugcggcaccgggaacaucguguccgccgucaacaugaccagccgcaugcugcugaaccgguucaccauggcccaccgcaagcccacguacgagcgggacguggaccucggcgccggcacccgccacguggcggucgagccggagguggccaaccuggacaucaucgggcagcgcaucgagaacaucaagaacgagcacaaguccaccuggcacuacgacgaggacaaccccuacaagaccugggccuaccacggcagcuacgaggucaagcccuccgggagcgccuccagcauggugaacggcgugguccggcugcucacgaagcccugggacgugaucccgauggugacccagaucgccaugaccgacaccacgcccuucgggcagcagcgcgucuucaaggagaagguggacacccggacccccaaggcgaagcgcggcaccgcccagaucauggaggugacggcccgguggcuguggggcuuccugagccgcaacaagaagccgcggaucugcacccgcgaggaguucacccggaagguccgcuccaacgccgccaucggggcgguguucguggacgagaaccaguggaacagcgccaaggaggccgucgaggacgagcgguucugggaccucgugcaccgcgagcgggagcugcacaagcagggcaagugcgcgaccugcguguacaacaugauggggaagcgcgagaagaagcugggcgaguucgggaaggcgaagggcucccgggccaucugguacauguggcucggcgcccgcuuccuggaguucgaggcccugggguucaugaacgaggaccacugguucagccgggagaacucccucagcggcgucgagggggagggccugcacaagcugggguacauccuccgcgacaucuccaagauccccggcggcaacauguacgccgacgacacggcggggugggacacccggaucaccgaggacgaccugcagaacgaggccaagaucaccgacaucauggagcccgagcacgcccugcucgccacgagcaucuucaagcugaccuaccagaacaagguggugcgcguccagcggcccggcaagaacgggaccgugauggacgugaucucccgccgcgaccagcggggcagcggccaggucgggaccuacggccugaacacguucaccaacauggaggcccagcucauccgccagauggaguccgaggggaucuucagcccguccgagcuggagacccccaaccuggcggagcggguguucgacuggcucgagaagcacggcaucgagcgccugaagcggauggccaucagcggggacgacugcguggucaagcccaucgacgaccgcuucgccaccgcccugacggcccucaacgacaugggcaaggugcggaaggacaucccccagugggagccguccaagggcuggaacgacuggcagcagguccccuucugcagccaccacuuccaccagcugaucaugaaggacgggcgcgagaucgucgugcccugccggaaccaggacgagcuggugggccgcgcgcgggucucccagggggccggcuggagccuccgcgagaccgccugccugggcaagagcuacgcccagauguggcagcugauguacuuccaccggcgcgaccuccggcuggccgcgaacgccaucugcuccgccgugcccguggacugggucccgaccagccgcaccacgugguccauccacgcccaccaccaguggaugaccaccgaggacaugcugagcguguggaaccggguguggaucgaggagaaccccuggauggaggacaagacccacgucuccagcugggaggacgugcccuaccucggcaagcgcgaggaccaguggugcggcucccugaucgggcugaccgcgcgggccacgugggccaccaacauccagguggccaucaaccagguccgccgccucaucggcaacgagaacuaccuggacuacaugaccagcaugaagcgguucaagaacgaguccgaccccgagggggcccugugguga

SEQ ID NO: 8897 - RNA, 9879 nt, Artificial Sequence
  derived and/or modified CDS sequence (opt1) from DENV-1__KC762641__SS-prME
agcgugaccaugcugcucaugcugaugcccaccgcccuggccuuccaccucaccacccggggcggggagccccacaugaucgugagcaagcaggagcggggcaagagccugcuguucaagaccagcgcgggggugaacaugugcacccucaucgccauggaccugggcgagcugugcgaggacacgcucaccuacaagugcccccgcaucaccgaggccgagcccgacgacguggacugcuggugcaacgccaccgacacgugggugaccuacgggaccugcagccagaccggcgagcaccggcgcgacaagcgguccguggcccuggcgccccacgugggccuggggcucgagacgcgcaccgagaccuggaugagcuccgagggcgccuggaagcagauccagcgggucgagaccugggcccugcgccaccccggguucacggugaucgcccuguuccucgcgcacgccaucggcaccagcaucacccagaaggggaucaucuucauccugcugaugcucgugacccccuccauggccaugcggugcgucggcaucggcagccgcgacuucguggaggggcuguccggcgccacguggguggacgucgugcuggagcacgggagcugcgugaccaccauggccaaggacaagcccacccucgacaucgagcugcugaagacggaggucaccaaccccgcggugcuccggaagcugugcaucgaggccaagaucuccaacaccaccacggacagccgcugcccgacccagggcgaggccacccugguggaggagcaggacgccaacuucgucugccggcgcaccuucguggaccggggcugggggaacggcugcgggcuguucggcaaggggucccugaucacgugcgccaaguucaagugcgugaccaagcuggagggcaagaucguccaguacgagaaccucaaguacagcgugaucgugaccguccacaccggcgaccagcaccagguggggaacgaguccacggagcacggcaccaccgcgaccaucacgccccaggcccccacgaccgagauccagcugaccgacuacggggcccugacccucgacugcagcccccgcacgggccuggacuucaacgagaugguccugcucaccaugaaggagaaguccuggcuggugcacaagcagugguuccuggaccucccccugcccuggaccagcggggccagcaccucccaggagacguggaaccggcaggaccugcucgugaccuucaagaccgcccacgcgaagaagcaggaggucguggugcugggcagccaggagggcgccaugcacaccgcccugacgggggccaccgagauccagaccuccggcaccacgaccaucuucgccgggcaccucaagugccgccugaagauggacaagcugacccucaagggcaugagcuacgucaugugcaccggguccuucaagcuggagaaggagguggcggagacgcagcacggcaccgugcugguccagaucaaguacgagggcaccgacgcccccugcaagauccccuucagcacccaggacgagaagggggugacgcagaacggccggcugaucaccgccaacccgaucgugaccgacaaggagaagcccgucaacaucgaggccgagccgcccuucggggaguccuacaucgugaucggcgcgggcgagaaggcccucaagcugagcugguucaagaagggguccagcaucggcaagauguucgaggccaccgcccgcggggcccggcgcauggcgauccugggcgacacggccugggacuucggguccaucggcggcguguucaccagcgucgggaagcucgugcaccagaucuucggcaccgccuacggggugcuguucuccggcgucagcuggaccaugaagaucgggaucggcgugcugcucacguggcugggccugaacucccgcagcaccucccucagcaugaccugcaucgccguggggcuggucacccuguaccucggcgugauggugcaggccgacuccgggugcgucaucaacuggaagggccgggagcugaagugcgggagcggcaucuucgugacgaacgaggugcacaccuggaccgagcaguacaaguuccaggcggacagcccgaagcgccuguccgccgccaucggcaaggccugggaggagggggucugcggcauccggagcgccacccgccucgagaacaucauguggaagcagaucuccaacgagcugaaccacauccugcucgagaacgacaugaaguucaccgugguggucggggacguggcgggcauccuggcccaggggaagaagaugauccggccccagcccauggagcacaaguacagcuggaaguccuggggcaaggccaagaucaucggcgccgacgugcagaacacgaccuucaucaucgacgggcccaacaccccggagugccccgacgaccagcgcgcguggaacaucugggaggucgaggacuacggcuucgggaucuucaccacgaacaucuggcugaagcuccgggacagcuacacccaggugugcgaccaccgccugauguccgccgccaucaaggacagcaaggccgugcacgccgacaugggcuacuggaucgaguccgagaagaacgagaccuggaagcuggcgcgggccagcuucaucgaggucaagaccugcaucuggcccaagucccacacgcucuggagcaacggcgugcuggaguccgagaugaucauccccaagaucuacgggggcccgaucagccagcacaacuaccgccccggguacuucacccagaccgccggccccuggcaccuggggaagcucgagcuggacuucgaccugugcgagggcaccacgguggucguggacgagcacugcggcaaccgggggccgucccuccgcaccaccaccgugacgggcaagaucauccacgaguggugcugccggagcugcacccugccgccccugcgcuuccgcggggaggacggcugcugguacgggauggagauccgccccgucaaggagaaggaggagaaccucgugaaguccauggugagcgccggcagcggcgaggucgacuccuucagccuggggcugcucugcaucuccaucaugaucgaggaggugaugcggagccgcuggucccggaagaugcugaugaccggcacccuggccguguucuuccuccugaucauggggcagcugacguggaacgaccucauccgccugugcaucauggucggcgcgaacgccagcgaccgcauggggaugggcaccaccuaccuggcccucauggccaccuucaagaugcggccgauguucgccgugggccugcuguuccgccggcucacgucccgcgaggugcugcugcucaccaucgggcugagccuggucgcguccguggagcuccccaacagccuggaggagcugggcgacgggcucgccaugggcaucaugauccugaagcugcucaccgacuuccagucccaccagcugugggccacccugcucagccugacguucaucaagaccaccuucucccugcacuacgccuggaagaccauggcgaugguccucagcaucgugucccuguucccccugugccucagcacgaccucccagaagaccaccuggcugcccgugcugcucggcagccuggggugcaagccgcugacgauguuccucaucgccgagaacaagaucuggggccggaaguccuggccccugaacgaggggaucauggccgucggcaucgugagcauccugcucagcucccugcugaagaacgacgugccccucgccgggccccugaucgccggcggcaugcugaucgcgugcuacgucaucagcggguccagcgccgaccucucccuggagaaggccgccgaggugagcugggaggaggaggccgagcacuccggcgcgagccacaacauccugguggagguccaggacgacgggaccaugaagaucaaggacgaggagcgcgacgacacccucaccauccugcugaaggccacccuccuggccguguccggcguguacccgcugagcauccccgccacccucuucgucugguacuucuggcagaagaagaagcagcgguccggggugcugugggacacccccagcccgcccgagguggagcgcgccguccuggacgacggcaucuaccggaucaugcagcgcggccugcucgggcggucccaggugggcgugggggucuuccaggagaacguguuccacaccauguggcacgugacccgcggcgcgguccugauguaccaggggaagcggcuggagcccagcugggccuccgugaagaaggaccucaucagcuacggcggcggguggcgccugcagggcuccuggaacacgggggaggaggugcaggucaucgccguggagcccggcaagaaccccaagaacgugcagaccgcccccgggaccuucaagacccccgagggcgaggucggcgccaucgcgcuggacuucaagcccgggacgagcggcucccccaucgugaaccgggaggggaagaucgugggccucuacggcaacggggucgugaccaccagcggcaccuacgugagcgccaucgcccaggccaaggcgucccaggaggggccgcugcccgagaucgaggacgaggucuuccgcaagcggaaccugacgaucauggaccuccaccccggcagcgggaagacccgccgguaccugccggccaucgugcgcgaggccaucaagcggaagcugcgcacccucauccuggcccccacccgcguggucgccuccgagauggcggaggcccugaagggcaugcccauccgguaccagacgaccgccgucaagagcgagcacaccggcaaggagaucguggaccucaugugccacgccaccuucacgaugcgccugcugucccccguccgggugccgaacuacaacaugaucaucauggacgaggcccacuucaccgaccccagcuccaucgcggcccgcggguacaucagcacccgggugggcaugggggaggccgccgccaucuucaugaccgcgacgccgcccggcuccgucgaggccuucccgcagagcaacgccgugauccaggacgaggagcgcgacauccccgagcgguccuggaacagcggguacgaguggaucaccgacuuccccggcaagaccgugugguucguccccuccaucaagagcggcaacgacaucgccaacugccuccgcaagaacgggaagcgggugauccagcugucccgcaagaccuucgacacggaguaccagaagaccaagaacaacgacugggacuacguggucaccaccgacaucagcgagaugggcgcgaacuuccgggccgaccgcgugaucgacccgcggcgcugccugaagcccgugauccucaaggacgggcccgagcgggucauccuggccggccccaugccggugacggucgccuccgccgcgcagcgccgggggcgcgugggccggaaccacaacaaggagggcgaccaguacaucuacauggggcagccccugaacaacgacgaggaccacgcccacuggaccgaggccaagaugcuccuggacaacaucaacacccccgagggcaucauccccgcccuguucgagccggagcgcgagaaguccgccgcgaucgacggggaguaccgccuccggggcgaggcccgcaagaccuucguggagcugaugcggcgcggggaccugcccgucuggcucuccuacaagguggccagcgagggcuuccaguacagcgaccggcgcuggugcuucgacggcgagcggaacaaccaggugcuggaggagaacauggacgucgagaucuggacgaaggagggggagcgcaagaagcugcggccccgcuggcucgacgcccggaccuacuccgacccccuggcccugcgcgaguucaaggaguucgcggccggccggcgcagcguguccggggaccucauccuggagaucggcaagcugccgcagcaccucacccagcgggcccagaacgcccuggacaaccuggugaugcuccacaacagcgagcagggcgggcgcgcguaccggcacgccauggaggagcugcccgacaccaucgagacgcugaugcuccuggcccugaucgccguccucaccggcggggugacccuguucuuccuguccggccgcgggcucggcaagaccagcaucggccugcugugcgugauggccuccagcguccuccuguggauggcguccguggagccccacuggaucgccgccagcaucauccuggaguucuuccucauggugcugcugauccccgagccggaccggcagcgcacgccccaggacaaccagcucgccuacgucgugaucgggcugcuguucaugauccucacggugaccgccaacgagaugggccugcuggagaccaccaagaaggaccucgggaucggccacgucgcgguggagaaccaccaccacgccgccaugcuggacguggaccugcaccccgccuccgccuggacgcucuacgcggucgccaccaccaucaucaccccgaugaugcggcacacgaucgagaacaccaccgccaacaucagccugaccgccaucgccaaccaggcggccauccugauggggcucgacaagggcuggcccaucuccaagauggacaucggcgugccccugcuggcccucgggugcuacagccaggugaacccccugacgcugaccgccgcgguccucaugcugguggcccacuacgccaucaucggcccggggcugcaggccaaggccacccgcgaggcgcagaagcgcaccgccgccggcaucaugaagaaccccacgguggacgggaucgucgccaucgaccucgaccccgugguguacgacgccaaguucgagaagcagcugggccagaucaugcugcucauccugugcaccucccagauccugcucaugcggaccaccugggcgcugugcgagagcaucacgcuggccaccggcccccucaccacccugugggagggguccccgggcaaguucuggaacacgaccaucgccgucagcauggccaacaucuuccgcggguccuaccuggccggcgcgggccucgccuucagccugaugaagucccucgggggcgggcggcgcgggaccggggcccagggcgagacccucggcgagaaguggaagcggcagcugaaccagcuguccaagagcgaguucaacacguacaagcgcuccgggaucauggagguggaccggagcgaggccaaggagggccucaagcgcggggagaccaccaagcacgcggugucccggggcaccgccaagcugcgcugguucgucgagcggaaccuggugaagcccgaggggaaggugaucgaccugggcugcggccgcgggggcuggagcuacuacugcgccgggcucaagaaggucacggaggugaagggcuacaccaagggcgggcccggccacgaggagcccaucccgauggccaccuacggguggaaccuggugaagcugcacuccggcaaggacgucuucuucaucccgcccgagaagugcgacacccuccugugcgacaucggggagagcucccccaacccgacgaucgaggagggccggacccugcgcgugcucaagaugguggagcccuggcugcgggggaaccaguucugcaucaagauccugaaccccuacaugcccagcgucguggagacccucgagcagaugcagcgcaagcacggcggcaugcuggugcggaacccgcugucccgcaacagcacccacgagauguacugggucuccugcgggaccggcaacaucgugagcgccgugaacaugacgucccggaugcuccugaaccgcuucaccauggcgcaccgcaagcccaccuacgagcgggacgucgaccugggggccggcacccgccacguggccguggagcccgaggucgccaaccucgacaucaucggccagcggaucgagaacaucaagcacgagcacaagagcacguggcacuacgacgaggacaaccccuacaagaccugggccuaccacggguccuacgaggugaagccgagcggcuccgcgagcagcauggucaacgggguggugaagcugcugaccaagcccugggacgucauccccauggugacccagaucgccaugacggacaccacccccuucggccagcagcgcguguucaaggagaaggucgacacccggacgccgaaggccaagcgcgggaccacccagaucauggaggugaccgcccgguggcucuggggcuuccugucccgcaacaagaagccccggaucugcacgcgcgaggaguucacccggaaggugcgcagcaacgccgcgaucggcgccgucuucguggacgagaaccaguggaacuccgccaaggaggccguggaggacgagcgguucugggaccugguccaccgcgagcgggagcuccacaagcaggggaagugcgcgaccugcguguacaacaugaugggcaagcgcgagaagaagcugggggaguucggcaaggccaaggggagccgggccaucugguacauguggcugggcgcccgcuuccucgaguucgaggcccugggcuucaugaacgaggaccacugguucucccgggagaacagccuguccgggguggagggcgaggggcuccacaagcugggcuacauccugcgcgacaucagcaagauccccgggggcaacauguacgcggacgacaccgccggcugggacacgcggaucaccgaggacgaccuccagaacgaggccaagaucaccgacaucauggagccggagcacgcccugcuggccaaggcgaucuucaagcucaccuaccagaacaaggucgugcgcgugcagcgccccgccaagaacgggacggucauggacgugaucucccggcgcgaccagcggggcagcggccagguggggaccuacggccugaacaccuucaccaacauggaggcccagcugauccgccagauggaguccgaggggaucuucagccccuccgagcucgagacgcccaaccuggccgagcggguccuggacuggcucgagaaguacggcguggagcgccugaagcggauggccaucagcggggacgacugcguggucaagccgaucgacgaccgcuucgcgaccgcccugaccgcccucaacgacaugggcaaggugcggaaggacaucccccagugggagcccuccaagggguggaacgacuggcagcagguccccuucugcagccaccacuuccaccagcugaucaugaaggacggccgcgagaucgucgugccgugccggaaccaggacgagcuggugggccgcgcccgggucucccagggggccggcuggagccuccgcgagaccgcgugccugggcaagagcuacgcccagauguggcagcugauguacuuccaccggcgcgaccuccggcuggccgccaacgcgaucugcuccgccgugcccguggacuggguccccacgagccgcaccaccugguccauccacgcccaccaccaguggaugaccacggaggacaugcugagcguguggaaccggguguggaucgaggagaaccccuggauggaggacaagacccacaucuccagcugggaggacgucccguaccucggcaagcgcgaggaccaguggugcgggucccugaucggccugaccgcccgcgccaccugggcgaccaacauccagguggccaucaaccaggugcggcgccucaucggcaacgagaacuaccuggacuacaugacgagcaugaagcgguucaagaacgaguccgaccccgagggggcccugugguga

SEQ ID NO: 8898 - RNA, 9879 nt, Artificial Sequence
  derived and/or modified CDS sequence (opt1) from DENV-1__KC762648__SS-prME
agcgugaccaugcugcucaugcugaugcccaccgcccuggccuuccaccucaccacccggggcggggagccccacaugaucgugagcaagcaggagcggggcaagagccugcuguucaagaccagcgccggggugaacaugugcacccucaucgccauggaccugggcgagcugugcgaggacacgcucaccuacaagugcccccgcaucaccgaggccgagcccgacgacguggacugcuggugcaacgccaccgacacgugggugaccuacgggaccugcagccagaccggcgagcaccggcgcgacaagcgguccguggcccuggcgccccacgugggccuggggcucgagacgcgcaccgagaccuggaugagcuccgagggcgccuggaagcagauccagcgggucgagaccugggcccugcgccaccccggguucacggugaucgcccuguuccucgcgcacgccaucggcaccagcaucacccagaaggggaucaucuucauccugcugaugcucgugacccccuccauggccaugcggugcgucggcaucggcagccgcgacuucguggaggggcuguccggcgccacguggguggacgucgugcuggagcacgggagcugcgugaccaccauggccaaggacaagcccacccucgacaucgagcugcugaagacggaggucaccaaccccgcggugcuccggaagcugugcaucgaggccaagaucuccaacaccaccacggacagccgcugcccgacccagggcgaggccacccugguggaggagcaggacgccaacuucgucugccggcgcaccuucguggaccggggcugggggaacggcugcgggcuguucggcaaggggucccugaucacgugcgccaaguucaagugcgugaccaagcuggagggcaagaucguccaguacgagaaccucaaguacagcgugaucgugaccguccacaccggcgaccagcaccagguggggaacgaguccacggagcacggcaccaccgcgaccaucacgccccaggcccccacgaccgagauccagcugaccgacuacggggcccugacccucgacugcagcccccgcacgggccuggacuucaacgagaugguccugcucaccaugaaggagaaguccuggcuggugcacaagcagugguuccuggaccucccccugcccuggaccagcggggccagcaccucccaggagacguggaaccggcaggaccugcucgugaccuucaagaccgcccacgcgaagaagcaggaggucguggugcugggcagccaggagggcgccaugcacaccgcccugacgggggccaccgagauccagaccuccggcaccacgaccaucuucgccgggcaccucaagugccgccugaagauggacaagcugacccucaagggcaugagcuacgucaugugcaccggguccuucaagcuggagaaggagguggcggagacgcagcacggcaccgugcugguccagaucaaguacgagggcaccgacgcccccugcaagauccccuucagcacccaggacgagaagggggugacgcagaacggccggcugaucaccgccaacccgaucgugaccgacaaggagaagcccgucaacaucgaggccgagccgcccuucggggaguccuacaucgugaucggcgcgggcgagaaggcccucaagcugagcugguucaagaagggguccagcaucggcaagauguucgaggccaccgcccgcggggcccggcgcauggcgauccugggcgacacggccugggacuucggguccaucggcggcguguucaccagcgucgggaagcucgugcaccagaucuucggcaccgccuacggggugcuguucuccggcgucagcuggaccaugaagaucgggaucggcgugcugcucacguggcugggccugaacucccgcagcaccucccucagcaugaccugcaucgccguggggcuggucacccuguaccucggcgugauggugcaggccgacuccgggugcgucaucaacuggaagggccgggagcugaagugcgggagcggcaucuucgugacgaacgaggugcacaccuggaccgagcaguacaaguuccaggcggacagcccgaagcgccuguccgccgccaucggcaaggccugggaggagggggucugcggcauccggagcgccacccgccucgagaacaucauguggaagcagaucuccaacgagcugaaccacauccugcucgagaacgacaugaaguucaccgugguggucggggacguggcgggcauccuggcccaggggaagaagaugauccggccccagcccauggagcacaaguacagcuggaaguccuggggcaaggccaagaucaucggcgccgacgugcagaacacgaccuucaucaucgacgggcccaacaccccggagugccccgacgaccagcgcgcguggaacaucugggaggucgaggacuacggcuucgggaucuucaccacgaacaucuggcugaagcuccgggacagcuacacccaggugugcgaccaccgccugauguccgccgccaucaaggacagcaaggccgugcacgccgacaugggcuacuggaucgaguccgagaagaacgagaccuggaagcuggcgcgggccagcuucaucgaggucaagaccugcaucuggcccaagucccacacgcucuggagcaacggcgugcuggaguccgagaugaucauccccaagaucuacgggggcccgaucagccagcacaacuaccgccccggguacuucacccagaccgccggccccuggcaccuggggaagcucgagcuggacuucgaccugugcgagggcaccacgguggucguggacgagcacugcggcaaccgggggccgucccuccgcaccaccaccgugacgggcaagaucauccacgaguggugcugccggagcugcacccugccgccccugcgcuuccgcggggaggacggcugcugguacgggauggagauccgccccgucaaggagaaggaggagaaccucgugaaguccauggugagcgccggcagcggcgaggucgacuccuucagccuggggcugcucugcaucuccaucaugaucgaggaggugaugcggagccgcuggucccggaagaugcugaugaccggcacccuggccguguucuuccuccugaucauggggcagcugacguggaacgaccucauccgccugugcaucauggucggcgcgaacgccagcgaccgcauggggaugggcaccaccuaccuggcccucauggccaccuucaagaugcggccgauguucgccgugggccugcuguuccgccggcucacgucccgcgaggugcugcugcucaccaucgggcugagccuggucgcguccguggagcuccccaacagccuggaggagcugggcgacgggcucgccaugggcaucaugauccugaagcugcucaccgacuuccagucccaccagcugugggccacccugcucagccugacguucaucaagaccaccuucucccugcacuacgccuggaagaccauggcgaugguccucagcaucgugucccuguucccccugugccucagcacgaccucccagaagaccaccuggcugcccgugcugcucggcagccuggggugcaagccgcugacgauguuccucaucgccgagaacaagaucuggggccggaaguccuggccccugaacgaggggaucauggccgucggcaucgugagcauccugcucagcucccugcugaagaacgacgugccccucgccgggccccugaucgccggcggcaugcugaucgcgugcuacgucaucagcggguccagcgccgaccucucccuggagaaggccgccgaggugagcugggaggaggaggccgagcacuccggcgcgagccacaacauccugguggagguccaggacgacgggaccaugaagaucaaggacgaggagcgcgacgacacccucaccauccugcugaaggccacccuccuggccguguccggcguguacccgcugagcauccccgccacccucuucgucugguacuucuggcagaagaagaagcagcgguccggggugcugugggacacccccagcccgcccgagguggagcgcgccguccuggacgacggcaucuaccggaucaugcagcgcggccugcucgggcggucccaggugggcgugggggucuuccaggagaacguguuccacaccauguggcacgugacccgcggcgcgguccugauguaccaggggaagcggcuggagcccagcugggccuccgugaagaaggaccucaucagcuacggcggcggguggcgccugcagggcuccuggaacacgggggaggaggugcaggucaucgccguggagcccggcaagaaccccaagaacgugcagaccgcccccgggaccuucaagacccccgagggcgaggucggcgccaucgcgcuggacuucaagcccgggacgagcggcucccccaucgugaaccgggaggggaagaucgugggccucuacggcaacggggucgugaccaccagcggcaccuacgugagcgccaucgcccaggccaaggcgucccaggaggggccgcugcccgagaucgaggacgaggucuuccgcaagcggaaccugacgaucauggaccuccaccccggcagcgggaagacccgccgguaccugccggccaucgugcgcgaggccaucaagcggaagcugcgcacccucauccuggcccccacccgcguggucgccuccgagauggcggaggcccugaagggcaugcccauccgguaccagacgaccgccgucaagagcgagcacaccggcaaggagaucguggaccucaugugccacgccaccuucacgaugcgccugcugucccccguccgggugccgaacuacaacaugaucaucauggacgaggcccacuucaccgaccccagcuccaucgcggcccgcggguacaucagcacccgggugggcaugggggaggccgccgccaucuucaugaccgcgacgccgcccggcuccgucgaggccuucccgcagagcaacgccgugauccaggacgaggagcgcgacauccccgagcgguccuggaacagcggguacgaguggaucaccgacuuccccggcaagaccgugugguucguccccuccaucaagagcggcaacgacaucgccaacugccuccgcaagaacgggaagcgggugauccagcugucccgcaagaccuucgacacggaguaccagaagaccaagaacaacgacugggacuacguggucaccaccgacaucagcgagaugggcgcgaacuuccgggccgaccgcgugaucgacccgcggcgcugccugaagcccgugauccucaaggacgggcccgagcgggucauccuggccggccccaugccggugacggucgccuccgccgcgcagcgccgggggcgcgugggccggaaccacaacaaggagggcgaccaguacaucuacauggggcagccccugaacaacgacgaggaccacgcccacuggaccgaggccaagaugcuccuggacaacaucaacacccccgagggcaucauccccgcccuguucgagccggagcgcgagaaguccgccgcgaucgacggggaguaccgccuccggggcgaggcccgcaagaccuucguggagcugaugcggcgcggggaccugcccgucuggcucuccuacaagguggccagcgagggcuuccaguacagcgaccggcgcuggugcuucgacggcgagcggaacaaccaggugcuggaggagaacauggacgucgagaucuggacgaaggagggggagcgcaagaagcugcggccccgcuggcucgacgcccggaccuacuccgacccccuggcccugcgcgaguucaaggaguucgcggccggccggcgcagcguguccggggaccucauccuggagaucggcaagcugccgcagcaccucacccagcgggcccagaacgcccuggacaaccuggugaugcuccacaacagcgagcagggcgggcgcgcguaccggcacgccauggaggagcugcccgacaccaucgagacgcugaugcuccuggcccugaucgccguccucaccggcggggugacccuguucuuccuguccggccgcgggcucggcaagaccagcaucggccugcugugcgugauggccuccagcgcgcuccuguggauggccuccgucgagccccacuggaucgccgccagcaucauccuggaguucuuccucauggugcugcugauccccgagccggaccggcagcgcacgccccaggacaaccagcucgccuacguggucaucgggcugcuguucaugauccucacgguggcggccaacgagaugggccugcuggagaccaccaagaaggaccucgggaucggccacguggccgucgagaaccaccaccacgccgccaugcuggacguggaccugcaccccgcguccgccuggacccucuacgccguggccacgaccaucaucaccccgaugaugcggcacaccaucgagaacacgaccgccaacaucagccugaccgcgaucgccaaccaggccgccauccugauggggcucgacaagggcuggcccaucuccaagauggacaucggcgucccccugcuggcgcucgggugcuacagccaggugaacccccugacccugacggccgccgugcucaugcuggucgcccacuacgccaucaucggcccggggcugcaggcgaaggccacccgcgaggcccagaagcgcaccgccgccggcaucaugaagaaccccaccguggacgggaucguggcgaucgaccucgaccccgucguguacgacgccaaguucgagaagcagcugggccagaucaugcugcucauccugugcacgucccagauccugcucaugcggaccaccugggcccugugcgagagcaucacccuggccacgggcccccucaccacccugugggagggguccccgggcaaguucuggaacaccacgaucgccgugagcauggcgaacaucuuccgcggguccuaccuggccggcgccggccucgccuucagccugaugaagucccucgggggcgggcggcgcgggaccggggcgcagggcgagacccucggcgagaaguggaagcggcagcugaaccagcuguccaagagcgaguucaacaccuacaagcgcuccgggaucauggaggucgaccggagcgaggccaaggagggccucaagcgcggggagacgaccaagcacgccgugucccggggcaccgccaagcugcgcugguucguggagcggaaccuggucaagcccgaggggaaggugaucgaccugggcugcggccgcgggggcuggagcuacuacugcgccgggcucaagaaggugaccgaggucaagggcuacacgaagggcggccccggccacgaggagcccaucccgauggcgaccuacggguggaaccuggugaagcugcacuccggcaaggacguguucuucaucccgcccgagaagugcgacacccuccugugcgacaucggggagagcucccccaacccgaccaucgaggagggccggacgcugcgcguccucaagaugguggagcccuggcugcgggggaaccaguucugcaucaagauccugaaccccuacaugcccagcguggucgagacccucgagcagaugcagcgcaagcacggcggcaugcuggugcggaacccgcugucccgcaacagcacccacgagauguacuggguguccugcgggaccggcaacaucgucagcgccgugaacaugaccucccggaugcuccugaaccgcuucacgauggcccaccgcaagcccaccuacgagcgggacguggaccugggggccggcacccgccacgucgccguggagcccgagguggcgaaccucgacaucaucggccagcggaucgagaacaucaagcacgagcacaagagcaccuggcacuacgacgaggacaaccccuacaagacgugggccuaccacggguccuacgaggucaagccgagcggcuccgccagcagcauggugaacggggucgugaagcugcugaccaagcccugggacgugauccccauggucacccagaucgccaugaccgacacgacccccuucggccagcagcgcguguucaaggagaagguggacacccggaccccgaaggccaagcgcgggacgacccagaucauggaggucaccgcgcgguggcucuggggcuuccugucccgcaacaagaagccccggaucugcacccgcgaggaguucacgcggaaggugcgcagcaacgccgccaucggcgccguguucgucgacgagaaccaguggaacuccgcgaaggaggccguggaggacgagcgguucugggaccuggugcaccgcgagcgggagcuccacaagcaggggaagugcgcgaccugcgucuacaacaugaugggcaagcgcgagaagaagcugggggaguucggcaaggccaaggggagccgggccaucugguacauguggcugggcgcgcgcuuccucgaguucgaggcccugggcuucaugaacgaggaccacugguucucccgggagaacagccuguccgggguggagggcgaggggcuccacaagcugggcuacauccugcgcgacaucagcaagauccccgggggcaacauguacgccgacgacaccgccggcugggacacccggaucacggaggacgaccuccagaacgaggccaagaucaccgacaucauggagccggagcacgcgcugcuggccaaggccaucuucaagcucaccuaccagaacaaggugguccgcgugcagcgccccgccaagaacgggaccgugauggacgucaucucccggcgcgaccagcggggcagcggccagguggggacguacggccugaacaccuucaccaacauggaggcccagcugauccgccagauggaguccgaggagaucuucagccccuccgagcucgagacccccaaccuggcggagcgggugcuggacuggcucgagaaguacggggucgagcgccugaagcggauggccaucagcggcgacgacugcguggugaagccgaucgacgaccgcuucgccacggcccugaccgcccucaacgacauggggaagguccggaaggacaucccccagugggagcccuccaagggcuggaacgacuggcagcagguccccuucugcagccaccacuuccaccagcugaucaugaaggacgggcgcgagaucguggucccgugccggaaccaggacgagcuggugggccgcgcgcgggugucccagggcgccggguggagccuccgcgagaccgccugccugggcaagagcuacgcccagauguggcagcugauguacuuccaccggcgcgaccuccggcuggcggccaacgccaucugcuccgccguccccguggacugggugcccaccagccgcacgaccugguccauccacgcccaccaccaguggaugaccaccgaggacaugcugagcgucuggaaccggguguggaucgaggagaaccccuggauggaggacaagacgcacaucuccagcugggaggacgugccguaccucgggaagcgcgaggaccaguggugcggcucccugaucgggcugaccgcgcgcgccaccugggccaccaacauccaggucgccaucaaccaggugcggcgccucaucggcaacgagaacuaccuggacuacaugaccagcaugaagcgguucaagaacgaguccgaccccgagggcgcccugugguga

SEQ ID NO: 8899 - RNA, 9879 nt, Artificial Sequence
  derived and/or modified CDS sequence (opt1) from DENV-1__KC762622__SS-prME
agcgugaccaugcugcucaugcugaugcccaccgcccuggccuuccaccucaccacccggggcggggagccccacaugaucgugagcaagcaggagcggggcaagagccugcuguucaagaccagcgccggggugaacaugugcacccucaucgccauggaccugggcgagcugugcgaggacacgcucaccuacaagugcccccgcaucaccgaggccgagcccgacgacguggacugcuggugcaacgccaccgacaccugggugaccuacgggaccugcagccagaccggcgagcaccggcgcgacaagcgguccguggcccuggcgccccacgugggccuggggcucgagacgcgcaccgagaccuggaugagcuccgagggcgccuggaagcagauccagcgggucgagaccugggcccugcgccaccccggguucacggugauggcccuguuccucgcgcacgccaucggcaccagcaucacccagaaggggaucaucuucauccugcugaugcucgugacccccuccauggccaugcggugcgucggcaucggcagccgcgacuucguggaggggcuguccggcgccacguggguggacgucgugcuggagcacgggagcugcgugaccaccauggccaaggacaagcccacccucgacaucgagcugcugaagacggaggucaccaaccccgcggugcuccggaagcugugcaucgaggccaagaucuccaacaccaccacggacagccgcugcccgacccagggcgaggccacccugguggaggagcaggacgccaacuucgucugccggcgcaccuucguggaccggggcugggggaacggcugcgggcuguucggcaaggggucccugaucacgugcgccaaguucaagugcgugaccaagcuggagggcaagaucguccaguacgagaaccucaaguacagcgugaucgugaccguccacaccggcgaccagcaccagguggggaacgaguccacggagcacggcaccaccgcgaccaucacgccccaggcccccacgaccgagauccagcugaccgacuacggggcccugacccucgacugcagcccccgcacgggccuggacuucaacgagaugguccugcucaccaugaaggagaaguccuggcuggugcacaagcagugguuccuggaccucccccugcccuggaccagcggggccagcaccucccaggagacguggaaccggcaggaccugcucgugaccuucaagaccgcccacgcgaagaagcaggaggucguggugcugggcagccaggagggcgccaugcacaccgcccugacgggggccaccgagauccagaccuccggcaccacgaccaucuucgccgggcaccucaagugccgccugaagauggacaagcugacccucaagggcaugagcuacgucaugugcaccggguccuucaagcuggagaaggagguggcggagacgcagcacggcaccgugcugguccagaucaaguacgagggcaccgacgcccccugcaagauccccuucagcacccaggacgagaagggggugacgcagaacggccggcugaucaccgccaacccgaucgugaccgacaaggagaagcccgucaacaucgaggccgagccgcccuucggggaguccuacaucgugaucggcgcgggcgagaaggcccucaagcugagcugguucaagaagggguccagcaucggcaagauguucgaggccaccgcccgcggggcccggcgcauggcgauccugggcgacacggccugggacuucggguccaucggcggcguguucaccagcgucgggaagcucgugcaccagaucuucggcaccgccuacggggugcuguucuccggcgucagcuggaccaugaagaucgggaucggcgugcugcucacguggcugggccugaacucccgcagcaccucccucagcaugaccugcaucgccguggggcuggucacccuguaccucggcgugauggugcaggccgacuccgggugcgucaucaacuggaagggccgggagcugaagugcgggagcggcaucuucgugacgaacgaggugcacaccuggaccgagcaguacaaguuccaggcggacagcccgaagcgccuguccgccgccaucggcaaggccugggaggagggggucugcggcauccggagcgccacccgccucgagaacaucauguggaagcagaucuccaacgagcugaaccacauccugcucgagaacgacaugaaguucaccgugguggucggggacguggcgggcauccuggcccaggggaagaagaugauccggccccagcccauggagcacaaguacagcuggaaguccuggggcaaggccaagaucaucggcgccgacgugcagaacacgaccuucaucaucgacgggcccaacaccccggagugccccgacgaccagcgcgcguggaacaucugggaggucgaggacuacggcuucgggaucuucaccacgaacaucuggcugaagcuccgggacagcuacacccaggugugcgaccaccgccugauguccgccgccaucaaggacagcaaggccgugcacgccgacaugggcuacuggaucgaguccgagaagaacgagaccuggaagcuggcgcgggccagcuucaucgaggucaagaccugcaucuggcccaagucccacacgcucuggagcaacggcgugcuggaguccgagaugaucauccccaagaucuacgggggcccgaccagccagcacaacuaccgccccggguacuucacccagaccgccggccccuggcaccuggggaagcucgagcuggacuucgaccugugcgagggcacgaccguggucguggacgagcacugcggcaaccgggggccgucccuccgcaccaccacggugaccggcaagaucauccacgaguggugcugccggagcugcacccugccgccccugcgcuuccgcggggaggacggcugcugguacgggauggagauccgccccgucaaggagaaggaggagaaccucgugaaguccauggugagcgccggcagcggcgaggucgacuccuucagccuggggcugcucugcaucuccaucaugaucgaggaggugaugcggagccgcuggucccggaagaugcugaugaccggcacgcuggccguguucuuccuccugaucauggggcagcugaccuggaacgaccucauccgccugugcaucauggucggcgcgaacgccagcgaccgcauggggaugggcaccaccuaccuggcccucauggccacguucaagaugcggccgauguucgccgugggccugcuguuccgccggcucaccucccgcgaggugcugcugcucaccaucgggcugagccuggucgcguccguggagcuccccaacagccuggaggagcugggcgacgggcucgccaugggcaucaugauccugaagcugcucaccgacuuccagucccaccagcugugggccacgcugcucagccugaccuucaucaagaccaccuucucccugcacuacgccuggaagacgauggcgaugguccucagcaucgugucccuguucccccugugccucagcaccaccucccagaagaccacguggcugcccgugcugcucggcagccuggggugcaagccgcugaccauguuccucaucgccgagaacaagaucuggggccggaaguccuggccccugaacgaggggaucauggccgucggcaucgugagcauccugcucagcucccugcugaagaacgacgugccccucgccgggccccugaucgccggcggcaugcugaucgcgugcuacgucaucagcggguccagcgccgaccucucccuggagaaggccgccgaggugagcugggaggaggaggccgagcacuccggcgcgagccacaacauccugguggagguccaggacgacgggaccaugaagaucaaggacgaggagcgcgacgacacccucaccauccugcugaaggccacgcuccuggccguguccggcguguacccgcugagcauccccgccacccucuucgucugguacuucuggcagaagaagaagcagcgguccggggugcugugggacacccccagcccgcccgagguggagcgcgccguccuggacgacggcaucuaccggaucaugcagcgcggccugcucgggcggucccaggugggcgugggggucuuccaggagaacguguuccacaccauguggcacgugacgcgcggcgcgguccugauguaccaggggaagcggcuggagcccagcugggccuccgugaagaaggaccucaucagcuacggcggcggguggcgccugcagggcuccuggaacaccggggaggaggugcaggucaucgccguggagcccggcaagaaccccaagaacgugcagaccgcccccgggaccuucaagacgcccgagggcgaggucggcgccaucgcgcuggacuucaagcccgggaccagcggcucccccaucgugaaccgggaggggaagaucgugggccucuacggcaacggggucgugaccaccagcggcacguacgugagcgccaucgcccaggccaaggcgucccaggaggggccgcugcccgagaucgaggacgaggucuuccgcaagcggaaccugaccaucauggaccuccaccccggcagcgggaagacccgccgguaccugccggccaucgugcgcgaggccaucaagcggaagcugcgcacccucauccuggcccccacgcgcguggucgccuccgagauggcggaggcccugaagggcaugcccauccgguaccagaccaccgccgucaagagcgagcacaccggcaaggagaucguggaccucaugugccacgccacguucaccaugcgccugcugucccccguccgggugccgaacuacaacaugaucaucauggacgaggcccacuucaccgaccccagcuccaucgcggcccgcggguacaucagcacccgggugggcaugggggaggccgccgccaucuucaugacggcgacgccgcccggcuccgucgaggccuucccgcagagcaacgccgugauccaggacgaggagcgcgacauccccgagcgguccuggaacagcggguacgaguggaucaccgacuuccccggcaagaccgugugguucguccccuccaucaagagcggcaacgacaucgccaacugccuccgcaagaacgggaagcgggugauccagcugucccgcaagacguucgacaccgaguaccagaagaccaagaacaacgacugggacuacguggucaccacggacaucagcgagaugggcgcgaacuuccgggccgaccgcgugaucgacccgcggcgcugccugaagcccgugauccucaaggacgggcccgagcgggucauccuggccggccccaugccggugaccgucgccuccgccgcgcagcgccgggggcgcgugggccggaaccacaacaaggagggcgaccaguacaucuacauggggcagccccugaacaacgacgaggaccacgcccacuggaccgaggccaagaugcuccuggacaacaucaacacccccgagggcaucauccccgcccuguucgagccggagcgcgagaaguccgccgcgaucgacggggaguaccgccuccggggcgaggcccgcaagacguucguggagcugaugcggcgcggggaccugcccgucuggcucuccuacaagguggccagcgagggcuuccaguacagcgaccggcgcuggugcuucgacggcgagcggaacaaccaggugcuggaggagaacauggacgucgagaucuggaccaaggagggggagcgcaagaagcugcggccccgcuggcucgacgcccggaccuacuccgacccccuggcccugcgcgaguucaaggaguucgcggccggccggcgcagcguguccggggaccucauccuggagaucggcaagcugccgcagcaccucacccagcgggcccagaacgcccuggacaaccuggugaugcuccacaacagcgagcagggcgggcgcgcguaccggcacgccauggaggagcugcccgacacgaucgagacccugaugcuccuggcccugaucgccguccucaccggcggggugacccuguucuuccuguccggccgcgggcucggcaagaccagcaucggccugcugugcgugauggccuccagcguccuccuguggauggcguccguggagccccacuggaucgccgccagcaucauccuggaguucuuccucauggugcugcugauccccgagccggaccggcagcgcacgccccaggacaaccagcucgccuacgucgugaucgggcugcuguucaugauccucaccguggccgcgaacgagaugggccugcuggagaccaccaagaaggaccucgggaucggccacgucgccguggagaaccaccaccacgccgccaugcuggacguggaccugcaccccgccuccgcguggacgcucuacgccgucgccaccaccaucaucaccccgaugaugcggcacacgaucgagaacaccaccgccaacaucagccugaccgccaucgcgaaccaggccgccauccugauggggcucgacaagggcuggcccaucuccaagauggacaucggcgugccccugcuggcccucgggugcuacagccaggugaacccccugacgcugaccgcggccguccucaugcugguggcccacuacgccaucaucggcccggggcugcaggccaaggcgacccgcgaggcccagaagcgcaccgccgccggcaucaugaagaaccccacgguggacgggaucgucgccaucgaccucgaccccgugguguacgacgcgaaguucgagaagcagcugggccagaucaugcugcucauccugugcaccucccagauccugcucaugcggaccaccugggcccugugcgagagcaucacgcuggccaccggcccccucaccacccugugggagggguccccgggcaaguucuggaacacgaccaucgccgucagcauggccaacaucuuccgcggguccuaccuggcgggcgccggccucgccuucagccugaugaagucccucgggggcgggcggcgcgggaccggggcccagggcgagacccucggcgagaaguggaagcggcagcugaaccagcuguccaagagcgaguucaacacguacaagcgcuccgggaucauggagguggaccggagcgaggcgaaggagggccucaagcgcggggagaccaccaagcacgccgugucccggggcaccgccaagcugcgcugguucgucgagcggaaccuggugaagcccgaggggaaggugaucgaccugggcugcggccgcgggggcuggagcuacuacugcgccgggcucaagaaggucacggaggugaagggcuacaccaagggcgggcccggccacgaggagcccaucccgauggccaccuacggguggaaccuggugaagcugcacuccggcaaggacgucuucuucaucccgcccgagaagugcgacacccuccugugcgacaucggggagagcucccccaacccgacgaucgaggagggccggacccugcgcgugcucaagaugguggagcccuggcugcgggggaaccaguucugcaucaagauccugaaccccuacaugcccagcgucguggagacccucgagcagaugcagcgcaagcacggcggcaugcuggugcggaacccgcugucccgcaacagcacccacgagauguacugggucuccugcgggaccggcaacaucgugagcgcggugaacaugacgucccggaugcuccugaaccgcuucaccauggcccaccgcaagcccaccuacgagcgggacgucgaccugggggccggcacccgccacguggccguggagcccgaggucgccaaccucgacaucaucggccagcggaucgagaacaucaagcacgagcacaagagcacguggcacuacgacgaggacaaccccuacaagaccugggcguaccacggguccuacgaggugaagccgagcggcuccgccagcagcauggucaacgggguggugaagcugcugaccaagcccugggacgucauccccauggugacccagaucgccaugacggacaccacccccuucggccagcagcgcguguucaaggagaaggucgacacccggacgccgaaggccaagcgcgggaccacccagaucauggaggugaccgcccgguggcucuggggcuuccugucccgcaacaagaagccccggaucugcacgcgcgaggaguucauccggaaggugcgcagcaacgcggccaucggcgccgucuucguggacgagaaccaguggaacuccgccaaggaggcgguggaggacgagcgguucugggaccugguccaccgcgagcgggagcuccacaagcaggggaagugcgcgaccugcguguacaacaugaugggcaagcgcgagaagaagcugggggaguucggcaaggccaaggggagccgggccaucugguacauguggcugggcgcccgcuuccucgaguucgaggcgcugggcuucaugaacgaggaccacugguucucccgggagaacagccuguccgggguggagggcgaggggcuccacaagcugggcuacauccugcgcgacaucagcaagauccccgggggcaacauguacgccgacgacaccgccggcugggacacccggaucacggaggacgaccuccagaacgaggccaagaucaccgacaucauggagccggagcacgcccugcuggcgaaggccaucuucaagcucaccuaccagaacaaggucgugcgcgugcagcgccccgccaagaacgggaccgucauggacgugaucucccggcgcgaccagcggggcagcggccagguggggacguacggccugaacaccuucaccaacauggaggcccagcugauccgccagauggaguccgaggggaucuucagccccuccgagcucgagacccccaaccuggccgagcggguccuggacuggcucgagaaguacggcguggagcgccugaagcggauggcgaucagcggggacgacugcguggucaagccgaucgacgaccgcuucgccacggcccugaccgcccucaacgacaugggcaaggugcggaaggacaucccccagugggagcccuccaagggguggaacgacuggcagcagguccccuucugcagccaccacuuccaccagcugaucaugaaggacggccgcgagaucgucgugccgugccggaaccaggacgagcuggugggccgcgcccgggucucccagggggcgggcuggagccuccgcgagaccgccugccugggcaagagcuacgcccagauguggcagcugauguacuuccaccggcgcgaccuccggcuggccgcgaacgccaucugcuccgccgugcccguggacuggguccccaccagccgcacgaccugguccauccacgcccaccaccaguggaugaccaccgaggacaugcugagcguguggaaccggguguggaucgaggagaaccccuggauggaggacaaggcccacgucuccagcugggaggacgugccguaccucggcaagcgcgaggaccaguggugcgggucccugaucggccugacggcgcgcgccaccugggccaccaacauccagguggccaucaaccagguccggcgccucaucggcaacgagaacuaccuggacuacaugaccagcaugaagcgguucaagaacgaguccgaccccgagggggcccugugguga

SEQ ID NO: 8900 - RNA, 9879 nt, Artificial Sequence
  derived and/or modified CDS sequence (opt1) from DENV-1__KC762629__SS-prME
agcgugaccaugcugcucaugcugaugcccaccgcccuggccuuccaccucaccacccggggcggggagccccacaugguggugagcaagcaggagcggggcaagagccugcuguucaagaccagcgcgggggugaacaugugcacccucaucgccauggaccugggcgagcugugcgaggacacgcucaccuacaagugcccccggaucaccgaggccgagcccgacgacgucgacugcuggugcaacgccaccgacaccugggugaccuacgggaccugcagccagaccggcgagcaccggcgggacaagcgguccguggcccuggcgccccacgucggccuggggcucgagacgcgcaccgagaccuggaugagcuccgagggcgccuggcggcagauccagcggguggagaccugggcccugcggcaccccggguucacggugaucgcccuguuccucgcgcacgccaucggcaccagcaucacccagaaggggaucaucuucauccugcugaugcucgucacccccuccauggccaugcgcugcgugggcaucggcagccgggacuucguggaggggcuguccggcgccacgugggucgacguggugcuggagcacgggagcugcgucaccaccauggccaaggacaagcccacccucgacaucgagcugcugaagacggaggugaccaaccccgcggugcuccgcaagcugugcaucgaggccaagaucuccaacaccaccacggacagccggugcccgacccagggcgaggccacccuggucgaggagcaggacgccaacuucgugugccgccggaccuucguggaccgcggcugggggaacggcugcgggcuguucggcaaggggucccugaucacgugcgccaaguucaagugcgucaccaagcuggagggcaagaucgugcaguacgagaaccucaaguacagcgugaucgucaccgugcacaccggcgaccagcaccaggucgggaacgaguccacggagcacggcaccaccgcgaccaucacgccccaggcccccacgaccgagauccagcugaccgacuacggggcccugacccucgacugcagcccccggacgggccuggacuucaacgagauggugcugcucaccaugaaggagaaguccuggcuggugcacaagcagugguuccuggaccucccccugcccuggaccagcggggccagcaccucccaggagacguggaaccgccaggaccugcucgucaccuucaagaccgcccacgcgaagaagcaggagguggugguccugggcagccaggagggcgccaugcacaccgcccugacgggggccaccgagauccagaccuccggcaccacgaccaucuucgccgggcaccucaagugccggcugaagauggacaagcugacccucaagggcaugagcuacgugaugugcaccggguccuucaagcuggagaaggagguggcggagacgcagcacggcaccguccuggugcagaucaaguacgagggcaccgacgcccccugcaagauccccuucagcacccaggacgagaagggggugacgcagaacggccgccugaucaccgccaacccgaucgucaccgacaaggagaagcccgugaacaucgaggccgagccgcccuucggggaguccuacaucgugaucggcgcgggcgagaagacccucaagcugagcugguucaagaagggguccagcaucggcaagauguucgaggccacggcccgcggggcccgccgcauggccauccugggcgacaccgcgugggacuucggguccaucggcggcgucuucaccagcguggggaagcucgugcaccagaucuucggcaccgccuacgggguccuguucuccggcgugagcuggacgaugaagaucgggaucggcgugcugcucaccuggcugggccugaacucccggagcaccucccucagcaugaccugcaucgccgucgggcuggugacgcuguaccucggcgugaugguccaggccgacuccgggugcgugaucaacuggaagggccgcgagcugaagugcgggagcggcaucuucgugaccaacgagguccacaccuggaccgagcaguacaaguuccaggccgacagcccgaagcggcuguccgcggccaucggcaaggccugggaggagggggugugcggcauccgcagcgccacccggcucgagaacaucauguggaagcagaucuccaacgagcugaaccacauccugcucgagaacgacaugaaguucacgguggucgugggggacguggccggcauccuggcgcaggggaagaagaugauccgcccccagcccauggagcacaaguacagcuggaaguccuggggcaaggccaagaucaucggcgccgacguccagaacaccaccuucaucaucgacgggcccaacaccccggagugccccgacgaccagcgggccuggaacaucugggagguggaggacuacggcuucgggaucuucacgaccaacaucuggcugaagcuccgcgacagcuacacccaggugugcgaccaccggcugauguccgcggccaucaaggacagcaaggccguccacgccgacaugggcuacuggaucgaguccgagaagaacgagaccuggaagcuggcccgcgcgagcuucaucgaggugaagacgugcaucuggcccaagucccacacccucuggagcaacggcgugcuggaguccgagaugaucauccccaagaucuacgggggcccgaucagccagcacaacuaccggcccggguacuucacccagaccgccggccccuggcaccuggggaagcucgagcuggacuucaaccugugcgagggcacgaccgucgugguggacgagcacugcggcaaccgcgggccgucccuccggaccaccacggucaccggcaagaucauccacgaguggugcugccgcagcugcacccugccgccccugcgguuccgcggggaggacggcugcugguacgggauggagauccggcccgugaaggagaaggaggagaaccucgugaaguccauggucagcgccggcagcggcgagguggacuccuucagccuggggcugcucugcaucuccaucaugaucgaggaggugaugcgcagccgguggucccgcaagaugcugaugaccggcacgcuggccgucuucuuccuccugaucauggggcagcugaccuggaacgaccucauccgccugugcaucauggugggcgccaacgcgagcgaccggauggggaugggcaccaccuaccuggcccucauggccacguucaagaugcgcccgauguucgccgugggccugcuguuccggcgccucaccucccgggagguccugcugcucaccaucgggcugagccugguggccuccgucgagcuccccaacagccuggaggagcugggcgacgggcucgcgaugggcaucaugauccugaagcugcucaccgacuuccagucccaccagcugugggccacgcugcucagccugaccuucaucaagaccaccuucucccugcacuacgccuggaagacgauggccauggugcucagcaucgugucccuguucccccugugccucagcaccaccucccagaagaccacguggcugcccguccugcucggcagccuggggugcaagccgcugaccauguuccucaucgcggagaacaagaucuggggccgcaaguccuggccccugaacgaggggaucauggccgugggcaucgugagcauccugcucagcucccugcugaagaacgacgucccccucgccgggccccugaucgccggcggcaugcugaucgccugcuacgugaucagcggguccagcgcggaccucucccuggagaaggccgccgaggugagcugggaggaggaggccgagcacuccggcgccagccacaacauccuggucgaggugcaggacgacgggaccaugaagaucaaggacgaggagcgggacgacacccucaccauccugcugaaggcgacgcuccuggccguguccggcgucuacccgcugagcauccccgccacccucuucgugugguacuucuggcagaagaagaagcagcgcuccggggugcugugggacacccccagcccgcccgaggucgagcgggccgugcuggacgacggcaucuaccgcaucaugcagcggggccugcucgggcgcucccaggugggcgucgggguguuccaggagaacguguuccacaccauguggcacgucacgcggggcgccgugcugauguaccaggggaagcgccuggagcccagcugggcguccgugaagaaggaccucaucagcuacggcggcggguggcggcugcagggcuccuggaacaccggggaggagguccaggugaucgccguggagcccggcaagaaccccaagaacguccagaccgcccccgggaccuucaagacgcccgagggcgaggugggcgccaucgcccuggacuucaagcccgggaccagcggcucccccaucgugaaccgcgaggggaagaucgucggccucuacggcaacgggguggugaccaccagcggcacguacgucagcgcgaucgcccaggccaaggccucccaggaggggccgcugcccgagaucgaggacgagguguuccggaagcgcaaccugaccaucauggaccuccaccccggcagcgggaagacccggcgcuaccugccggcgaucgugcgggaggccaucaagcgcaagcugcgcacccucauccuggcccccacgcgggucguggccuccgagauggccgaggcgcugaagggcaugcccauccgcuaccagaccaccgccgucaagagcgagcacaccggcaaggagaucgucgaccucaugugccacgccacguucaccaugcggcugcugucccccgugcgcgugccgaacuacaacaugaucaucauggacgaggcccacuucaccgaccccagcuccaucgccgcgcggggguacaucagcacccgcgucggcaugggggaggccgccgccaucuucaugacggccacgccgcccggcuccguggaggcguucccgcagagcaacgccgugauccaggacgaggagcgggacauccccgagcgcuccuggaacagcggguacgaguggaucaccgacuuccccggcaagaccgucugguucgugcccuccaucaagagcggcaacgacaucgccaacugccuccggaagaacgggaagcgcgugauccagcugucccggaagacguucgacaccgaguaccagaagaccaagaacaacgacugggacuacgucgugaccacggacaucagcgagaugggcgccaacuuccgcgcggaccgggugaucgacccgcgccggugccugaagcccgucauccucaaggacgggcccgagcgcgugauccuggccggccccaugccggucaccguggccuccgccgcccagcggcgcgggcgggugggccgcaaccacaacaaggagggcgaccaguacaucuacauggggcagccccugaacaacgacgaggaccacgcgcacuggaccgaggccaagaugcuccuggacaacaucaacacccccgagggcaucauccccgcccuguucgagccggagcgcgagaaguccgccgccaucgacggggaguaccggcuccgcggcgaggcgcggaagacguucgucgagcugaugcgccgcggggaccugcccguguggcucuccuacaagguggccagcgagggcuuccaguacagcgaccgccgguggugcuucgacggcgagcgcaacaaccagguccuggaggagaacauggacguggagaucuggaccaaggagggggagcggaagaagcugcgcccccgguggcucgacgcccgcaccuacuccgacccccuggcccugcgggaguucaaggaguucgccgcgggccgccggagcguguccggggaccucauccuggagaucggcaagcugccgcagcaccucacccagcgcgcccagaacgcccuggacaaccuggucaugcuccacaacagcgagcagggcgggcgggccuaccgccacgcgauggaggagcugcccgacacgaucgagacccugaugcuccuggcccugaucgccgugcucaccggcggggugacccuguucuuccuguccggccgggggcucggcaagaccagcaucggccugcugugcgucauggccuccagcgugcuccuguggauggccuccguggagccccacuggaucgcggccagcaucauccuggaguucuuccucaugguccugcugauccccgagccggaccgccagcggacgccccaggacaaccagcucgccuacguggugaucgggcugcuguucaugauccucaccgucgccgccaacgagaugggccugcuggagaccaccaagaaggaccucgggaucggccacguggcgguggagaaccaccaccacgccgccaugcuggacgucgaccugcaccccgccuccgccuggacgcucuacgcgguggccaccaccaucaucaccccgaugaugcgccacacgaucgagaacaccaccgccaacaucagccugaccgccaucgccaaccaggcggccauccugauggggcucgacaagggcuggcccaucuccaagauggacaucggcgugccccugcuggcccucgggugcuacagccaggucaacccccugacgcugaccgccgcggugcucaugcugguggcccacuacgccaucaucggcccggggcugcaggccaaggccacccgcgaggcgcagaagcggaccgccgccggcaucaugaagaaccccacggucgacgggaucguggccaucgaccucgaccccguggucuacgacgccaaguucgagaagcagcugggccagaucaugcugcucauccugugcaccucccagauccugcucaugcgcaccaccugggcgcugugcgagagcaucacgcuggccaccggcccccucaccacccugugggagggguccccgggcaaguucuggaacacgaccaucgccgugagcauggccaacaucuuccggggguccuaccuggccggcgcgggccucgccuucagccugaugaagucccucgggggcgggcgccgggggaccggggcccagggcgagacccucggcgagaaguggaagcgccagcugaaccagcuguccaagagcgaguucaacacguacaagcgguccgggaucauggagguggaccgcagcgaggccaaggagggccucaagcgcggggagaccaccaagcacgcggucucccgcggcaccgccaagcugcggugguucguggagcgcaaccuggugaagcccgaggggaaggucaucgaccugggcugcggccgcgggggcuggagcuacuacugcgccgggcucaagaaggugacggaggugaagggcuacaccaagggcggccccggccacgaggagcccaucccgauggccaccuacggguggaaccuggucaagcugcacuccggcaaggacguguucuucaucccgcccgagaagugcgacacccuccugugcgacaucggggagagcucccccaacccgacgaucgaggagggccgcacccugcgggugcucaagauggucgagcccuggcugcgcgggaaccaguucugcaucaagauccugaaccccuacaugcccagcgugguggagacccucgagcagaugcagcggaagcacggcggcaugcugguccgcaacccgcugucccggaacagcacccacgagauguacuggguguccugcgggaccggcaacaucgugagcgccgucaacaugacgucccgcaugcuccugaaccgcuucaccauggcgcaccggaagcccaccuacgagcgcgacguggaccugggggccggcacccggcacguggccgucgagcccgagguggccaaccucgacaucaucggccagcgcaucgagaacaucaagcacgagcacaagagcacguggcacuacgacgaggacaaccccuacaagaccugggccuaccacggguccuacgaggucaagccgagcggcuccgcgagcagcauggugaacgggguggucaagcugcugaccaagcccugggacgugauccccauggugacccagaucgccaugacggacaccacccccuucggccagcagcgggucuucaaggagaagguggacacccgcacgccgaaggccaagcgggggaccacccagaucauggaggugaccgcccgcuggcucuggggcuuccugucccggaacaagaagccccgcaucugcacgcgggaggaguucacccgcaagguccggagcaacgccgcgaucggcgccguguucguggacgagaaccaguggaacuccgccaaggaggccgucgaggacgagcgcuucugggaccuggugcaccgggagcgcgagcuccacaagcaggggaagugcgcgaccugcguguacaacaugaugggcaagcgggagaagaagcugggggaguucggcaaggccaaggggagccgcgccaucugguacauguggcugggcgcccgguuccucgaguucgaggcccugggcuucaugaacgaggaccacugguucucccgcgggaacagccuguccggcgucgagggggagggccuccacaagcugggguacauccugcgggacaucagcaagauccccggcggcaacauguacgcggacgacaccgccgggugggacacgcgcaucaccgaggacgaccuccagaacgaggccaagaucaccgacaucauggagccggagcacgcccugcuggccaaggcgaucuucaagcucaccuaccagaacaagguggugcgcguccagcggcccgccaagaacggcacggugauggacgugaucucccgccgggaccagcgcgggagcggccaggucggcaccuacgggcugaacaccuucaccaacauggaggcccagcugauccggcagauggaguccgagggcaucuucagccccuccgagcucgagacgcccaaccuggccgagcgcgugcuggacuggcucgagaaguacgggguggagcggcugaagcgcauggccaucagcggcgacgacugcgucgugaagccgaucgacgaccgguucgcgaccgcccugaccgcccucaacgacauggggaaggugcgcaaggacaucccccagugggagcccuccaagggcuggaacgacuggcagcagguccccuucugcagccaccacuuccaccagcugaucaugaaggacggccgggagaucguggugccgugccgcaaccaggacgagcuggucgggcgggcccgcgugucccagggcgccggguggagccuccgggagaccgcgugccugggcaagagcuacgcccagauguggcagcugauguacuuccaccgccgggaccuccgccuggccgccaacgcgaucugcuccgccgugcccgucgacugggugcccacgagccggaccaccugguccauccacgcccaccaccaguggaugaccacggaggacaugcugagcguguggaaccgcgucuggaucgaggagaaccccuggauggaggacaagacccacaucuccagcugggaggacgugccguaccucgggaagcgcgaggaccaguggugcggcucccugaucggccugaccgcccgggccaccugggcgaccaacauccagguggccaucaaccagguccgccggcucaucgggaacgagaacuaccuggacuacaugacgagcaugaagcgcuucaagaacgaguccgaccccgagggcgcccugugguga

SEQ ID NO: 8901 - RNA, 9879 nt, Artificial Sequence
  derived and/or modified CDS sequence (opt1) from DENV-1__KC762627__SS-prME
agcgugaccaugcugcucaugcugaugcccaccgcccuggccuuccaccucaccacccggggcggggagccccacaugaucgugagcaagcaggagcggggcaagagccugcuguucaagaccagcgccggggugaacaugugcacccucaucgccauggaccugggcgagcugugcgaggacacgcucaccuacaagugcccccgcaucaccgaggccgagcccgacgacguggacugcuggugcaacgccaccgacacgugggugaccuacgggaccugcagccagaccggcgagcaccggcgcgacaagcgguccguggcccuggcgccccacgugggccuggggcucgagacgcgcaccgagaccuggaugagcuccgagggcgccuggaagcagauccagcgggucgagaccugggcccugcgccaccccggguucacggugaucgcccuguuccucgcgcacgccaucggcaccagcaucacccagaaggggaucaucuucauccugcugaugcucgugacccccuccauggccaugcggugcgucggcaucggcagccgcgacuucguggaggggcuguccggcgccacguggguggacgucgugcuggagcacgggagcugcgugaccaccauggccaaggacaagcccacccucgacaucgagcugcugaagacggaggucaccaaccccgcggugcuccggaagcugugcaucgaggccaagaucuccaacaccaccacggacagccgcugcccgacccagggcgaggccacccugguggaggagcaggacgccaacuucgucugccggcgcaccuucguggaccggggcugggggaacggcugcgggcuguucggcaaggggucccugaucacgugcgccaaguucaagugcgugaccaagcuggagggcaagaucguccaguacgagaaccucaaguacagcgugaucgugaccguccacaccggcgaccagcaccagguggggaacgaguccacggagcacggcaccaccgcgaccaucacgccccaggcccccacgaccgagauccagcugaccgacuacggggcccugacccucgacugcagcccccgcacgggccuggacuucaacgagaugguccugcucaccaugaaggagaaguccuggcuggugcacaagcagugguuccuggaccucccccugcccuggaccagcggggccagcaccucccaggagacguggaaccggcaggaccugcucgugaccuucaagaccgcccacgcgaagaagcaggaggucguggugcugggcagccaggagggcgccaugcacaccgcccugacgggggccaccgagauccagaccuccggcaccacgaccaucuucgccgggcaccucaagugccgccugaagauggacaagcugacccucaagggcaugagcuacgucaugugcaccggguccuucaagcuggagaaggagguggcggagacgcagcacggcaccgugcugguccagaucaaguacgagggcaccgacgcccccugcaagauccccuucagcacccaggacgagaagggggugacgcagaacggccggcugaucaccgccaacccgaucgugaccgacaaggagaagcccgucaacaucgaggccgagccgcccuucggggaguccuacaucgugaucggcgcgggcgagaaggcccucaagcugagcugguucaagaagggguccagcaucggcaagauguucgaggccaccgcccgcggggcccggcgcauggcgauccugggcgacacggccugggacuucggguccaucggcggcguguucaccagcgucgggaagcucauccaccagaucuucggcaccgccuacggggugcuguucuccggcgugagcuggaccaugaagaucgggaucggcguccugcucacguggcugggccugaacucccgcagcaccucccucagcaugaccugcaucgccguggggcuggugacccuguaccucggcgucauggugcaggccgacuccgggugcgugaucaacuggaagggccgggagcugaagugcgggagcggcaucuucgucacgaacgaggugcacaccuggaccgagcaguacaaguuccaggcggacagcccgaagcgccuguccgccgccaucggcaaggccugggaggagggggugugcggcauccggagcgccacccgccucgagaacaucauguggaagcagaucuccaacgagcugaaccacauccugcucgagaacgacaugaaguucaccgucguggugggggacgucgcgggcauccuggcccaggggaagaagaugauccggccccagcccauggagcacaaguacagcuggaaguccuggggcaaggccaagaucaucggcgccgacgugcagaacacgaccuucaucaucgacgggcccaacaccccggagugccccgacgaccagcgcgcguggaacaucugggagguggaggacuacggcuucgggaucuucaccacgaacaucuggcugaagcuccgggacagcuacacccaggucugcgaccaccgccugauguccgccgccaucaaggacagcaaggccgugcacgccgacaugggcuacuggaucgaguccgagaagaacgagaccuggaagcuggcgcgggccagcuucaucgaggugaagaccugcaucuggcccaagucccacacgcucuggagcaacggcguccuggaguccgagaugaucauccccaagaucuacgggggcccgaucagccagcacaacuaccgccccggguacuucacccagaccgccggccccuggcaccuggggaagcucgagcuggacuucgaccugugcgagggcaccacggugguggucgacgagcacugcggcaaccgggggccgucccuccgcaccaccaccgugacgggcaagaucauccacgaguggugcugccggagcugcacccugccgccccugcgcuuccgcggggaggacggcugcugguacgggauggagauccgccccgugaaggagaaggaggagaaccucgucaaguccauggugagcgccggcagcggcgagguggacuccuucagccuggggcugcucugcaucuccaugaugaucgaggaggucaugcggagccgcuggucccggaagaugcugaugaccggcacccuggccguguucuuccuccugaucauggggcagcugacguggaacgaccucauccgccugugcaucauggugggcgcgaacgccagcgaccgcauggggaugggcaccaccuaccuggcccucauggccaccuucaagaugcggccgauguucgccgucggccugcuguuccgccggcucacgucccgcgaggugcugcugcucaccaucgggcugagccugguggcguccgucgagcuccccaacagccuggaggagcugggcgacgggcucgccaugggcaucaugauccugaagcugcucaccgacuuccagucccaccagcugugggccacccugcucagccugacguucaucaagaccaccuucucccugcacuacgccuggaagaccauggcgauggugcucagcaucgucucccuguucccccugugccucagcacgaccucccagaagaccaccuggcugcccgugcugcucggcagccuggggugcaagccgcugacgauguuccucaucgccgagaacaagaucuggggccggaaguccuggccccugaacgaggggaucauggccgugggcaucgucagcauccugcucagcucccugcugaagaacgacgugccccucgccgggccccugaucgccggcggcaugcugaucgcgugcuacgugaucagcggguccagcgccgaccucucccuggagaaggccgccgaggucagcugggaggaggaggccgagcacuccggcgcgagccacaacauccugguggaggugcaggacgacgggaccaugaagaucaaggacgaggagcgcgacgacacccucaccauccugcugaaggccacccuccuggccgucuccggcguguacccgcugagcauccccgccacccucuucgugugguacuucuggcagaagaagaagcagcgguccgggguccugugggacacccccagcccgcccgagguggagcgcgccgugcuggacgacggcaucuaccggaucaugcagcgcggccugcucgggcggucccaggucggcguggggguguuccaggagaacgucuuccacaccauguggcacgugacccgcggcgcggugcugauguaccaggggaagcggcuggagcccagcugggccuccgucaagaaggaccucaucagcuacggcggcggguggcgccugcagggcuccuggaacacgggggaggagguccaggugaucgccgucgagcccggcaagaaccccaagaacgugcagaccgcccccgggaccuucaagacccccgagggcgaggugggcgccaucgcgcuggacuucaagcccgggacgagcggcucccccaucgucaaccgggaggggaagaucgugggccucuacggcaacgggguggucaccaccagcggcaccuacgugagcgccaucgcccaggccaaggcgucccaggaggggccgcugcccgagaucgaggacgagguguuccgcaagcggaaccugacgaucauggaccuccaccccggcagcgggaagacccgccgguaccugccggccaucguccgcgaggccaucaagcggaagcugcgcacccucauccuggcccccacccgcgugguggccuccgagauggcggaggcccugaagggcaugcccauccgguaccagacgaccgccgucaagagcgagcacaccggcaaggagaucguggaccucaugugccacgccaccuucacgaugcgccugcugucccccgugcgggucccgaacuacaacaugaucaucauggacgaggcccacuucaccgaccccagcuccaucgcggcccgcggguacaucagcacccgggugggcaugggggaggccgccgccaucuucaugaccgcgacgccgcccggcuccguggaggccuucccgcagagcaacgccgucauccaggacgaggagcgcgacauccccgagcgguccuggaacagcggguacgaguggaucaccgacuuccccggcaagaccgugugguucgugcccuccaucaagagcggcaacgacaucgccaacugccuccgcaagaacgggaagcgggucauccagcugucccgcaagaccuucgacacggaguaccagaagaccaagaacaacgacugggacuacguggugaccaccgacaucagcgagaugggcgcgaacuuccgggccgaccgcgucaucgacccgcggcgcugccugaagcccgugauccucaaggacgggcccgagcgggugauccuggccggccccaugccggucacgguggccuccgccgcgcagcgccgggggcgcgucggccggaaccacaacaaggagggcgaccaguacaucuacauggggcagccccugaacaacgacgaggaccacgcccacuggaccgaggccaagaugcuccuggacaacaucaacacccccgagggcaucauccccgcccuguucgagccggagcgcgagaaguccgccgcgaucgacggggaguaccgccuccggggcgaggcccgcaagaccuucguggagcugaugcggcgcggggaccugcccguguggcucuccuacaaggucgccagcgagggcuuccaguacagcgaccggcgcuggugcuucgacggcgagcggaacaaccaggugcuggaggagaacauggacguggagaucuggacgaaggagggggagcgcaagaagcugcggccccgcuggcucgacgcccggaccuacuccgacccccuggcccugcgcgaguucaaggaguucgcggccggccggcgcagcgucuccggggaccucauccuggagaucggcaagcugccgcagcaccucacccagcgggcccagaacgcccuggacaaccuggugaugcuccacaacagcgagcagggcgggcgcgcguaccggcacgccauggaggagcugcccgacaccaucgagacgcugaugcuccuggcccugaucgccgugcucaccggcggggucacccuguucuuccuguccggccgcgggcucggcaagaccagcaucggccugcugugcgugauggccuccagcgugcuccuguggauggcguccgucgagccccacuggaucgccgccagcaucauccuggaguucuuccucauggugcugcugauccccgagccggaccggcagcgcacgccccaggacaaccagcucgccuacguggucaucgggcugcuguucaugauccucacgguggccgcgaacgagaugggccugcuggagaccaccaagaaggaccucgggaucggccacguggccgucgagaaccaccaccacgccgccaugcuggacguggaccugcaccccgccuccgcguggacccucuacgccguggccacgaccaucaucaccccgaugaugcggcacaccaucgagaacacgaccgccaacaucagccugaccgccaucgcgaaccaggccgccauccugauggggcucgacaagggcuggcccaucuccaagauggacaucggcgucccccugcuggcccucgggugcuacagccaggugaacccccugacccugacggcggccgugcucaugcuggucgcccacuacgccaucaucggcccggggcugcaggccaaggcgacccgcgaggcccagaagcgcaccgccgccggcaucaugaagaaccccaccguggacgggaucguggccaucgaccucgaccccgucguguacgacgcgaaguucgagaagcagcugggccagaucaugcugcucauccugugcacgucccagauccugcucaugcggaccaccugggcccugugcgagagcaucacccuggccacgggcccccucaccacccugugggagggguccccgggcaaguucuggaacaccacgaucgccgugagcauggccaacaucuuccgcggguccuaccuggcgggcgccggccucgccuucagccugaugaagucccucgggggcgggcggcgcgggaccggggcccagggcgagacccucggcgagaaguggaagcggcagcugaaccagcuguccaagagcgaguucaacaccuacaagcgcuccgggaucauggaggucgaccggagcgaggcgaaggagggccucaagcgcggggagacgaccaagcacgccgugucccggggcaccgccaagcugcgcugguucguggagcggaaccuggucaagcccgaggggaaggugaucgaccugggcugcggccgcgggggcuggagcuacuacugcgccgggcucaagaaggugaccgaggucaagggcuacacgaagggcggccccggccacgaggagcccaucccgauggccaccuacggguggaaccuggugaagcugcacuccggcaaggacguguucuucaucccgcccgagaagugcgacacccuccugugcgacaucggggagagcucccccaacccgaccaucgaggagggccggacgcugcgcguccucaagaugguggagcccuggcugcgggggaaccaguucugcaucaagauccugaaccccuacaugcccagcguggucgagacccucgagcagaugcagcgcaagcacggcggcaugcuggugcggaacccgcugucccgcaacagcacccacgagauguacuggguguccugcgggaccggcaacaucgucagcgcggugaacaugaccucccggaugcuccugaaccgcuucacgauggcccaccgcaagcccaccuacgagcgggacguggaccugggggccggcacccgccacgucgccguggagcccgagguggccaaccucgacaucaucggccagcggaucgagaacaucaagcacgagcacaagagcaccuggcacuacgacgaggacaaccccuacaagacgugggcguaccacggguccuacgaggucaagccgagcggcuccgccagcagcauggugaacggggucgugaagcugcugaccaagcccugggacgugauccccauggucacccagaucgccaugaccgacacgacccccuucggccagcagcgcguguucaaggagaagguggacacccggaccccgaaggccaagcgcgggacgacccagaucauggaggucaccgcccgguggcucugguccuuccugagccgcaacaagaagccccggaucugcacccgcgaggaguucacgcggaaggugcgcuccaacgcggccaucggcgccguguucgucgacgagaaccaguggaacagcgccaaggaggcgguggaggacgagcgguucugggaccuggugcaccgcgagcgggagcuccacaagcagggcaagugcgcgaccugcgucuacaacaugauggggaagcgcgagaagaagcugggcgaguucgggaaggccaagggcucccgggccaucugguacauguggcugggggcccgcuuccucgaguucgaggcgcugggcuucaugaacgaggaccacugguucagccgggagaacucccugagcggcguggagggggagggccuccacaagcugggguacauccugcgcgacaucuccaagauccccggcgggaacauguacgccgacgacaccgccggcugggacacccggaucacggaggacgaccuccagaacgaggccaagaucaccgacaucauggagccggagcacgcccugcuggcgaaggccaucuucaagcucaccuaccagaacaaggugguccgcgugcagcgccccgccaagaacggcaccgugauggacgucaucagccggcgcgaccagcggggguccggccagguggggacguacggccugaacaccuucaccaacauggaggcccagcugauccgccagauggagagcgagggcaucuucucccccagcgagcucgagaccuccaaccuggccgagcgggugcuggacuggcucgagaaguacggggucgagcgccugaagcggauggcgaucagcggcgacgacugcguggugaagcccaucgacgaccgcuucgccacggcccugaccgcccucaacgacauggggaagguccggaaggacaucccgcagugggagcccuccaagggcuggaacgacuggcagcagguccccuucugcagccaccacuuccaccagcugaucaugaaggacgggcgcgagaucgugguccccugccggaaccaggacgagcuggugggccgcgcccgggugagccagggcgcgggguggucccuccgcgagaccgccugccugggcaagagcuacgcccagauguggcagcugauguacuuccaccggcgcgaccuccggcuggccgcgaacgccaucugcuccgccgucccgguggacugggugcccaccagccgcacgaccugguccauccacgcccaccaccaguggaugaccaccgaggacaugcugagcgucuggaaccggguguggaucgaggagaaccccuggauggaggacaagacgcacaucuccagcugggaggacgugcccuaccucgggaagcgcgaggaccaguggugcggcucccugaucgggcugaccgcccgcgcgaccugggccaccaacauccaggucgccaucaaccaggugcggcgccucaucggcaacgagaacuaccuggacuacaugaccagcaugaagcgguucaagaacgaguccgacccggagggcgcccugugguga

SEQ ID NO: 8902 - RNA, 9879 nt, Artificial Sequence
  derived and/or modified CDS sequence (opt1) from DENV-1__KC762647__SS-prME
agcgugaccaugcugcucaugcugacccccaccgcccuggccuuccaccucaccacccggggcggggagccccacaugaucgugagcaagcaggagcggggcaagagccugcuguucaagaccagcgccggggugaacaugugcacccucaucgccauggaccugggcgagcugugcgaggacacccucaccuacaagugcccccgcaucaccgaggccgagcccgacgacguggacugcuggugcaacgccacggacaccugggugaccuacgggaccugcagccagacgggcgagcaccggcgcgacaagcgguccguggcccuggcgccccacgugggccuggggcucgagacccgcaccgagaccuggaugagcuccgagggcgccuggaagcagauccagcgggucgagacgugggcccugcgccaccccggguucaccgugaucgcccuguuccucgcgcacgccaucggcaccagcaucacccagaaggggaucaucuucauccugcugaugcucgugacgcccuccauggccaugcggugcgucggcaucggcagccgcgacuucguggaggggcuguccggcgccaccuggguggacgucgugcuggagcacgggagcugcgugaccaccauggccaaggacaagcccacgcucgacaucgagcugcugaagaccgaggucaccaaccccgcggugcuccggaagcugugcaucgaggccaagaucuccaacaccacgaccgacagccgcugcccgacccagggcgaggccacccugguggaggagcaggacgccaacuucgucugccggcgcacguucguggaccggggcugggggaacggcugcgggcuguucggcaaggggucccugaucacgugcgccaaguucaagugcgugaccaagcuggagggcaagaucguccaguacgagaaccucaaguacagcgugaucgugaccguccacacgggcgaccagcaccagguggggaacgaguccaccgagcacggcaccaccgcgaccaucacgccccaggcccccaccaccgagauccagcugaccgacuacggggcccugacgcucgacugcagcccccgcaccggccuggacuucaacgagaugguccugcucaccaugaaggagaaguccuggcuggugcacaagcagugguuccuggaccucccccugcccuggaccagcggggccagcacgucccaggagaccuggaaccggcaggaccugcucgugaccuucaagaccgcccacgcgaagaagcaggaggucguggugcugggcagccaggagggcgccaugcacacggcccugaccggggccaccgagauccagaccuccggcacgaccaccaucuucgccgggcaccucaagugccgccugaagauggacaagcugacccucaagggcaugagcuacgucaugugcacgggguccuucaagcuggagaaggagguggcggagacccagcacggcaccgugcugguccagaucaaguacgagggcaccgacgcccccugcaagauccccuucagcacgcaggacgagaagggggugacccagaacggccggcugaucaccgccaacccgaucgugaccgacaaggagaagcccgucaacaucgaggccgagccgcccuucggggaguccuacaucgugaucggcgcgggcgagaaggcccucaagcugagcugguucaagaagggguccagcaucggcaagauguucgaggccacggcccgcggggcccggcgcauggcgauccugggcgacaccgccugggacuucggguccaucggcggcguguucaccagcgucgggaagcucgugcaccagaucuucggcaccgccuacggggugcuguucuccggcgucagcuggacgaugaagaucgggaucggcgugcugcucaccuggcugggccugaacucccgcagcaccucccucagcaugaccugcaucgccguggggcuggucacgcuguaccucggcgugauggugcaggccgacuccgggugcgucaucaacuggaagggccgggagcugaagugcgggagcggcaucuucgugaccaacgaggugcacaccuggaccgagcaguacaaguuccaggcggacagcccgaagcgccuguccgccgccaucggcaaggccugggaggagggggucugcggcauccggagcgccacccgccucgagaacaucauguggaagcagaucuccaacgagcugaaccacauccugcucgagaacgacaugaaguucacggugguggucggggacguggcgggcauccuggcccaggggaagaagaugauccggccccagcccauggagcacaaguacagcuggaaguccuggggcaaggccaagaucaucggcgccgacgugcagaacaccaccuucaucaucgacgggcccaacaccccggagugccccgacgaccagcgcgcguggaacaucugggaggucgaggacuacggcuucgggaucuucacgaccaacaucuggcugaagcuccgggacagcuacacccaggugugcgaccaccgccugauguccgccgccaucaaggacagccgggccgugcacgccgacaugggcuacuggaucgaguccgagaagaacgagaccuggaagcuggcgcgcgccagcuucaucgaggucaagacgugcguguggcccaagucccacacccucuggagcaacggcgugcuggaguccgagaugaucauccccaagaucuacgggggcccgaucagccagcacaacuaccggcccggguacuucacccagaccgccggccccuggcaccuggggaagcucgagcuggacuucgaccugugcgagggcacgaccgucgugguggacgagcacugcggcaaccgcgggccgucccuccggaccaccacggucaccggcaagaucauccacgaguggugcugccgcagcugcacccugccgccccugcgguuccgcggggaggacggcugcugguacgggauggagauccggcccgugaaggagaaggaggagaaccucgugaaguccauggucagcgccggcagcggcgagguggacuccuucagccuggggcugcucugcaucuccaucaugaucgaggaggugaugcgcagccgguggucccgcaagaugcugaugaccggcacgcuggccgucuucuuccuccugaucauggggcagcugaccuggaacgaccucauccgccugugcaucauggugggcgcgaacgccagcgaccggauggggaugggcaccaccuaccuggcccucauggccacguucaagaugcgcccgauguucgccguggggcugcuguuccggcgccucaccucccgggagguccugcugcucaccaucgggcugagccugguggcguccgucgagcuccccaacagccuggaggagcugggcgacgggcucgccaugggcaucaugauccugaagcugcucaccgacuuccagucccaccagcugugggccacgcugcucagccugaccuucaucaagaccaccuucucccugcacuacgccuggaagacgauggcgauggugcucagcaucgugucccuguucccccugugccucagcaccaccucccagaagaccacguggcugcccguccugcucggcagccuggggugcaagccgcugaccauguuccucaucgccgagaacaagaucuggggccgcaaguccuggccccugaacgaggggaucauggccgugggcaucgugagcauccugcucagcucccugcugaagaacgacgucccccucgccgggccccugaucgccggcggcaugcugaucgcgugcuacgugaucagcggguccagcgccgaccucucccuggagaaggccgccgaggugagcugggaggaggaggccgagcacuccggcgcgagccacaacauccuggucgaggugcaggacgacgggaccaugaagaucaaggacgaggagcgggacgacacccucaccauccugcugaaggccacgcuccuggccguguccggcgucuacccgcugagcauccccgccacccucuucgugugguacuucuggcagaagaagaagcagcgcuccggggugcugugggacacccccagcccgcccgaggucgagcgggccgugcuggacgacggcaucuaccgcaucaugcagcggggccugcucgggcgcucccaggugggcgucgggguguuccaggagaacguguuccacaccauguggcacgucacgcggggcgcggugcugauguaccaggggaagcgccuggagcccagcugggccuccgugaagaaggaccucaucagcuacggcggcggguggcggcugcagggcuccuggaacaccggggaggagguccaggugaucgccguggagcccggcaagaaccccaagaacguccagaccgcccccgggaccuucaagacgcccgagggcgaggugggcgccaucgcgcuggacuucaagcccgggaccagcggcucccccaucgugaaccgcgaggggaagaucgucggccucuacggcaacgggguggugaccaccagcggcacguacgucagcgccaucgcccaggccaaggcgucccaggaggggccgcugcccgagaucgaggacgagguguuccggaagcgcaaccugaccaucauggaccuccaccccggcagcgggaagacccggcgcuaccugccggccaucgugcgggaggccaucaagcgcaagcugcgcacccucauccuggcccccacgcgggucguggccuccgagauggcggaggcccugaagggcaugcccauccgcuaccagaccaccgccgucaagagcgagcacaccggcaaggagaucgucgaccucaugugccacgccacguucaccaugcggcugcugucccccgugcgcgugccgaacuacaacaugaucaucauggacgaggcccacuucaccgaccccagcuccaucgcggcccggggguacaucagcacccgcgucggcaugggggaggccgccgccaucuucaugacggcgacgccgcccggcuccguggaggccuucccgcagagcaacgccgugauccaggacgaggagcgggacauccccgagcgcuccuggaacagcggguacgaguggaucaccgacuuccccggcaagaccgucugguucgugcccuccaucaagagcggcaacgacaucgccaacugccuccggaagaacgggaagcgcgugauccagcugucccggaagacguucgacaccgaguaccagaagaccaagaacaacgacugggacuacgucgugaccacggacaucagcgagaugggcgcgaacuuccgcgccgaccgggugaucgacccgcgccggugccugaagcccgucauccucaaggacgggcccgagcgcgugauccuggccggccccaugccggucaccguggccuccgccgcgcagcggcgcgggcgggugggccgcaaccacaacaaggagggcgaccaguacaucuacauggggcagccccugaacaacgacgaggaccacgcccacuggaccgaggccaagaugcuccuggacaacaucaacacccccgagggcaucauccccgcccuguucgagccggagcgcgagaaguccgccgcgaucgacggggaguaccggcuccgcggcgaggcccggaagacguucgucgagcugaugcgccgcggggaccugcccguguggcucuccuacaagguggccagcgagggcuuccaguacagcgaccgccgguggugcuucgacggcgagcgcaacaaccagguccuggaggagaacauggacguggagaucuggaccaaggagggggagcggaagaagcugcgcccccgguggcucgacgcccgcaccuacuccgacccccuggcccugcgggaguucaaggaguucgcggccggccgccggagcguguccggggaccucauccuggagaucggcaagcugccgcagcaccucacccagaaggcccagaacgcccuggacaaccuggucaugcuccacaacagcgagcagggcgggcgcgcguaccggcacgccauggaggagcugcccgacacgaucgagacccugaugcuccuggcccugaucgccgugcucaccggcggggugacccuguucuuccuguccggccgcgggcucggcaagaccagcaucggccugcugugcgucauggccuccagcgugcuccuguggauggcguccguggagccccacuggaucgccgccagcaucauccuggaguucuuccucaugguccugcugauccccgagccggaccggcagcgcacgccccaggacaaccagcucgccuacguggugaucgggcugcuguucaugauccucaccgucgccgcgaacgagaugggccugcuggagaccaccaagaaggaccucgggaucggccacguggccguggagaaccaccaccacgccgccaugcuggacgucgaccugcaccccgccuccgcguggacgcucuacgccguggccaccaccaucaucaccccgaugaugcggcacacgaucgagaacaccaccgccaacaucagccugaccgccaucgcgaaccaggccgccauccugauggggcucgacaagggcuggcccaucuccaagauggacaucggcgugccccugcuggcccucgggugcuacagccaggucaacccccugacgcugaccgcggccgugcucaugcugguggcccacuacgccaucaucggcccggggcugcaggccaaggcgacccgcgaggcccagaagcgcaccgccgccggcaucaugaagaaccccacggucgacgggaucguggccaucgaccucgaccccguggucuacgacgcgaaguucgagaagcagcugggccagaucaugcugcucauccugugcaccucccagauccugcucaugcggaccaccugggcccugugcgagagcaucacgcuggccaccggcccccucaccacccugugggagggguccccgggcaaguucuggaacacgaccaucgccgugagcauggccaacaucuuccgcggguccuaccuggcgggcgccggccucgccuucagccugaugaagucccucgggggcgggcggcgcgggaccggggcccagggcgagacccucggcgagaaguggaagcggcagcugaaccagcuguccaagagcgaguucaacacguacaagcgcuccgggaucauggagguggaccggagcgaggcgaaggagggccucaagcgcggggagaccaccaagcacgccgucucccggggcaccgccaagcugcgcugguucguggagcggaaccuggugaagcccgaggggaaggucaucgaccugggcugcggccgcgggggcuggagcuacuacugcgccgggcucaagaaggugacggaggugaagggcuacaccaagggcgggcccggccacgaggagcccaucccgauggccaccuacggguggaaccuggucaagcugcacuccggcaaggacguguucuucaucccgcccgagaagugcgacacccuccugugcgacaucggggagagcucccccaacccgacgaucgaggagggccggacccugcgcgugcucaagauggucgagcccuggcugcgggggaaccaguucugcaucaaggugcugaaccccuacaugcccagcguggucgagacccucgagcagaugcagcgcaagcacggcggcaugcuggugcggaacccgcugucccgcaacagcacccacgagauguacuggguguccugcgggaccggcaacaucgucagcgcggugaacaugacgucccggaugcuccugaaccgcuucaccauggcccaccgcaagcccaccuacgagcgggacguggaccugggggccggcacccgccacgucgccguggagcccgaggucgccaaccucgacaucaucggccagcggaucgagaacaucaagcacgagcacaagagcacguggcacuacgacgaggacaaccccuacaagaccugggcguaccacggguccuacgaggugaagccgagcggcuccgccagcagcauggugaacggggucgugaagcugcugaccaagcccugggacgugauccccauggucacccagaucgccaugacggacaccacccccuucggccagcagcgcguguucaaggagaagguggacacccggacgccgaaggccaagcgcgggaccacccagaucauggaggucaccgcccgguggcucuggggcuuccugucccgcaacaagaagccccggaucugcacgcgcgaggaguucacccggaaggugcgcagcaacgcggccaucggcgccguguucgucgacgagaaccaguggaacuccgccaaggaggcgguggaggacgagcgguucugggaccuggugcaccgcgagcgggagcuccacaagcaggggaagugcgcgaccugcgucuacaacaugaugggcaagcgcgagaagaagcugggggaguucggcaaggccaaggggagccgggccaucugguacauguggcugggcgcccgcuuccucgaguucgaggcgcugggcuucaugaacgaggaccacugguucucccgggagaacagccuguccgggguggagggcgaggggcuccacaagcugggcuacauccugcgcgacaucagcaagauccccgggggcaacauguacgccgacgacaccgccggcugggacacgcggaucaccgaggacgaccuccagaacgaggccaagaucaccgacaucauggagccggagcacgcccugcuggcgaaggccaucuucaagcucaccuaccagaacaaggugguccgcgugcagcgccccgccaagaacgggacggugauggacgucaucucccggcgcgaccagcggggcagcggccaggugggcaccuacggccugaacaccuucaccaacauggaggcccagcugauccgccagauggaguccgaggggaucuucagccccuccgagcucgagacgcccaaccuggccgagcgggugcuggacuggcucgagaaguacggcgucgagcgccugaagcggauggcgaucagcggggacgacugcguggugaagccgaucgacgaccgcuucgccaccgcccugaccgcccucaacgacaugggcaagguccggaaggacaucccccagugggagcccuccaagggguggaacgacuggcagcagguccccuucugcagccaccacuuccaccagcugaucaugaaggacggccgcgagaucguggucccgugccggaaccaggacgagcuggugggccgcgcccgggugucccagggggcgggcuggagccuccgcgagcccgccugccugggcaagagcuacgcccagauguggcagcugauguacuuccaccggcgcgaccuccggcuggccgcgaacgccaucugcuccgccguccccguggacugggugcccaccagccgcacgaccugguccauccacgcccaccaccaguggaugaccaccgaggacaugcugagcgucuggaaccggguguggaucgaggagaacccguggauggaggacaagacgcacaucuccagcugggaggacgugcccuaccucggcaagcgcgaggaccaguggugcgggucccugaucggccugaccgcccgcgcgaccugggccaccaacauccaggucgccaucaaccaggugcggcgccucaucggcaacgagaacuaccuggacuacaugaccagcaugaagcgguucaagaacgaguccgaccccgagggggcccugugguga

SEQ ID NO: 8903 - RNA, 9879 nt, Artificial Sequence
  derived and/or modified CDS sequence (opt1) from DENV-1__KC762639__SS-prME
agcgugaccaugcugcucaugcugacccccaccgcccuggccuuccaccucaccacccggggcggggagccccacaugaucgugagcaagcaggagcggggcaagagccugcuguucaagaccagcgccggggugaacaugugcacccucaucgccauggaccugggcgagcugugcgaggacacccucaccuacaagugcccccgcaucaccgaggccgagcccgacgacguggacugcuggugcaacgccacggacaccugggugaccuacgggaccugcagccagacgggcgagcaccggcgcgacaagcgguccguggcccuggcgccccacgugggccuggggcucgagacccgcaccgagaccuggaugagcuccgagggcgccuggaagcagauccagcgggucgagacgugggcccugcgccaccccggguucaccgugaucgcccuguuccucgcgcacgccaucggcaccagcaucacccagaaggggaucaucuucauccugcugaugcucgugacgcccuccauggccaugcggugcgucggcaucggcagccgcgacuucguggaggggcuguccggcgccaccuggguggacgucgugcuggagcacgggagcugcgugaccaccauggccaaggacaagcccacgcucgacaucgagcugcugaagaccgaggucaccaaccccgcggugcuccggaagcugugcaucgaggccaagaucuccaacaccacgaccgacagccgcugcccgacccagggcgaggccacccugguggaggagcaggacgccaacuucgucugccggcgcacguucguggaccggggcugggggaacggcugcgggcuguucggcaaggggucccugaucacgugcgccaaguucaagugcgugaccaagcuggagggcaagaucguccaguacgagaaccucaaguacagcgugaucgugaccguccacacgggcgaccagcaccagguggggaacgaguccaccgagcacggcaccaccgcgaccaucacgccccaggcccccaccaccgagauccagcugaccgacuacggggcccugacgcucgacugcagcccccgcaccggccuggacuucaacgagaugguccugcucaccaugaaggagaaguccuggcuggugcacaagcagugguuccuggaccucccccugcccuggaccagcggggccagcacgucccaggagaccuggaaccggcaggaccugcucgugaccuucaagaccgcccacgcgaagaagcaggaggucguggugcugggcagccaggagggcgccaugcacacggcccugaccggggccaccgagauccagaccuccggcacgaccaccaucuucgccgggcaccucaagugccgccugaagauggacaagcugacccucaagggcaugagcuacgucaugugcacgggguccuucaagcuggagaaggagguggcggagacccagcacggcaccgugcugguccagaucaaguacgagggcaccgacgcccccugcaagauccccuucagcacgcaggacgagaagggggugacccagaacggccggcugaucaccgccaacccgaucgugaccgacaaggagaagcccgucaacaucgaggccgagccgcccuucggggaguccuacaucgugaucggcgcgggcgagaaggcccucaagcugagcugguucaagaagggguccagcaucggcaagauguucgaggccacggcccgcggggcccggcgcauggcgauccugggcgacaccgccugggacuucggguccaucggcggcguguucaccagcgucgggaagcucgugcaccagaucuucggcaccgccuacggggugcuguucuccggcgucagcuggacgaugaagaucgggaucggcgugcugcucaccuggcugggccugaacucccgcagcaccucccucagcaugaccugcaucgccguggggcuggucacgcuguaccucggcgugauggugcaggccgacuccgggugcgucaucaacuggaagggccgggagcugaagugcgggagcggcaucuucgugaccaacgaggugcacaccuggaccgagcaguacaaguuccaggcggacagcccgaagcgccuguccgccgccaucggcaaggccugggaggagggggucugcggcauccggagcgccacccgccucgagaacaucauguggaagcagaucuccaacgagcugaaccacauccugcucgagaacgacaugaaguucacggugguggucggggacguggcgggcauccuggcccaggggaagaagaugauccggccccagcccauggagcacaaguacagcuggaaguccuggggcaaggccaagaucaucggcgccgacgugcagaacaccaccuucaucaucgacgggcccaacaccccggagugccccgacgaccagcgcgcguggaacaucugggaggucgaggacuacggcuucgggaucuucacgaccaacaucuggcugaagcuccgggacagcuacacccaggugugcgaccaccgccugauguccgccgccaucaaggacagccgggccgugcacgccgacaugggcuacuggaucgaguccgagaagaacgagaccuggaagcuggcgcgcgccagcuucaucgaggucaagacgugcguguggcccaagucccacacccucuggagcaacggcgugcuggaguccgagaugaucauccccaagaucuacgggggcccgaucagccagcacaacuaccggcccggguacuucacccagaccgccggccccuggcaccuggggaagcucgagcuggacuucgaccugugcgagggcacgaccgucgugguggacgagcacugcggcaaccgcgggccgucccuccggaccaccacggucaccggcaagaucauccacgaguggugcugccgcagcugcacccugccgccccugcgguuccgcggggaggacggcugcugguacgggauggagauccggcccgugaaggagaaggaggagaaccucgugaaguccauggucagcgccggcagcggcgagguggacuccuucagccuggggcugcucugcaucuccaucaugaucgaggaggugaugcgcagccgguggucccgcaagaugcugaugaccggcacgcuggccgucuucuuccuccugaucauggggcagcugaccuggaacgaccucauccgccugugcaucauggugggcgcgaacgccagcgaccggauggggaugggcaccaccuaccuggcccucauggccacguucaagaugcgcccgauguucgccguggggcugcuguuccggcgccucaccucccgggagguccugcugcucaccaucgggcugagccugguggcguccgucgagcuccccaacagccuggaggagcugggcgacgggcucgccaugggcaucaugauccugaagcugcucaccgacuuccagucccaccagcugugggccacgcugcucagccugaccuucaucaagaccaccuucucccugcacuacgccuggaagacgauggcgauggugcucagcaucgugucccuguucccccugugccucagcaccaccucccagaagaccacguggcugcccguccugcucggcagccuggggugcaagccgcugaccauguuccucaucgccgagaacaagaucuggggccgcaaguccuggccccugaacgaggggaucauggccgugggcaucgugagcauccugcucagcucccugcugaagaacgacgucccccucgccgggccccugaucgccggcggcaugcugaucgcgugcuacgugaucagcggguccagcgccgaccucucccuggagaaggccgccgaggugagcugggaggaggaggccgagcacuccggcgcgagccacaacauccuggucgaggugcaggacgacgggaccaugaagaucaaggacgaggagcgggacgacacccucaccauccugcugaaggccacgcuccuggccguguccggcgucuacccgcugagcauccccgccacccucuucgugugguacuucuggcagaagaagaagcagcgcuccggggugcugugggacacccccagcccgcccgaggucgagcgggccgugcuggacgacggcaucuaccgcaucaugcagcggggccugcucgggcgcucccaggugggcgucgggguguuccaggagaacguguuccacaccauguggcacgucacgcggggcgcggugcugauguaccaggggaagcgccuggagcccagcugggccuccgugaagaaggaccucaucagcuacggcggcggguggcggcugcagggcuccuggaacaccggggaggagguccaggugaucgccguggagcccggcaagaaccccaagaacguccagaccgcccccgggaccuucaagacgcccgagggcgaggugggcgccaucgcgcuggacuucaagcccgggaccagcggcucccccaucgugaaccgcgaggggaagaucgucggccucuacggcaacgggguggugaccaccagcggcacguacgucagcgccaucgcccaggccaaggcgucccaggaggggccgcugcccgagaucgaggacgagguguuccggaagcgcaaccugaccaucauggaccuccaccccggcagcgggaagacccggcgcuaccugccggccaucgugcgggaggccaucaagcgcaagcugcgcacccucauccuggcccccacgcgggucguggccuccgagauggcggaggcccugaagggcaugcccauccgcuaccagaccaccgccgucaagagcgagcacaccggcaaggagaucgucgaccucaugugccacgccacguucaccaugcggcugcugucccccgugcgcgugccgaacuacaacaugaucaucauggacgaggcccacuucaccgaccccagcuccaucgcggcccggggguacaucagcacccgcgucggcaugggggaggccgccgccaucuucaugacggcgacgccgcccggcuccguggaggccuucccgcagagcaacgccgugauccaggacgaggagcgggacauccccgagcgcuccuggaacagcggguacgaguggaucaccgacuuccccggcaagaccgucugguucgugcccuccaucaagagcggcaacgacaucgccaacugccuccggaagaacgggaagcgcgugauccagcugucccggaagacguucgacaccgaguaccagaagaccaagaacaacgacugggacuacgucgugaccacggacaucagcgagaugggcgcgaacuuccgcgccgaccgggugaucgacccgcgccggugccugaagcccgucauccucaaggacgggcccgagcgcgugauccuggccggccccaugccggucaccguggccuccgccgcgcagcggcgcgggcgggugggccgcaaccacaacaaggagggcgaccaguacaucuacauggggcagccccugaacaacgacgaggaccacgcccacuggaccgaggccaagaugcuccuggacaacaucaacacccccgagggcaucauccccgcccuguucgagccggagcgcgagaaguccgccgcgaucgacggggaguaccggcuccgcggcgaggcccggaagacguucgucgagcugaugcgccgcggggaccugcccguguggcucuccuacaagguggccagcgagggcuuccaguacagcgaccgccgguggugcuucgacggcgagcgcaacaaccagguccuggaggagaacauggacguggagaucuggaccaaggagggggagcggaagaagcugcgcccccgguggcucgacgcccgcaccuacuccgacccccuggcccugcgggaguucaaggaguucgcggccggccgccggagcguguccggggaccucauccuggagaucggcaagcugccgcagcaccucacccagaaggcccagaacgcccuggacaaccuggucaugcuccacaacagcgagcagggcgggcgcgcguaccggcacgccauggaggagcugcccgacacgaucgagacccugaugcuccuggcccugaucgccgugcucaccggcggggugacccuguucuuccuguccggccgcgggcucggcaagaccagcaucggccugcugugcgucauggccuccagcgugcuccuguggauggcguccguggagccccacuggaucgccgccagcaucauccuggaguucuuccucaugguccugcugauccccgagccggaccggcagcgcacgccccaggacaaccagcucgccuacguggugaucgggcugcuguucaugauccucaccgucgccgcgaacgagaugggccugcuggagaccaccaagaaggaccucgggaucggccacguggccguggagaaccaccaccacgccgccaugcuggacgucgaccugcaccccgccuccgcguggacgcucuacgccguggccaccaccaucaucaccccgaugaugcggcacacgaucgagaacaccaccgccaacaucagccugaccgccaucgcgaaccaggccgccauccugauggggcucgacaagggcuggcccaucuccaagauggacaucggcgugccccugcuggcccucgggugcuacagccaggucaacccccugacgcugaccgcggccgugcucaugcugguggcccacuacgccaucaucggcccggggcugcaggccaaggcgacccgcgaggcccagaagcgcaccgccgccggcaucaugaagaaccccacggucgacgggaucguggccaucgaccucgaccccguggucuacgacgcgaaguucgagaagcagcugggccagaucaugcugcucauccugugcaccucccagauccugcucaugcggaccaccugggcccugugcgagagcaucacgcuggccaccggcccccucaccacccugugggagggguccccgggcaaguucuggaacacgaccaucgccgugagcauggccaacaucuuccgcggguccuaccuggcgggcgccggccucgccuucagccugaugaagucccucgggggcgggcggcgcgggaccggggcccagggcgagacccucggcgagaaguggaagcggcagcugaaccagcuguccaagagcgaguucaacacguacaagcgcuccgggaucauggagguggaccggagcgaggcgaaggagggccucaagcgcggggagaccaccaagcacgccgucucccggggcaccgccaagcugcgcugguucguggagcggaaccuggugaagcccgaggggaaggucaucgaccugggcugcggccgcgggggcuggagcuacuacugcgccgggcucaagaaggugacggaggugaagggcuacaccaagggcgggcccggccacgaggagcccaucccgauggccaccuacggguggaaccuggucaagcugcacuccggcaaggacguguucuucaucccgcccgagaagugcgacacccuccugugcgacaucggggagagcucccccaacccgacgaucgaggagggccggacccugcgcgugcucaagauggucgagcccuggcugcgggggaaccaguucugcaucaaggugcugaaccccuacaugcccagcguggucgagacccucgagcagaugcagcgcaagcacggcggcaugcuggugcggaacccgcugucccgcaacagcacccacgagauguacuggguguccugcgggaccggcaacaucgucagcgcggugaacaugacgucccggaugcuccugaaccgcuucaccauggcccaccgcaagcccaccuacgagcgggacguggaccugggggccggcacccgccacgucgccguggagcccgaggucgccaaccucgacaucaucggccagcggaucgagaacaucaagcacgagcacaagagcacguggcacuacgacgaggacaaccccuacaagaccugggcguaccacggguccuacgaggugaagccgagcggcuccgccagcagcauggugaacggggucgugaagcugcugaccaagcccugggacgugauccccauggucacccagaucgccaugacggacaccacccccuucggccagcagcgcguguucaaggagaagguggacacccggacgccgaaggccaagcgcgggaccacccagaucauggaggucaccgcccgguggcucuggggcuuccugucccgcaacaagaagccccggaucugcacgcgcgaggaguucacccggaaggugcgcagcaacgcggccaucggcgccguguucgucgacgagaaccaguggaacuccgccaaggaggcgguggaggacgagcgguucugggaccuggugcaccgcgagcgggagcuccacaagcaggggaagugcgcgaccugcgucuacaacaugaugggcaagcgcgagaagaagcugggggaguucggcaaggccaaggggagccgggccaucugguacauguggcugggcgcccgcuuccucgaguucgaggcgcugggcuucaugaacgaggaccacugguucucccgggagaacagccuguccgggguggagggcgaggggcuccacaagcugggcuacauccugcgcgacaucagcaagauccccgggggcaacauguacgccgacgacaccgccggcugggacacgcggaucaccgaggacgaccuccagaacgaggccaagaucaccgacaucauggagccggagcacgcccugcuggcgaaggccaucuucaagcucaccuaccagaacaaggugguccgcgugcagcgccccgccaagaacgggacggugauggacgucaucucccggcgcgaccagcggggcagcggccaggugggcaccuacggccugaacaccuucaccaacauggaggcccagcugauccgccagauggaguccgaggggaucuucagccccuccgagcucgagacgcccaaccuggccgagcgggugcuggacuggcucgagaaguacggcgucgagcgccugaagcggauggcgaucagcggggacgacugcguggugaagccgaucgacgaccgcuucgccaccgcccugaccgcccucaacgacaugggcaagguccggaaggacaucccccagugggagcccuccaagggguggaacgacuggcagcagguccccuucugcagccaccacuuccaccagcugaucaugaaggacggccgcgagaucguggucccgugccggaaccaggacgagcuggugggccgcgcccgggugucccagggggcgggcuggagccuccgcgagaccgccugccugggcaagagcuacgcccagauguggcagcugauguacuuccaccggcgcgaccuccggcuggccgcgaacgccaucugcuccgccguccccguggacugggugcccacgagccgcaccaccugguccauccacgcccaccaccaguggaugaccacggaggacaugcugagcgucuggaaccggguguggaucgaggagaaccccuggauggaggacaagacccacaucuccagcugggaggacgugccguaccucggcaagcgcgaggaccaguggugcgggucccugaucggccugaccgcccgcgcgaccugggccaccaacauccaggucgccaucaaccaggugcggcgccucaucggcaacgagaacuaccuggacuacaugacgagcaugaagcgguucaagaacgaguccgaccccgagggggcccugugguga

SEQ ID NO: 8904 - RNA, 9879 nt, Artificial Sequence
  derived and/or modified CDS sequence (opt1) from DENV-1__KC762642__SS-prME
agcgugaccaugcugcucaugcugaugcccaccgcccuggccuuccaccucaccacccggggcggggagccccacaugaucgugagcaagcaggagcggggcaagagccugcuguucaagaccuccgccggggugaacaugugcacccucaucgccauggaccugggcgagcugugcgaggacacccucaccuacaagugcccccggaucaccgaggccgagcccgacgacguggacugcuggugcaacgccaccgacaccugggucaccuacgggaccugcagccagaccggcgagcaccggcgggacaagcgguccguggcccuggcgccccacgugggccuggggcucgagacgcggaccgagaccuggaugagcuccgagggcgccuggaagcagauccagcgggucgagaccugggcccugcggcaccccggguucacggugaucgcccuguuccucgcgcacgccaucggcaccagcaucacccagaaggggaucaucuucauccugcugaugcucgugacccccuccauggccaugcggugcgucggcaucggcagccgcgacuucguggaggggcuguccggcgccacguggguggacgucgugcuggagcacgggagcugcgugaccaccauggccaaggacaagcccacccucgacaucgagcugcugaagacggaggucaccaaccccgcggugcuccggaagcugugcaucgaggccaagaucuccaacaccaccacggacagccgcugcccgacccagggcgaggccacccugguggaggagcaggacgccaacuucgucugccggcgcaccuucguggaccggggcugggggaacggcugcgggcuguucggcaaggggucccugaucacgugcgccaaguucaagugcgugaccaagcuggagggcaagaucguccaguacgagaaccucaaguacagcgugaucgugaccguccacaccggcgaccagcaccagguggggaacgaguccacggagcacggcaccaccgcgaccaucacgccccaggcccccacgaccgagauccagcugaccgacuacggggcccugacccucgacugcagcccccgcacgggccuggacuucaacgagaugguccugcucaccaugaaggagaaguccuggcuggugcacaagcagugguuccuggaccucccccugcccuggaccagcggggccagcaccacgcaggagaccuggaaccggcaggaccugcucgugaccuucaagaccgcccacgcgaagaagcaggaggucguggugcugggcucccaggagggcgccaugcacacggcccugaccggggccaccgagauccagaccagcggcacgaccaccaucuucgccgggcaccucaagugccgccugaagauggacaagcugacccucaagggcauguccuacgucaugugcacggggagcuucaagcuggagaaggagguggcggagacccagcacggcaccgugcugguccagaucaaguacgagggcaccgacgcccccugcaagauccccuucuccacgcaggacgagaagggggugacccagaacggccggcugaucaccgccaacccgaucgugaccgacaaggagaagcccgucaacaucgaggccgagccgcccuucggggagagcuacaucgugaucggcgcgggcgagaaggcccucaagcuguccugguucaagaaggggagcuccaucggcaagauguucgaggccacggcccgcggggcccggcgcauggcgauccugggcgacaccgccugggacuucgggagcaucggcggcguguucaccuccgucgggaagcucgugcaccagaucuucggcaccgccuacggggugcuguucagcggcgucuccuggacgaugaagaucgggaucggcgugcugcucaccuggcugggccugaacagccgcuccaccagccucuccaugaccugcaucgccguggggcuggucacgcuguaccucggcgugauggugcaggccgacagcgggugcgucaucaacuggaagggccgggagcugaagugcggguccggcaucuucgugaccaacgaggugcacaccuggaccgagcaguacaaguuccaggcggacagcccgaagcgccugagcgccgccaucggcaaggccugggaggagggggucugcggcauccgguccgccacccgccucgagaacaucauguggaagcagaucagcaacgagcugaaccacauccugcucgagaacgacaugaaguucacggugguggucggggacguggcgggcauccuggcccaggggaagaagaugauccggccccagcccauggagcacaaguacuccuggaaguccuggggcaaggccaagaucaucggcgccgacgugcagaacaccaccuucaucaucgacgggcccaacaccccggagugccccgacgaccagcgcgcguggaacaucugggaggucgaggacuacggcuucgggaucuucacgaccaacaucuggcugaagcuccgggacuccuacacccaggugugcgaccaccgccugaugagcgccgccaucaaggacuccaaggccgugcacgccgacaugggcuacuggaucgagagcgagaagaacgagaccuggaagcuggcgcgggccuccuucaucgaggucaagacgugcaucuggcccaagagccacacccucugguccaacggcgugcuggagagcgagaugaucauccccaagaucuacgggggcccgaucucccagcacaacuaccgccccggguacuucacccagaccgccggccccuggcaccuggggaagcucgagcuggacuucgaccugugcgagggcacgaccguggucguggacgagcacugcggcaaccgggggccgagccuccgcaccaccacggugaccggcaagaucauccacgaguggugcugccgguccugcacccugccgccccugcgcuuccgcggggaggacggcugcugguacgggauggagauccgccccgucaaggagaaggaggagaaccucgucaagagcaugguguccgccggcagcggcgaggucgacagcuucucccuggggcugcucugcaucagcaucaugaucgaggaggugaugcggucccgcuggagccggaagaugcugaucaccggcacgcuggccguguucuuccuccugaucauggggcaggucaccuggaacgaccugacccgccucugcaucauggugggcgcgaacgccuccgaccgcauggggaugggcaccacguaccuggcccugauggccaccuucaagaugcggccgauguucgccgugggccuccuguuccgccggcugaccagccgcgagguccuccugcugaccaucgggcucucccugguggcgagcgucgagcugcccaacucccucgaggagcugggcgacgggcuggccaugggcaucaugauccucaagcugcugacggacuuccagagccaccagcucugggccacccugcugucccucaccuucaucaagaccacguucagccugcacuacgccuggaagaccauggcgauggugcuguccaucgugagccucuucccccugugccuguccaccaccagccagaagacgaccuggcuccccguccugcugggcucccucgggugcaagccgcugaccauguuccugaucgccgagaacaagaucuggggccgcaagagcuggccccucaacgaggggaucauggccgugggcaucguguccauccugcugagcagccuccugaagaacgacgucccccuggccgggccccucaucgccggcggcaugcugaucgcgugcuacgugaucuccgggagcuccgccgaccugagccucgagaaggccgccgagguguccugggaggaggaggccgagcacagcggcgcgucccacaacauccuggucgaggugcaggacgacgggaccaugaagaucaaggacgaggagcgcgacgacacccugacgauccuccugaaggccacccugcucgccgugagcggcgucuacccgcuguccauccccgccacccuguucgugugguacuucuggcagaagaagaagcagcggagcggggugcucugggacacccccagcccgcccgaggucgagcgcgccgugcuggacgacggcaucuaccggaucaugcagcgcggccugcuggggcggagccaggugggcgucgggguguuccaggagaacguguuccacacgauguggcacgucacccgcggcgcggugcucauguaccaggggaagcggcuggagcccuccugggccagcgugaagaaggaccugaucuccuacggcggcggguggcgccuccagggcagcuggaacaccggggaggagguccaggugaucgccguggagcccggcaagaaccccaagaacguccagaccgcccccgggacguucaagacccccgagggcgaggugggcgccaucgcgcuggacuucaagcccgggaccuccggcagccccaucgugaaccgggaggggaagaucgucggccuguacggcaacgggguggugaccacguccggcaccuacgucagcgccaucgcccaggccaaggcgagccaggaggggccgcuccccgagaucgaggacgagguguuccgcaagcggaaccugaccaucauggaccugcaccccggcuccgggaagacccgccgguaccucccggccaucgugcgcgaggccaucaagcggaagcugcgcacgcugauccucgcccccacccgcgucguggccagcgagauggcggaggcccugaagggcaugcccauccgguaccagaccaccgccgugaaguccgagcacacgggccgcgagaucgucgaccugaugugccacgccaccuucaccaugcggcuccugagccccgugcgcgugccgaacuacaacaugaucaucauggacgaggcccacuucaccgaccccuccagcaucgcggcccggggguacaucuccacgcgcgucggcaugggggaggccgccgccaucuucaugaccgcgacgccgcccggcagcguggaggccuucccgcaguccaacgccgugauccaggacgaggagcgggacauccccgagcgcagcuggaacuccggguacgaguggaucaccgacuuccccggcaagacggucugguucgugcccagcaucaaguccggcaacgacaucgccaacugccugcggaagaacgggaagcgcgugauccagcucagccggaagaccuucgacaccgaguaccagaagaccaagaacaacgacugggacuacgucgugacgaccgacaucuccgagaugggcgcgaacuuccgcgccgaccgggugaucgacccgcgccggugccugaagcccgucauccugaaggacgggcccgagcgcgugauccucgccggccccaugccggucaccguggccagcgccgcgcagcggcgcgggcggaucggccgcaaccacaacaaggagggcgaccaguacaucuacauggggcagccccugaacaacgacgaggaccacgcccacuggaccgaggccaagaugcugcucgacaacaucaacacgcccgagggcaucauccccgcccuguucgagccggagcgcgagaaguccgccgcgaucgacggggaguaccggcugcgcggcgaggcccggaagaccuucguggagcucaugcgccgcggggaccugcccgucuggcugagcuacaagguggccuccgagggcuuccaguacagcgaccgccgguggugcuucgacggcgagcgcaacaaccaggugcucgaggagaacauggacgucgagaucuggaccaaggagggggagcggaagaagcugcgcccccgguggcuggacgcccgcaccuacagcgacccccucgcccugcgggaguucaaggaguucgcggccggccgccgguccgugagcggggaccugauccucgagaucggcaagcugccgcagcaccugacgcagcgcgcccagaacgcccucgacaaccuggugaugcugcacaacuccgagcagggcgggcgggcguaccgccacgccauggaggagcuccccgacaccaucgagacccugaugcugcucgcccugaucgccguccugaccggcggggugacccucuucuuccugagcggccgggggcugggcaagacguccaucggccuccugugcgugauggccagcuccguccugcucuggauggcgagcguggagccccacuggaucgccgccuccaucauccuggaguucuuccugauggugcuccugauccccgagccggaccgccagcggacgccccaggacaaccagcuggccuacgucgugaucgggcuccuguucaugauccugaccguggccgcgaacgagaugggccuccuggagaccacgaagaaggaccuggggaucggccacgucgccguggagaaccaccaccacgccgccaugcucgacguggaccugcaccccgccagcgcguggacccuguacgccgucgccaccaccaucaucacgccgaugaugcgccacaccaucgagaacaccaccgccaacaucucccucacggccaucgcgaaccaggccgccauccugauggggcuggacaagggcuggcccaucagcaagauggacaucggcgugccccuccuggcccuggggugcuacucccaggugaacccccucacccugaccgcggccguccugaugcucguggcccacuacgccaucaucggcccggggcugcaggccaaggcgacccgcgaggcccagaagcggacggccgccggcaucaugaagaaccccaccguggacgggaucgucgccaucgaccuggaccccgugguguacgacgcgaaguucgagaagcagcucggccagaucaugcugcugauccucugcaccagccagauccugcugaugcgcaccacgugggcccucugcgaguccaucacccuggccaccggcccccugaccacgcucugggaggggagcccgggcaaguucuggaacaccaccaucgccgucuccauggccaacaucuuccgggggagcuaccuggcgggcgccggccuggccuucucccucaugaagucccucgggggcgggcgccgggggaccggggcccagggcgagacgcugggcgagaaguggaagcgccagcucaaccagcugagcaaguccgaguucaacaccuacaagcggagcgggaucauggagguggaccgcuccgaggcgaaggagggccugaagcgcggggagaccaccaagcacgccgugagccgcggcacggccaagcuccggugguucgucgagcgcaaccuggugaagcccgaggggaaggugaucgaccugggcugcggccgcggcgggugguccuacuacugcgccgggcugaagaaggucaccgaggugaagggguacaccaagggcggccccggccacgaggagcccaucccgauggccaccuacggguggaaccucgugaagcugcacagcggcaaggacgucuucuucaucccgcccgagaagugcgacacgcugcucugcgacaucggggaguccagccccaacccgaccaucgaggagggccgcacccugcgggugcugaagaugguggagcccuggcuccgcgggaaccaguucugcaucaagauccugaaccccuacaugcccuccgucguggagacccuggagcagaugcagcggaagcacggcggcaugcucgugcgcaacccgcugagccggaacuccacccacgagauguacugggucagcugcgggacgggcaacaucguguccgcggugaacaugaccagccgcaugcugcucaaccgcuucaccauggcccaccggaagcccaccuacgagcgcgacgucgaccugggggccggcacgcggcacguggccguggagcccgaggucgccaaccuggacaucaucggccagcgcaucgagaacaucaaguacgagcacaaguccaccuggcacuacgacgaggacaaccccuacaagaccugggcguaccacgggagcuacgaggugaagccguccggcagcgccuccagcauggucaacgggguggugaagcuccugaccaagcccugggacgucauccccauggugacgcagaucgccaugaccgacaccacccccuucggccagcagcggguguucaaggagaaggucgacacgcgcaccccgaaggccaagcgggggaccgcccagaucauggaggugaccgcgcgcuggcuguggggcuuccucagccggaacaagaagccccgcaucugcacgcgggaggaguucacccgcaaggugcgguccaacgccgccaucggcgccgucuucguggacgagaaccaguggaacagcgcgaaggaggccguggaggacgagcgcuucugggaccugguccaccgggagcgcgagcugcacaagcaggggaagugcgcgaccugcguguacaacaugaugggcaagcgggagaagaagcucggggaguucggcaaggccaaggggucccgcgccaucugguacauguggcugggcgcgcgguuccuggaguucgaggcccucggcuucaugaacgaggaccacugguucagccgcgagaacucccugagcgggguggagggcgaggggcugcacaagcucggcuacauccugcgggacaucuccaagauccccgggggcaacauguacgccgacgacaccgccggcugggacacgcgcaucaccgaggacgaccugcagaacgaggccaagaucaccgacaucauggagccggagcacgcgcuccuggccaaggccgucuucaagcugaccuaccagaacaagguggugcgcguccagcggcccgccaagaacgggacggugauggacgugaucagccgccgggaccagcgcggcuccgggcaggucggcaccuacggccucaacaccuucaccaacauggaggcccagcugauccggcagauggagagcgaggggaucuucucccccagcgagcuggagacgcccaaccucgcggagcgcgugcuguacuggcuggagaaguacggcguggagcggcucaagcgcauggccaucuccggggacgacugcgucgugaagccgaucgacgaccgguucgccaccgcccugaccgcccugaacgacaugggcaaggugcgcaaggacaucccccagugggagcccagcaagggguggaacgacuggcagcagguccccuucugcucccaccacuuccaccagcucaucaugaaggacggccgggagaucguggugccgugccgcaaccaggacgagcuggucggccgggcgcgcgugagccagggggccggcuggucccugcgggagaccgccugccucggcaagagcuacgcccagauguggcagcugauguacuuccaccgccgggaccugcgccucgcggccaacgccaucugcagcgccgugcccgucgacugggugcccacgucccggaccaccuggagcauccacgcccaccaccaguggaugaccacggaggacaugcuguccguguggaaccgcgucuggaucgaggagaaccccuggauggaggacaagacccacaucagcuccugggaggacgugccguaccugggcaagcgcgaggaccaguggugcgggagccucaucggccugaccgcgcgggccaccugggccaccaacauccagguggccaucaaccagguccgccggcugaucggcaacgagaacuaccucgacuacaugacguccaugaagcgcuucaagaacgagagcgaccccgagggggcccugugguga

SEQ ID NO: 8905 - RNA, 9879 nt, Artificial Sequence
  derived and/or modified CDS sequence (opt1) from DENV-1__JQ915077__SS-prME
agcgugaccaugcugcucaugcugcugcccaccgugcucaccuuccaccugaccacccgcggcggggagccccacaugaucgugagcaagcaggagcggggcaagagccuccuguucaagaccuccgccggggugaacaugugcacccugaucgccauggaccugggcgagcucugcgacgacaccaugaccuacaagugcccccgcaucaccgagaccgagcccgacgacguggacugcuggugcaacgcgaccgagaccugggugaccuacgggacgugcagccagaccggcgagcaccggcgcgacaagcgguccguggcccuggcgccccacgucggccuggggcucgagacccgcaccgagacguggaugagcuccgagggcgccuggcggcagauccagaagguggagaccugggcccugcgccaccccggguucaccgugaucgcgcuguuccucgcccacgccaucggcaccagcaucacgcagaaggggaucaucuucauccugcugaugcucgucacccccuccauggccaugcggugcgugggcaucggcaaccgcgacuucguggaggggcugagcggcgcgaccugggucgacguggugcuggagcacggguccugcgucaccacgauggccaaggacaagcccacccucgacaucgagcugcugaagaccgaggugaccaaccccgccgugcuccggaagcugugcaucgaggccaagaucagcaacacgaccaccgacucccgcugcccgacccagggcgaggccacgcuggucgaggagcaggacaccaacuucgugugccggcgcaccuucguggaccggggcugggggaacggcugcggccucuucggcaaggggagccugaucacgugcgcgaaguucaagugcgucacgaagcuggagggcaagaucgugcaguacgagaaccucaaguacuccgugaucgucaccgugcacaccggcgaccagcaccaggucgggaacgagaccaccgagcacggcacgaucgccaccaucacgccccaggcccccaccagcgagauccagcugacggacuacggggcccugacccucgacugcagcccccggaccggccuggacuucaacgagauggugcugcucaccaugaaggagaaguccuggcuggugcacaagcagugguuccuggaccucccgcugcccuggacguccggggccagcaccagccaggagaccuggaaccggcaggaccugcucgucaccuucaagacggcgcacgccaagaagcaggagguggugguccugggcucccaggagggcgccaugcacaccgcccugaccggggccaccgagauccagacgagcggcaccaccaccaucuucgcggggcaccucaagugccgccugaagauggacaagcugacgcucaagggcaucuccuacgugaugugcaccgggagcuucaagcuggagaaggagguggccgagacccagcacggcaccguccugguccaggugaaguacgagggcacggacgcccccugcaagauccccuucuccagccaggacgagaagggggucacccagaacggccggcuggugaccgccaacccgaucgugaccgacaaggagaagcccgucaacaucgaggccgagccgcccuucggggaguccuacaucguggugggcgcgggcgagaaggcccucaagcugagcugguucaagaagggguccagcaucggcaagauguucgaggccacggcccgcggggcgcggcgcauggccauccugggcgacaccgccugggacuucggguccaucggcggcgucuucaccagcguggggaagcucgugcaccagaucuucggcaccgccuacgggguccuguucuccggcgugagcuggacgaugaagaucgggaucggcauccugcucaccuggcugggccugaacucccgcagcaccucccucagcaugaccugcaucgccguggggauggucacgcuguaccugggcgugauggugcaggcggacuccgggugcgucaucaacuggaagggccgggagcucaagugcgggagcggcaucuucgugaccaacgaggugcacaccuggaccgagcaguacaaguuccaggccgacagcccgaagcgccuguccgccgccaucggcaaggccugggaggagggggucugcggcauccggagcgcgacccgccuggagaacaucauguggaagcagaucuccaacgagcucaaccacauccugcuggagaacgacaugaaguucacggugguggucggggacgugagcggcauccucgcccaggggaagaagaccauccggccccagcccauggagcacaaguacuccuggaaguccuggggcaaggccaagaucaucggcgccgacgugcagaacaccaccuucaucaucgacgggcccaacacgccggagugccccgacgaccagcgcgccuggaacaucugggaggucgaggacuacggcuucgggaucuucaccaccaacaucuggcugaagcugcgggacuccuacacccaggugugcgaccaccgccucaugagcgcggccaucaaggacuccaaggccgugcacgccgacaugggcuacuggaucgagagcgagaagaacgagacguggaagcuggcgcgggccuccuucaucgaggucaagaccugcguguggcccaagagccacacccugugguccaacggcgugcucgagagcgagaugaucauccccaagaucuacgggggcccgaucucccagcacaacuaccgccccggguacuucacccagacggccggccccuggcaccuggggaagcuggagcucgacuucgaccugugcgagggcaccaccgucgugguggacgagcacugcggcaaccgggggccgagccugcgcaccacgaccgucaccggcaagaucauccacgaguggugcugccgguccugcacccugccgccccugcgcuucaagggggaggacggcugcugguacgggauggagauccggcccgugaaggagaaggaggagaaccuggucaagagcauggucagcgccggcuccggcgagguggacagcuucucccucgggcugcugugcaucagcaucaugaucgaggaggugaugcgcucccgguggagccgcaagaugcucaugacgggcacccuggucguguuccugcuccugacccuggggcagcucaccuggaacgaccugauccggcugugcaucauggucggcgccaacgcguccgacaacauggggaugggcacgaccuaccucgcccugauggccaccuuccgcaugcgcccgauguucgccguggggcuccucuuccggcgccugaccagccgggaggugcugcuccugacggucgggcugucccucguggccagcguggagcugcccaacucccuggacgagcucggcgacgggcuggccaugggcaucaugauccugaagcuccugaccgacuuccagagccaccagcugugggccauccuccugucccugaccuucgucaagaccacgcucagccugcacuacgccuggaagaccauggccaugauccuguccaucgugagccuccugccccugugccucuccaccaccagccagaagacgaccuggcugcccgugcugcucggcucccuggggugcaagccgcugaccauguuccucaucaccgagaacaagaucuggggccgcaagagcuggccccugaacgaggggaucauggccgucggcaucgugagcauccugcucuccagccugcugaagaacgacgugccccucgcggggccccugaucgccggcggcaugcugaucgccugcuacgucaucuccgggagcuccgccgaccucagccuggagaaggcggccaagguguccugggaggaggaggccgagcacagcggcgccucccacaacauccugguggagauccaggacgacgggaccaugaagaucaaggacgaggagcgggacgacacgaucaccauccuccugaaggccacccugcucgcgaucagcggcgucuacccgauguccauccccgccacccuguucguguggcacuucuggcagaagaagaagcagcgcagcggggugcugugggacacgcccagcccgcccgaggucgagaaggccgugcuggacgacggcaucuaccggauccuccagcgcggccugcuggggcggagccaggugggcgucgggguguuccaggagggcguguuccacaccauguggcacgucacccgcggggccgugcucauguaccagggcaagcggcuggagcccuccugggccagcgugaagaaggaccugaucuccuacggcgggggcuggcgcuuccaggggagcuggaacaccggcgaggagguccaggugaucgcgguggagcccgggaagaaccccaagaacguccagacggcccccggcaccuucaagaccuccgagggcgaggugggggccaucgcccucgacuucaagcccggcaccagcgggagccccaucgugaaccgggagggcaagaucgucggccuguacgggaacggcguggugacgaccuccgggaccuacgucagcgccaucgcgcaggccaaggccucccaggagggcccccugccggagaucgaggacgagguguuccgcaagcggaaccucaccaucauggaccugcaccccgggagcggcaagacgcgccgguaccugcccgccaucgugcgcgaggccaucaagcggaagcuccgcacccugguccuggcgccgacccgggugguggccuccgagauggccgaggcccucaagggcaugcccauccgcuaccagaccacggcggucaagagcgagcacaccgggaaggagaucguggaccugaugugccacgccaccuucaccaugcgccugcucucccccgugcggguccccaacuacaacaugaucaucauggacgaggcccacuucacggacccggccagcaucgccgcgcgcggcuacaucuccacccggguggggaugggcgaggccgccgccaucuucaugaccgccacgccgcccgggagcguggaggcguucccccaguccaacgccgucauccaggacgaggagaaggacaucccggagcgcagcuggaacuccggcuacgacuggaucacggacuuccccggcaagaccgugugguucgugcccagcaucaaguccgggaacgacaucgccaacugccugcggaagaacggcaagcgcgucauccagcugagccggaagaccuucgacaccgaguaccagaagacgaagaacaacgacugggacuacguggucaccaccgacaucuccgagaugggggccaacuuccgcgccgaccgggugaucgacccccgccggugccucaagccggugauccugaaggacggccccgagcgcgucauccuggcggggcccaugcccgugaccguggccagcgccgcccagcggcgcggccggaucggccgcaaccagaacaaggagggggaccaguacaucuacaugggccagccgcucaacaacgacgaggaccacgcgcacuggacggaggccaagaugcugcuggacaacaucaacacccccgaggggaucauccccgcccucuucgagcccgagcgggagaaguccgccgccaucgacggcgaguaccgccugcgcggggaggcgcgcaagaccuucgucgagcugaugcgccggggcgaccucccgguguggcugagcuacaagguggccagcgagggcuuccaguacuccgaccgccgguggugcuucgacggggagcgcaacaaccagguccuggaggagaacauggacguggagaucuggaccaaggagggcgagcggaagaagcuccgcccccgguggcuggacgcccgcacguacagcgacccccuggcccuccgggaguucaaggaguucgccgcggggcgccgguccgugagcggcgaccugauccuggagaucggcaagcucccccagcaccugacccagcgcgcccagaacgcccuggacaaccucgucaugcugcacaacuccgagcagggcgggaaggccuaccggcacgccauggaggagcugccggacaccaucgagaccaucaugcuccuggcgcugaucgccgugcucaccgggggcgugacgcuguucuuccugagcgggcgcggccucggcaagaccuccaucgggcugcugugcgucaccagcuccagcgugcuccuguggauggccuccguggagccccacuggaucgccgcgagcaucauccuggaguucuuccucaugguccugcugauccccgagcccgaccggcagcgcaccccgcaggacaaccagcucgccuacguggugaucggccugcuguucaugauccucacggucgccgccaacgagauggggcugcuggagaccaccaagaaggaccucggcaucgggcacgccgcggccgagaaccaccaccacgccgccaugcuggacguggaccugcaccccgccuccgcguggacccucuacgccguggccacgaccaucaucacccccaugaugcggcacaccaucgagaacacgaccgccaacaucagccugaccgccaucgcgaaccaggccgccauccugaugggccucgacaagggcuggccgaucuccaagauggacaucggggucccccugcuggcccucggcugcuacagccaggugaacccccugacccugacggccgcggugcucaugcuggucgcccacuacgccaucaucgggcccggccugcaggccaaggcgacccgcgaggcccagaagcggaccgccgccgggaucaugaagaacccgaccguggacggcaucguggccaucgaccucgaccccgucguguacgacgcgaaguucgagaagcagcugggccagaucaugcugcucauccugugcacgucccagauccugcucaugcgcaccaccugggcccugugcgagagcaucacccuggccacggggccccucaccacccugugggagggcucccccgggaaguucuggaacaccacgaucgccgugagcauggccaacaucuuccggggcagcuaccuggcgggcgccgggcucgccuucucccugaugaagucccugggcgggggccgccgcgggaccggcgcccagggcgagacccucggggagaaguggaagcggcagcugaaccagcuguccaagagcgaguucaacaccuacaagcgcuccggcaucaucgaggucgaccggagcgaggccaaggaggggcucaagcgcggcgagacgaccaagcacgcggugucccgggggaccgccaagcugcgcugguucguggagcggaaccuggucaagccggagggcaaggugaucgaccugggcugcgggcgcggcggguggagcuacuacugcgccggccucaagaaggugaccgaggucaagggguacacgaagggcggccccgggcacgaggagcccauccccauggccaccuacggcuggaaccuggugaagcugcacuccgggaaggacguguucuucaucccgcccgagaagugcgacacccuccugugcgacaucggcgagagcucccccaaccccaccaucgaggaggggcggacccugcgcguccucaagaugguggagccguggcugcggggcaaccaguucugcaucaagauccugaaccccuacaugcccagcguggucgagacgcucgagcagaugcagcgcaagcacggcgggaugcuggugcggaacccccugucccgcaacagcacccacgagauguacuggguguccugcggcaccgggaacaucgucagcgcggugaacaugaccucccggaugcuccugaaccgcuucacgauggcccaccggaagccgaccuacgagcgcgacguggaccugggcgccggcacccggcacgucgccguggagcccgaggucgccaaccucgacaucaucgggcagcgcaucgagaacaucaagaacgagcacaagagcaccuggcacuacgacgaggacaaccccuacaagacgugggcguaccacggcuccuacgaggugaagcccagcgggagcgccuccagcauggugaacggcgucgugcgccugcugaccaagccgugggacgugauccccauggucacccagaucgccaugaccgacacgacccccuucgggcagcagcggguguucaaggagaagguggacacccgcacccccaaggccaagcggggcacggcccagaucauggaggucaccgcgaaguggcucuggggcuuccugucccgcaacaagaagccgcggaucugcacccgcgaggaguucacccggaaggugcgcagcaacgccgccaucggggccguguucgucgacgagaaccaguggaacuccgccaaggaggcgguggaggacgagcgguucugggaccuggugcgccgggagcgcgagcuccacaagcagggcaagugcgccacgugcgucuacaacaugauggggaagcgggagaagaagcugggcgaguucgggaaggccaagggcagccgcgccaucugguacauguggcugggcgcgcgguuccucgaguucgaggcccugggguucaugaacgaggaccacugguucucccgcgagaacagccuguccggcguggagggggagggccuccacaagcugggguacauccugcgggacaucagcaagauccccggcggcaacauguacgccgacgacaccgccgggugggacacccgcaucaccgaggacgaccuccagaacgaggccaagaucacggacaucauggagcccgagcacgcgcugcuggccaccuccaucuucaagcucaccuaccagaacaaggugguccgggugcagcgcccggccaagaacggcaccgugauggacgucaucagccggcgcgaccagcgcggguccggccaggugggcacguacgggcugaacaccuucaccaacauggaggcccagcugauccggcagauggagagcgagggcaucuucucccccagcgagcucgagacccccaaccuggccgggcgcgugcuggacuggcucgagaagcacggcacggagcggcugcgccggauggcgaucuccggggacgacugcgucgugaagcccaucgacgaccgcuucgccaccgcccugaccgcccucaacgacaugggcaaggugcggaaggacaucccgcagugggagcccagcaagggcuggaacgacuggcagcagguccccuucugcagccaccacuuccaccagcugaucaugaaggacgggcgcgagaucguggugcccugccggaaccaggacgagcuggucggccgcgcccgggugucccagggggcgggcuggagccuccgcgagaccgccugccuggggaaguccuacgcccagauguggcagcugauguacuuccaccggcgcgaccuccggcuggccgccaacgcgaucugcagcgccgugccggucgacugggugcccacgucccgcaccaccuggagcauccacgcccaccaccaguggaugaccaccgaggacaugcuguccguguggaaccgggucuggaucgaggagaaccccuggauggaggacaagacgcacgugagcuccugggaggacgugcccuaccucggcaagcgcgaggaccaguggugcggcagccugaucgggcugaccgcccgggcgaccugggccaccaacauccaggucgccaucaaccaggugcgccgccucaucggcaacgagaacuaccuggacuacaugacguccaugaagcgguucaagaacgagagcgacccggagggggcccugugguga

SEQ ID NO: 8906 - RNA, 9879 nt, Artificial Sequence
  derived and/or modified CDS sequence (opt1) from DENV-1__JQ915079__SS-prME
agcgugaccaugcugcucaugcugcugcccaccgugcucaccuuccaccugaccacccggggcggggagccccacaugaucgugagcaagcaggagcggggcaagagccuccuguucaagaccuccgccggggugaacaugugcacgcugaucgccauggaccugggcgagcucugcgacgacaccaugaccuacaagugcccccgcaucaccgagacggagcccgacgacguggacugcuggugcaacgcgaccgagaccugggugaccuacgggacgugcagccagaccggcgagcaccggcgcgacaagcgguccguggcccuggcgccccacgucggccuggggcucgagacccgcaccgagacguggaugagcuccgagggcgccuggcggcagauccagaagguggagaccugggcccugcgccaccccggguucaccgugaucgcgcuguuccucgcccacgccaucggcaccagcaucacgcagaaggggaucaucuucauccugcugaugcucgucacccccuccauggccaugcggugcgugggcaucggcaaccgcgacuucguggaggggcugagcggcgcgaccugggucgacguggugcuggagcacggguccugcgucaccacgauggccaaggacaagcccacccucgacaucgagcugcugaagaccgaggugaccaaccccgccgugcuccggaagcugugcaucgaggccaagaucagcaacacgaccaccgacucccgcugcccgacccagggcgaggccacgcuggucgaggagcaggacaccaacuucgugugccggcgcaccuucguggaccggggcugggggaacggcugcggccucuucggcaaggggagccugaucacgugcgcgaaguucaagugcgucacgaagcuggagggcaagaucgugcaguacgagaaccucaaguacuccgugaucgucaccgugcacaccggcgaccagcaccaggucgggaacgagaccaccgagcacggcacgaucgccaccaucacgccccaggcccccaccagcgagauccagcugacggacuacggggcccugacccucgacugcagcccccggaccggccuggacuucaacgagauggugcugcucaccaugaaggagaaguccuggcuggugcacaagcagugguuccuggaccucccgcugcccuggacgaccggggccuccaccagccaggagaccuggaaccggcaggaccugcucgucacguucaagaccgcgcacgccaagaagcaggagguggugguccugggcagccaggagggcgccaugcacaccgcccugaccggggccacggagauccagaccuccggcaccaccacgaucuucgcggggcaccucaagugccgccugaagauggacaagcugacccucaagggcaucagcuacgugaugugcaccggguccuucaagcuggagaaggagguggccgagacccagcacggcacgguccugguccaggugaaguacgagggcaccgacgcccccugcaagauccccuucagcucccaggacgagaagggggucacccagaacggccggcuggugaccgccaacccgaucgugacggacaaggagcgccccgucaacaucgaggccgagccgcccuucggggagagcuacaucguggugggcgcgggcgagaaggcccucaagcuguccugguucaagaaggggagcuccaucggcaagauguucgaggccaccgcccgcggggcccgccgcauggccauccugggcgacaccgccugggacuucgggagcaucggcggcgucuucaccuccguggggaagcucgugcaccagaucuucggcacggccuacgggguccuguucagcggcguguccuggaccaugaagaucgggaucggcauccugcucaccuggcugggccugaacagccgguccaccagccucuccaugacgugcaucgccguggggauggucacccuguaccugggcgugauggugcaggcggacagcgggugcgucaucaacuggaagggccgcgagcucaagugcggguccggcaucuucgugaccaacgaggugcacaccuggaccgagcaguacaaguuccaggccgacagcccgaagcggcugagcgccgccaucggcaaggccugggaggagggggucugcggcauccgcuccgcgacgcggcuggagaacaucauguggaagcagaucagcaacgagcucaaccacauccugcuggagaacgacaugaaguucaccgugguggucggggacguguccggcauccucgcccaggggaagaagaccauccgcccccagcccauggagcacaaguacagcuggaaguccuggggcaaggccaagaucaucggcgccgacgugcagaacaccacguucaucaucgacgggcccaacaccccggagugccccgacgaccagcgggccuggaacaucugggaggucgaggacuacggcuucgggaucuucaccaccaacaucuggcugaagcugcgcgacagcuacacccaggugugcgaccaccggcucauguccgcggccaucaaggacagcaaggccgugcacgccgacaugggcuacuggaucgaguccgagaagaacgagaccuggaagcuggcgcgcgccagcuucaucgaggucaagaccugcguguggcccaagucccacacccuguggagcaacggcgugcucgaguccgagauggucauccccaagaucuacgggggcccgaucagccagcacaacuaccggcccggguacuucacgcagaccgccggccccuggcaccuggggaagcuggagcucgacuucgaccugugcgagggcaccaccgugguggucgacgagcacugcggcaaccgcgggccgucccugcggacgaccaccgugaccggcaagaucauccacgaguggugcugccgcagcugcacgcugccgccccugcgguucaagggggaggacggcugcugguacgggauggagauccgccccgugaaggagaaggaggagaaccuggucaaguccauggugagcgccggcagcggcgagguggacuccuucagccucgggcugcugugcaucuccaucaugaucgaggaggucaugcggagccgcuggucccggaagaugcucaugaccggcacccugguggucuuccugcuccugacccuggggcagcucacguggaacgaccugauccgccugugcaucauggugggcgccaacgcgagcgacaacauggggaugggcacgaccuaccucgcccugauggccaccuuccgcaugcggccgauguucgccguggggcuccucuuccgccggcugacgucccgcgagguccugcuccugaccguggggcugagccucguggccuccgucgagcugcccaacagccuggacgagcucggcgacgggcuggccaugggcaucaugauccugaagcuccugaccgacuuccagucccaccagcugugggccacccuccugagccugacguucgugaagaccacccucucccugcacuacgccuggaagaccauggccaugauccugagcaucgugucccuccugccccugugccucagcacgaccucccagaagaccaccuggcugcccguccugcucggcagccuggggugcaagccgcugaccauguuccucaucacggagaacaagaucuggggccggaaguccuggccccugaacgaggggaucauggccgugggcaucgugagcauccugcucagcucccugcugaagaacgacgucccccucgcggggccccugaucgccggcggcaugcugaucgccugcuacgugaucagcggguccagcgccgaccucucccuggagaaggcggccaaggugagcugggaggaggaggccgagcacuccggcgccagccacaacauccuggucgagauccaggacgacgggaccaugaagaucaaggacgaggagcgcgacgacaccaucaccauccuccugaaggccacgcugcucgcgaucuccggcguguacccgaugagcauccccgccacccuguucguguggcacuucuggcagaagaagaagcagcgguccgggguccugugggacacccccagcccgcccgagguggagaaggccgugcuggacgacggcaucuaccgcauccuccagcggggccugcuggggcgcucccaggucggcguggggguguuccaggagggcgucuuccacaccauguggcacgugacgcgcggggccgugcucauguaccagggcaagcgccuggagcccagcugggccuccgucaagaaggaccugaucagcuacggcgggggcuggcgguuccagggguccuggaacaugggcgaggagguccaggugaucgcggucgagcccgggaagaaccccaagaacgugcagaccgcccccggcaccuucaagaccagcgagggcgaggugggggccaucgcccucgacuucaagcccggcacguccgggagccccaucgucaaccgcgagggcaagaucgugggccuguacgggaacggcguggucaccaccagcgggaccuacguguccgccaucgcgcaggccaaggccagccaggagggcccccugccggagaucgaggacgagguguuccggaagcgcaaccucacgaucauggaccugcaccccggguccggcaagacccggcgcuaccugcccgccaucguccgggaggccaucaagcgcaagcuccggacccuggugcuggcgccgacccgcguggucgccagcgagauggccgaggcccucaagggcaugcccauccgcuaccagacgaccgcggugaaguccgagcacaccgggaaggagaucguggaccugaugugccacgccaccuucacgaugcggcugcucagccccguccgcgugcccaacuacaacaugaucaucauggacgaggcccacuucaccgacccggccuccaucgccgcgcggggcuacaucagcacccgcguggggaugggcgaggccgccgccaucuucaugaccgccacgccgcccggguccgucgaggcguucccccagagcaacgccgugauccaggacgaggagaaggacaucccggagcgguccuggaacagcggcuacgacuggaucaccgacuuccccggcaagaccgugugguucguccccuccaucaagagcgggaacgacaucgccaacugccugcgcaagaacggcaagcgggugauccagcugucccgcaagaccuucgacacggaguaccagaagaccaagaacaacgacugggacuacgucgugaccaccgacaucagcgagaugggggccaacuuccgggccgaccgcgugaucgacccccggcgcugccucaagccggucauccugaaggacggccccgagcgggugauccuggcggggcccaugcccgugacggucgccuccgccgcccagcgccggggccgcaucggccggaaccagaacaaggagggggaccaguacaucuacaugggccagccgcucaacaacgacgaggaccacgcgcacuggaccgaggccaagaugcugcuggacaacaucaacacccccgaggggaucauccccgcccucuucgagcccgagcgcgagaaguccgccgccaucgacggcgaguaccggcugcgcggggaggcgcgcaagaccuucguggagcugaugcggcgcggcgaccucccgguguggcuguccuacaaggucgccagcgagggcuuccaguacagcgaccggcgcuggugcuucgacggggagcggaacaaccaggugcuggaggagaacauggacguggagaucuggacgaaggagggcgagcgcaagaagcuccggccccgcuggcuggacgcccggaccuacuccgacccccuggcccuccgcgaguucaaggaguucgccgcggggcggcgcagcgucuccggcgaccugauccuggagaucggcaagcucccccagcaccugacccagcgggcccagaacgcccuggacaaccucgugaugcugcacaacagcgagcagggcgggaaggccuaccgccacgccauggaggagcugccggacaccaucgagaccaucaugcuccuggcgcugaucgccgugcucaccggcggggucacccuguucuuccuguccgggcgggggcucggcaagaccagcaucgggcugcugugcgugaccuccagcuccgcccuccuguggauggccagcguggagccccacuggaucgcggccuccaucauccuggaguucuuccucaugguccugcugauccccgagcccgaccgccagcggacgccgcaggacaaccagcucgccuacguggugaucggccugcuguucaugauccucaccgucgccgccaacgagauggggcugcuggagaccaccaagaaggaccucggcaucgggcacacggcggccgagaaccaccaccacgccgccaugcuggacguggaccugcaccccgccagcgcguggacccucuacgccguggccaccaccaucaucacgcccaugaugcgccacaccaucgagaacaccaccgccaacaucucccugacggccaucgcgaaccaggccgccauccugaugggccucgacaagggcuggccgaucagcaagauggacaucggggucccccugcuggcccucggcugcuacucccaggugaacccccugacccugaccgccgcggugcucaugcuggucgcccacuacgccaucaucgggcccggccugcaggccaaggcgacccgggaggcccagaagcgcacggccgccgggaucaugaagaacccgaccguggacggcaucguggccaucgaccucgaccccgucguguacgacgcgaaguucgagaagcagcugggccagaucaugcugcucauccugugcaccagccagauccugcucaugcggaccacgugggcccugugcgaguccaucacccuggccaccgggccccucaccacgcugugggagggcagccccgggaaguucuggaacaccaccaucgccguguccauggccaacaucuuccgcggcagcuaccuggcgggcgccgggcucgccuucagccugaugaagucccugggcgggggccgccgggggaccggcgcccagggcgagacgcucggggagaaguggaagcgccagcugaaccagcugagcaagucccaguucaacaccuacaagcggagcggcaucaucgaggucgaccgcuccgaggccaaggaggggcucaagcggggcgagaccaccaagcacgcggugagccgcgggacggccaagcugcggugguucguggagcgcaaccuggucaagccggagggcaaggugaucgaccugggcugcgggcggggcgggugguccuacuacugcgccggccucaagaaggugaccgaggucaagggguacaccaagggcggccccgggcacgaggagcccauccccauggccaccuacggcuggaaccuggugaagcugcacagcgggaaggacguguucuucaucccgcccgagaagugcgacacccuccugugcgacaucggcgaguccagccccaaccccacgaucgaggaggggcgcacccugcggguccucaagaugguggagccguggcugcgcggcaaccaguucugcaucaagauccugaaccccuacaugcccuccguggucgagacccucgagcagaugcagcggaagcacggcgggaugcuggugcgcaacccccugagccggaacuccacccacgagauguacugggugagcugcggcacggggaacaucgucuccgcggugaacaugaccagccgcaugcuccugaaccgguucaccauggcccaccgcaagccgaccuacgagcgggacguggaccugggcgccggcacgcgccacgucgccguggagcccgaggucgccaaccucgacaucaucgggcagcgcaucgagaacaucaagaacgagcacaaguccaccuggcacuacgacgaggacaaccccuacaagaccugggcguaccacggcagcuacgaggugaagcccuccgggagcgccagcuccauggugaacggcgucgugcggcugcugaccaagccgugggacgugauccccauggucacgcagaucgccaugaccgacaccacccccuucgggcagcagcgcguguucaaggagaagguggacacgcggacccccaaggccaagcgcggcaccgcccagaucauggaggucaccgcgaaguggcucuggggcuuccugagccggaacaagaagccgcgcaucugcacgcgggaggaguucacccgcaaggugcgguccaacgccgccaucggggccguguucgucgacgagaaccaguggaacagcgccaaggaggcgguggaggacgagcgcuucugggaccuggugcggcgcgagcgggagcuccacaagcagggcaagugcgcgaccugcgucuacaacaugauggggaagcgcgagaagaagcugggcgaguucgggaaggccaagggcucccgggccaucugguacauguggcugggcgcgcgcuuccucgaguucgaggcccugggguucaugaacgaggaccacugguucagccgggagaacucccugagcggcguggagggggagggccuccacaagcugggguacauccugcgcgacaucuccaagauccccggcggcaacauguacgccgacgacaccgccgggugggacacgcggaucaccgaggaggaccuccagaacgaggccaagaucaccgacaucauggagcccgagcacgcgcugcuggccaccagcaucuucaagcucacguaccagaacaaggugguccgcgugcagcggccggccaagaacggcaccgugauggacgucaucucccgccgcgaccagcgggggagcggccaggugggcaccuacgggcugaacaccuucacgaacauggaggcccagcugauccgccagauggaguccgagggcaucuucagccccuccgagcucgagacccccaaccuggccgggcgggugcuggacuggcucgagaagcacggcaucgagcgccugcggcgcauggcgaucagcggggacgacugcgucgugaagcccaucgacgaccgguucgccaccgcccugaccgcccucaacgacaugggcaaggugcgcaaggacaucccgcagugggagcccuccaagggcuggaacgacuggcagcagguccccuucugcagccaccacuuccaccagcugaucaugaaggacgggcgggagaucguggugcccugccgcaaccaggacgagcuggucggccgggcccgcgugagccagggggcgggcuggucccuccgggagacggccugccugggcaagagcuacgcccagauguggcagcugauguacuuccaccgccgggaccuccgccuggccgccaacgcgaucugcuccgccgugccggucgacugggugcccaccagccggaccaccugguccauccacgcccaccaccaguggaugaccacggaggacaugcugagcguguggaaccgcgucuggaucgaggagaaccccuggauggaggacaagacccacguguccagcugggaggacgugcccuaccucggcaagcgggaggaccaguggugcggcucccugaucgggcugaccgcccgcgcgaccugggccacgaacauccaggucgccaucaaccaggugcgccggcucaucggcaacgagaacuaccuggacuacaugaccagcaugaagcgcuucaagaacgaguccgacccggagggggcccugugguga

SEQ ID NO: 8907 - RNA, 9879 nt, Artificial Sequence
  derived and/or modified CDS sequence (opt1) from DENV-1__JQ915080__SS-prME
agcgugaccaugcugcucaugcugcugcccaccgugcucaccuuccaccugaccacccggggcggggagccccacaugaucgugagcaagcaggagcggggcaagagccuccuguucaagaccuccgccggggugaacaugugcacgcugaucgccauggaccugggcgagcucugcgacgacaccaugaccuacaagugcccccgcaucaccgagacggagcccgacgacguggacugcuggugcaacgcgaccgagaccugggugaccuacgggacgugcagccagaccggcgagcaccggcgcgacaagcgguccguggcccuggcgccccacgucggccuggggcucgagacccgcaccgagacguggaugagcuccgagggcgccuggcggcagauccagaagguggagaccugggcccugcgccaccccggguucaccgugaucgcgcuguuccucgcccacgccaucggcaccagcaucacgcagaaggggaucaucuucauccugcugaugcucgucacccccuccauggccaugcggugcgugggcaucggcaaccgcgacuucguggaggggcugagcggcgcgaccugggucgacguggugcuggagcacggguccugcgucaccacgauggccaaggacaagcccacccucgacaucgagcugcugaagaccgaggugaccaaccccgccgugcuccggaagcugugcaucgaggccaagaucagcaacacgaccaccgacucccgcugcccgacccagggcgaggccacgcuggucgaggagcaggacaccaacuucgugugccggcgcaccuucguggaccggggcugggggaacggcugcggccucuucggcaaggggagccugaucacgugcgcgaaguucaagugcgucacgaagcuggagggcaagaucgugcaguacgagaaccucaaguacuccgugaucgucaccgugcacaccggcgaccagcaccaggucgggaacgagaccaccgagcacggcacgaucgccaccaucacgccccaggcccccaccagcgagauccagcugacggacuacggggcccugacccucgacugcagcccccggaccggccuggacuucaacgagauggugcugcucaccaugaaggagaaguccuggcuggugcacaagcagugguuccuggaccucccgcugcccuggacgaccggggccuccaccagccaggagaccuggaaccggcaggaccugcucgucacguucaagaccgcgcacgccaagaagcaggagguggugguccugggcagccaggagggcgccaugcacaccgcccugaccggggccacggagauccagaccuccggcaccaccacgaucuucgcggggcaccucaagugccgccugaagauggacaagcugacccucaagggcaucagcuacgugaugugcaccggguccuucaagcuggagaaggagguggccgagacccagcacggcacgguccugguccaggugaaguacgagggcaccgacgcccccugcaagauccccuucagcucccaggacgagaagggggucacccagaacggccggcuggugaccgccaacccgaucgugacggacaaggagcgccccgucaacaucgaggccgagccgcccuucggggagagcuacaucguggugggcgcgggcgagaaggcccucaagcuguccugguucaagaaggggagcuccaucggcaagauguucgaggccaccgcccgcggggcccgccgcauggccauccugggcgacaccgccugggacuucgggagcaucggcggcgucuucaccuccguggggaagcucgugcaccagaucuucggcacggccuacgggguccuguucagcggcguguccuggaccaugaagaucgggaucggcauccugcucaccuggcugggccugaacagccgguccaccagccucuccaugacgugcaucgccguggggauggucacccuguaccugggcgugauggugcaggcggacagcgggugcgucaucaacuggaagggccgcgagcucaagugcggguccggcaucuucgugaccaacgaggugcacaccuggaccgagcaguacaaguuccaggccgacagcccgaagcggcugagcgccgccaucggcaaggccugggaggagggggucugcggcauccgcuccgcgacgcggcuggagaacaucauguggaagcagaucagcaacgagcucaaccacauccugcuggagaacgacaugaaguucaccgugguggucggggacguguccggcauccucgcccaggggaagaagaccauccgcccccagcccauggagcacaaguacagcuggaaguccuggggcaaggccaagaucaucggcgccgacgugcagaacaccacguucaucaucgacgggcccaacaccccggagugccccgacgaccagcgggccuggaacaucugggaggucgaggacuacggcuucgggaucuucaccaccaacaucuggcugaagcugcgcgacagcuacacccaggugugcgaccaccggcucauguccgcggccaucaaggacagcaaggccgugcacgccgacaugggcuacuggaucgaguccgagaagaacgagaccuggaagcuggcgcgcgccagcuucaucgaggucaagaccugcguguggcccaagucccacacccuguggagcaacggcgugcucgaguccgagauggucauccccaagaucuacgggggcccgaucagccagcacaacuaccggcccggguacuucacgcagaccgccggccccuggcaccuggggaagcuggagcucgacuucgaccugugcgagggcaccaccgugguggucgacgagcacugcggcaaccgcgggccgucccugcggacgaccaccgugaccggcaagaucauccacgaguggugcugccgcagcugcacgcugccgccccugcgguucaagggggaggacggcugcugguacgggauggagauccgccccgugaaggagaaggaggagaaccuggucaaguccauggugagcgccggcagcggcgagguggacuccuucagccucgggcugcugugcaucuccaucaugaucgaggaggucaugcggagccgcuggucccggaagaugcucaugaccggcacccugguggucuuccugcuccugacccuggggcagcucacguggaacgaccugauccgccugugcaucauggugggcgccaacgcgagcgacaacauggggaugggcacgaccuaccucgcccugauggccaccuuccgcaugcggccgauguucgccguggggcuccucuuccgccggcugacgucccgcgagguccugcuccugaccguggggcugagccucguggccuccgucgagcugcccaacagccuggacgagcucggcgacgggcuggccaugggcaucaugauccugaagcuccugaccgacuuccagucccaccagcugugggccacccuccugagccugacguucgugaagaccacccucucccugcacuacgccuggaagaccauggccaugauccugagcaucgugucccuccugccccugugccucagcacgaccucccagaagaccaccuggcugcccguccugcucggcagccuggggugcaagccgcugaccauguuccucaucacggagaacaagaucuggggccggaaguccuggccccugaacgaggggaucauggccgugggcaucgugagcauccugcucagcucccugcugaagaacgacgucccccucgcggggccccugaucgccggcggcaugcugaucgccugcuacgugaucagcggguccagcgccgaccucucccuggagaaggcggccaaggugagcugggaggaggaggccgagcacuccggcgccagccacaacauccuggucgagauccaggacgacgggaccaugaagaucaaggacgaggagcgcgacgacaccaucaccauccuccugaaggccacgcugcucgcgaucuccggcguguacccgaugagcauccccgccacccuguucguguggcacuucuggcagaagaagaagcagcgguccgggguccugugggacacccccagcccgcccgagguggagaaggccgugcuggacgacggcaucuaccgcauccuccagcggggccugcuggggcgcucccaggucggcguggggguguuccaggagggcgucuuccacaccauguggcacgugacgcgcggggccgugcucauguaccagggcaagcgccuggagcccagcugggccuccgucaagaaggaccugaucagcuacggcgggggcuggcgguuccagggguccuggaacaugggcgaggagguccaggugaucgcggucgagcccgggaagaaccccaagaacgugcagaccgcccccggcaccuucaagaccagcgagggcgaggugggggccaucgcccucgacuucaagcccggcacguccgggagccccaucgucaaccgcgagggcaagaucgugggccuguacgggaacggcguggucaccaccagcgggaccuacguguccgccaucgcgcaggccaaggccagccaggagggcccccugccggagaucgaggacgagguguuccggaagcgcaaccucacgaucauggaccugcaccccggguccggcaagacccggcgcuaccugcccgccaucguccgggaggccaucaagcgcaagcuccggacccuggugcuggcgccgacccgcguggucgccagcgagauggccgaggcccucaagggcaugcccauccgcuaccagacgaccgcggugaaguccgagcacaccgggaaggagaucguggaccugaugugccacgccaccuucacgaugcggcugcucagccccguccgcgugcccaacuacaacaugaucaucauggacgaggcccacuucaccgacccggccuccaucgccgcgcggggcuacaucagcacccgcguggggaugggcgaggccgccgccaucuucaugaccgccacgccgcccggguccgucgaggcguucccccagagcaacgccgugauccaggacgaggagaaggacaucccggagcgguccuggaacagcggcuacgacuggaucaccgacuuccccggcaagaccgugugguucguccccuccaucaagagcgggaacgacaucgccaacugccugcgcaagaacggcaagcgggugauccagcugucccgcaagaccuucgacacggaguaccagaagaccaagaacaacgacugggacuacgucgugaccaccgacaucagcgagaugggggccaacuuccgggccgaccgcgugaucgacccccggcgcugccucaagccggucauccugaaggacggccccgagcgggugauccuggcggggcccaugcccgugacggucgccuccgccgcccagcgccggggccgcaucggccggaaccagaacaaggagggggaccaguacaucuacaugggccagccgcucaacaacgacgaggaccacgcgcacuggaccgaggccaagaugcugcuggacaacaucaacacccccgaggggaucauccccgcccucuucgagcccgagcgcgagaaguccgccgccaucgacggcgaguaccggcugcgcggggaggcgcgcaagaccuucguggagcugaugcggcgcggcgaccucccgguguggcuguccuacaaggucgccagcgagggcuuccaguacagcgaccggcgcuggugcuucgacggggagcggaacaaccaggugcuggaggagaacauggacguggagaucuggacgaaggagggcgagcgcaagaagcuccggccccgcuggcuggacgcccggaccuacuccgacccccuggcccuccgcgaguucaaggaguucgccgcggggcggcgcagcgucuccggcgaccugauccuggagaucggcaagcucccccagcaccugacccagcgggcccagaacgcccuggacaaccucgugaugcugcacaacagcgagcagggcgggaaggccuaccgccacgccauggaggagcugccggacaccaucgagaccaucaugcuccuggcgcugaucgccgugcucaccggcggggucacccuguucuuccuguccgggcgggggcucggcaagaccagcaucgggcugcugugcgugaccuccagcuccgcccuccuguggauggccagcguggagccccacuggaucgcggccuccaucauccuggaguucuuccucaugguccugcugauccccgagcccgaccgccagcggacgccgcaggacaaccagcucgccuacguggugaucggccugcuguucaucauccucaccgucgccgccaacgagauggggcugcuggagaccaccaagaaggaccucggcaucgggcacacggcggccgagaaccaccaccacgccgccaugcuggacguggaccugcaccccgccagcgcguggacccucuacgccguggccaccaccaucaucacgcccaugaugcgccacaccaucgagaacaccaccgccaacaucucccugacggccaucgcgaaccaggccgccauccugaugggccucgacaagggcuggccgaucagcaagauggacaucggggucccccugcuggcccucggcugcuacucccaggugaacccccugacccugaccgccgcggugcucaugcuggucgcccacuacgccaucaucgggcccggccugcaggccaaggcgacccgggaggcccagaagcgcacggccgccgggaucaugaagaacccgaccguggacggcaucguggccaucgaccucgaccccgucguguacgacgcgaaguucgagaagcagcugggccagaucaugcugcucauccugugcaccagccagauccugcucaugcggaccacgugggcccugugcgaguccaucacccuggccaccgggccccucaccacgcugugggagggcagccccgggaaguucuggaacaccaccaucgccguguccauggccaacaucuuccgcggcagcuaccuggcgggcgccgggcucgccuucagccugaugaagucccugggcgggggccgccgggggaccggcgcccagggcgagacgcucggggagaaguggaagcgccagcugaaccagcugagcaagucccaguucaacaccuacaagcggagcggcaucaucgaggucgaccgcuccgaggccaaggaggggcucaagcggggcgagaccaccaagcacgcggugagccgcgggacggccaagcugcggugguucguggagcgcaaccuggucaagccggagggcaaggugaucgaccugggcugcgggcggggcgggugguccuacuacugcgccggccucaagaaggugaccgaggucaagggguacaccaagggcggccccgggcacgaggagcccauccccauggccaccuacggcuggaaccuggugaagcugcacagcgggaaggacguguucuucaucccgcccgagaagugcgacacccuccugugcgacaucggcgaguccagccccaaccccacgaucgaggaggggcgcacccugcggguccucaagaugguggagccguggcugcgcggcaaccaguucugcaucaagauccugaaccccuacaugcccuccguggucgagacccucgagcagaugcagcggaagcacggcgggaugcuggugcgcaacccccugagccggaacuccacccacgagauguacugggugagcugcggcacggggaacaucgucuccgcggugaacaugaccagccgcaugcuccugaaccgguucaccauggcccaccgcaagccgaccuacgagcgggacguggaccugggcgccggcacgcgccacgucgccguggagcccgaggucgccaaccucgacaucaucgggcagcgcaucgagaacaucaagaacgagcacaaguccaccuggcacuacgacgaggacaaccccuacaagaccugggcguaccacggcagcuacgaggugaagcccuccgggagcgccagcuccauggugaacggcgucgugcggcugcugaccaagccgugggacgugauccccauggucacgcagaucgccaugaccgacaccacccccuucgggcagcagcgcguguucaaggagaagguggacacgcggacccccaaggccaagcgcggcaccgcccagaucauggaggucaccgcgaaguggcucuggggcuuccugagccggaacaagaagccgcgcaucugcacgcgggaggaguucacccgcaaggugcgguccaacgccgccaucggggccguguucgucgacgagaaccaguggaacagcgccaaggaggcgguggaggacgagcgcuucugggaccuggugcggcgcgagcgggagcuccacaagcagggcaagugcgcgaccugcgucuacaacaugauggggaagcgcgagaagaagcugggcgaguucgggaaggccaagggcucccgggccaucugguacauguggcugggcgcgcgcuuccucgaguucgaggcccugggguucaugaacgaggaccacugguucagccgggagaacucccugagcggcguggagggggagggccuccacaagcugggguacauccugcgcgacaucuccaagauccccggcggcaacauguacgccgacgacaccgccgggugggacacgcggaucaccgaggaggaccuccagaacgaggccaagaucaccgacaucauggagcccgagcacgcgcugcuggccaccagcaucuucaagcucacguaccagaacaaggugguccgcgugcagcggccggccaagaacggcaccgugauggacgucaucucccgccgcgaccagcgggggagcggccaggugggcaccuacgggcugaacaccuucacgaacauggaggcccagcugauccgccagauggaguccgagggcaucuucagccccuccgagcucgagacccccaaccuggccgggcgggugcuggacuggcucgagaagcacggcaucgagcgccugcggcgcauggcgaucagcggggacgacugcgucgugaagcccaucgacgaccgguucgccaccgcccugaccgcccucaacgacaugggcaaggugcgcaaggacaucccgcagugggagcccuccaagggcuggaacgacuggcagcagguccccuucugcagccaccacuuccaccagcugaucaugaaggacgggcgggagaucguggugcccugccgcaaccaggacgagcuggucggccgggcccgcgugagccagggggcgggcuggucccuccgggagacggccugccugggcaagagcuacgcccagauguggcagcugauguacuuccaccgccgggaccuccgccuggccgccaacgcgaucugcuccgccgugccggucgacugggugcccaccagccggaccaccugguccauccacgcccaccaccaguggaugaccacggaggacaugcugagcguguggaaccgcgucuggaucgaggagaaccccuggauggaggacaagacccacguguccagcugggaggacgugcccuaccucggcaagcgggaggaccaguggugcggcucccugaucgggcugaccgcccgcgcgaccugggccacgaacauccaggucgccaucaaccaggugcgccggcucaucggcaacgagaacuaccuggacuacaugaccagcaugaagcgcuucaagaacgaguccgacccggagggggcccugugguga

SEQ ID NO: 8908 - RNA, 9879 nt, Artificial Sequence
  derived and/or modified CDS sequence (opt1) from DENV-1__KJ755855__SS-prME
agcgugaccaugcugcucaugcugaugcccaccgcccuggccuuccaccucaccacccggggcggggagccccacaugaucgugagcaagcaggagcggggcaagagccugcuguucaagaccagcgccggggugaacaugugcacccucaucgccauggaccugggcgagcugugcgaggacaccaugaccuacaagugcccccgcaucaccgaggccgagcccgacgacguggacugcuggugcaacgccaccgacaccugggugaccuacgggaccugcagccagaccggcgagcaccggcgcgacaagcggagcguggcccucgcgccccacgugggccuggggcuggagacgcgcgccgagaccuggaugagcuccgagggcgccuggaagcagauccagcgggucgagaccugggcccuccgccaccccggguucaccgugaucgcgcuguuccuggcccacgccaucggcacgagcaucacccagaaggggaucaucuucauccuccugaugcuggugacccccuccauggccaugcggugcgucggcaucggcagccgcgacuucguggaggggcucuccggcgccaccuggguggacgucgagcuggagcacgggagcugcgugacgaccauggcgaaggacaagcccacccuggacaucgagcuccugaagaccgaggugacgaaccccgccguccugcggaagcucugcaucgaggccaagaucuccaacaccaccaccgacagccgcugcccgacgcagggcgaggccacccugguggaggagcaggacgccaacuucgugugccggcgcaccuucgucgaccggggcugggggaacggcugcgagcuguucgggaagggcucccuccugaccugcgcgaaguucaagugcgugacgaagcuggaggggaagaucgugcaguacgagaaccucaaguacagcgucaucgugaccgugcacaucgccgcccagcaccaggucggcaacgaguccaccgagcacggcaccacggccaucaucacgccccaggcccccaccaccgagauccagcugaccgacuacggggcgcugacgcucgacugcagcccccgcaccggccuggacuucaacgagauggugcugcucaccaugaaggagaaguccuggcugguccacaagcagugguuccuggaccucccccugcccuggaccagcggggccagcacgucccaggagaccuggaaccggcuguuccuccuggugaccuucaagaccgcccacgccaagaagcaggagguggucgugcugggcagccaggagggggccaugcacacggcgcucaccggcgccaccgcccugcagaccuucggcacgaccaccaucuucgccgggcaccugaacauccgccucaagauggacaagcugacccugaagggcauguccuacgugaugugcacggggagcuucaagcuggagaaggaggucgcggagacccagcacggcaccauccucgugcagaucaaguacgaggggaccgacgcccccugcaagauccccuucuccacgcaggacgagaagggcgugacccagaacggccggcugaucaccgccaacccgaucgucaccgacaaggagaagcccgugaacaucgaggccgagccgcccuucggggagagcuacaucgugaucggcgccggggagaaggcgcugaagcucuccugguucaagaagggcagcuccaucggcaagauguucgaggccacggcccgcggggcccggcgcauggccauccugggcgacaccgcgugggacuucgggagcaucggcggggucuucaccuccgugggcaagcuggugcaccagaucuucggcaccgccuacgggguccucuucagcggcguguccuggacgaugaagaucgggaucggcgugcugcugaccuggcucgggcugaacagccgcuccaccagccuguccaugaccugcaucgccgucggccucgugacgcuguaccugggcgugaugguccaggccgacagcgggugcgugaucaacuggaagggccgggagcucaagugcggguccggcaucuucgugaccaacgagguccacaccuggaccgagcaguacaaguuccaggccgacagcccgaagcgccugagcgcggccaucgggaaggccugggaggagggcgugugcggcauccgguccgccacgcgccuggagaacaucauguggaagcagaucagcaacgagcucaaccacauccugcuggagaacgaccucaaguucaccguggucgugggggacguggcgggcauccuggcccaggggaagaagaugauccggccccagcccauggagcacaaguacuccuggaagaacuggggcaaggccaagaucaucggggccgacguccagaacagcaccuucaucaucgacggccccaacaccccggagugcuccgacgaccagcgcgccuggaacaucugggagguggaggacuacggcuucgggaucuucaccacgaacaucuggcugaagcuccgggacagcuacacccaggugugcgaccaccgccugauguccgcggccaucaaggacagcaaggccguccacgccgacaugggcuacuggaucgaguccgagaagaacgagaccuggaagcuggcccgggcgagcuucaucgaggugaagaccugcacguggcccaagucccacacccucuggagcaacggggugcuggaguccgagaugaucauccccaagaucuacggcggccccaucagccagcacaacuacuccccgggguacuucacccagaccgccggccccuggcaccuggggaagcucgagcuggacuucgaccugugcgagggcacgaccgucgugguggacgagcacugcgggaaccgcggccccagccuccggaccaccacggucaccggcaagaucauccacgaguggugcugccgcuccugcacccugccgccccugcgguuccgcggggaggacggcugcugguacgggauggagauccggcccgugaaggagaaggaggagaaccucgucaagagcauggucagcgccggcuccggggagguggugagccugucccugggccuccugugcaucagcaucaugaucgaggaggucaugcgcucccgguggagccgcaagaugcugaugaccggcacgcucgccguguucuuccggaagauccgcgggcagcugaccuggaacgaccugauccgccucugcaucauggugggcgccaacgcguccgaccggauggggacccgcaccacguaccuggcccugauggccaccuucaagaugcggcccauguucagcgucggccuccuguuccgccggcugaccucccgcgaggugcuccugcugaccaucgggcucagccugguggccuccgucgagcugccgaacagccucgaggagcugggcgugcugcucgcgaugggcaucaugauccugacgcugcucaccgacuuccagucccaccagcugugggccacccugcucagcaugaccuucaucaagacgaccuucucccugcacuacaccuggaagaccauggccaugguccugagcaucgugucccucuucccccugugccugagcacgaccucccagaagaccaccuggcuccccgugcugcuggggagccucggcugcaagccccugacgauguuccugaucgccgagaacaagaucugggggcgcaagagcuggccgcucaacgagggcaucauggccgucggcaucguguccauccugcugagcucccuccugaagaacgacgugccccuggcggggccccucaucgccggcgggaugcugaucgccugcuacgucaucagcggcuccagcgccgaccugucccucgagaaggccgcggaggugagcugggaggaggaggccgagcacuccggggccagccacaacauccugguggagguccaggacgacggcaccaugaagaucaaggacgaggagcgcgacgacacccugaccauccuccugaaggccacccugcucgccguguccggcguguacccccugagcaucccggcgacgcuguucgucugguacuucuggcagaagaagaagcagcgguccggggugcugugggacacccccuccccgcccaagguggagaaggccguccucgacgacggcaucuaccgcaucaugcagcgggggcugcugggccgcucccaggugggggugggcgucuuccaggagaacguguuccacaccauguggcacgugacccggggcgccguccucauguaccaggggaagcgccuggagccgagcuggggccgggugaagaaggaccugaucuccuacgggggcggguggggccucaagggcagcuggaacacgggggaggaggugcaggucaucgccguggagcccggcaagaaccccaagaacgugcagaccgcccccgggaccuucaagaccccggagggcgaggucggggcgaucgcccuggacuucaagcccggcacguccggcagccccaucgugaaccgcgaggggaagaucgugggccuguacgggaacggcgucgugaccaccagcggcaccuacguguccgccaucgcccacgcgaaggccagccaggaggggccccucccggagacggaggucgaggccuuccggaagcgcaaccugaccaucauggaccugcaccccggcuccgggaagacccggcgcuaccuccccgccaucgugcgggaggccaucaagcgcaagaugcgcacccugauccuggcgccgacgcggguggucgccagcgagauggccgaggcccucaagggcaugcccauccgcuaccagaccaccgccgugaaguccgagcacaccgggaaggagaucguggaccugaugugccacgcgacguucaccaugcggcugcucagccccguccgcgugcccaacuacaacaugaucaucauggacgaggcccacuucaccgacccguccagccuggccgcccggggcuacaucuccacccgcgugggcaugggggaggccgcggccaucuucaugacggccacgccgcccggcagcgucgaggccuucccccaguccaacgcggugauccaggacgaggagcgggacaucccggagcgcagcuggaacuccggguacgaguggaucaccgacuuccccggcaagaccgugugguucguccccagcaucaaggccgggaacgacaucgccaacugccugcggaagaacggcaagcgcgugauccagcucucccggaagacguucgacaccgaguaccagaagaccaagaacaacgacugggacuacguggucaccacggacaucagcgagaugggcgccaacuuccccgccgaccgcgugaucgacccgcggcgcugccugaaccccgugauccugaaggacgggcccgagcgggucauccucgcgggccccaugccggugaccgucgccuccgccaaccagcgccgggggcgcaucggccggaaccacaacaaggagggggaccaguacaucuacaugggccagccccugaacaacgacgaggaccacgcccacuggaccgaggccaagaugcugcucgacaacaucaacacccccgagggcaucauccccgcgcuguucgagccggagcgcgagaaguccgccgccaucgacggggaguaccgccugcggggcgaggcccgcaagacguucguggagcucaugcggcgcggggaccugcccguguggcuguccuacaaggucgccagcgagggcuuccaguacagcgaccggcgcuggugcuucgacggggagcggaacaaccaggugcucgaggagaacauggacguggagaucuggaccaaggagggcgagcgcaagaagcugcggccccgcuggcuggacgcgcggaccuacuccgacccccucgcccugcgcgagaagaaggaguucgccgccggccggcgcagcgucuccggggaccugauccucgagaucggcaagcugccgcagcaccugacccagcgggcgcagaacgcccucgacaaccuggugaugcugcacaacagcgagcagggcgggcgcgccuaccggcacgccauggaggagcuccccgacacgaucgagacccugaugcugcucgcccugaucgcggugcugaccggcggggucacccucuucuuccuguccggcaaggggcugggcaaggccgggaacggccuccugugcgugauggccagcuccgcccugcucuggauggccaacguggagccccacuggaucgcggccagcaucauccuggaguucuuccugaugguccuccugauccccgagccggaccgccagcggacgccccaggacaaccagcuggccuacguggugauccgccuccuguucaugauccugacggucgccgccaacgagaugggccuccuggagaccaccaagaaggaccuggggaucggccacgcggccguggagaaccaccaccacgccgccaugcucgacaucgaccugcaccccgccuccgcguggacccuguacgccguggccacgaccaucaucaccccgaugaugcggcacaccaucgagaacacgaccgccaacaucagccucaccgcgaucgccaaccaggccgccauccugauggggcuggacaagggcuggcccaucuccaagauggacaucggggucccccuccuggcccugggcuuccucagccaggugaacccccugacccugacggcggccgugcucaugcuggucgcccacuacgccaucaucggcccggggcugcaggccaaggcgacccgcgaggcccagaagcgcaccgccgccggcaucaugaagaaccccaccaucgacgggaucguggccaucgaccucgaccccguggucuacgacgcgaaguucgagaagcagcugggccagaucaugcugcucauccugugcacgucccagauccugcucaugcggaccaccugggcccugugcgagagcaucacccuggccacggggccccucuccccgcugugggagggcagccccggcaaguccuggaacaccaccaucgccgugagcauggcgaacaucuuccgcggguccuaccuggccggcgccgggcucgccuucagccugaugaagucccugggcggcgggcggcgcggcaccggggcccagggcgagacgcucggggagaaguggaagcggcagcugaaccagcuguccaagaccgaguucaacaccuacaagcgcagcggcaucauggagguggaccgguccgaggcgaaggagggccugaagcgcggggagaccacgaagcacgccgucagccggggcaccgccaagcuccgcugguucguggagcggaaccuggugaagcccgaggggaaggucaucgaccugggcugcgggcgcggcggcugguccuacuacugcgccgggcucaagaaggugagcgaggugcggggcuacaccaagggcgggcccgggcacgaggagccgauccccauggccaccuacggcugggaccugcugaagcgcugcuccggcaaggaguucuucuucaucccgcccgagaagugcgacagcuuccucggggacaucggcgaguccagcccgaaccccacgaucgaggaggggcggaccguccgcgugcugaagaugguggagcccuggcugcggggcaaccaguucugcaucaagauccucaaccccuacaugccguccgucguggagacccuggagcagaugcagcgcaagcacgggggcaugcuggugcggaacccccucagccgcaacuccacccacgagauguacugggucagcugcggcacggggaacaucguguccgcggugaacaugaccagccgcaugcugcugaaccgguucaccauggcccaccgcaagcccaccuacgagcgggacgucgaccucggcgccgggacccgccacguggccguggagcccgaggucgccaaccuggacaucaucggccagcggaucgagaacaucaagcacgagcacaaguccacguggcacuacgacgaggacaacccguacaagaccugggcguaccacggcagcuacgaggugaagcccuccgggagcgccagcuccauggugaacggcgucgugaagcugcucaccaagcccugggacgugauccccauggucacccagaucgccaugacggacaccaccccguucgggcagcagcgcguguucaaggagaaggucgacacccggacgcccaaggccaagcgcggcaccgcgcagaucauggaggugaccgcccgguggcuguggagcuuccugucccgcaacaagaagccccggaucugcacccgcgaggaguucacgcggaaggugcgcagcaacgccgccaucggggccgucuucguggacgagaaccaguggaacuccgcgaaggaggccguggaggacgaccgguucugggaccucguccaccgcgagcgggagcugcacaagcagggcaagugcgcgaccugcguguacaacaugaugggcaagcgcgagaagaagcugggggaguucggcaaggccaaggggagccgggccaucugguacauguggcucggcgcgcgcuuccuggaguucgaggcccugggguucaugaacgaggaccacugguucucccgggagaacagccucuccggcguggagggcgaggggcugcacaagcugggcuacauccuccgcgacaucagcaagauccccggcgggaacauguacgccgacgacaccgccgggugggacacccgcaucacggaggacgaccugcagaacgaggccaagaucaccgacaucauggagcccgagcacgcgcugcucgccaaguccaucuucaagcugaccuaccagaacaaggucgugcgggugcagcgccccgccaagaacgggaccgucauggacgugaucagccggcgcgaccagcggggcuccggccaggugggcacguacgggcugaacaccuucaccaacauggaggcccagcucauccgccagauggagagcgaggagaucuucucccccaacgagcuggagaccccgaaccuggccgagcggguccucgacuggcuggagaaguacggcguggagcgccugaagcggauggcgaucagcggcgacgacugcguggucaagcccaucgacgaccgcuucgccacggcccucaccgcccugaacgacauggggaaggugcggaaggacaucccccagugggagcccuccaagggcuggaacgacuggcagcaggucccguucugcagccaccacuuccaccagcuggucaugaaggacgggcgcgagaucguggugcccugccggaaccaggacgagcucgucggccgcgcgcgggugagccagggggccggcuggucccugcgcgagaccgccugccugggcaagagcuacgcccagauguggcagcucauguacuuccaccggcgcgaccugcggcuggccgcgaacgccaucugcuccgccgugcccgucgacugggugcccaccagccgcacgaccugguccauccacgcccaccaccaguggaugaccaccgaggacaugcucagcguguggaaccgcgucuggaucgaggagaacccguggauggaggacaagacgcggguguccagcugggaggacgugcccuaccuggggaagcgcgaggaccaguggugcggcucccugaucgggcucaccgcccgggcgaccugggccaccaacauccaggucgccaucaaccaggugcgccggcugaucggcaacgagaacuacagcgacuacaugacguccaugaagcgcuucaagaacgagagcgagcccgagggggcccugugguga

SEQ ID NO: 8909 - RNA, 9879 nt, Artificial Sequence
  derived and/or modified CDS sequence (opt1) from DENV-1__KF289073__SS-prME
agcgugaccaugcuguucaugcuccugcccaccgcccuggccuuccaccucaccacccggggcggggagccccacaugaucgugagcaagcaggagcggggcaagagccugcuguucaagaccuccgccggggugaacaugugcacccucaucgccauggaccugggcgagcugugcgaggacaccaugaccuacaagugcccccggaucaccgaggccgagcccgacgacguggacugcuggugcaacgccaccgacaccugggucaccuacgggaccugcagccagaccggcgagcaccggcgggacaagcgguccguggcccucgcgccccacgugggccuggggcuggagacgcgcaccgagaccuggaugagcuccgagggcgccuggaagcagauccagaaggucgagaccugggcccuccggcaccccggguucaccgugaucgcccuguuccuggcgcacgccaucggcaccagcaucacccagaaggggaucaucuucauccuccugaugcuggugacccccuccauggccaugcgcugcgucggcaucggcaaccgggacuucguggaggggcucagcggcgccacguggguggacgucgugcuggagcacggguccugcgugaccaccauggccaagaacaagcccacccuggacaucgagcuccugaagacggaggucaccaaccccgcggugcugcgcaagcucugcaucgaggccaagaucagcaagaccaccacggacucccggugccccacccagggcgaggccacccugguggaggagcaggacgccaacuucgucugccgccggaccuucguggaccgcggcugggggaacggcugcgggcuguucggcaaggggagccuccugacgugcgccaaguucaagugcgugaccaagcuggagggcaagaucguccaguacgagaaccucaaguacuccgugaucgugaccguccacaccggcgaccagcaccagguggggaacgagacgaccgagcacggcaccaucgcgaccaucacgccccaggcccccacgagcgagauccagcugaccgacuacggggcccugacccucgacugcagcccccggaccggccuggacuucaacgagaugguccugcucacgaugaaggagaaguccuggcuggugcacaagcagugguuccuggaccucccgcugcccuggaccuccggggccagcaccagccaggagaccuggaaccgccaggaccugcucgugacguucaagaccgcccacgcgaagaagcaggaggucguggugcugggcucccaggagggcgccaugcacaccgcccugaccggggccacggagauccagaccagcggcaccaccacgaucuucgccgggcaccucaagugccggcugaagauggacaagcugacccucaagggcauguccuacgucaugugcaccgggagcuucaagcuggagaaggagguggcggagacccagcacggcacggugcugguccaggugaaguacgagggcaccgacgcccccugcaagauccccaucuccacccaggacgagaagggggugacccagaacggccgccugaucacggccaacccgaucgucaccgacaaggagaagcccgugaacaucgagaccgagccgcccuucggggagagcuacaucgugaucggcgccggcgagaaggcgcucaagcuguccugguucaagaaggggagcuccaucggcaagauguucgaggccaccgcccgcggggcccgccggauggccauccugggcgacacggcgugggacuucgggagcaucggcggcgucuucaccuccguggggaagcucgugcaccaggucuucggcaccgccuacggggugcuguucagcggcguguccuggaccaugaagaucgggaucggcguccugcucacguggcugggccugaacagccgcuccaccagccucuccaugaccugcaucgccguggggauggugacccuguaccugggcgucauggugcaggccgacagcgggugcgugaucaacuggaagggccgcgagcucaagugcggguccggcaucuucgucacgaacgaggugcacaccuggaccgagcaguacaaguuccaggccgacagcccgaagcggcugagcgcggccaucggcaaggccugggaggagggggugugcggcauccgcuccgccacccggcuggagaacaucauguggaagcagaucagcaacgagcucaaccacauccugcuggagaacgacaugaaguucaccgucguggugggggacgccaacggcauccucgcgcaggggaagaagaugauccgcccccagcccauggagcacaaguacuccuggaaguccuggggcaaggccaagaucaucggcgccgacauccagaacacgaccuucaucaucgacgggcccgacaccccggagugccccgacgaccaccgggccuggaacaucugggaggucgaggacuacggcuucgggaucuucaccacgaacaucuggcugaagcugcgcgacuccuacacccagaugugcgaccaccggcucaugagcgcggccaucaaggacuccaaggccgugcacgccgacaugggcuacuggaucgagagcgagaagaacgagaccuggaagcuggcccgcgcguccuucaucgaggugaagaccugcaucuggcccaagagccacacgcugugguccaacggcguccucgagagcgagaugaucauccccaagaucuacgggggcccgaucucccagcacaacuaccggcccggguacuucacccagaccgccggccccuggcaccuggggaagcuggagcucgacuucgaccugugcgagggcaccacggugguggucgacgagcacugcggcaaccgcgggccgagccugcggaccaccaccgugacgggcaagaucauccacgaguggugcugccgcuccugcacccugccgccccuccgguucaagggggaggacggcugcugguacgggauggagauccgccccgugaaggagaaggaggagaaccugguccggagcaugguguccgccggcagcggcgagguggacagcuucucccucgggcugcugugcgucagcaucaugaucgaggaggugaugcgcucccgguggagccgcaagaugcucaugaccggcacccuggccguguuccugcuccugaucauggggcagcugacguggaacgaccucauccggcugugcaucauggucggcgccaacgcguccgaccgcauggggaugggcaccaccuaccuggcccucauggccaccuucaagaugcgcccgauguucgccgugggccugcuguuccggcgccucacgagccgggaggugcugcugcucaccaucgggcugucccuggucgccagcguggagcuccccaacucccuggaggagcugggcgacgggcucgcgaugggcaucaugaugcugaagcugcucaccgacuuccagagccaccagcuguggaccacgcugcucucccugaccuucaucaagaccacccugagccucgacuacgccuggaagacgauggccaugguccuguccaucgugagccuguucccccucugccuguccaccaccagccagaagaccacguggcugcccgugcuccugggcuccuucgggugcaagccgcugaccauguuccucaucaccgagaacaagaucuggggccgcaagagcuggccccugaacgaggggaucauggccgucggcaucguguccauccugcucagcagccugcugaagaacgacgugccccucgcggggccccugaucgccggcggcaugcugaucgccugcuacgucaucuccgggagcuccgccgaccucagccuggagaaggccgcggagguguccugggaggaggaggccgagcacagcggcgccucccacaacauccugguggagguccaggacgacgggaccaugaagaucaaggacgaggagcgggacgacacccucacgauccugcugaaggccacccuccuggccgugagcggcguguacccgauguccauccccgcgacccuguucgucugguacuucuggcagaagaagaagcagcgcagcggggugcucugggacacccccagcccgcccgagguggagcgggccguccuggacgacggcaucuaccgcauccugcagcggggccugcucgggcgcagccaggugggcgugggggucuuccaggacggcguguuccacacgauguggcacgugacccgcggggccguccugauguaccagggcaagcgccuggagcccuccugggccagcgugaagaaggaccucaucuccuacggcgggggcuggcgguuccaggggagcuggaacaugggcgaggaggugcaggucaucgccguggagcccgggaagaaccccaagaacgugcagaccacccccggcacguucaagacccccgagggcgaggucggggcgaucgcccuggacuucaagcccggcaccuccgggagccccaucgugaaccgcgagggcaagaucgugggccuguacgggaacggcgucgugaccacguccgggaccuacgugagcgccaucgcccaggccaaggcgagccaggagggcccgcuccccgagaucgaggacgaggucuuccggaagcgcaaccugaccaucauggaccugcaccccggguccggcaagacccggcgcuaccucccggccaucgugcgggaggccaucaagcgcaagcugcggacgcugauccucgcccccacccgcguggucgcgagcgagauggccgaggcccugaagggcaugcccauccgcuaccagaccaccgccgugaaguccgagcacacggggcgggagaucguggaccugaugugccacgccaccuucaccaugcgccuccugagccccguccgggugccgaacuacaacaugaucaucauggacgaggcgcacuucaccgaccccgccuccaucgccgcccgcggcuacaucagcacgcggguggggaugggcgaggccgcggccaucuucaugaccgccacgccgcccggguccgucgaggccuucccgcagagcaacgccgugauccaggacgaggagcgcgacauccccgagcgguccuggaacagcggcuacgacuggaucaccgacuuccccggcaagacggugugguucguccccuccaucaagagcgggaacgacaucgcgaacugccugcgcaagaacggcaagcgggugauccagcucucccgcaagaccuucgacaccgaguaccagaagaccaagaacaacgacugggacuacguggucacgaccgacaucagcgagaugggggccaacuuccgggccgaccgcgugaucgacccgcggcgcugccugaagcccgugauccugaaggacggccccgagcgggucauccucgccgggcccaugccggugaccgucgcguccgccgcccagcgccggggccgcaucggccggaaccagaacaaggagggggaccaguacguguacaugggccagccccugaacaacgacgaggaccacgcccacuggaccgaggccaagaugcugcucgacaacaucaacacgcccgaggggaucauccccgcgcuguucgagccggagcgcaagaaguccgccgccaucgacggcgaguaccgccugcgcggggaggcccgcaagaccuucguggagcucaugcggcgcggcgaccugcccgucuggcuguccuacaagguggccagcgagggcuuccaguacuccgaccggcgcuggugcuucgacggggagcggaacaaccaggugcucgaggagaacauggacgucgagaucuggaccaaggagggcgagcgcaagaagcugcggccccgcuggcuggacgcgcggaccuacagcgacccccucgcccugcgcgaguucaaggaguucgccgccgggcggcgcagcguguccggcgaccugauccucgagaucggcaagcugccgcagcaccugacgcuccgggcccagaaggcgcuggacaaccuggugaugcuccacaacagcgagcagggcgggaaggccuaccgccacgccauggaggagcugcccgacaccaucgagacccugaugcuccuggcccugaucgcgguccucaccgggggcgugacccuguucuuccuguccgggaagggccucggcaagacgagcaucgggcugcugugcgugauggccuccagcgcccuccuguggauggccuccgucgagccccacuggaucgccgcgagcaucauccuggaguucuuccucauggugcugcugauccccgagccggaccggcagcgcacgccccaggacaaccagcucgccuacguggucaucggccugcuguucaugauccucaccguggccgccaacgagauggggcugcuggagaccacgaagaaggaccucggcaucgggcacguggccgcggagaaccaccaccacgccaccaugcuggacgucgaccugcggcccgccuccgccuggacccucuacgccguggcgaccacgaucaucaccccgaugaugcgccacaccaucgagaacaccacggccaacaucagccugaccgccaucgccaaccaggccgcgauccugaugggccucgacaagggcuggcccaucuccaagauggacaucggggugccccugcuggcccucggcugcuacagccaggucaacccccugacccugaccgccgccgugcucaugcugguggcgcacuacgccaucaucgggccgggccugcaggccaaggccacgcgggaggcccagaagcgcaccgcggccgggaucaugaagaaccccaccgucgacggcaucguggccaucgaccucgaccccguggucuacgacgccaaguucgagaagcagcugggccagaucaugcugcucauccugugcaccucccagauccugcucaugcgcacgaccugggcccugugcgagagcaucacccuggcgaccgggccccucacgacccugugggagggcuccccggggaaguucuggaacaccaccaucgccgugagcauggccaacaucuuccggggcuccuaccuggccggcgccgggcucgcguucagccugaugaagucccugggcgggggccgccgggggacgggcgcccagggcgagacccucggggagaaguggaagcgccagcugaaccagcugagcaagagcgaguucaacaccuacaagcgguccggcaucauggagguggaccgcagcgaggccaaggaggggcucaagcggggcgagaccacgaagcacgccgucucccgcgggaccgcgaagcugcggugguucguggagcgcaaccuggugaagcccgagggcaaggucaucgaccugggcugcgggcggggcggguggagcuacuacugcgccggccucaagaaggugaccgaggugaagggguacaccaagggcggccccgggcacgaggagcccaucccgauggccacguacggcuggaaccuggucaagcugcacuccgggaaggacguguucuucacgccgcccgagaagugcgacacccuccugugcgacaucggcgagagcucccccaacccgaccaucgaggaggggcgcacccugcgggugcucaagauggucgagcccuggcugcgcggcaaccaguucugcaucaagauccugaaccccuacaugcccagcgugguggagacgcucgagcagaugcagcggaagcacggcgggaugcugguccgcaacccgcugucccggaacagcacccacgagauguacuggguguccugcggcaccgggaacaucgugagcgccgucaacaugaccucccgcaugcuccugaaccgguucacgaugacccaccgcaagcccaccuacgagcgcgacguggaccugggcgccggcacccggcacguggcggucgagcccgagguggccaaccucgacaucaucgggcagcgcaucgagaacaucaagaacgagcacaagagcacguggcacuacgacgaggacaaccccuacaagaccugggccuaccacggcuccuacgaggugaagccgagcggguccgccagcuccauggucaacggcgugguccggcugcugaccaagcccugggacgugauccccauggugacccagaucgccaugacggacaccacccccuucgggcagcagcgcgucuucaaggagaagguggacacccggacgccgcgcgcgaagcggggcaccgcccagaucauggaggugaccgccaaguggcucuggggcuuccugagccgcaacaagaagccccggaucugcacccgcgaggaguucacgcggaagguccgcagcaacgccgccaucggggcgguguucguggacgagaaccaguggaacuccgccaaggaggccgucgaggacgagcgguucugggaccuggugcaccgcgagcgggagcuccacaagcagggcaagugcgcgaccugcguguacaacaugauggggaagcgcgagaagaagcugggcgaguucgggaaggcgaagggcagccgggccaucugguacauguggcugggcgcccgcuuccucgaguucgaggcccugggguucaugaacgaggaccacugguucucccgggagaacagccuguccggcgucgagggggagggccuccacaagcugggguacauccugcgcgacaucagcaagauccccggcggcaacauguacgccgacgacaccaccgggugggacacgcggaucaccgaggacgaccuccagaacgaggcgaagaucaccgacaucauggagccggagcacgcccugcuggccaccuccaucuucaagcucacguaccagaacaagguggugcgcguccagcgccccgccaagagcggcaccgugauggacgugaucucccggcgcgaccagcgggggagcggccaggucggcaccuacgggcugaacaccuucacgaacauggaggugcagcugauccgccagauggaguccgagggcaucuuccuccccagcgagcuggagacccccaaccuggccgagcgggugcucgacuggcuggagaagcacggggucgagcgccugaagcggauggcgaucuccggcgacgacugcguggugaagccgaccgacgaccgcuucgccaccgcccucacggcccugaacgacauggggaagguccggaaggacaucccccagugggagcccagcaagggcuggaacgacuggcagcagguccccuucugcucccaccacuuccaccagcugaucaugaaggacggccgcgagaucguggucccgugccggaaccaggacgagcucauggggcgcgcccgggugagccagggcgcgggguggucccugcgcgagaccgccugccugggcaagagcuacgcccagauguggcagcucauguacuuccaccggcgcgaccugcggcuggccgccaacgcgaucugcagcgccgugcccgucgacugggugcccaccucccgcaccaccuggagcauccacgcccaccaccaguggaugacgaccgaggacaugcucuccguguggaaccgggucuggaucgaggagaaccccuggauggaggacaagacccacgugagcuccugggaggacgugccguaccuggggaagcgcgaggaccaguggugcggcagccugaucggccucaccgcccgcgcgacgugggccaccaacauccaggucgccaucaaccaggugcggcgccugaucgggaacgagaacuaccuggacuacaugaccuccaugaagcgguucaagaacgagagcgaccccgagggcgcccucugguga

SEQ ID NO: 8910 - RNA, 9879 nt, Artificial Sequence
  derived and/or modified CDS sequence (opt1) from DENV-1__JQ915072__SS-prME
agcgugaccaugcugcucaugcugcugcccaccgugcucaccuuccaccugaccacccgcggcggggagccccacaugaucgugagcaagcaggagcggggcaagagccuccuguucaagaccuccgccggggugaacaugugcacgcugaucgccauggaccugggcgagcucugcgacgacaccaugaccuacaagugcccccgcaucaccgagacggagcccgacgacguggacugcuggugcaacgccaccgagaccugggugaccuacgggacgugcagccagaccggcgagcaccggcgcgacaagcgguccguggcccuggcgccccacgucggccuggggcucgagacccgcaccgagacguggaugagcuccgagggcgccuggcggcagauccagaagguggagaccugggcccugcgccaccccggguucaccgugaucgcccuguuccucgcccacgccaucggcaccagcaucacgcagaaggggaucaucuucauccugcugaugcucgucacccccuccauggccaugcggugcgugggcaucggcaaccgcgacuucguggaggggcugagcggcgcgaccugggucgacguggugcuggagcacggguccugcgucaccacgauggccaaggacaagcccacccucgacaucgagcugcugaagaccgaggugaccaaccccgccgugcuccggaagcugugcaucgaggccaagaucagcaacacgaccaccgacucccgcugcccgacccagggcgaggccacgcuggucgaggagcaggacaccaacuucgugugccggcgcaccuucguggaccggggcugggggaacggcugcggccucuucggcaaggggagccugaucacgugcgcgaaguucaagugcgucacgaagcuggagggcaagaucgugcaguacgagaaccucaaguacuccgugaucgucaccgugcacaccggcgaccagcaccaggucgggaacgagaccaccgagcacggcacgaucgccaccaucacgccccaggcccccaccagcgagauccagcugacggacuacggggcccugacccucgacugcagcccccggaccggccuggacuucaacgagauggugcugcucaccaugaaggagaaguccuggcuggugcacaagcagugguuccuggaccucccgcugcccuggacgaccggggccuccaccagccaggagaccuggaaccggcaggaccugcucgucacguucaagaccgcgcacgccaagaagcaggagguggugguccugggcagccaggagggcgccaugcacaccgcccugaccggggccacggagauccagaccuccggcaccaccacgaucuucgcggggcaccucaagugccgccugaagauggacaagcugacccucaagggcaucagcuacgugaugugcaccggguccuucaagcuggagaaggagguggccgagacccagcacggcacgguccugguccaggugaaguacgagggcaccgacgcccccugcaagauccccuucagcucccaggacgagaagggggucacccagaacggccggcuggugaccgccaacccgaucgugacggacaaggagaagcccgucaacaucgaggccgagccgcccuucggggagagcuacaucguggugggcgcgggcgagaaggcccucaagcuguccugguucaagaaggggagcuccaucggcaagauguucgaggccaccgcccgcggggcgcggcgcauggccauccugggcgacaccgccugggacuucgggagcaucggcggcgucuucaccuccguggggaagcucgugcaccagaucuucggcacggccuacgggguccuguucagcggcguguccuggaccaugaagaucgggaucggcauccugcucaccuggcugggccugaacagccgcuccaccagccucuccaugacgugcaucgccguggggauggucacccuguaccugggcgugauggugcaggcggacagcgggugcgucaucaacuggaagggccgggagcucaagugcggguccggcaucuucgugaccaacgaggugcacaccuggaccgagcaguacaaguuccaggccgacagcccgaagcgccugagcgccgccaucggcaaggccugggaggagggggucugcggcauccgguccgcgacgcgccuggagaacaucauguggaagcagaucagcaacgagcucaaccacauccugcuggagaacgacaugaaguucaccgugguggucggggacguguccggcauccucgcccaggggaagaagaccauccggccccagcccauggagcacaaguacagcuggaaguccuggggcaaggccaagaucaucggcgccgacgugcagaacaccacguucaucaucgacgggcccaacaccccggagugccccgacgaccagcgcgccuggaacaucugggaggucgaggacuacggcuucgggaucuucaccaccaacaucuggcugaagcugcgggacagcuacacccaggugugcgaccaccgccucauguccgcggccaucaaggacagcaaggccgugcacgccgacaugggcuacuggaucgaguccgagaagaacgagacguggaagcuggcgcgggccagcuucaucgaggucaagaccugcguguggcccaagucccacacccuguggagcaacggcgugcucgaguccgagaugaucauccccaagaucuacgggggcccgaucagccagcacaacuaccgccccggguacuucacgcagaccgccggccccuggcaccuggggaagcuggagcucgacuucgaccugugcgagggcaccaccgucgugguggacgagcacugcggccaccgggggccgucccugcgcacgaccaccgucaccggcaagaucauccacgaguggugcugccggagcugcacgcugccgccccugcgcuucaagggggaggacggcugcugguacgggauggagauccggcccgugaaggagaaggaggagaaccuggugaaguccauggucagcgccggcagcggcgagguggacuccuucagccucgggcugcugugcaucuccaucaugaucgaggaggugaugcgcagccgguggucccgcaagaugcucaugaccggcacccuggucguguuccugcuccugacccuggggcagcucacguggaacgaccugauccggcugugcaucauggucggcgccaacgcgagcgacaacauggggaugggcaccaccuaccucgcccugauggccaccuuccgcaugcgcccgauguucgccgugggccuccucuuccggcgccugacgucccgggaggugcugcuccugaccgucgggcugagccucguggccuccguggagcugcccaacagccuggacgagcucggcgacgggcuggcgaugggcaucaugauccugaagcuccugaccgacuuccagucccaccagcugugggccacccuccugagccugacguucgucaagaccacccucucccugcacuacgccuggaagaccauggccaugauccugagcaucgugucccuccugccccugugccucagcacgaccucccagaagaccaccuggcugcccgugcugcucggcagccuggggugcaagccgcugaccauguuccucaucacggagaacaagaucuggggccgcaaguccuggccccugaacgaggggaucauggccgucggcaucgugagcauccugcucagcucccugcugaagaacgacgugccccucgcggggccccugaucgccggcggcaugcugaucgccugcuacgucaucagcggguccagcgccgaccucucccuggagaaggcggccaaggugagcugggaggaggaggccgagcacuccggcgccagccacaacauccugguggagauccaggacgacgggaccaugaagaucaaggacgaggagcgggacgacaccaucaccauccuccugaaggccacgcugcucgcgaucuccggcgucuacccgaugagcauccccgccacccuguucguguggcacuucuggcagaagaagaagcagcgcuccggggugcugugggacacccccagcccgcccgaggucgagaaggccgugcuggacgacggcaucuaccggauccuccagcgcggccugcuggggcggucccaggugggcgucgggguguuccaggagggcguguuccacaccauguggcacgucacgcgcggggccgugcucauguaccagggcaagcggcuggagcccagcugggccuccgugaagaaggaccugaucagcuacggcgggggcuggcgcuuccagggguccuggaacaugggcgaggagguccaggugaucgcgguggagcccgggaagaaccccaagaacguccagaccgcccccggcaccuucaagaccagcgagggcgaggugggggccaucgcccucgacuucaagcccggcacguccgggagccccaucgugaaccgggagggcaagaucgucggccuguacgggaacggcguggugaccaccagcgggaccuacgucuccgccaucgcgcaggccaaggccagccaggagggcccccugccggagaucgaggacgagguguuccgcaagcggaaccucacgaucauggaccugcaccccggguccggcaagacccgccgguaccugcccgccaucgugcgcgaggccaucaagcggaagcuccgcacccugguccuggcgccgacccgggugguggccagcgagauggccgaggcccucaagggcaugcccauccgcuaccagacgaccgcggucaaguccgagcacaccgggaaggagaucguggaccugaugugccacgccaccuucacgaugcgccugcucagccccgugcggguccccaacuacaacaugaucaucauggacgaggcccacuucaccgacccggccuccaucgccgcgcgcggcuacaucagcacccggguggggaugggcgaggccgccgccaucuucaugaccgccacgccgcccggguccguggaggcguucccccagagcaacgccgucauccaggacgaggagaaggacaucccggagcgcuccuggaacagcggcuacgacuggaucaccgacuuccccggcaagaccgugugguucgugcccuccaucaagagcgggaacgacaucgccaacugccugcggaagaacggcaagcgcgucauccagcugucccggaagaccuucgacacggaguaccagaagaccaagaacaacgacugggacuacguggucaccaccgacaucagcgagaugggggccaacuuccgcgccgaccgggugaucgacccccgccggugccucaagccggugauccugaaggacggccccgagcgcgucauccuggcggggcccaugcccgugacgguggccuccgccgcccagcggcgcggccggaucggccgcaaccagaacaaggagggggaccaguacaucuacaugggccagccgcucaacaacgacgaggaccacgcgcacuggaccgaggccaagaugcugcuggacaacaucaacacccccgaggggaucauccccgcccucuucgagcccgagcgggagaaguccgccgccaucgacggcgaguaccgccugcgcggggaggcgcgcaagaccuucgucgagcugaugcgccggggcgaccucccgguguggcuguccuacaagguggccagcgagggcuuccaguacagcgaccgccgguggugcuucgacggggagcgcaacaaccagguccuggaggagaacauggacguggagaucuggacgaaggagggcgagcggaagaagcuccgcccccgguggcuggacgcccgcaccuacuccgacccccuggcccuccgggaguucaaggaguucgccgcggggcgccggagcguguccggcgaccugauccuggagaucggcaagcucccccagcaccugacccagcgcgcccagaacgcccuggacaaccucgucaugcugcacaacagcgagcagggcgggaaggccuaccggcacgccauggaggagcugccggacaccaucgagaccaucaugcuccuggcgcugaucgccgugcucaccggcggggugacccuguucuuccuguccgggcgcgggcucggcaagaccagcaucgggcugcugugcgucaccuccagcuccgcccuccuguggauggccagcguggagccccacuggaucgcggccuccaucauccuggaguucuuccucauggugcugcugauccccgagcccgaccggcagcgcacgccgcaggacaaccagcucgccuacgucgugaucggccugcuguucaugauccucaccguggccgccaacgagauggggcugcuggagaccaccaagaaggaccucggcaucgggcacacggcggccgagaaccaccaccacgccgccaugcuggacgucgaccugcaccccgccagcgcguggacccucuacgccguggccaccaccaucaucacgcccaugaugcggcacaccaucgagaacaccaccgccaacaucucccugacggccaucgcgaaccaggccgccauccugaugggccucgacaagggcuggccgaucagcaagauggacaucggggugccccugcuggcccucggcugcuacucccaggucaacccccugacccugaccgccgcggugcucaugcugguggcccacuacgccaucaucgggcccggccugcaggccaaggcgacccgcgaggcccagaagcggacggccgccgggaucaugaagaacccgaccgucgacggcaucguggccaucgaccucgaccccguggucuacgacgcgaaguucgagaagcagcugggccagaucaugcugcucauccugugcaccagccagauccugcucaugcgcaccacgugggcccugugcgaguccaucacccuggccaccgggccccucaccacgcugugggagggcagccccgggaaguucuggaacaccaccaucgccguguccauggccaacaucuuccggggcagcuaccuggcgggcgccgggcucgccuucagccugaugaagucccugggcgggagccgccgcggcaccggggcccagggcgagacgcucggcgagaaguggaagcggcagcugaaccagcuguccaagagcgaguucaacaucuacaagcgcuccgggaucaucgagguggaccggagcgaggccaaggagggccucaagcgcggggagaccaccaagcacgcggucucccggggcaccgccaagcugcgcugguucguggagcggaaccuggugaagccggaggggaaggucaucgaccugggcugcggccgcgggggcuggagcuacuacugcgccgggcucaagaaggugacggaggugaagggcuacaccaagggcgggcccggccacgaggagcccauccccauggccaccuacggguggaaccuggucaagcugcacuccggcaaggacguguucuucaucccgcccgagaagugcgacacccuccugugcgacaucggggagagcucccccaaccccaccaucgaggagggccggacgcugcgcgugcucaagauggucgagccguggcugcgggggaaccaguucugcaucaagauccugaaccccuacaugcccagcgugguggagacccucgagcagaugcagcgcaagcacggcggcaugcugguccggaacccccugucccgcaacagcacccacgagauguacuggguguccugcgggaccggcaacaucgugagcgcggucaacaugacgucccggaugcuccugaaccgcuucaccauggcccaccggaagccgaccuacgagcgcgacguggaccugggggccggcacccggcacguggccgucgagcccgagguggccaaccucgacaucaucggccagcgcaucgagaacaucaagaacgagcacaagagcacguggcacuacgacgaggacaaccccuacaagaccugggcguaccacggguccuacgaggucaagcccagcggcagcgccuccagcauggugaacggggugguccgccugcugaccaagccgugggacgugauccccauggugacccagaucgccaugacggacaccacccccuucggccagcagcgggucuucaaggagaagguggacacccgcacgcccaaggccaagcgggggaccgcccagaucauggaggugaccgcgaaguggcucuggggcuuccugucccgcaacaagaagccgcggaucugcacccgcgaggaguucacgcggaagguccgcagcaacgccgccaucggcgccguguucguggacgagaaccaguggaacuccgccaaggaggcggucgaggacgagcgguucugggaccuggugcgccgggagcgcgagcuccacaagcaggggaagugcgcgaccugcguguacaacaugaugggcaagcgggagaagaagcugggggaguucggcaaggccaaggggagccgcgccaucugguacauguggcugggcgcgcgguuccucgaguucgaggcccugggcuucaugaacgaggaccacugguucucccgcgagaacagccuguccggggucgagggcgaggggcuccacaagcugggcuacauccugcgggacaucagcaagauccccgggggcaacauguacgccgacgacaccgccggcugggacacccgcaucacggaggaggaccuccagaacgaggccaagaucaccgacaucauggagcccgagcacgcgcugcuggccaccuccaucuucaagcucaccuaccagaacaagguggugcggguccagcgcccggccaagaacgggacggugauggacgugaucagccggcgcgaccagcgcggcuccgggcaggucggcaccuacggccugaacaccuucaccaacauggaggcccagcugauccggcagauggagagcgaggggaucuucucccccagcgagcucgagacgcccaaccuggccggccgcgugcuggacuggcucgagaagcacgggaucgagcggcugcgccggauggcgaucuccggcgacgacugcguggucaagcccaucgacgaccgcuucgccaccgcccugaccgcccucaacgacauggggaaggugcggaaggacaucccgcagugggagcccagcaagggcuggaacgacuggcagcagguccccuucugcagccaccacuuccaccagcugaucaugaaggacggccgcgagaucgucgugcccugccggaaccaggacgagcugguggggcgcgcccgggucucccagggcgcgggguggagccuccgcgagaccgccugccugggcaaguccuacgcccagauguggcagcugauguacuuccaccggcgcgaccuccggcuggccgccaacgcgaucugcagcgccgugccgguggacuggguccccacgucccgcaccaccuggagcauccacgcccaccaccaguggaugaccaccgaggacaugcuguccguguggaaccggguguggaucgaggagaaccccuggauggaggacaagacgcacgucagcuccugggaggacgugcccuaccucgggaagcgcgaggaccaguggugcggcagccugaucggccugaccgcccgggcgaccugggccaccaacauccagguggccaucaagcagguccgccgccucaucgggaacgagaacuaccuggacuacaugacguccaugaagcgguucaagaacgagagcgacccggagggcgcccugugguga

SEQ ID NO: 8911 - RNA, 9879 nt, Artificial Sequence
  derived and/or modified CDS sequence (opt1) from DENV-1__JQ915071__SS-prME
agcgugaccaugcugcucaugcugcugcccaccgugcucaccuuccaccugaccacccggggcggggagccccacaugaucgugagcaagcaggagcggggcaagagccuccuguucaagaccuccgccggggugaacaugugcacccugaucgccauggaccugggcgagcucugcgacgacaccaugaccuacaagugcccccgcaucaccgagaccgagcccgacgacgucgacugcuggugcaacgccaccgagaccugggugaccuacgggacgugcagccagaccggcgagcaccggcgcgacaagcgguccguggcccuggcgccccacgucggccuggggcucgagacccgcaccgagacguggaugagcuccgagggcgccuggcggcagauccagaagguggagaccugggcccugcgccaccccggguucaccgugaucgcgcuguuccucgcccacgccaucggcaccagcaucacgcagaaggggaucaucuucauccugcugaugcucgucacccccuccauggccaugcggugcgugggcaucggcaaccgcgacuucguggaggggcugagcggcgcgaccugggucgacguggugcuggagcacggguccugcgucaccacgauggccaaggacaagcccacccucgacaucgagcugcugaagaccgaggugaccaaccccgccgugcuccggaagcugugcaucgaggccaagaucagcaacacgaccaccgacucccgcugcccgacccagggcgaggccacgcuggucgaggagcaggacaccaacuucgugugccggcgcaccuucguggaccggggcugggggaacggcugcggccuguucggcaaggggagccugaucacgugcgcgaaguucaagugcgccacgaagcuggagggcaagaucguccaguacgagaaccucaaguacuccgugaucgugaccguccacaccggcgaccagcaccagguggggaacgagaccaccgagcacggcacgaucgccaccaucacgccccaggcccccaccagcgagauccagcugacggacuacggggcccugacccucgacugcagcccccggaccggccuggacuucaacgagaugguccugcucaccaugaaggagaaguccuggcuggugcacaagcagugguuccuggaccucccgcugcccuggacgaccggggcguccaccagccaggagaccuggaaccggcaggaccugcucgugacguucaagaccgcccacgccaagaagcaggaggucguggugcugggcagccaggagggcgccaugcacaccgcccugaccggggcgacggagauccagaccuccggcaccaccacgaucuucgccgggcaccucaagugccgccugaagauggacaagcugacccucaagggcaucagcuacgucaugugcaccggguccuucaagcuggagaaggagguggccgagacccagcacggcacggugcugguccaggugaaguacgagggcaccgacgcccccugcaagauccccuucagcucccaggacgagaagggggugacccagaacggccggcuggucaccgccaacccgaucgugacggacaaggagcgccccgugaacaucgaggcggagccgcccuucggggagagcuacaucgucgugggcgccggcgagaaggcccucaagcuguccugguucaagaaggggagcuccaucggcaagauguucgaggccaccgcgcgcggggcccgccgcauggccauccugggcgacaccgccugggacuucgggagcaucggcggcguguucaccuccgucgggaagcucgugcaccagaucuucggcacggccuacggggugcuguucagcggcgucuccuggaccaugaagaucgggaucggcauccugcucaccuggcugggccugaacagccgguccaccagccucuccaugacgugcaucgcgguggggauggugacccuguaccugggcgucauggugcaggccgacagcgggugcgugaucaacuggaagggccgcgagcucaagugcggguccggcaucuucgucaccaacgaggugcacaccuggaccgagcaguacaaguuccaggccgacagcccgaagcggcugagcgccgccaucggcaaggcgugggaggagggggugugcggcauccgcuccgccacgcggcuggagaacaucauguggaagcagaucagcaacgagcucaaccacauccugcuggagaacgacaugaaguucaccgucguggugggggacgucuccggcauccucgcccaggggaagaagaccauccgcccccagcccauggagcacaaguacagcuggaaguccuggggcaaggccaagaucaucggcgccgacgugcagaacaccacguucaucaucgacgggcccaacaccccggagugccccgacgaccagcgggcguggaacaucugggagguggaggacuacggcuucgggaucuucaccaccaacaucuggcugaagcugcgcgacagcuacacgcaggucugcgaccaccggcucauguccgccgccaucaaggacagcaaggccgugcacgcggacaugggcuacuggaucgaguccgagaagaacgagaccuggaagcuggcccgcgccagcuucaucgaggugaagaccugcgucuggcccaagucccacacccuguggagcaacggcgugcucgaguccgagaugaucauccccaagaucuacgggggcccgaucagccagcacaacuaccggcccggguacuucacgcagaccgccggccccuggcaccuggggaagcuggagcucgacuucgaccugugcgagggcaccaccguggucguggacgagcacugcggcaaccgcgggccgucccugcggacgaccaccgugaccggcaagaucauccacgaguggugcugccgcagcugcacgcugccgccccugcgguucaagggggaggacggcugcugguacgggauggagauccgccccgucaaggagaaggaggagaaccuggugaaguccauggugagcgccggcagcggcgaggucgacuccuucagccucgggcugcugugcaucuccaucaugaucgaggaggugaugcggagccgcuggucccggaagaugcucaugaccggcacccugguggucuuccugcuccugacccuggggcagcucacguggaacgaccugauccgccugugcaucauggugggcgcgaacgccagcgacaacauggggaugggcaccaccuaccucgcccugauggccaccuuccgcaugcggccgauguucgccgucgggcuccucuuccgccggcugacgucccgcgaggugcugcuccugaccguggggcugagccucgucgccuccguggagcugcccaacagccuggacgagcucggcgacgggcuggccaugggcaucaugauccugaagcuccugaccgacuuccagucccaccagcugugggccacccuccugagccugacguucgugaagaccacccucucccugcacuacgccuggaagaccauggccaugauccugagcaucgucucccuccugccccugugccucagcacgaccucccagaagaccaccuggcugcccgugcugcucggcagccuggggugcaagccgcugaccauguuccucaucacggagaacaagaucuggggccggaaguccuggccccugaacgaggggaucauggcggugggcaucgucagcauccugcucagcucccugcugaagaacgacgugccccucgccgggccccugaucgccggcggcaugcugaucgccugcuacgugaucagcggguccagcgcggaccucucccuggagaaggccgccaaggucagcugggaggaggaggccgagcacuccggcgccagccacaacauccugguggagauccaggacgacgggaccaugaagaucaaggacgaggagcgcgacgacaccaucaccauccuccugaaggcgacgcugcucgccaucuccggcguguacccgaugagcauccccgccacccuguucgucuggcacuucuggcagaagaagaagcagcgguccggggugcugugggacacccccagcccgcccgagguggagaaggccguccuggacgacggcaucuaccgcauccuccagcggggccugcuggggcgcucccaggugggcgugggggucuuccaggagggcguguuccacaccauguggcacgugacgcgcggggccguccucauguaccagggcaagcgccuggagcccagcugggcguccgugaagaaggaccugaucagcuacggcgggggcuggcgguuccagggguccuggaacaccggcgaggaggugcaggucaucgccguggagcccgggaagaaccccaagaacgugcagaccgcccccggcaccuucaagacgagcgagggcgaggucggggccaucgcccucgacuucaagcccggcaccuccgggagccccaucgugaaccgcgagggcaagaucgugggccuguacgggaacggcgucgugaccaccagcgggacguacguguccgcgaucgcccaggccaaggccagccaggagggcccccugccggagaucgaggacgaggucuuccggaagcgcaaccucaccaucauggaccugcaccccggguccggcaagacccggcgcuaccugcccgccaucgugcgggaggcgaucaagcgcaagcuccggacccuggugcuggccccgacgcgcgucguggccagcgagauggccgaggcgcucaagggcaugcccauccgcuaccagaccaccgccgugaaguccgagcacaccgggaaggagaucgucgaccugaugugccacgccacguucaccaugcggcugcucagccccgugcgcgugcccaacuacaacaugaucaucauggacgaggcccacuucaccgacccggccuccaucgcggcccggggcuacaucagcacccgcgucgggaugggcgaggccgccgccaucuucaugacggcgacgccgcccggguccguggaggccuucccccagagcaacgccgugauccaggacgaggagaaggacaucccggagcgguccuggaacagcggcuacgacuggaucaccgacuuccccggcaagaccgucugguucgugcccuccaucaagagcgggaacgacaucgccaacugccugcgcaagaacggcaagcgggugauccagcugucccgcaagacguucgacaccgaguaccagaagaccaagaacaacgacugggacuacgucgugaccacggacaucagcgagaugggggccaacuuccgggcggaccgcgucaucgacccccggcgcugccucaagccggugauccugaaggacggccccgagcgggugauccuggccgggcccaugcccgucaccguggccuccgccgcgcagcgccggggccgcaucggccggaaccagaacaaggagggggaccaguacaucuacaugggccagccgcucaacaacgacgaggaccacgcccacuggaccgaggccaagaugcugcuggacaacaucaacacccccgaggggaucauccccgcccucuucgagcccgagcgcgagaaguccgccgcgaucgacggcgaguaccggcugcgcggggaggcccgcaagacguucguggagcugaugcggcgcggcgaccucccggucuggcuguccuacaagguggccagcgagggcuuccaguacagcgaccggcgcuggugcuucgacggggagcggaacaaccaggugcuggaggagaacauggacgucgagaucuggaccaaggagggcgagcgcaagaagcuccggccccgcuggcuggacgcccggaccuacuccgacccccuggcccuccgcgaguucaaggaguucgcggccgggcggcgcagcguguccagcgaccugauccuggagaucggcaagcucccccagcaccugacccagcgggcccagaacgcccuggacaaccucgugaugcugcacaacuccgagcagggcgggaaggccuaccgccacgcgauggaggagcugccggacaccaucgagacgaucaugcuccuggcccugaucgccguccucaccggcggggugacccuguucuuccugagcggccgggggcucggcaagaccuccaucggccugcugugcgugacgagcuccagcgcccuccuguggauggcgaacgucgagccccacuggaucgccgccuccaucauccuggaguucuuccucauggugcugcugauccccgagcccgaccgccagcggaccccgcaggacaaccagcucgccuacguggucaucgggcugcuguucaugauccucaccguggccgcgaacgagaugggccugcuggagaccacgaagaaggaccucgggaucggccacaccgccgccgagaaccaccaccacgccgccaugcuggacguggaccugcaccccgcgagcgccuggacccucuacgccgucgccaccacgaucaucacccccaugaugcgccacaccaucgagaacaccacggccaacaucucccugaccgcgaucgccaaccaggccgccauccugauggggcucgacaagggcuggccgaucagcaagauggacaucggcgugccccugcuggcccucgggugcuacucccaggugaacccccugacccugaccgcggccguccucaugcugguggcccacuacgccaucaucggccccgggcugcaggcgaaggccacgcgggaggcccagaagcgcaccgccgccggcaucaugaagaacccgaccguggacgggaucgucgcgaucgaccucgaccccgugguguacgacgccaaguucgagaagcagcugggccagaucaugcugcucauccugugcaccagccagauccugcucaugcggacgaccugggcccugugcgaguccaucacccuggccaccggcccccucacgacccugugggaggggagccccggcaaguucuggaacaccaccaucgccgucuccauggcgaacaucuuccgcgggagcuaccuggccggcgccggccucgccuucagccugaugaagucccucgggggcgggcgccgggggacgggggcccagggcgagacccucggcgagaaguggaagcgccagcugaaccagcugagcaaguccgaguucaacaccuacaagcggagcgggaucaucgagguggaccgcuccgaggcgcgggagggccucaagcgcggggagaccacgaagcacgccgugagccggggcaccgccaagcugcgcugguucgucgagcggaaccuggugaagccggaggggaaggugaucgaccugggcugcggccgcgggggcugguccuacuacugcgccgggcucaagaaggucaccgaggugaagggcuacaccaagggcgggcccggccacgaggagcccauccccauggcgaccuacggguggaaccuggugaagcugcacagcggcaaggacgucuucuucaucccgcccgagaagugcgacacgcuccugugcgacaucggggaguccagccccaaccccaccaucgaggagggccggacccugcgcgugcucaagaugguggagccguggcugcgggggaaccaguucugcaucaagauccugaaccccuacaugcccuccgucguggagacccucgagcagaugcagcgcaagcacggcggcaugcuggugcggaacccccugagccgcaacuccacgcacgagauguacugggucagcugcgggaccggcaacaucguguccgccgugaacaugaccagccggaugcuccugaaccgcuucaccauggcccaccggaagccgacguacgagcgcgacgucgaccugggggccggcacccgccacguggccguggagcccgaggucgcgaaccucgacaucaucggccagcggaucgagaacaucaagaacgagcacaaguccaccuggcacuacgacgaggacaaccccuacaagaccugggccuaccacgggagcuacgaggugaagcccuccggcagcgccagcuccauggucaacgggguggugcgccugcugacgaagccgugggacgucauccccauggugacccagaucgccaugaccgacaccacgcccuucggccagcagcggguguucaaggagaaggucgacacccgcacccccaaggccaagcgggggaccgcgcagaucauggaggugacggccaaguggcucuggggcuuccugagccgcaacaagaagccgcggaucugcacccgcgaggaguucacccggaaggugcgcuccaacgccgccaucggcgccgucuucguggacgagaaccaguggaacagcgcgaaggaggccguggaggacgagcgguucugggaccugguccgccgggagcgcgagcuccacaagcaggggaagugcgcgaccugcguguacaacaugaugggcaagcgggagaagaagcugggggaguucggcaaggccaaggggucccgcgcgaucugguacauguggcugggcgcccgguuccucgaguucgaggcccugggcuucaugaacgaggaccacugguucagccgcgagaacucccugagcgggguggagggcgaggggcuccacaagcugggcuacauccugcgggacaucuccaagauccccgggggcaacauguacgccgacgacacggccggcugggacacccgcaucaccgaggaggaccuccagaacgaggcgaagaucaccgacaucauggagcccgagcacgcccugcuggccacgagcaucuucaagcucaccuaccagaacaaggucgugcgggugcagcgcccggccaagaacgggaccgucauggacgugaucucccgccgggaccagcgcggcagcggccaggugggcaccuacggccugaacacguucaccaacauggaggcccagcugauccggcagauggaguccgaggggaucuucagccccuccgagcucgagacccccaaccuggcgggccgcguccuggacuggcucgagaagcacgggaucgagcggcugcgccggauggccaucagcggcgacgacugcguggugaagcccaucgacgaccgcuucgccaccgcccugacggcccucaacgacauggggaagguccggaaggacaucccgcagugggagcccuccaagggcuggaacgacuggcagcagguccccuucugcagccaccacuuccaccagcugaucaugaaggacggccgcgagaucgugguccccugccggaaccaggacgagcugguggggcgcgcgcgggugagccagggcgccggguggucccuccgcgagaccgccugccugggcaagagcuacgcccagauguggcagcugauguacuuccaccggcgcgaccuccggcuggccgcgaacgccaucugcuccgccgucccgguggacugggugcccaccagccgcaccaccugguccauccacgcccaccaccaguggaugacgaccgaggacaugcugagcgucuggaaccggguguggaucgaggagaaccccuggauggaggacaagacccacguguccagcugggaggacguccccuaccucgggaagcgcgaggaccaguggugcggcucccugaucggccugaccgcgcgcgccacgugggccaccaacauccagguggccaucaaccaggugcggcgccucaucgggaacgagaacuaccuggacuacaugaccagcaugaagcgguucaagaacgaguccgacccggagggcgcccugugguga

SEQ ID NO: 8912 - RNA, 9879 nt, Artificial Sequence
  derived and/or modified CDS sequence (opt1) from DENV-1__JQ915073__SS-prME
agcgugaccaugcugcucaugcugcugcccaccgugcucaccuuccaccugaccacccggggcggggagccccacaugaucgugagcaagcaggagcggggcaagagccuccuguucaagaccuccgccggggugaacaugugcacccugaucgccauggaccugggcgagcucugcgacgacaccaugaccuacaagugcccccgcaucaccgagaccgagcccgacgacguggacugcuggugcaacgcgaccgagaccugggugaccuacgggacgugcuuccagaccggcgagcaccggcgcgacaagcggagcguggcccuggcgccccacgucggccuggggcucgagacccgcaccgagacguggauguccagcgagggcgccuggcggcagauccagaagguggagaccugggcccugcgccaccccggguucaccgugaucgcgcuguuccucgcccacgccaucggcaccuccaucacgcagaaggggaucaucuucauccugcugaugcucgugacccccagcauggccaugcggugcgugggcaucggcaaccgcgacuucguggaggggcuguccggcgcgaccugggucgacguggugcuggagcacgggagcugcgucaccacgauggccaaggacaagcccacccucgacaucgagcugcugaagaccgaggugaccaaccccgccgugcuccggaagcugugcaucgaggccaagaucuccaacacgaccaccgacagccgcugcccgacccagggcgaggccacgcuggucgaggagcaggacaccaacuucgugugccggcgcaccuucguggaccggggcugggggaacggcugcggccucuucggcaaggggucccugaucacgugcgcgaaguucaagugcgucacgaagcuggagggcaagaucgugcaguacgagaaccucaaguacagcgugaucgucaccgugcacaccggcgaccagcaccaggucgggaacgagaccaccgagcacggcacgaucgccaccaucacgccccaggcccccaccuccgagauccagcugacggacuacggggcccugacccucgacugcagcccccgcaccggccuggacuucaacgagauggugcugcucaccaugaaggagaaguccuggcuggugcacaagcagugguuccuggaccucccgcugcccuggacgaccggggccagcaccucccaggagaccuggaaccggcaggaccugcucgucacguucaagaccgcgcacgccaagaagcaggagguggugguccugggcagccaggagggcgccaugcacaccgcccugaccggggccacggagauccagaccagcggcaccaccacgaucuucgcggggcaccucaagugccgccugaagauggacaagcugacccucaagggcaucuccuacgugaugugcaccgggagcuucaagcuggagaaggagguggccgagacccagcacggcacgguccugguccaggugaaguacgagggcaccgacgcccccugcaagauccccuucuccagccaggacgagaagggggucacccagaacggccggcuggugaccgccaacccgaucgugacggacaaggagaagcccgucaacaucgaggccgagccgcccuucggggaguccuacaucguggugggcgcgggcgagaaggcccucaagcugagcugguucaagaagggguccagcaucggcaagauguucgaggccaccgcccgcggggcgcggcgcauggccauccugggcgacaccgccugggacuucggguccaucggcggcgucuucaccagcguggggaagcucgugcaccagaucuucggcacggccuacgggguccuguucuccggcgugagcuggaccaugaagaucgggaucggcauccugcucaccuggcugggccugaacucccgcagcaccucccucagcaugacgugcaucgccguggggauggucacccuguaccugggcgugauggugcaggcggacuccgggugcgucaucaacuggaagggccgggagcucaagugcgggagcggcaucuucgugaccaacgaggugcacaccuggaccgagcaguacaaguuccaggccgacuccccgaagcgccugagcgccgccaucggcaaggccugggaggagggggucugcggcauccggagcgcgacgcgccuggagaacaucauguggaagcagaucuccaacgagcucaaccacauccugcuggagaacgacaugaaguucaccgugguggucggggacgugagcggcauccucgcccaggggaagaagaccauccggccccagcccauggagcacaaguacuccuggaaguccuggggcaaggccaagaucaucggcgccgacgugcagaacaccacguucaucaucgacgggcccaacaccccggagugccccgacgaccagcgcgccuggaacaucugggaggucgaggacuacggcuucgggaucuucaccaccaacaucuggcugaagcugcgggacuccuacacccaggugugcgaccaccgccucaugagcgcggccaucaaggacuccaaggccgugcacgccgacaugggcuacuggaucgagagcgagaagaacgagaccuggaagcuggcgcgggccuccuucaucgaggucaagaccugcguguggcccaagagccacacccugugguccaacggcgugcucgagagcgagaugaucauccccaagaucuacgggggcccgaucucccagcacaacuaccgccccggguacuucacgcagaccgccggccccuggcaccuggggaagcuggagcucgacuucgaccugugcgagggcaccaccgucgugguggacgagcacugcggccaccgggggccgagccugcgcacgaccaccgucaccggcaagaucauccacgaguggugcugccgguccugcacgcugccgccccugcgcuucaagggggaggacggcugcugguacgggauggagauccggcccgugaaggagaaggaggagaaccuggucaagagcauggucuccgccggcagcggcgagguggacagcuucucccucgggcugcugugcaucagcaucaugaucgaggaggugaugcgcucccgguggagccgcaagaugcucaugaccggcacccuggucguguuccugcuccugacccuggggcagcucacguggaacgaccugauccggcugugcaucauggucggcgccaacgcguccgacaacauggggaugggcacgaccuaccucgcccugauggccaccuuccgcaugcgcccgauguucgccguggggcuccucuuccggcgccugacgagccgggaggugcugcuccugaccgucgggcugucccucguggccagcguggagcugcccaacucccuggacgagcucggcgacgggcuggccaugggcaucaugauccugaagcuccugaccgacuuccagagccaccagcugugggccacccuccugucccugacguucgucaagaccacccucagccugcacuacgccuggaagaccauggccaugauccuguccaucgugagccuccugccccugugccucuccacgaccagccagaagaccaccuggcugcccgugcugcucggcucccuggggugcaagccgcugaccauguuccucaucacggagaacaagaucuggggccgcaagagcuggccccugaacgaggggaucauggccgucggcaucguguccauccugcucagcagccugcugaagaacgacgugccccucgcggggccccugaucgccggcggcaugcugaucgccugcuacgucaucuccgggagcuccgccgaccucagccuggagaaggcggccaagguguccugggaggaggaggccgagcacagcggcgccucccacaacauccugguggagauccaggacgacgggaccaugaagaucaaggacgaggagcgggacgacaccaucaccauccuccugaaggccacgcugcucgcgaucagcggcgucuacccgauguccauccccgccacccuguucguguggcacuucuggcagaagaagaagcagcgcagcggggugcugugggacacccccagcccgcccgaggucgagaaggccgugcuggacgacggcaucuaccggauccuccagcgcggccugcuggggcggagccaggugggcgucgggguguuccaggagggcguguuccacaccauguggcacgucacgcgcggggccgugcucauguaccagggcaagcggcuggagcccuccugggccagcgugaagaaggaccugaucuccuacggcgggggcuggcgcuuccaggggagcuggaacaccggcgaggagguccaggugaucgcgguggagcccgggaagaaccccaagaacguccagaccacccccggcacguucaagaccuccgagggcgaggugggggccaucgcccucgacuucaagcccggcaccagcgggucccccaucgugaaccgggagggcaagaucgucggccuguacgggaacggcguggugaccacgagcgggaccuacgucagcgccaucgcccaggcgaaggccucccaggagggcccccugccggagaucgaggacgagguguuccgcaagcggaaccucaccaucauggaccugcaccccgggagcggcaagacccgccgguaccugcccgccaucgugcgcgaggccaucaagcggaagcuccgcacgcugguccuggccccgacccgggugguggcguccgagauggccgaggcccucaagggcaugcccauccgcuaccagaccaccgccgucaagagcgagcacacggggaaggagaucguggaccugaugugccacgcgaccuucaccaugcgccugcucucccccgugcggguccccaacuacaacaugaucaucauggacgaggcccacuucaccgacccggccagcaucgccgcccgcggcuacaucuccacgcggguggggaugggcgaggcggccgccaucuucaugaccgccacgccgcccgggagcgccgaggcguucccccaguccaacgccgugauccaggacgaggagaaggacaucccggagcgcagcuggaacuccggcuacgacuggaucaccgacuuccccggcaagacggucugguucgugcccagcaucaaguccgggaacgacaucgccaacugccugcggaagaacggcaagcgcgugauccagcugagccggaagaccuucgacaccgaguaccagaagaccaagaacaacgacugggacuacgucgugacgaccgacaucuccgagaugggggccaacuuccgcgccgaccgggucaucgacccccgccggugccucaagccggugauccugaaggacggccccgagcgcgugauccuggcggggcccaugcccgucaccguggccagcgccgcccagcggcgcggccggaucggccgcaaccagaacaaggagggggaccaguacaucuacaugggccagccgcucaacaacgacgaggaccacgcgcacuggaccgaggccaagaugcugcuggacaacaucaacacgcccgaggggaucauccccgcccucuucgagcccgagcgggagaaguccgccgccaucgacggcgaguaccgccugcgcggggaggcgcgcaagaccuucguggagcugaugcgccggggcgaccucccggucuggcugagcuacaagguggccuccgagggcuuccaguacagcgaccgccgguggugcuucgacggggagcgcaacaaccaggugcuggaggagaacauggacgucgagaucuggaccaaggagggcgagcggaagaagcuccgcccccgguggcuggacgcccgcaccuacagcgacccccuggcccuccgggaguucaaggaguucgccgcggggcgccgguccgugagcggcgaccugauccuggagaucggcaagcucccccagcaccugacccagcgcgcccagaacgcccuggacaaccucgugaugcugcacaacuccgagcagggcgggaaggccuaccggcacgccauggaggagcugccggacacgaucgagaccaucaugcuccuggcgcugaucgccguccucaccgggggcgugacccuguucuuccugagcgggcgcggccucggcaagacguccaucgggcugcugugcgugaccagcuccagcgcccuccuguggauggccuccgucgagccccacuggaucgcggccagcaucauccuggaguucuuccucauggugcugcugauccccgagcccgaccggcagcgcaccccgcaggacaaccagcucgccuacguggucaucggccugcuguucaugauccucaccguggccgccaacgagauggggcugcuggagacgaccaagaaggaccucggcaucgggcacaccgcggccgagaaccaccaccacgccgccaugcuggacguggaccugcaccccgccuccgcguggacccucuacgccgucgccacgaccaucaucacccccaugaugcggcacaccaucgagaacacgaccgccaacaucagccugaccgccaucgcgaaccaggccgccauccugaugggccucgacaagggcuggccgaucuccaagauggacaucggggugccccugcuggcccucggcugcuacagccaggugaacccccugacccugacggccgcgguccucaugcugguggcccacuacgccaucaucgggcccggccugcaggccaaggcgacccgcgaggcccagaagcggaccgccgccgggaucaugaagaacccgaccguggacggcaucgucgccaucgaccucgaccccgugguguacgacgcgaaguucgagaagcagcugggccagaucaugcugcucauccugugcacgucccagauccugcucaugcgcaccaccugggcccugugcgagagcaucacccuggccacggggccccucaccacccugugggagggcucccccgggaaguucuggaacaccacgaucgccgucagcauggccaacaucuuccggggcuccuaccuggcgggcgccgggcucgccuucagccugaugaagucccugggcgggggccgccgcgggaccggcgcccagggcgagacccucggggagaaguggaagcggcagcugaaccagcuguccaagagcgaguucaacaccuacaagcgcuccggcaucaucgagguggaccggagcgaggccaaggaggggcucaagcgcggcgagacgaccaagcacgcggugucccgggggaccgccaagcugcgcugguucgucgagcggaaccuggugaagccggagggcaaggugaucgaccugggcugcgggcgcggcggguggagcuacuacugcgccggccucaagaaggucaccgaggugaagggguacaccaagggcggccccgggcacgaggagcccauccccauggccacguacggcuggaaccuggugaagcugcacuccgggaaggacgucuucuucaucccgcccgagaagugcgacacccuccugugcgacaucggcgagagcucccccaaccccaccaucgaggaggggcggacccugcgcgugcucaagaugguggagccguggcugcggggcaaccaguucugcaucaagauccugaaccccuacaugcccagcgucguggagacgcucgagcagaugcagcgcaagcacggcgggaugcuggugcggaacccccugucccgcaacagcacccacgagauguacugggucuccugcggcaccgggaacaucgugagcgcggugaacaugaccucccggaugcuccugaaccgcuucacgauggcccaccggaagccgaccuacgagcgcgacgucgaccugggcgccggcacccggcacguggccguggagcccgaggucgccaaccucgacaucaucgggcagcgcaucgagaacaucaagaacgagcacaagagcaccuggcacuacgacgaggacaaccccuacaagacgugggcguaccacggcuccuacgaggugaagcccagcggguccgccagcagcauggucaacggcguggugcgccugcugaccaagccgugggacgucauccccauggugacccagaucgccaugaccgacacgacccccuucgggcagcagcggguguucaaggagaaggucgacacccgcacccccaaggccaagcggggcacggcccagaucauggaggugaccgcgaaguggcucuggggcuuccugucccgcaacaagaagccgcggaucugcacccgcgaggaguucacccggaaggugcgcagcaacgccgccaucggggccgucuucguggacgagaaccaguggaacuccgccaaggaggcgguggaggacgagcgguucugggaccugguccgccgggagcgcgagcuccacaagcagggcaagugcgccacgugcguguacaacaugauggggaagcgggagaagaagcugggcgaguucgggaaggccaagggcagccgcgccaucugguacauguggcugggcgcgcgguuccucgaguucgaggcccugggguucaugaacgaggaccacugguucucccgcgagaacagccuguccggcguggagggggagggccuccacaagcugggguacauccugcgggacaucagcaagauccccggcggcaacauguacgccgacgacaccgccgggugggacacccgcaucaccgaggaggaccuccagaacgaggccaagaucacggacaucauggagcccgagcacgcgcugcuggccaccuccaucuucaagcucaccuaccagaacaaggucgugcgggugcagcgcccggccaagaacggcaccgucauggacgugaucagccggcgcgaccagcgcggguccggccaggugggcacguacgggcugaacaccuucaccaacauggaggcccagcugauccggcagauggagagcgagggcaucuucucccccagcgagcucgagacccccaaccuggccgggcgcguccuggacuggcucgagaagcacggcaucgagcggcugcgccggauggcgaucuccggggacgacugcguggugaagcccaucgacgaccgcuucgccacggcccugaccgcccucaacgacaugggcaagguccggaaggacaucccgcagugggagcccagcaagggcuggaacgacuggcagcagguccccuucugcucccaccacuuccaccagcugaucaugaaggacgggcgcgagaucgugguccccugccggaaccaggacgagcuggugggccgcgcccgggugagccagggggcgggcuggagccuccgcgagaccgccugccuggggaaguccuacgcccagauguggcagcugauguacuuccaccggcgcgaccuccggcuggccgccaacgcgaucugcagcgccgucccgguggacugggugcccaccucccgcaccacguggagcauccacgcccaccaccaguggaugaccaccgaggacaugcuguccgucuggaaccggguguggaucgaggagaaccccuggauggaggacaagacccacgugagcuccugggaggacguccccuaccucggcaagcgcgaggaccaguggugcggcagccugaucgggcugacggcccgggcgaccugggccaccaacauccagguggccaucaaccaggugcgccgccucaucggcaacgagaacuaccuggacuacaugaccuccaugaagcgguucaagaacgagagcgacccggagggggcccugugguga

SEQ ID NO: 8913 - RNA, 9879 nt, Artificial Sequence
  derived and/or modified CDS sequence (opt1) from DENV-1__JQ915075__SS-prME
agcgugaccaugcugcucaugcugcugcccaccgugcucaccuuccaccugaccacccggggcggggagccccacaugaucgugagcaagcaggagcggggcaagagccuccuguucaagaccuccgccggggugaacaugugcacccugaucgccauggaccugggcgagcucugcgacgacaccaugaccuacaagugcccccgcaucaccgagacggagcccgacgacgucgacugcuggugcaacgccaccgagaccugggugaccuacgggacgugcagccagaccggcgagcaccggcgcgacaagcgguccguggcccuggcgccccacgucggccuggggcucgagacccgcaccgagacguggaugagcuccgagggcgccuggcggcagauccagaagguggagaccugggcccugcgccaccccggguucaccgugaucgcgcuguuccucgcccacgccaucggcaccagcaucacgcagaaggggaucaucuucauccugcugaugcucgucacccccuccauggccaugcggugcgugggcaucggcaaccgcgacuucguggaggggcugagcggcgcgaccugggucgacguggugcuggagcacggguccugcgucaccacgauggccaaggacaagcccacccucgacaucgagcugcugaagaccgaggugaccaaccccgccgugcuccggaagcugugcaucgaggccaagaucagcaacacgaccaccgacucccgcugcccgacccagggcgaggccacgcuggucgaggagcaggacaccaacuucgugugccggcgcaccuucguggaccggggcugggggaacggcugcggccuguucggcaaggggagccugaucacgugcgcgaaguucaagugcgccacgaagcuggagggcaagaucguccaguacgagaaccucaaguacuccgugaucgugaccguccacaccggcgaccagcaccagguggggaacgagaccaccgagcacggcacgaucgccaccaucacgccccaggcccccaccagcgagauccagcugacggacuacggggcccugacccucgacugcagcccccggaccggccuggacuucaacgagaugguccugcucaccaugaaggagaaguccuggcuggugcacaagcagugguuccuggaccucccgcugcccuggacgaccggggcguccaccagccaggagaccuggaaccggcaggaccugcucgugacguucaagaccgcccacgccaagaagcaggaggucguggugcugggcagccaggagggcgccaugcacaccgcccugaccggggcgacggagauccagaccuccggcaccaccacgaucuucgccgggcaccucaagugccgccugaagauggacaagcugacccucaagggcaucagcuacgucaugugcaccggguccuucaagcuggagaaggagguggccgagacccagcacggcacggugcugguccaggugaaguacgagggcaccgacgcccccugcaagauccccuucagcucccaggacgagaagggggugacccagaacggccggcuggucaccgccaacccgaucgugacggacaaggagcgccccgugaacaucgaggcggagccgcccuucggggagagcuacaucgucgugggcgccggcgagaaggcccucaagcuguccugguucaagaaggggagcuccaucggcaagauguucgaggccaccgcgcgcggggcccgccgcauggccauccugggcgacaccgccugggacuucgggagcaucggcggcguguucaccuccgucgggaagcucgugcaccagaucuucggcacggccuacggggugcuguucagcggcgucuccuggaccaugaagaucgggaucggcauccugcucaccuggcugggccugaacagccgguccaccagccucuccaugacgugcaucgcgguggggauggugacccuguaccugggcgucauggugcaggccgacagcgggugcgugaucaacuggaagggccgcgagcucaagugcggguccggcaucuucgucaccaacgaggugcacaccuggaccgagcaguacaaguuccaggccgacagcccgaagcggcugagcgccgccaucggcaaggcgugggaggagggggugugcggcauccgcuccgccacgcggcuggagaacaucauguggaagcagaucagcaacgagcucaaccacauccugcuggagaacgacaugaaguucaccgucguggugggggacgucuccggcauccucgcccaggggaagaagaccauccgcccccagcccauggagcacaaguacagcuggaaguccuggggcaaggccaagaucaucggcgccgacgugcagaacaccacguucaucaucgacgggcccaacaccccggagugccccgacgaccagcgggcguggaacaucugggagguggaggacuacggcuucgggaucuucaccaccaacaucuggcugaagcugcgcgacagcuacacgcaggucugcgaccaccggcucauguccgccgccaucaaggacagcaaggccgugcacgcggacaugggcuacuggaucgaguccgagaagaacgagaccuggaagcuggcccgcgccagcuucaucgaggugaagaccugcgucuggcccaagucccacacccuguggagcaacggcgugcucgaguccgagaugaucauccccaagaucuacgggggcccgaucagccagcacaacuaccggcccggguacuucacgcagaccgccggccccuggcaccuggggaagcuggagcucgacuucgaccugugcgagggcaccaccguggucguggacgagcacugcggcaaccgcgggccgucccugcggacgaccaccgugaccggcaagaucauccacgaguggugcugccgcagcugcacgcugccgccccugcgguucaagggggaggacggcugcugguacgggauggagauccgccccgucaaggagaaggaggagaaccuggugaaguccauggugagcgccggcagcggcgaggucgacuccuucagccucgggcugcugugcaucuccaucaugaucgaggaggugaugcggagccgcuggucccggaagaugcucaugaccggcacccugguggucuuccugcuccugacccuggggcagcucacguggaacgaccugauccgccugugcaucauggugggcgcgaacgccagcgacaacauggggaugggcaccaccuaccucgcccugauggccaccuuccgcaugcggccgauguucgccgucgggcuccucuuccgccggcugacgucccgcgaggugcugcuccugaccguggggcugagccucgucgccuccguggagcugcccaacagccuggacgagcucggcgacgggcuggccaugggcaucaugauccugaagcuccugaccgacuuccagucccaccagcugugggccacccuccugagccugacguucgugaagaccacccucucccugcacuacgccuggaagaccauggccaugauccugagcaucgucucccucuucccccugugccugagcacgaccucccagaagaccaccuggcuccccgugcugcugggcagccucgggugcaagccgcugaccauguuccugaucacggagaacaagaucuggggccggaaguccuggccccucaacgaggggaucauggcggugggcaucgucagcauccugcugagcucccuccugaagaacgacgugccccuggccgggccccucaucgccggcggcaugcugaucgccugcuacgugaucagcggguccagcgcggaccugucccucgagaaggccgccaaggucagcugggaggaggaggccgagcacuccggcgccagccacaacauccugguggagauccaggacgacgggaccaugaagaucaaggacgaggagcgcgacgacaccaucaccauccugcucaaggcgacgcugcuggccaucuccggcguguacccgaugagcauccccgccacccucuucgucuggcacuucuggcagaagaagaagcagcgguccggggugcugugggacacccccagcccgcccgagguggagaaggccguccuggacgacggcaucuaccgcauccugcagcggggccuccuggggcgcucccaggugggcgugggggucuuccaggagggcguguuccacaccauguggcacgugacgcgcggggccguccugauguaccagggcaagcgccucgagcccagcugggcguccgugaagaaggaccugaucagcuacggcgggggcuggcgguuccagggguccuggaacaccggcgaggaggugcaggucaucgccguggagcccgggaagaaccccaagaacgugcagaccgcccccggcaucuucaagaccagcgagggcgaggucggggccaucgcccuggacuucaagcccggcacguccgggagccccaucgugaaccgcgagggcaagaucgugggccucuacgggaacggcgucgugaccaccagcgggaccuacguguccgcgaucgcccaggccaaggccagccaggagggcccccugccggagaucgaggacgaggucuuccggaagcgcaaccugacgaucauggaccuccaccccggguccggcaagacccggcgcuaccugcccgccaucgugcgggaggcgaucaagcgcaagcugcggacccucgugcuggccccgacccgcgucguggccagcgagauggccgaggcgcugaagggcaugcccauccgcuaccagacgaccgccgugaaguccgagcacaccgggaaggagaucgucgaccucaugugccacgccaccuucacgaugcggcugcugagccccgugcgcgugcccaacuacaacaugaucaucauggacgaggcccacuucaccgacccggccuccaucgcggcccggggcuacaucagcacccgcgucgggaugggcgaggccgccgccaucuucaugaccgcgacgccgcccggguccguggaggccuucccccagagcaacgccgugauccaggacgaggagaaggacaucccggagcgguccuggaacagcggcuacgacuggaucaccgacuuccccggcaagaccgucugguucgugcccuccaucaagagcgggaacgacaucgccaacugccuccgcaagaacggcaagcgggugauccagcugucccgcaagaccuucgacacggaguaccagaagaccaagaacaacgacugggacuacgucgugaccaccgacaucagcgagaugggggccaacuuccgggcggaccgcgucaucgacccccggcgcugccugaagccggugauccucaaggacggccccgagcgggugauccuggccgggcccaugcccgucacgguggccuccgccgcgcagcgccggggccgcaucggccggaaccagaacaaggagggggaccaguacaucuacaugggccagccgcugaacaacgacgaggaccacgcccacuggaccgaggccaagaugcuccuggacaacaucaacacccccgaggggaucauccccgcccuguucgagcccgagcgcgagaaguccgccgcgaucgacggcgaguaccggcuccgcggggaggcccgcaagaccuucguggagcugaugcggcgcggcgaccugccggucuggcucuccuacaagguggccagcgagggcuuccaguacagcgaccggcgcuggugcuucgacggggagcggaacaaccaggugcuggaggagaacauggacgucgagaucuggacgaaggagggcgagcgcaagaagcugcggccccgcuggcucgacgcccggaccuacuccgacccccuggcccugcgcgaguucaaggaguucgcggccgggcggcgcagcguguccagcgaccucauccuggagaucggcaagcugccccagcaccucacccagcgggcccagaacgcccuggacaaccuggugaugcuccacaacuccgagcagggcgggaaggccuaccgccacgcgauggaggagcugccggacaccaucgagaccaucaugcugcucgcccugaucgccguccugacgggcggggugacccucuucuuccugagcggccgggggcugggcaagaccuccaucggccuccugugcgugaccagcuccagcgcccugcucuggauggcgaacgucgagccccacuggaucgccgccuccaucauccuggaguucuuccugauggugcuccugauccccgagcccgaccgccagcggacgccgcaggacaaccagcuggccuacguggucaucgggcuccuguucaugauccugaccguggccgcgaacgagaugggccuccuggagaccaccaagaaggaccuggggaucggccacacggccgccgagaaccaccaccacgccgccaugcucgacguggaccugcaccccgcgagcgccuggacccuguacgccgucgccaccaccaucaucacgcccaugaugcgccacaccaucgagaacaccaccgccaacaucucccucacggcgauggccaaccaggccgccauccugauggggcuggacaagggcuggccgaucagcaagauggacaucggcgugccccuccuggcccuggggugcuacucccaggugaacccccucacccugaccgcggccguccugaugcucguggcccacuacgccaucaucggccccgggcugcaggcgaaggccacccgggaggcccagaagcgcacggccgccggcaucaugaagaacccgaccguggacgggaucgucgcgaucgaccuggaccccgugguguacgacgccaaguucgagaagcagcucggccagaucaugcugcugauccucugcaccagccagauccugcugaugcggaccacgugggcccucugcgaguccaucacccuggccaccggcccccugaccacgcucugggaggggagccccggcaaguucuggaacaccaccaucgccgucuccauggcgaacaucuuccgcgggagcuaccuggccggcgccggccuggccuucagccucaugaagucccucgggggcgggcgccgggggaccggggcccagggcgagacgcugggcgagaaguggaagcgccagcucaaccagcugagcaaguccgaguucaacaccuacaagcggagcgggaucaucgagguggaccgcuccgaggcgcgggagggccugaagcgcggggagaccaccaagcacgccgugagccggggcacggccaagcuccgcugguucgucgagcggaaccuggugaagccggaggggaaggugaucgaccugggcugcggccgcgggggcugguccuacuacugcgccgggcugaagaaggucaccgaggugaagggcuacaccaagggcgggcccggccacgaggagcccauccccauggcgaccuacggguggaaccucgugaagcugcacagcggcaaggacgucuucuucaucccgcccgagaagugcgacacccugcucugcgacaucggggaguccagccccaaccccacgaucgaggagggccggacccugcgcgugcugaagaugguggagccguggcuccgggggaaccaguucugcaucaagauccugaaccccuacaugcccuccgucguggagacccuggagcagaugcagcgcaagcacggcggcaugcucgugcggaacccccugagccgcaacuccacccacgagauguacugggucagcugcgggacgggcaacaucguguccgccgugaacaugaccagccggaugcugcucaaccgcuucaccauggcccaccggaagccgaccuacgagcgcgacgucgaccugggggccggcacgcgccacguggccguggagcccgaggucgcgaaccuggacaucaucggccagcggaucgagaacaucaagaacgagcacaaguccaccuggcacuacgacgaggacaaccccuacaagaccugggccuaccacgggagcuacgaggugaagcccuccggcagcgccagcuccauggucaacgggguggugcgccuccugaccaagccgugggacgucauccccauggugacgcagaucgccaugaccgacaccacccccuucggccagcagcggguguucaaggagaaggucgacacgcgcacccccaaggccaagcgggggaccgcgcagaucauggaggugaccgccaaguggcuguggggcuuccucagccgcaacaagaagccgcggaucugcacgcgcgaggaguucacccggaaggugcgcuccaacgccgccaucggcgccgucuucguggacgagaaccaguggaacagcgcgaaggaggccguggaggacgagcgguucugggaccugguccgccgggagcgcgagcugcacaagcaggggaagugcgcgaccugcguguacaacaugaugggcaagcgggagaagaagcucggggaguucggcaaggccaaggggucccgcgcgaucugguacauguggcugggcgcccgguuccuggaguucgaggcccucggcuucaugaacgaggaccacugguucagccgcgagaacucccugagcgggguggagggcgaggggcugcacaagcucggcuacauccugcgggacaucuccaagauccccgggggcaacauguacgccgacgacaccgccggcugggacacgcgcaucaccgaggaggaccugcagaacgaggcgaagaucaccgacaucauggagcccgagcacgcccuccuggccaccagcaucuucaagcugacguaccagaacaaggucgugcgggugcagcgcccggccaagaacgggaccgucauggacgugaucucccgccgggaccagcgcggcagcggccaggugggcaccuacggccucaacaccuucacgaacauggaggcccagcugauccggcagauggaguccgaggggaucuucagccccuccgagcuggagacccccaaccucgcgggccgcguccuggacuggcuggagaagcacgggaucgagcggcuccgccggauggccaucagcggcgacgacugcguggugaagcccaucgacgaccgcuucgccaccgcccugaccgcccugaacgacauggggaagguccggaaggacaucccgcagugggagcccuccaagggcuggaacgacuggcagcagguccccuucugcagccaccacuuccaccagcucaucaugaaggacggccgcgagaucgugguccccugccggaaccaggacgagcugguggggcgcgcgcgggugagccagggcgccggguggucccugcgcgagacggccugccucggcaagagcuacgcccagauguggcagcugauguacuuccaccggcgcgaccugcggcucgccgcgaacgccaucugcuccgccgucccgguggacugggugcccaccagccgcaccaccugguccauccacgcccaccaccaguggaugaccacggaggacaugcugagcgucuggaaccggguguggaucgaggagaaccccuggauggaggacaagacccacguguccagcugggaggacguccccuaccuggggaagcgcgaggaccaguggugcggcucccucaucggccugaccgcgcgcgccaccugggccacgaacauccagguggccaucaaccaggugcggcgccugaucgggaacgagaacuaccucgacuacaugaccagcaugaagcgguucaagaacgaguccgacccggagggcgcccugugguga

SEQ ID NO: 8914 - RNA, 9879 nt, Artificial Sequence
  derived and/or modified CDS sequence (opt1) from DENV-1__JQ915076__SS-prME
agcgugaccaugcugcucaugcugcugcccaccgugcucaccuuccaccugaccacccgcggcggggagccccacaugaucgugagcaagcaggagcggggcaagagccuccuguucaagaccuccgccggggugaacaugugcacccugaucgccauggaccugggggagcucugcgacgacaccaugaccuacaagugcccccgcaucaccgagaccgagcccgacgacgucgacugcuggugcaacgcgaccgagaccugggugaccuacgggacgugcagccagaccggggagcaccggcgcgacaagcgguccguggcccuggcgccccacgucggccuggggcucgagacccgcaccgagacguggaugagcuccgagggcgccuggcggcagauccagaagguggagaccugggcccugcgccaccccggguucaccgugaucgcccuguuccucgcccacgccaucggcaccagcaucacgcagaaggggaucaucuucauccugcugaugcucgucacccccuccauggccaugcggugcgugggcaucggcaaccgcgacuucguggaggggcugagcggcgcgaccugggucgacguggugcuggagcacggguccugcgucaccacgauggccaaggacaagcccacccucgacaucgagcugcugaagaccgaggugaccaaccccgccgugcuccggaagcugugcaucgaggccaagaucagcaacacgaccaccgacucccgcugcccgacccagggcgaggccacgcuggucgaggagcaggacaccaacuucgugugccggcgcaccuucguggaccggggcugggggaacggcugcggccucuucggcaaggggagccugaucacgugcgcgaaguucaagugcgucacgaagcuggagggcaagaucgugcaguacgagaaccucaaguacuccgugaucgucaccgugcacaccggcgaccagcaccaggucgggaacgagaccaccgagcacggcacgaucgccaccaucacgccccaggcccccaccagcgagauccagcugacggacuacggggcccugacccucgacugcagcccccggaccggccuggacuucaacgagauggugcugcucaccaugaaggagaaguccuggcuggugcacaagcagugguuccuggaccucccgcugcccuggacgaccggggccuccaccagccaggagaccuggaaccggcaggaccugcucgucacguucaagaccgcgcacgccaagaagcaggagguggugguccugggcagccaggagggcgccaugcacaccgcccugaccggggccacggagauccagaccuccggcaccaccacgaucuucgcggggcaccucaagugccgccugaagauggacaagcugacccucaagggcaugagcuacgugaugugcaccggguccuucaagcuggagaaggagguggccgagacccagcacggcacgguccugguccaggugaaguacgagggcaccgacgcccccugcaagauccccuucagcucccaggacgagaagggggucacccagaacggccggcuggugaccgccaacccgaucgugacggacaaggagaagcccgucaacaucgaggccgagccgcccuucggggagagcuacaucguggugggcgcgggcgagaaggcccucaagcuguccugguucaagaaggggagcuccaucggcaagauguucgaggccaccgcccgcggggcgcggcgcauggccauccugggcgacaccgccugggacuucgggagcaucggcggcgucuucaccuccguggggaagcucgugcaccagaucuucggcacggccuacgggguccuguucagcggcguguccuggaccaugaagaucgggaucggcauccugcucaccuggcugggccugaacagccgcuccaccagccucuccaugacgugcaucgccguggggauggucacccuguaccugggcgugauggugcaggcggacagcgggugcgucaucaacuggaagggccgggagcucaagugcggguccggcaucuucgugaccaacgaggugcacaccuggaccgagcaguacaaguuccaggccgacagcccgaagcgccugagcgccgccaucggcaaggccugggaggagggggucugcggcauccgguccgcgacgcgccuggagaacaucauguggaagcagaucagcaacgagcucaaccacauccugcuggagaacgacaugaaguucaccgugguggucggggacguguccggcauccucgcccaggggaagaagaccauccggccccagcccauggagcacaaguacagcuggaaguccuggggcaaggccaagaucaucggcgccgacgugcagaacaccacguucaucaucgacgggcccaacaccccggagugccccgacgaccagcgcgccuggaacaucugggaggucgaggacuacggcuucgggaucuucaccaccaacaucuggcugaagcugcgggacagcuacacccaggugugcgaccaccgccucauguccgcggccaucaaggacagcaaggccgugcacgccgacaugggcuacuggaucgaguccgagaagaacgagacguggaagcuggcgcgggccagcuucaucgaggucaagaccugcguguggcccaagucccacacccuguggagcaacggcgugcucgaguccgagaugaucauccccaagaucuacgggggcccgaucagccagcacaacuaccgccccggguacuucacgcagaccgccggccccuggcaccuggggaagcuggagcucgacuucgaccugugcgagggcaccaccgucgugguggacgagcacugcggccaccgggggccgucccugcgcacgaccaccgucaccggcaagaucauccacgaguggugcugccggagcugcacgcugccgccccugcgcuucaagggggaggacggcugcugguacgggauggagauccggcccgugaaggagaaggaggagaaccuggugaaguccauggucagcgccggcagcggcgagguggacuccuucagccucgggcugcugugcaucuccaucaugaucgaggaggugaugcgcagccgguggucccgcaagaugcucaugaccggcacccuggucguguuccugcuccugacccuggggcagcucacguggaacgaccugauccggcugugcaucauggucggcgccaacgcgagcgacaacauggggaugggcaccaccuaccucgcccugauggccaccuuccgcaugcgcccgauguucgccgugggccuccucuuccggcgccugacgucccgggaggugcugcuccugaccgucgggcugagccucguggccuccguggagcugcccaacagccuggacgagcucggcgacgggcuggcgaugggcaucaugauccugaagcuccugaccgacuuccagucccaccagcugugggccacccuccugagccugacguucgucaagaccacccucucccugcacuacgccuggaagaccauggccaugauccugagcaucgugucccuccugccccugugccucagcacgaccucccagaagaccaccuggcugcccgugcugcucggcagccuggggugcaagccgcugaccauguuccucaucacggagaacaagaucuggggccgcaaguccuggccccugaacgaggggaucauggccgucggcaucgugagcauccugcucagcucccugcugaagaacgacgugccccucgcggggccccugaucgccggcggcaugcugaucgccugcuacgucaucagcggguccagcgccgaccucucccuggagaaggcggccaaggugagcugggaggaggaggccgagcacuccggcgccagccacaacauccugguggagauccaggacgacgggaccaugaagaucaaggacgaggagcgggacgacaccaucaccauccuccugaaggccacgcugcucgcgaucuccggcgucuacccgaugagcauccccgccacccuguucguguggcacuucuggcagaagaagaagcagcgcuccggggugcugugggacacccccagcccgcccgaggucgagaaggccgugcuggacgacggcaucuaccggauccuccagcgcggccugcuggggcggucccaggugggcgucgggguguuccaggagggcguguuccacaccauguggcacgucacgcgcggggccgugcucauguaccagggcaagcggcuggagcccagcugggccuccgugaagaaggaccugaucagcuacggcgggggcuggcgcuuccagggguccuggaacaccggcgaggagguccaggugaucgcgguggagcccgggaagaaccccaagaacguccagaccgcccccggcaccuucaagacgagcgagggcgaggugggggccaucgcccucgacuucaagcccggcaccuccgggagccccaucgugaaccgggagggcaagaucgucggccuguacgggaacggcguggugaccaccagcgggacguacgucuccgccaucgcgcaggccaagaccagccaggagggcccccugccggagaucgaggacgagguguuccgcaagcggaaccucaccaucauggaccugcaccccggguccggcaagacccgccgguaccugcccgccaucgugcgcgaggccaucaagcggaagcuccgcacgcugguccuggccccgacccgggugguggcgagcgagauggccgaggcccucaagggcaugcccauccgcuaccagaccaccgccgucaaguccgagcacacggggaaggagaucguggaccugaugugccacgcgaccuucaccaugcgccugcucagccccgugcggguccccaacuacaacaugaucaucauggacgaggcccacuucaccgacccggccuccaucgccgcccgcggcuacaucagcacgcggguggggaugggcgaggcggccgccaucuucaugaccgccacgccgcccggguccguggaggccuucccccagagcaacgcggucauccaggacgaggagaaggacaucccggagcgcuccuggaacagcggcuacgacuggaucaccgacuuccccggcaagacggugugguucgugcccuccaucaagagcgggaacgacaucgccaacugccugcggaagaacggcaagcgcgucauccagcugucccggaagaccuucgacaccgaguaccagaagaccaagaacaacgacugggacuacguggucacgaccgacaucagcgagaugggggccaacuuccgcgccgaccgggugaucgacccccgccggugccucaagccggugauccugaaggacggccccgagcgcgucauccuggccgggcccaugcccgugaccguggcguccgccgcccagcggcgcggccggaucggccgcaaccagaacaaggagggggaccaguacgucuacaugggccagccgcucaacaacgacgaggaccacgcccacuggaccgaggcgaagaugcugcuggacaacaucaacacgcccgaggggaucauccccgcccucuucgagcccgagcgggagaaguccgccgccaucgacggcgaguaccgccugcgcggggaggcccgcaagaccuucguggagcugaugcgccggggcgaccucccgguguggcuguccuacaaggucgcgagcgagggcuuccaguacagcgaccgccgguggugcuucgacggggagcgcaacaaccaggugcuggaggagaacauggacguggagaucuggaccaaggagggcgagcggaagaagcuccgcccccgguggcuggacgcccgcaccuacuccgacccccuggcccuccgggaguucaaggaguucgccgccgggcgccggagcgucuccggcgaccugauccuggagaucggcaagcucccccagcaccugacccagcgcgcgcagaacgcccuggacaaccucgugaugcugcacaacagcgagcagggcgggaaggccuaccggcacgccauggaggagcugccggacacgaucgagaccaucaugcuccuggcccugaucgcggugcucaccgggggcgucacccuguucuuccuguccgggcgcggccucggcaagacgagcaucgggcugcugugcgugaccuccagcuccgcccuccuguggauggccagcguggagccccacuggaucgccgcguccaucauccuggaguucuuccucaugguccugcugauccccgagcccgaccggcagcgcaccccgcaggacaaccagcucgccuacguggugaucggccugcuguucaugauccucaccgucgccgccaacgagauggggcugcuggagacgaccaagaaggaccucggcaucgggcacaccgccgcggagaaccaccaccacgccgccaugcuggacguggaccugcaccccgccagcgccuggacccucuacgcgguggccacgaccaucaucacccccaugaugcggcacaccaucgagaacacgaccgccaacaucucccugaccgccaucgccaaccaggcggccauccugaugggccucgacaagggcuggccgaucagcaagauggacaucggggucccccugcuggcccucggcugcuacucccaggugaacccccugacccugacggccgccgugcucaugcuggucgcgcacuacgccaucaucgggcccggccugcaggccaaggccacccgcgaggcgcagaagcggaccgccgccgggaucaugaagaacccgaccguggacggcaucguggccaucgaccucgaccccgucguguacgacgccaaguucgagaagcagcugggccagaucaugcugcucauccugugcacgagccagauccugcucaugcgcaccaccugggcgcugugcgaguccaucacccuggccacggggccccucaccacccugugggagggcagccccgggaaguucuggaacaccacgaucgccguguccauggccaacaucuuccggggcagcuaccuggccggcgcggggcucgccuucagccugaugaagucccugggcgggggccgccgcgggaccggcgcccagggcgagacccucggggagaaguggaagcggcagcugaaccagcugagcaaguccgaguucaacaucuacaagcgcagcggcaucaucgaggucgaccgguccgaggccaaggaggggcucaagcgcggcgagaccacgaagcacgccgugagccgggggaccgcgaagcugcgcugguucguggagcggaaccuggucaagccggagggcaaggugaucgaccugggcugcgggcgcggcgggugguccuacuacugcgccggccucaagaaggugaccgaggucaagggguacaccaagggcggccccgggcacgaggagcccauccccauggccaccuacggcuggaaccuggugaagcugcacagcgggaaggacguguucuucaucccgcccgagaagugcgacacgcuccugugcgacaucggcgaguccagccccaaccccaccaucgaggaggggcggacccugcgcguccucaagaugguggagccguggcugcggggcaaccaguucugcaucaagauccugaaccccuacaugcccuccguggucgagacccucgagcagaugcagcgcaagcacggcgggaugcuggugcggaacccccugagccgcaacuccacgcacgagauguacugggugagcugcggcaccgggaacaucgucuccgccgugaacaugaccagccggaugcuccugaaccgcuucaccauggcgcaccggaagccgacguacgagcgcgacguggaccugggcgccggcacccggcacgucgccguggagcccgaggucgccaaccucgacaucaucgggcagcgcaucgagaacaucaagaacgagcacaaguccaccuggcacuacgacgaggacaaccccuacaagaccugggccuaccacggcagcuacgaggugaagcccuccgggagcgcgagcuccauggugaacggcgucgugcgccugcugacgaagccgugggacgugauccccauggucacccagaucgccaugaccgacaccacgcccuucgggcagcagcggguguucaaggagaagguggacacccgcacccccaaggccaagcggggcaccgcccagaucauggaggucacggccaaguggcucuggggcuuccugagccgcaacaagaagccgcggaucugcacccgcgaggaguucacccggaaggugcgcuccaacgcggccaucggggccguguucgucgacgagaaccaguggaacagcgccaaggaggccguggaggacgagcgguucugggaccuggugcgccgggagcgcgagcuccacaagcagggcaagugcgcgaccugcgucuacaacaugauggggaagcgggagaagaagcugggcgaguucgggaaggccaagggcucccgcgccaucugguacauguggcugggcgcccgguuccucgaguucgaggcgcugggguucaugaacgaggaccacugguucagccgcgagaacucccugagcggcguggagggggagggccuccacaagcugggguacauccugcgggacaucuccaagauccccggcggcaacauguacgccgacgacacggccgggugggacacccgcaucaccgaggaggaccuccagaacgaggccaagaucaccgacaucauggagcccgagcacgcccugcuggcgacgagcaucuucaagcucaccuaccagaacaaggugguccgggugcagcgcccggccaagaacggcaccgugauggacgucaucucccggcgcgaccagcgcgggagcggccaggugggcaccuacgggcugaacacguucaccaacauggaggcccagcugauccggcagauggaguccgagggcaucuucagccccuccgagcucgagacccccaaccuggccgggcgcgugcuggacuggcucgagaagcacggcaucgagcggcugcgccggauggccaucagcggggacgacugcgucgugaagcccaucgacgaccgcuucgcgaccgcccugacggcccucaacgacaugggcaaggugcggaaggacaucccgcagugggagcccuccaagggcuggaacgacuggcagcagguccccuucugcagccaccacuuccaccagcugaucaugaaggacgggcgcgagaucguggugcccugccggaaccaggacgagcuggucggccgcgcccgggugagccagggggccggcuggucccuccgcgagaccgcgugccugggcaagagcuacgcccagauguggcagcugauguacuuccaccggcgcgaccuccggcuggccgccaacgccaucugcuccgcggugccggucgacugggugcccaccagccgcaccaccugguccauccacgcccaccaccaguggaugacgaccgaggacaugcugagcguguggaaccgggucuggaucgaggagaaccccuggauggaggacaagacccacguguccagcugggaggacgugcccuaccucggcaagcgcgaggaccaguggugcggcucccugaucgggcugaccgcccgggccacgugggcgaccaacauccaggucgccaucaaccaggugcgccgccucaucggcaacgagaacuaccuggacuacaugaccagcaugaagcgguucaagaacgaguccgacccggagggggcccugugguga

SEQ ID NO: 8915 - RNA, 9879 nt, Artificial Sequence
  derived and/or modified CDS sequence (opt1) from DENV-1__KF289072__SS-prME
agcgugaccaugcugcucaugcugcugcccaccgcccucgccuuccaccugaccacccgcggcggggagccccacaugaucgugagcaagcaggagcggggcaagagccuccuguucaagaccuccgcgggggugaacaugugcacccugaucgccauggaccugggcgagcucugcgaggacacgaugaccuacaagugcccccgcaucaccgaggccgagcccgacgacguggacugcuggugcaacgccaccgacaccugggugaccuacgggaccugcagccagaccggcgagcaccggcgcgacaagcgguccguggcccuggcgccccacgugggccuggggcucgagacccgcaccgagaccuggaugagcuccgagggcgccuggcggcagauccagaagguggagaccugggcccugcgccaccccggguucacggugaucgcccuguuccucgcgcacgccaucggcaccagcaucacccagaaggggaucaucuucauccugcugaugcucgugacccccuccauggccaugcggugcgucggcaucggcaaccgcgacuucguggaggggcugagcggcgccacguggguggacgucgugcuggagcacggguccugcgugaccaccauggccaagaacaagcccacccucgacaucgagcugcugaagacggaggucaccaaccccgcggugcuccggaagcugugcaucgaggccaagaucagcaacaccaccacggacucccgcugccccacccagggcgaggccacccugguggaggagcaggacgccaacuucgucugccggcgcaccuucguggaccggggcugggggaacggcugcggccucuucggcaaggggagccugcugacgugcgccaaguucaagugcgugaccaagcucgagggcaagaucguccaguacgagaaccugaaguacuccgugaucgugaccguccacaccggcgaccagcaccagguggggaacgagacgaccgagcacggcaccaucgcgaccaucacgccccaggcccccacgagcgagauccagcugaccgacuacggggcccucacccuggacugcagcccccgcaccggccuggacuucaacgagaugguccuccugacgaugaaggagaaguccuggcuggugcacaagcagugguuccucgaccugccgcugcccuggaccuccggggccagcaccagccaggagaccuggaaccggcaggaccuccuggugacguucaagaccgcccacgcgaagaagcaggaggucguggugcugggcucccaggagggcgccaugcacaccgcccucaccggggccacggagauccagaccagcggcaccaccacgaucuucgccgggcaccugaagugccgccugaagauggacaagcucacccugaagggcgucuccuacgugaugugcaccgggagcuucaagcuggagaaggagguggcggagacccagcacggcacgguccugguccaggugaaguacgagggcaccgacgcccccugcaagauccccaucuccacccaggacgagaagggggucacccagaacggccggcucaucacggccaacccgaucgugaccgacaaggagaagcccgugaacaucgagaccgagccgcccuucggggagagcuacaucgucaucggcgccggcgagaaggcgcugaagcuguccugguucaagaaggggagcuccaucggcaagauguucgaggccaccgcccgcggggcccggcgcauggccauccucggcgacacggcgugggacuucgggagcaucggcggcguguucaccuccguggggaagcugguccaccagguguucggcaccgccuacggggugcuguucagcggcgucuccuggaccaugaagaucgggaucggcauccuccugacguggcugggccucaacagccgcuccaccagccuguccaugaccugcaucgccguggggauggugacccuguaccucggcgucauggugcaggccgacagcgggugcgugaucaacuggaagggccgggagcugaagugcggguccggcaucuucgucacgaacgaggugcacaccuggaccgagcaguacaaguuccaggccgacagcccgaagcgccugagcgcggccaucggcaaggccugggaggagggggugugcggcauccgguccgccacccgccucgagaacaucauguggaagcagaucagcaacgagcugaaccacauccugcucgagaacgacaugaaguucaccgucguggugggggacgccaacggcauccugacgcaggggaagaagaugauccggccccagcccauggagcacaaguacuccuggaaguccuggggcaaggcgaagaucaucggcgccgacacccagaacaccaccuucaucaucgacgggcccgacacgccggagugccccgacgaccagcgcgccuggaacaucugggaggucgaggacuacggcuucgggguguucaccaccaacaucuggcugaagcuccgggacuccuacacccagaugugcgaccaccgccugaugagcgccgcgaucaaggacuccaaggccgugcacgccgacaugggcuacuggaucgagagcgagaagaacgagacguggaagcuggcccgggccuccuucaucgaggucaagaccugcaucuggccccgcagccacacccucugguccaacggcgugcuggagagcgagaugaucauccccaagaucuacgggggcccgaucucccagcacaacuaccggcccggguacuucacccagacggcgggccccuggcaccuggggaagcucgagcuggacuucaaccugugcgagggcaccaccguggucguggacgagcacugcggcaaccgcgggccgagccuccggaccacgaccgugaccggcaagaucauccacgaguggugcugccgcuccugcacccugccgccccugcgguucaagggggaggacggcugcugguacgggauggagauccgccccgucaaggagaaggaggagaaccucgugcggagcaugguguccgccggcagcggcgaggucgacagcuucucccuggggcugcucugcgugagcaucaugaucgaggaggugaugcgcucccgguggagccgcaagaugcugaugacgggcacccuggccgucuucuuccuccugaucauggggcagcugaccuggaacgaccucauccgccugugcaucauggugggcgccaacguguccgaccggauggggaugggcaccacguaccuggcccucauggcgaccuucaagaugcgcccgauguucgccgucgggcugcuguuccggcgccucaccagccgggaggugcugcugcucaccaucgggcugucccuggucgccagcguggagcuccccaacucccuggaggagcugggcgacgggcucgccaugggcaucaugaugcugaagcugcucacggacuuccagagccaccagcuguggaccacccugcucucccugaccuucaucaagacgacccugagccucgacuacgccuggaagaccauggcgauggugcuguccaucgucagccuguucccccucugccuguccaccacgagccagaagaccaccuggcugcccgugcuccugggcuccuucgggugcaagccgcugaccauguuccucaucaccgagaacaagaucuggggccgcaagagcuggccccugaacgaggggaucauggccgugggcaucgucuccauccugcucagcagccugcugaagaacgacgugccccucgccgggccccugaucgccggcggcaugcugaucgcgugcuacgugaucuccgggagcuccgccgaccucagccuggagcgggccgccgaggucuccugggaggaggaggccgagcacagcggcgcgucccacaacauccugguggaggugcaggacgacgggacgaugaagaucaaggacgaggagcgcgacgacacccucaccauccugcugaaggccacccuccuggccgucagcggcguguacccgauguccauccccgccacgcuguucgugugguacuucuggcagaagaagaagcagcggagcgggguccucugggacacccccagcccgcccgagguggagcgcgccgugcuggacgacggcaucuaccggauccugcagcgcggccugcucgggcggagccaggucggcguggggguguuccaggacggcgucuuccacaccauguggcacgugacccgcggggcggugcugauguaccagggcaagcggcuggagcccuccugggccagcgucaagaaggaccucaucuccuacggcgggggcuggcgcuuccaggggagcuggaacacgggcgaggagguccaggugaucgccgucgagcccgggaagaaccccaagaacgugcagaccacccccggcaccuucaagacgcccgagggcgccgugggggccaucgcgcuggacuucaagcccggcaccuccgggagccccaucgucaaccgggagggcaagaucgugggccuguacgggaacggcguggucaccaccuccgggacguacgugagcgccaucgcccaggccaaggccagccaggagggcccgcuccccgagaucgaggacgagguguucaagaagcgcaaccugaccaucauggaccugcaccccggguccggcaagacccggcgcuaccucccggcgaucguccgggaggccaucaagcgcaagcugcgcacccugauccucgcccccacgcgggugguggccagcgagauggcggaggcccugaagggcaugcccauccgcuaccagaccaccgccgucaaguccgagcacaccgggaaggagaucguggaccugaugugccacgccacguucaccaugcggcuccugagccccgugcgcgucccgaacuacaacaugaucaucauggacgaggcccacuucaccgaccccgcguccaucgccgcccggggcuacaucagcacccgcguggggaugggcgaggccgccgcgaucuucaugacggccacgccgcccggguccguggaggccuucccgcagagcaacgccgucauccaggacgaggagcgggacauccccgagcgcuccuggaacagcggcuacgacuggaucaccgacuuccccggcaagaccgugugguucgugcccuccaucaagagcgggaacgacaucgccaacugccugcggaagaacggcaagcgcgucauccagcucucccggaagacguucgacaccgaguaccagaagaccaagaacaacgacugggacuacguggugaccacggacaucagcgagaugggggcgaacuuccgcgccgaccgggucaucgacccgcgccggugccugaagcccgugauccugaaggacggccccgagcgcgucauccucgccgggcccaugccggugaccgccgcguccgccgcccagcggcgcggccggaucggccgcaaccagaacaaggagggggaccaguacaucuacaugggccagccccugaacaacgacgaggaccacgcccacuggaccgaggccaagaugcugcucgacaacaucaacacccccgaggggaucauccccgcgcuguucgagccggagcgcgagaaguccgccgccaucgacggcgaguaccggcugcgcggggaggcccggaagacguucguggagcucaugcgccggggcgaccugcccgucuggcuguccuacaagguggccagcgagggcuuccaguacuccgaccgccgguggugcuucgacggggagcgcaacaaccaggugcucgaggagaacauggacgucgagaucuggaccaaggagggcgagcggaagaagcugcgcccccgguggcuggacgcgcgcaccuacagcgacccccucgcccugcgggaguucaaggaguucgccgccgggcgccggagcguguccggcgaccugauccucgagaucggcaagcugccgcagcaccugacccuccgcgcccagaacgcgcuggacaaccuggugaugcuccacaacagcgagcagggcgggaaggccuaccggcacgccauggaggagcugcccgacaccaucgagacgcugaugcuccuggcccugaucgcgguccucaccgggggcgugacccuguucuuccuguccgggaagggccucggcaagaccagcaucgggcugcugugcgugauggccuccagcguccuccuguggauggccuccguggagccccacuggaucgccgccagcaucauccuggaguucuuccucauggugcugcugauccccgagccggaccgccagcggacgccccaggacaaccagcucgcguacgucgugaucggccugcuguucaugauccucaccguggccgccaacgagauggggcugcuggagaccaccaagaaggaccucggcaucgggcacgucguggccgagaaccaccaccacgccacgaugcuggacaucgaccugcaccccgcguccgccuggacccucuacgccguggccaccaccaucaucacgccgaugaugcgccacaccaucgagaacaccaccgccaacaucagccugacggcgaucgccaaccaggccgccauccugaugggccucgacaagggcuggcccaucuccaagauggacaucggggucccccugcuggcccucggcugcuacagccaggugaacccccugacccugaccgcggccgugcucaugcuggucgcccacuacgccaucaucgggccgggccugcaggcgaaggccacccgggaggcccagaagcgcacggccgccgggaucaugaagaaccccaccguggacggcaucguggcgaucgaccucgaccccgucguguacgacgccaaguucgagaagcagcugggccagaucaugcugcucauccugugcaccucccagauccugcucaugcgcaccacgugggcccugugcgagagcaucacccuggccaccgggccccucaccacgcugugggagggcuccccggggcgguucuggaacaccaccaucgccgugagcauggcgaacaucuuccgcggcuccuaccuggccggcgccgggcucgccuucagccugaugaagucccugggcgggggccggcgcgggaccggcgcccagggcgagacgcucggggagaaguggaagcggcagcugaaccagcugagcaagagcgaguucaacaccuacaagcgcuccggcaucauggaggucgaccggagcgaggcgaaggaggggcucaagcgcggcgagaccaccaagcacgccgugucccgggggacggccaagcugcgcugguucguggagcggaaccuggucaagcccgagggcaaggugaucgaccugggcugcgggcgcggcggguggagcuacuacugcgccggccucaagaaggugaccgaggucaagggguacaccaagggcggccccgggcacgaggagcccaucccgauggcgaccuacggcuggaacaucgugaagcugcacuccgggcgggacguguucuucacgccgcccgagaagugcgacacgcugcucugcgacaucggcgagagcucccccaacccgaccaucgaggaggggcgcacccugcggguccugaagaugguggagcccuggcuccgcggcaaccaguucugcaucaagauccugaaccccuacaugcccagcguggucgagacccuggagcagaugcagcggaagcacggcgggaugcucgugcgcaacccgcugucccggaacagcacgcacgagauguacuggguguccugcggcaccgggaacaucgucagcgccgugaacaugaccucccgcaugcugcucaaccgcuucaccaugacgcaccggaagcccaccuacgagcgcgacguggaccugggcgccggcacccggcacgucgccguggagcccgagaucgccaaccuggacaucaucgggcagcgcaucgagaacaucaagaacgagcacaagagcaccuggcacuacgacgaggacaaccccuacaagacgugggcguaccacggcuccuacgaggugaagccgagcggguccgccagcuccauggucaacggcgugguccggcuccugaccaagcccugggacgugauccccauggugacccagaucgccaugaccgacacgacccccuucgggcagcagcgcgucuucaaggagaagguggacacccggaccccgcgccccaagcggggcacggcccagaucauggaggugaccgccaaguggcuguggggcuuccucagccgcaacaagaagccccggaucugcacccgcgaggaguucacccggaagguccgcagcaacgcggccaucggggccguguucguggacgagaaccaguggaacuccgccaaggaggccgucgaggacgagcgguucugggaccuggugcaccgcgagcgggagcugcacaagcagggcaagugcgcgacgugcguguacaacaugauggggaagcgcgagaagaagcucggcgaguucgggaaggccaagggcagccgggccaucugguacauguggcugggcgcccgcuuccuggaguucgaggcgcucggguucaugaacgaggaccacugguucucccgggagaacagccuguccggcgucgagggggagggccugcacaagcucggguacauccugcgcgacaucagcaagaucccgggcggcaacauguacgccgacgacaccgccgggugggacacccgcaucaccgaggacgaccugcagaacgaggccaagaucacggacaucauggagcccgagcacgcccuccuggcgaccuccaucuucaagcugaccuaccagaacaagguggugcggguccagcgccccgccaagagcggcaccgugauggacgugaucucccggcgcgaccagcgggggagcggccaggucggcacguacgggcucaacaccuucaccaacauggaggugcagcugauccgccagauggaguccgagggcaucuucagccccuccgagcuggagaacagcaaccucgccgagcgggugcuggacuggcuggagaagcacggggucgagcgccucaagcggauggccaucuccggcgacgacugcguggugaagccgaccgacgaccgcuucgccacggcgcugaccgcccugaacgacauggggaagguccggaaggacaucccccagugggagcccagcaagggcuggaacgacuggcagcagguccccuucugcucccaccacuuccaccagcucaucaugaaggacggccgcgagaucguggucccgugccggaaccaggacgagcugguggggcgcgcccgggugagccagggcgccggguggagccugcgcgagaccgccugccucggcaaguccuacgcgcagauguggcagcugauguacuuccaccggcgcgaccugcggcucgccgccaacgccaucugcagcgccguccccguggacugggugcccaccucccgcaccacguggagcauccacgcgcaccaccaguggaugaccaccgaggacaugcuguccgucuggaaccgcguguggaucgaggagaaccccuggauggaggacaagacccacgugagcuccugggaggacgucccguaccuggggaagcgggaggaccaguggugcggcagccucaucggccugacggcccgcgccaccugggccaccaacauccagguggcgaucaaccaggugcggcgccugaucgggaacgagaacuaccucgacuacaugaccuccaugaagcgguucaagaacgagagcgacuccgagggcgcccugugguga

SEQ ID NO: 8916 - RNA, 9879 nt, Artificial Sequence
  derived and/or modified CDS sequence (opt1) from DENV-1__JQ692085__SS-prME
agcgugaccaugcugcucaugcugcugcccaccgcccucgccuuccaccugaccacccggggcggggagccccacaugaucgugagcaagcaggagcggggcaagagccuccuguucaagaccuccgcgggggugaacaugugcacccugaucgccauggaccugggcgagcucugcgaggacacgaugaccuacaagugcccccggaucaccgaggccgagcccgacgacguggacugcuggugcaacgccaccgacaccugggugaccuacgggaccugcagccagaccggcgagcaccggcgcgacaagcgguccguggcccuggcgccccacgugggccuggggcucgagacccgcaccgagaccuggaugagcuccgagggcgccuggcggcagauccagaagguggagaccugggcccugcgccaccccggguucacggugaucgcccuguuccucgcgcacgccaucggcaccagcaucacccagaaggggaucaucuucauccugcugaugcucgugacccccuccauggccaugcggugcgucggcaucggcaaccgcgacuucguggaggggcugagcggcgccacguggguggacgucgugcuggagcacggguccugcgugaccaccauggccaagaacaagcccacccucgacaucgagcugcugaagacggaggucaccaaccccgcggugcuccggaagcugugcaucgaggccaagaucagcaacaccaccacggacucccgcugccccacccagggcgaggccacccugguggaggagcaggacgccaacuucgucugccggcgcaccuucguggaccggggcugggggaacggcugcggccucuucggcaaggggagccugcugacgugcgccaaguucaagugcgugaccaagcucgagggcaagaucguccaguacgagaaccugaaguacuccgugaucgugaccguccacaccggcgaccagcaccagguggggaacgagacgaccgagcacggcaccaucgcgaccaucacgccccaggcccccacgagcgagauccagcugaccgacuacggggcccucacccuggacugcagcccccggaccggccuggacuucaacgagaugguccuccugacgaugaaggagaaguccuggcuggugcacaagcagugguuccucgaccugccgcugcccuggaccuccggggccagcaccagccaggagaccuggaaccggcaggaccuccuggugacguucaagaccgcccacgcgaagaagcaggaggucguggugcugggcucccaggagggcgccaugcacaccgcccucaccggggccacggagauccagaccagcggcaccaccacgaucuucgccgggcaccugaagugccgccugaagauggacaagcucacccugaagggcgucuccuacgugaugugcaccgggagcuucaagcuggagaaggagguggcggagacccagcacggcacgguccugguccaggugaaguacgagggcaccgacgcccccugcaagauccccaucuccacccaggacgagaagggggucacccagaacggccggcucaucacggccaacccgaucgugaccgacaaggagaagcccgugaacaucgagaccgagccgcccuucggggagagcuacaucgucaucggcgccggcgagaaggcgcugaagcuguccugguucaagaaggggagcuccaucggcaagauguucgaggccaccgcccgcggggcccggcgcauggccauccucggcgacacggcgugggacuucgggagcaucggcggcguguucaccuccguggggaagcugguccaccagguguucggcaccgccuacggggugcuguucagcggcgucuccuggaccaugaagaucgggaucggcauccuccugacguggcugggccucaacagccgcuccaccagccuguccaugaccugcaucgccguggggauggugacccuguaccucggcgucauggugcaggccgacagcgggugcgugaucaacuggaagggccgggagcugaagugcggguccggcaucuucgucacgaacgaggugcacaccuggaccgagcaguacaaguuccaggccgacagcccgaagcgccugagcgcggccaucggcaaggccugggaggagggggugugcggcauccgguccgccacccgccucgagaacaucauguggaagcagaucagcaacgagcugaaccacauccugcucgagaacgacaugaaguucaccgucguggugggggacgccaacggcauccugacgcaggggaagaagaugauccggccccagcccauggagcacaaguacuccuggaaguccuggggcaaggcgaagaucaucggcgccgacacccagaacaccaccuucaucaucgacgggcccgacacgccggagugccccgacgaccagcgcgccuggaacaucugggaggucgaggacuacggcuucgggguguucaccaccaacaucuggcugaagcuccgggacuccuacacccagaugugcgaccaccgccugaugagcgccgcgaucaaggacuccaaggccgugcacgccgacaugggcuacuggaucgagagcgagaagaacgagacguggaagcuggcccgggccuccuucaucgaggucaagaccugcaucuggccccgcagccacacccucugguccaacggcgugcuggagagcgagaugaucauccccaagaucuacgggggcccgaucucccagcacaacuaccggcccggguacuucacccagacggcgggccccuggcaccuggggaagcucgagcuggacuucaaccugugcgagggcaccaccguggucguggacgagcacugcggcaaccgcgggccgagccuccggaccacgaccgugaccggcaagaucauccacgaguggugcugccgcuccugcacccugccgccccugcgguuccgcggggaggacggcugcugguacgggauggagauccggcccgucaaggagaaggaggagaaccucgugcgcagcaugguguccgccggcagcggcgaggucgacagcuucucccuggggcugcucugcgugagcaucaugaucgaggaggugaugcggucccgcuggagccgcaagaugcugaugacgggcacccuggccgucuucuuccuccugaucauggggcagcugaccuggaacgaccucauccggcugugcaucauggugggcgccaacguguccgaccgcauggggaugggcaccacguaccuggcccucauggcgaccuucaagaugcggccgauguucgccgucgggcugcuguuccgccggcucaccagccgcgaggugcugcugcucaccaucgggcugucccuggucgccagcguggagcuccccaacucccuggaggagcugggcgacgggcucgccaugggcaucaugaugcugaagcugcucacggacuuccagagccaccagcuguggaccacccugcucucccugaccuucaucaagacgacccugagccucgacuacgccuggaagaccauggcgauggugcuguccaucgucagccuguucccccucugccuguccaccacgagccagaagaccaccuggcugcccgugcuccugggcuccuucgggugcaagccgcugaccauguuccucaucaccgagaacaagaucuggggccgcaagagcuggccccugaacgaggggaucauggccgugggcaucgucuccauccugcucagcagccugcugaagaacgacgugccccucgccgggccccugaucgccggcggcaugcugaucgcgugcuacgugaucuccgggagcuccgccgaccucagccuggagcgcgccgccgaggucuccugggaggaggaggccgagcacagcggcgcgucccacaacauccugguggaggugcaggacgacgggacgaugaagaucaaggacgaggagcgggacgacacccucaccauccugcugaaggccacccuccuggccgucagcggcguguacccgauguccauccccgccacgcuguucgugugguacuucuggcagaagaagaagcagcgcagcgggguccucugggacacccccagcccgcccgagguggagcgggccgugcuggacgacggcaucuaccgcauccugcagcggggccugcucgggcgcagccaggucggcguggggguguuccaggacggcgucuuccacaccauguggcacgugacccgcggggcggugcugauguaccagggcaagcgccuggagcccuccugggccagcgucaagaaggaccucaucuccuacggcgggggcuggcgguuccaggggagcuggaacacgggcgaggagguccaggugaucgccgucgagcccgggaagaaccccaagaacgugcagaccacccccggcaccuucaagacgcccgagggcgccgugggggccaucgcgcuggacuucaagcccggcaccuccgggagccccaucgucaaccgcgagggcaagaucgugggccuguacgggaacggcguggucaccaccuccgggacguacgugagcgccaucgcccaggccaaggccagccaggagggcccgcuccccgagaucgaggacgagguguucaagaagcggaaccugaccaucauggaccugcaccccggguccggcaagacccgccgguaccucccggcgaucguccgcgaggccaucaagcgcaagcugcggacccugauccucgcccccacgcgcgugguggccagcgagauggcggaggcccugaagggcaugcccauccgguaccagaccaccgccgucaaguccgagcacaccgggaaggagaucguggaccugaugugccacgccacguucaccaugcgccuccugagccccgugcgggucccgaacuacaacaugaucaucauggacgaggcccacuucaccgaccccgcguccaucgccgcccgcggcuacaucagcacccggguggggaugggcgaggccgccgcgaucuucaugacggccacgccgcccggguccguggaggccuucccgcagagcaacgccgucauccaggacgaggagcgcgacauccccgagcgguccuggaacagcggcuacgacuggaucaccgacuuccccggcaagaccgugugguucgugcccuccaucaagagcgggaacgacaucgccaacugccugcgcaagaacggcaagcgggucauccagcucucccgcaagacguucgacaccgaguaccagaagaccaagaacaacgacugggacuacguggugaccacggacaucagcgagaugggggcgaacuuccgggccgaccgcgucaucgacccgcggcgcugccugaagcccgugauccugaaggacggccccgagcgggucauccucgccgggcccaugccggugaccgccgcguccgccgcccagcgccggggccgcaucggccgcaaccagaacaaggagggggaccaguacaucuacaugggccagccccugaacaacgacgaggaccacgcccacuggaccgaggccaagaugcugcucgacaacaucaacacccccgaggggaucauccccgcgcuguucgagccggagcgggagaaguccgccgccaucgacggcgaguaccgccugcgcggggaggcccgcaagacguucguggagcucaugcggcgcggcgaccugcccgucuggcuguccuacaagguggccagcgagggcuuccaguacuccgaccggcgcuggugcuucgacggggagcggaacaaccaggugcucgaggagaacauggacgucgagaucuggaccaaggagggcgagcgcaagaagcugcggccccgcuggcuggacgcgcggaccuacagcgacccccucgcccugcgcgaguucaaggaguucgccgccgggcggcgcagcguguccggcgaccugauccucgagaucggcaagcugccgcagcaccugacccuccgggcccagaacgcgcuggacaaccuggugaugcuccacaacagcgagcagggcgggaaggccuaccgccacgccauggaggagcugcccgacaccaucgagacgcugaugcuccuggcccugaucgcgguccucaccgggggcgugacccuguucuuccuguccgggaagggccucggcaagaccagcaucgggcugcugugcgugauggccuccagcguccuccuguggauggccuccguggagccccacuggaucgccgccagcaucauccuggaguucuuccucauggugcugcugauccccgagccggaccggcagcgcacgccccaggacaaccagcucgcguacgucgugaucggccugcuguucaugauccucaccguggccgccaacgagauggggcugcuggagaccaccaagaaggaccucggcaucgggcacgucguggccgagaaccaccaccacgccacgaugcuggacaucgaccugcaccccgcguccgccuggacccucuacgccguggccaccaccaucaucacgccgaugaugcggcacaccaucgagaacaccaccgccaacaucagccugacggcgaucgccaaccaggccgccauccugaugggccucgacaagggcuggcccaucuccaagauggacaucggggucccccugcuggcccucggcugcuacagccaggugaacccccugacccugaccgcggccgugcucaugcuggucgcccacuacgccaucaucgggccgggccugcaggcgaaggccacccgcgaggcccagaagcgcacggccgccgggaucaugaagaaccccaccguggacggcaucguggcgaucgaccucgaccccgucguguacgacgccaaguucgagaagcagcugggccagaucaugcugcucauccugugcaccucccagauccugcucaugcggaccacgugggcccugugcgagagcaucacccuggccaccgggccccucaccacgcugugggagggcuccccggggcgcuucuggaacaccaccaucgccgugagcauggcgaacaucuuccggggcuccuaccuggccggcgccgggcucgccuucagccugaugaagucccugggcgggggccgccgggggaccggcgcccagggcgagacgcucggggagaaguggaagcgccagcugaaccagcugagcaagagcgaguucaacaccuacaagcgguccggcaucauggaggucgaccgcagcgaggcgaaggaggggcucaagcggggcgagaccaccaagcacgccgugucccgcgggacggccaagcugcggugguucguggagcgcaaccuggucaagcccgagggcaaggugaucgaccugggcugcgggcggggcggguggagcuacuacugcgccggccucaagaaggugaccgaggucaagggguacaccaagggcggccccgggcacgaggagcccaucccgauggcgaccuacggcuggaacaucgugaagcugcacuccgggcgcgacguguucuucacgccgcccgagaagugcgacacgcugcucugcgacaucggcgagagcucccccaacccgaccaucgaggaggggcggacccugcgcguccugaagaugguggagcccuggcuccggggcaaccaguucugcaucaagauccugaaccccuacaugcccagcguggucgagacccuggagcagaugcagcgcaagcacggcgggaugcucgugcggaacccgcugucccgcaacagcacgcacgagauguacuggguguccugcggcaccgggaacaucgucagcgccgugaacaugaccucccgcaugcugcucaaccgguucaccaugacgcaccgcaagcccaccuacgagcgggacguggaccugggcgccggcacccgccacgucgccguggagcccgagaucgccaaccuggacaucaucgggcagcggaucgagaacaucaagaacgagcacaagagcaccuggcacuacgacgaggacaaccccuacaagacgugggcguaccacggcuccuacgaggugaagccgagcggguccgccagcuccauggucaacggcgugguccgccuccugaccaagcccugggacgugauccccauggugacccagaucgccaugaccgacacgacccccuucgggcagcagcgggucuucaaggagaagguggacacccgcaccccgcggcccaagcgcggcacggcccagaucauggaggugaccgccaaguggcuguggggcuuccucagccggaacaagaagccccgcaucugcacccgggaggaguucacccgcaagguccggagcaacgcggccgugggggccguguucgucgacgagaaccaguggaacuccgccaaggaggccguggaggacgagcgcuucugggaccuggugcaccgggagcgcgagcugcacaagcagggcaagugcgcgacgugcgucuacaacaugauggggaagcgggagaagaagcucggcgaguucgggaaggccaagggcagccgcgccaucugguacauguggcugggcgcccgguuccuggaguucgaggcgcucggguucaugaacgaggaccacugguucucccgcgagaacagccuguccggcguggagggggagggccugcacaagcucggguacauccugcgcgacaucagcaagaucccgggcggcaacauguacgccgacgacaccgccgggugggacacccggaucaccgaggacgaccugcagaacgaggccaagaucacggacaucauggagcccgagcacgcccuccuggcgaccuccaucuucaagcugaccuaccagaacaaggugguccgcgugcagcggcccgccaagagcggcaccgugauggacgucaucucccgccgggaccagcgcgggagcggccaggugggcacguacgggcucaacaccuucaccaacauggaggugcagcugauccggcagauggaguccgagggcaucuucagccccaacgagcuggagaacuccaaccucgccgagcgcguccuggacuggcuggagaagcacgggguggagcggcucaagcgcauggccaucagcggcgacgacugcguggucaagccgaccgacgaccgguucgccacggcgcugaccgcccugaacgacauggggaaggugcgcaaggacaucccccagugggagcccuccaagggcuggaacgacuggcagcagguccccuucugcagccaccacuuccaccagcucaucaugaaggacggccgggagaucgucgugccgugccgcaaccaggacgagcugguggggcgggcccgcgucucccagggcgccggguggagccugcgggagaccgccugccucggcaagagcuacgcgcagauguggcagcugauguacuuccaccgccgggaccugcgccucgccgccaacgccaucugcuccgccgugcccguggacuggguccccaccagccgcaccacgugguccauccacgcgcaccaccaguggaugaccaccgaggacaugcugagcguguggaaccggguguggaucgaggagaaccccuggauggaggacaagacccacgucuccagcugggaggacgugccguaccuggggaagcgcgaggaccaguggugcggcucccucaucggccugacggcccgggccaccugggccaccaacauccagguggcgaucaaccagguccgccggcugaucgggaacgagaacuaccucgacuacaugaccagcaugaagcgcuucaagaacgaguccgacagcgagggcgcccugugguga

SEQ ID NO: 8917 - RNA, 9879 nt, Artificial Sequence
  derived and/or modified CDS sequence (opt1) from DENV-1__JQ917404__SS-prME
agcgugaccaugcugcucaugcugcugcccaccgcccucgccuuccaccugaccacccggggcggggagccccacaugaucgugagcaagcaggagcggggcaagagccuccuguucaagaccuccgcgggggugaacaugugcacccugaucgccauggaccugggcgagcucugcgaggacacgaugaccuacaagugcccccggaucaccgaggccgagcccgacgacguggacugcuggugcaacgccaccgacaccugggugaccuacgggaccugcagccagaccggcgagcaccggcgcgacaagcgguccguggcccuggcgccccacgugggccuggggcucgagacccgcaccgagaccuggaugagcuccgagggcgccuggcggcagauccagaagguggagaccugggcccugcgccaccccggguucacggugaucgcccuguuccucgcgcacgccaucggcaccagcaucacccagaaggggaucaucuucauccugcugaugcucgugacccccuccauggccaugcggugcgucggcaucggcaaccgcgacuucguggaggggcugagcggcgccacguggguggacgucgugcuggagcacggguccugcgugaccaccauggccaagaacaagcccacccucgacaucgagcugcugaagacggaggucaccaaccccgcggugcuccggaagcugugcaucgaggccaagaucagcaacaccaccacggacucccgcugccccacccagggcgaggccacccugguggaggagcaggacgccaacuucgucugccggcgcaccuucguggaccggggcugggggaacggcugcggccucuucggcaaggggagccugcugacgugcgccaaguucaagugcgugaccaagcucgagggcaagaucguccaguacgagaaccugaaguacuccgugaucgugaccguccacaccggcgaccagcaccagguggggaacgagacgaccgagcacggcaccaucgcgaccaucacgccccaggcccccacgagcgagauccagcugaccgacuacggggcccucacccuggacugcagcccccggaccggccuggacuucaacgagaugguccuccugacgaugaaggagaaguccuggcuggugcacaagcagugguuccucgaccugccgcugcccuggaccuccggggccagcaccagccaggagaccuggaaccggcaggaccuccuggugacguucaagaccgcccacgcgaagaagcaggaggucguggugcugggcucccaggagggcgccaugcacaccgcccucaccggggccacggagauccagaccagcggcaccaccacgaucuucgccgggcaccugaagugccgccugaagauggacaagcucacccugaagggcgucuccuacgugaugugcaccgggagcuucaagcuggagaaggagguggcggagacccagcacggcacgguccugguccaggugaaguacgagggcaccgacgcccccugcaagauccccaucuccacccaggacgagaagggggucacccagaacggccggcucaucacggccaacccgaucgugaccgacaaggagaagcccgugaacaucgagaccgagccgcccuucggggagagcuacaucgucaucggcgccggcgagaaggcgcugaagcuguccugguucaagaaggggagcuccaucggcaagauguucgaggccaccgcccgcggggcccggcgcauggccauccucggcgacacggcgugggacuucgggagcaucggcggcguguucaccuccguggggaagcugguccaccagguguucggcaccgccuacggggugcuguucagcggcgucuccuggaccaugaagaucgggaucggcauccuccugacguggcugggccucaacagccgcuccaccagccuguccaugaccugcaucgccguggggauggugacccuguaccucggcgucauggugcaggccgacagcgggugcgugaucaacuggaagggccgggagcugaagugcggguccggcaucuucgucacgaacgaggugcacaccuggaccgagcaguacaaguuccaggccgacagcccgaagcgccugagcgcggccaucggcaaggccugggaggagggggugugcggcauccgguccgccacccgccucgagaacaucauguggaagcagaucagcaacgagcugaaccacauccugcucgagaacgacaugaaguucaccgucguggugggggacgccaacggcauccugacgcaggggaagaagaugauccggccccagcccauggagcacaaguacuccuggaaguccuggggcaaggcgaagaucaucggcgccgacacccagaacaccaccuucaucaucgacgggcccgacacgccggagugccccgacgaccagcgcgccuggaacaucugggaggucgaggacuacggcuucgggguguucaccaccaacaucuggcugaagcuccgggacuccuacacccagaugugcgaccaccgccugaugagcgccgcgaucaaggacuccaaggccgugcacgccgacaugggcuacuggaucgagagcgagaagaacgagacguggaagcuggcccgggccuccuucaucgaggucaagaccugcaucuggccccgcagccacacccucugguccaacggcgugcuggagagcgagaugaucauccccaagaucuacgggggcccgaucucccagcacaacuaccggcccggguacuucacccagacggcgggccccuggcaccuggggaagcucgagcuggacuucaaccugugcgagggcaccaccguggucguggacgagcacugcggcaaccgcgggccgagccuccggaccacgaccgugaccggcaagaucauccacgaguggugcugccgcuccugcacccugccgccccugcgguuccgcggggaggacggcugcugguacgggauggagauccggcccgucaaggagaaggaggagaaccucgugcgcagcaugguguccgccggcagcggcgaggucgacagcuucucccuggggcugcucugcgugagcaucaugaucgaggaggugaugcggucccgcuggagccgcaagaugcugaugacgggcacccuggccgucuucuuccuccugaucauggggcagcugaccuggaacgaccucauccggcugugcaucauggugggcgccaacguguccgaccgcauggggaugggcaccacguaccuggcccucauggcgaccuucaagaugcggccgauguucgccgucgggcugcuguuccgccggcucaccagccgcgaggugcugcugcucaccaucgggcugucccuggucgccagcguggagcuccccaacucccuggaggagcugggcgacgggcucgccaugggcaucaugaugcugaagcugcucacggacuuccagagccaccagcuguggaccacccugcucucccugaccuucaucaagacgacccugagccucgacuacgccuggaagaccauggcgauggugcuguccaucgucagccuguucccccucugccuguccaccacgagccagaagaccaccuggcugcccgugcuccugggcuccuucgggugcaagccgcugaccauguuccucaucaccgagaacaagaucuggggccgcaagagcuggccccugaacgaggggaucauggccgugggcaucgucuccauccugcucagcagccugcugaagaacgacgugccccucgccgggccccugaucgccggcggcaugcugaucgcgugcuacgugaucuccgggagcuccgccgaccucagccuggagcgcgccgccgaggucuccugggaggaggaggccgagcacagcggcgcgucccacaacauccugguggaggugcaggacgacgggacgaugaagaucaaggacgaggagcgggacgacacccucaccauccugcugaaggccacccuccuggccgucagcggcguguacccgauguccauccccgccacgcuguucgugugguacuucuggcagaagaagaagcagcgcagcgggguccucugggacacccccagcccgcccgagguggagcgggccgugcuggacgacggcaucuaccgcauccugcagcggggccugcucgggcgcagccaggucggcguggggguguuccaggacggcgucuuccacaccauguggcacgugacccgcggggcggugcugauguaccagggcaagcgccuggagcccuccugggccagcgucaagaaggaccucaucuccuacggcgggggcuggcgguuccaggggagcuggaacacgggcgaggagguccaggugaucgccgucgagcccgggaagaaccccaagaacgugcagaccacccccggcaccuucaagacgcccgagggcgaggugggggccaucgcccuggacuucaagcccggcaccuccgggagccccaucgucaaccgcgagggcaagaucgugggccuguacgggaacggcguggucaccaccuccgggacguacgugagcgcgaucgcccaggccaaggccagccaggagggcccgcuccccgagaucgaggacgagguguucaagaagcggaaccugaccaucauggaccugcaccccggguccggcaagacccgccgguaccucccggccaucguccgcgaggcgaucaagcgcaagcugcggacccugauccucgcccccacgcgcgugguggccagcgagauggccgaggcgcugaagggcaugcccauccgguaccagaccaccgccgucaaguccgagcacaccgggaaggagaucguggaccugaugugccacgccacguucaccaugcgccuccugagccccgugcgggucccgaacuacaacaugaucaucauggacgaggcccacuucaccgaccccgccuccaucgcggcccgcggcuacaucagcacccggguggggaugggcgaggccgccgccaucuucaugacggcgacgccgcccggguccguggaggccuucccgcagagcaacgccgucauccaggacgaggagcgcgacauccccgagcgguccuggaacagcggcuacgacuggaucaccgacuuccccggcaagaccgugugguucgugcccuccaucaagagcgggaacgacaucgccaacugccugcgcaagaacggcaagcgggucauccagcucucccgcaagacguucgacaccgaguaccagaagaccaagaacaacgacugggacuacguggugaccacggacaucagcgagaugggggccaacuuccgggcggaccgcgucaucgacccgcggcgcugccugaagcccgugauccugaaggacggccccgagcgggucauccucgccgggcccaugccggugaccgccgccuccgcggcccagcgccggggccgcaucggccgcaaccagaacaaggagggggaccaguacaucuacaugggccagccccugaacaacgacgaggaccacgcccacuggaccgaggccaagaugcugcucgacaacaucaacacccccgaggggaucauccccgcccuguucgagccggagcgggagaaguccgcggccaucgacggcgaguaccgccugcgcggggaggcccgcaagacguucguggagcucaugcggcgcggcgaccugcccgucuggcuguccuacaagguggccagcgagggcuuccaguacuccgaccggcgcuggugcuucgacggggagcggaacaaccaggugcucgaggagaacauggacgucgagaucuggacccgcgagggcgagcggaagaagcugcgcccccgguggcuggacgcccgcaccuacagcgacccccucgcgcugcgggaguucaaggaguucgccgccgggcgccggagcguguccggcgaccugauccucgagaucggcaagcugccgcagcaccugacccuccgcgcccagaacgcccuggacaaccuggugaugcuccacaacagcgagcagggcgggaaggcguaccggcacgccauggaggagcugcccgacaccaucgagacgcugaugcuccuggcccugaucgccguccucaccgggggcgugacccuguucuuccuguccgggaagggccucggcaagaccagcaucgggcugcugugcgugauggcguccagcguccuccuguggauggccuccguggagccccacuggaucgccgccagcaucauccuggaguucuuccucauggugcugcugauccccgagccggaccgccagcggacgccccaggacaaccagcucgccuacgucgugaucggccugcuguucaugauccucaccguggcggccaacgagauggggcugcuggagaccaccaagaaggaccucggcaucgggcacgucguggccgagaaccaccaccacgccacgaugcuggacaucgaccugcaccccgccuccgcguggacccucuacgccguggccaccaccaucaucacgccgaugaugcgccacaccaucgagaacaccaccgccaacaucagccugacggccaucgcgaaccaggccgccauccugaugggccucgacaagggcuggcccaucuccaagauggacaucggggucccccugcuggcccucggcugcuacagccaggugaacccccugacccugaccgccgcggugcucaugcuggucgcccacuacgccaucaucgggccgggccugcaggccaaggcgacccgcgaggcccagaagcggacggccgccgggaucaugaagaaccccaccguggacggcaucguggccaucgaccucgaccccgucguguacgacgcgaaguucgagaagcagcugggccagaucaugcugcucauccugugcaccucccagauccugcucaugcgcaccacgugggcccugugcgagagcaucacccuggccaccgggccccucaccacgcugugggagggcuccccggggcgguucuggaacaccaccaucgccgugagcauggccaacaucuuccgcggcuccuaccuggcgggcgccgggcucgccuucagccugaugaagucccugggcgggggccggcgcgggaccggcgcccagggcgagacgcucggggagaaguggaagcggcagcugaaccagcugagcaagagcgaguucaacaccuacaagcgcuccggcaucauggaggucgaccggagcgaggccaaggaggggcucaagcgcggcgagaccaccaagcacgcggugucccgggggacggccaagcugcgcugguucguggagcggaaccuggucaagcccgagggcaaggugaucgaccugggcugcgggcgcggcggguggagcuacuacugcgccggccucaagaaggugaccgaggucaagggguacaccaagggcggccccgggcacgaggagcccaucccgauggccaccuacggcuggaacaucgugaagcugcacuccgggcgggacguguucuucacgccgcccgagaagugcgacacgcugcucugcgacaucggcgagagcucccccaacccgaccaucgaggaggggcgcacccugcggguccugaagaugguggagcccuggcuccgcggcaaccaguucugcaucaagauccugaaccccuacaugcccagcguggucgagacccuggagcagaugcagcggaagcacggcgggaugcucgugcgcaacccgcugucccgcaacagcacgcacgagauguacuggguguccugcggcaccgggaacaucgucagcgcggugaacaugaccucccggaugcugcucaaccgcuucaccauggcccaccggaagcccacguacgagcgcgacguggaccugggcgccggcacccggcacgucgccguggagcccgagaucgccaaccuggacaucaucgggcagcgcaucgagaacaucaagaacgagcacaagagcaccuggcacuacgacgaggacaaccccuacaagaccugggcguaccacggcuccuacgaggugaagccgagcggguccgccagcuccauggucaacggcgugguccggcuccugacgaagcccugggacgugauccccauggugacccagaucgccaugaccgacaccacgcccuucgggcagcagcgcgucuucaaggagaagguggacacccggaccccgcgccccaagcggggcaccgcccagaucauggaggugacggccaaguggcuguggggcuuccucagccgcaacaagaagccccggaucugcacccgcgaggaguucacccggaagguccgcagcaacgcggccaucggggccguguucguggacgagaaccaguggaacuccgccaaggaggccgucgaggacgagcgguucugggaccuggugcaccgcgagcgggagcugcacaagcagggcaagugcgcgaccugcguguacaacaugauggggaagcgcgagaagaagcucggcgaguucgggaaggccaagggcagccgggccaucugguacauguggcugggcgcccgcuuccuggaguucgaggcgcucggguucaugaacgaggaccacugguucucccgcgagaacagccuguccggcgucgagggggagggccugcacaagcucggguacauccugcgggacaucagcaagaucccgggcggcaacauguacgccgacgacacggccgggugggacacccgcaucaccgaggacgaccugcagaacgaggccaagaucaccgacaucauggagcccgagcacgcccuccuggcgacguccaucuucaagcugaccuaccagaacaagguggugcggguccagcgccccgccaagagcggcaccgugauggacgugaucucccggcgcgaccagcgggggagcggccaggucggcaccuacgggcucaacacguucaccaacauggaggugcagcugauccgccagauggaguccgagggcaucuucagccccuccgagcuggagaacagcaaccucgccgagcgggugcuggacuggcuggagaagcacggggucgagcgccucaagcggauggccaucuccggcgacgacugcguggugaagccgaccgacgaccgcuucgccaccgcgcugacggcccugaacgacauggggaagguccggaaggacaucccccagugggagcccagcaagggcuggaacgacuggcagcagguccccuucugcucccaccacuuccaccagcucaucaugaaggacggccgcgagaucguggucccgugccggaaccaggacgagcugguggggcgcgcccgggugagccagggcgccggguggagccugcgcgagaccgccugccucggcaaguccuacgcgcagauguggcagcugauguacuuccaccggcgcgaccugcgccucgccgccaacgccaucugcagcgccguccccgugaacugggugcccaccucccggaccaccuggagcauccacgcgcaccaccaguggaugacgaccgaggacaugcuguccgucuggaaccgcguguggaucgaggagaaccccuggauggaggacaagacccacgugagcuccugggaggacgucccguaccuggggaagcgggaggaccaguggugcggcagccucaucggccugaccgcccgcgccacgugggccaccaacauccagguggcgaucaaccaggugcggcgccugaucgggaacgagaacuaccucgacuacaugaccuccaugaagcgguucaagaacgagagcgaccccgagggcgcccugugguga

SEQ ID NO: 8918 - RNA, 9879 nt, Artificial Sequence
  derived and/or modified CDS sequence (opt1) from DENV-1__GU370048__SS-prME
agcgugaccaugcugcucaugcugaugcccaccgcccuggccuuccaccucaccacccggggcggggagccccacaugaucgugagcaagcaggagcggggcaagagccugcuguucaagaccagcgccggggugaacaugugcacccucaucgccauggaccugggcgagcugugcgaggacacccucaccuacaagugcccccggaucaccgaggccgagcccgacgacguggacugcuggugcaacgccaccgacacgugggugaccuacgggaccugcagccagaccggcgagcaccggcgcgacaagcgguccguggcccuggcgccccacgugggccuggggcucgagacgcggaccgagaccuggaugagcuccgagggcgccuggaagcagauccagcggguggagaccugggcccugcgccaccccggguucacggugaucgcccuguuccucgcgcacgccaucggcaccagcaucacccagaaggggaucaucuucauccugcugaugcucgugacccccuccauggccaugcggugcgucggcaucggcagccgcgacuucguggaggggcuguccggcgccacguggguggacgucgugcuggagcacgggagcugcgugaccaccauggccaaggacaagcccacccucgacaucgagcugcugaagacggaggucaccaaccccgcggugcuccggaagcugugcaucgaggccaagaucuccaacaccaccacggacagccgcugcccgacccagggcgaggccacccugguggaggagcaggacgccaacuucgucugccggcgcaccuucguggaccggggcugggggaacggcugcgggcuguucggcaaggggucccugaucacgugcgccaaguucaagugcgugaccaagcuggagggcaagaucguccaguacgagaaccucaaguacagcgugaucgugaccguccacaccggcgaccagcaccagguggggaacgaguccacggagcacggcaccaccgcgaccaucacgccccaggcccccacgaccgagauccagcugaccgacuacggggcccugacccucgacugcagcccccgcacgggccugaacuucaacgagaugguccugcucaccaugaaggagaaguccuggcuggugcacaagcagugguuccuggaccucccgcugcccuggaccagcggggccagcaccacgcaggagaccuggaaccggcaggaccugcucgugaccuucaagaccgcccacgcgaagaagcaggaggucguggugcugggcucccaggagggcgccaugcacacggcccugaccggggccaccgagauccagaccagcggcacgaccaccaucuucgccgggcaccucaagugccgccugaagauggacaagcugacccucaagggcauguccuacgucaugugcacggggagcuucaagcuggagaaggagguggcggagacccagcacggcaccgugcugguccagaucaaguacgagggcaccgacgcccccugcaagauccccuucuccacgcaggacgagaagggggugacccagaacggccggcugaucaccgccaacccgaucgugaccgacaaggagaagcccgucaacaucgaggccgagccgcccuucggggagagcuacaucgugaucggcgcgggcgagaaggcccucaagcuguccugguucaagaaggggagcuccaucggcaagauguucgaggccacggcccgcggggcccggcgcauggcgauccugggcgacaccgccugggacuucgggagcaucggcggcguguucaccuccgucgggaagcucgugcaccagaucuucggcaccgccuacggggugcuguucagcggcgucuccuggacgaugaagaucgggaucggcgugcugcucaccuggcugggccugaacagccgcuccaccagccucuccaugaccugcaucgccguggggcuggucacgcuguaccucggcgugauggugcaggccgacagcgggugcgucaucaacuggaagggccgggagcugaagugcggguccggcaucuucgugaccaacgaggugcacaccuggaccgagcaguacaaguuccaggcggacagcccgcgccggcugagcgccgccaucggcaaggccugggaggagggggucugcggcauccgcuccgccacccggcucgagaacaucauguggaagcagaucagcaacgagcugaaccacauccugcucgagaacgacaugaaguucacggugguggucggggacguggcgggcauccuggcccaggggaagaagaugauccgcccccagcccauggagcacaaguacuccuggaaguccuggggcaaggccaagaucaucggcgccgacgugcagaacaccaccuucaucaucgacgggcccaacaccccggagugccccgacgaccagcgggcguggaacaucugggaggucgaggacuacggcuucgggaucuucacgaccaacaucuggcugaagcuccgcgacuccuacacccaggugugcgaccaccggcugaugagcgccgccaucaaggacuccaaggccgugcacgccgacaugggcuacuggaucgagagcgagaagaacgagaccuggaagcuggcgcgcgccuccuucaucgaggucaagacgugcaucuggcccaagagccacacccucugguccaacggcgugcuggagagcgagaugaucauccccaagaucuacgggggcccgaucucccagcacaacuaccggcccggguacuucacccagaccgccggccccuggcaccuggggaagcucgagcuggacuucgaccugugcgagggcacgaccguggucguggacgagcacugcggcaaccgcgggccgagccuccggaccaccacggugaccggcaagaucauccacgaguggugcugccgcuccugcacccugccgccccugcgguuccgcggggaggacggcugcugguacgggauggagauccggcccgucaaggagaaggaggagaaccucgucaagagcaugguguccgccggcagcggcgaggucgacagcuucucccuggggcugcucugcaucagcaucaugaucgaggaggugaugcgcucccgguggagccgcaagaugcugaucaccggcacgcuggccguguucuuccuccugaucauggggcaggucaccuggaacgaccugauccgccucugcaucauggugggcgcgaacgccuccgaccggauggggaugggcaccaccuaccuggcccugauggccacguucaagaugcgcccgauguucgccgugggccuccuguuccggcgccugaccagccgggagguccuccugcugaccaucgggcucucccugguggcgagcgucgagcugcccaacucccucgaggagcugggcgacgggcuggccaugggcaucaugauccucaagcugcugaccgacuuccagccccaccagcucugggccacgcugcugagccucaccuucaucaagaccaccuucucccugcacuacgccuggaagacgauggcgauggugcugagcaucgugucccucuucccccugugccugagcaccaccucccagaagaccacguggcucccgguccugcugggcagccucgggugcaagccccugaccauguuccugaucgccgagaacaagaucuggggccgcaaguccuggccccucaacgaggggaucauggccgugggcaucgugagcauccugcuguccagccuccugaagaacgacgucccccuggccgggccgcucaucgccggcggcaugcugaucgcgugcuacgugaucagcggguccagcgccgaccugucccucgagaaggccgccgaggugagcugggaggaggaggccgagcacuccggcgcgagccacaacauccuggucgaggugcaggacgacgggaccaugaagaucaaggacgaggagcgggacgacacccugaccauccuccugaaggccacgcugcucgccguguccggcgucuacccccugagcauccccgccacccuguucgugugguacuucuggcagaagaagaagcagcgcuccggggugcucugggacacccccagcccgcccgaggucgagcgggccgugcuggacgacggcaucuaccgcaucaugcagcggggccugcuggggcgcucccaggugggcgucgggguguuccaggagaacguguuccacaccauguggcacgucacgcggggcgcggugcucauguaccaggggaagcgccuggagcccagcugggccuccgugaagaaggaccugaucagcuacggcggcggguggcggcuccagggcuccuggaacaccggggaggagguccaggugaucgccguggagcccggcaagaacccgaagaacguccagaccgcccccgggaccuucaagacgcccgagggcgaggugggcgccaucgcgcuggacuucaagcccgggaccagcggcuccccgaucgugaaccgcgaggggaagaucgucggccuguacggcaacgggguggugaccaccagcggcacguacgucuccgccaucgcccaggccaaggcgagccaggaggggccccuccccgagaucgaggacgagguguuccggaagcgcaaccugaccaucauggaccugcacccgggcagcgggaagacccggcgcuaccuccccgccaucgugcgggaggccaucaagcgcaagcugcgcacccugauccucgcccccacgcgggucguggccuccgagauggcggaggcccugaagggcaugcccauccgcuaccagaccaccgccgucaagagcgagcacaccggcaaggagaucgucgaccugaugugccacgccacguucaccaugcggcuccuguccccggugcgcgugcccaacuacaacaugaucaucauggacgaggcccacuucaccgaccccagcuccaucgcggcccggggguacaucagcacccgcgucggcaugggggaggccgccgccaucuucaugacggcgacgccgcccggcuccguggaggccuucccccagagcaacgccgugauccaggacgaggagcgggacauccccgagcgcuccuggaacagcggguacgaguggaucaccgacuuccccggcaagaccgucugguucgugccguccaucaagagcggcaacgacaucgccaacugccugcggaagaacgggaagcgcgugauccagcucucccggaagacguucgacaccgaguaccagaagaccaagaacaacgacugggacuacgucgugaccacggacaucagcgagaugggcgcgaacuuccgcgccgaccgggugaucgacccccgccggugccugaagcccgucauccugaaggacgggcccgagcgcgugauccucgccggcccgaugcccgucaccguggccuccgccgcgcagcggcgcgggcggaucggccgcaaccacaacaaggagggcgaccaguacaucuacauggggcagccccugaacaacgacgaggaccacgcccacuggaccgaggccaagaugcugcucgacaacaucaacacccccgagggcaucaucccggcccuguucgagcccgagcgcgagaaguccgccgcgaucgacggggaguaccggcugcgcggcgaggcccggaagacguucguggagcucaugcgccgcggggaccugcccgucuggcuguccuacaagguggccagcgagggcuuccaguacuccgaccgccgguggugcuucgacggcgagcgcaacaaccaggugcucgaggagaacauggacgucgagaucuggaccaaggagggggagcggaagaagcugcgcccccgguggcuggacgcccgcaccuacagcgacccgcucgcccugcgggaguucaaggaguucgcggccggccgccggagcguguccggggaccugauccucgagaucggcaagcugccccagcaccugacccagcgcgcccagaacgcccucgacaaccuggugaugcugcacaacagcgagcagggcgggcgggcguaccgccacgccauggaggagcuccccgacacgaucgagacccugaugcugcucgcccugaucgccguccugaccggcggggugacccucuucuuccuguccggccgggggcugggcaagaccagcaucggccuccugugcgugauggccuccagcguccugcucuggauggcguccguggagccccacuggaucgccgccagcaucauccuggaguucuuccugauggugcuccugaucccggagcccgaccgccagcggacgccccaggacaaccagcuggccuacgucgugaucgggcuccuguucaugauccugaccguggccgcgaacgagaugggccuccuggagaccaccaagaaggaccuggggaucggccacgucgccguggagaaccaccaccacgccgccaugcucgacguggaccugcacccggccuccgcguggacgcuguacgccgucgccaccaccaucaucacccccaugaugcgccacacgaucgagaacaccaccgccaacaucagccucaccgccaucgcgaaccaggccgccauccugauggggcuggacaagggcuggcccaucuccaagauggacaucggcgugccccuccuggcccuggggugcuacagccaggugaacccgcucacgcugaccgcggccguccugaugcucguggcccacuacgccaucaucggccccgggcugcaggccaaggcgacccgcgaggcccagaagcggaccgccgccggcaucaugaagaaccccacgguggacgggaucgucgccaucgaccuggaccccgugguguacgacgcgaaguucgagaagcagcucggccagaucaugcugcugauccucugcaccucccagauccugcugaugcgcaccaccugggcccucugcgagagcaucacgcuggccaccggcccgcugaccacccucugggaggggucccccggcaaguucuggaacacgaccaucgccgucagcauggccaacaucuuccggggguccuaccuggcgggcgccggccuggccuucagccucaugaagucccucgggggcgggcgccgggggaccggggcccagggcgagacccugggcgagaaguggaagcgccagcucaaccagcugagcaagagcgaguucaacacguacaagcgguccgggaucauggagguggaccgcagcgaggcgaaggagggccugaagcgcggggagaccaccaagcacgccgugucccgcggcaccgccaagcuccggugguucgucgagcgcaaccuggugaagcccgaggggaaggugaucgaccugggcugcggccgcggcggguggagcuacuacugcgccgggcugaagaaggucacggaggugaagggguacaccaagggcggccccggccacgaggagccgauccccauggccaccuacggguggaaccucgugaagcugcacuccggcaaggacgucuucuucaucccgcccgagaagugcgacacccugcucugcgacaucggggagagcuccccgaaccccacgaucgaggagggccgcacccugcgggugcugaagaugguggagcccuggcuccgcgggaaccaguucugcaucaagauccugaaccccuacaugccgagcgucguggagacccuggagcagaugcagcggaagcacggcggcaugcucgugcgcaacccccugucccggaacagcacccacgagauguacugggucuccugcgggaccggcaacaucgugagcgcggugaacaugacgucccgcaugcugcucaaccgcuucaccauggcccaccggaagcccaccuacgagcgcgacgucgaccugggggccggcacccggcacguggccguggagcccgaggucgccaaccuggacaucaucggccagcgcaucgagaacaucaagcacgagcacaagagcacguggcacuacgacgaggacaacccguacaagaccugggcguaccacggguccuacgaggugaagcccagcggcuccgccagcuccauggucaacgggguggugaagcuccugaccaagcccugggacgucauccccauggugacccagaucgccaugacggacaccaccccguucggccagcagcggguguucaaggagaaggucgacacccgcacgcccaaggccaagcgggggaccgcccagaucauggaggugaccgcgcgcuggcuguggggcuuccucagccggaacaagaagccccgcaucugcacccgggaggaguucacgcgcaaggugcggagcaacgccgccaucggcgccgucuucguggacgagaaccaguggaacuccgcgaaggaggccguggaggacgagcgcuucugggaccugguccaccgggagcgcgagcugcacaagcaggggaagugcgcgaccugcguguacaacaugaugggcaagcgggagaagaagcucggggaguucggcaaggccaaggggagccgcgccaucugguacauguggcugggcgcgcgguuccuggaguucgaggcccucggcuucaugaacgaggaccacugguucucccgcgagaacagccuguccgggguggagggcgaggggcugcacaagcucggcuacauccugcgggacaucagcaagauccccgggggcaacauguacgccgacgacaccgccggcugggacacccgcaucacggaggacgaccugcagaacgaggccaagaucaccgacaucauggagcccgagcacgcgcuccuggccaaggccaucuucaagcugaccuaccagaacaaggucgugcgcgugcagcggcccgccaagaacgggaccgucauggacgugaucucccgccgggaccagcgcggcagcggccaggugggcacguacggccucaacaccuucaccaacauggaggcccagcugauccggcagauggaguccgaggggaucuucagccccuccgagcuggagaccccgaaccucgcggagcgcguccuguacuggcuggagaaguacggcguggagcggcucaagcgcauggccaucagcggggacgacugcguggucaagcccaucgacgaccgguucgccacggcccugaccgcccugaacgacaugggcaaggugcgcaaggacaucccccagugggagcccuccaagggguggaacgacuggcagcaggucccguucugcagccaccacuuccaccagcucaucaugaaggacggccgggagaucgucgugcccugccgcaaccaggacgagcuggugggccgggcgcgcgucucccagggggccggcuggagccugcgggagaccgccugccucgggaaguccuacgcccagauguggcagcugauguacuuccaccgccgggaccugcgccucgcggccaacgccaucugcagcgccgugcccguggacuggguccccaccagccggacgaccugguccauccacgcccaccaccaguggaugaccaccgaggacaugcugagcguguggaaccgcguguggaucgaggagaacccguggauggaggacaagacgcacaucuccagcugggaggacguccccuaccugggcaagcgcgaggaccaguggugcgggucccucaucggccugaccgcgcgggccaccugggccaccaacauccagguggccaucaaccaggugcgccggcugaucggcaacgagaacuaccucgacuacaugaccagcaugaagcgcuucaagaacgaguccgaccccgagggggcccugugguga

SEQ ID NO: 8919 - RNA, 9879 nt, Artificial Sequence
  derived and/or modified CDS sequence (opt1) from DENV-1__KM403627__SS-prME
agcgugaccaugcugcucaugcugcugcccaccgcccucgccuuccaccugaccacccggggcggggagccccacaugaucgugagcaagcaggagcggggcaagagccuccuguucaagaccuccgcgggggugaacaugugcacccugaucgccauggaccugggcgagcucugcgaggacacgaugaccuacaagugcccccggaucaccgaggccgagcccgacgacguggacugcuggugcaacgccaccgacaccugggugaccuacgggaccugcagccagaccggcgagcaccggcgcgacaagcgguccguggcccuggcgccccacgugggccuggggcucgagacgcgcaccgagaccuggaugagcuccgagggcgccuggcggcagauccagaagguggagaccugggcccugcgccaccccggguucacggugaucgcccuguuccucgcgcacgccaucggcaccagcaucacccagaaggggaucaucuucauccugcugaugcucgugacccccuccauggccaugcggugcgucggcaucggcaaccgcgacuucguggaggggcugagcggcgccacguggguggacgucgugcuggagcacggguccugcgugaccaccauggccaagaacaagcccacccucgacaucgagcugcugaagacggaggucaccaaccccgcggugcuccggaagcugugcaucgaggccaagaucagcaacaccaccacggacucccgcugccccacccagggcgaggccacccugguggaggagcaggacgccaacuucgucugccggcgcaccuucguggaccggggcugggggaacggcugcggccucuucggcaaggggagccugcugacgugcgccaaguucaagugcgugaccaagcucgagggcaagaucguccaguacgagaaccugaaguacuccgugaucgugaccguccacaccggcgaccagcaccagguggggaacgagacgaccgagcacggcaccaucgcgaccaucacgccccaggcccccacgagcgagauccagcugaccgacuacggggcccucacccuggacugcagcccccggaccggccuggacuucaacgagaugguccuccugacgaugaaggagaaguccuggcuggugcacaagcagugguuccucgaccugccgcugcccuggaccuccggggccagcaccagccaggagaccuggaaccggcaggaccuccuggugacguucaagaccgcccacgcgaagaagcaggaggucguggugcugggcucccaggagggcgccaugcacaccgcccucaccggggccacggagauccagaccagcggcaccaccacgaucuucgccgggcaccugaagugccgccugaagauggacaagcucacccugaagggcgucuccuacgugaugugcaccgggagcuucaagcuggagaaggagguggcggagacccagcacggcacgguccugguccaggugaaguacgagggcaccgacgcccccugcaagauccccaucuccacccaggacgagaagggggucacccagaacggccggcucaucacggccaacccgaucgugaccgacaaggagaagcccgugaacaucgagaccgagccgcccuucggggagagcuacaucgucaucggcgccggcgagaaggcgcugaagcuguccugguucaagaaggggagcuccaucggcaagauguucgaggccaccgcccgcggggcccggcgcauggccauccucggcgacacggcgugggacuucgggagcaucggcggcguguucaccuccguggggaagcugguccaccagguguucggcaccgccuacggggugcuguucagcggcgucuccuggaccaugaagaucgggaucggcauccuccugacguggcugggccucaacagccgcuccaccagccuguccaugaccugcaucgccguggggauggugacccuguaccucggcgucauggugcaggccgacagcgggugcgugaucaacuggaagggccgggagcugaagugcggguccggcaucuucgucacgaacgaggugcacaccuggaccgagcaguacaaguuccaggccgacagcccgaagcgccugagcgcggccaucggcaaggccugggaggagggggugugcggcauccgguccgccacccgccucgagaacaucauguggaagcagaucagcaacgagcugaaccacauccugcucgagaacgacaugaaguucaccgucguggugggggacgccaacggcauccugacgcaggggaagaagaugauccggccccagcccauggagcacaaguacuccuggaaguccuggggcaaggcgaagaucaucggcgccgacauccagaacaccaccuucaucaucgacgggcccgacaccccggagugccccgacgaccagcgcgccuggaacaucugggaggucgaggacuacggcuucgggguguucacgaccaacaucuggcugaagcuccgggacuccuacacccagaugugcgaccaccgccugaugagcgccgcgaucaaggacuccaaggccgugcacgccgacaugggcuacuggaucgagagcgagaagaacgagaccuggaagcuggcccgggccuccuucaucgaggucaagacgugcaucuggccccgcagccacacccucugguccaacggcgugcuggagagcgagaugaucauccccaagaucuacgggggcccgaucucccagcacaacuaccggcccggguacuucacccagaccgcgggccccuggcaccuggggaagcucgagcuggacuucaaccugugcgagggcacgaccguggucguggacgagcacugcggcaaccgcgggccgagccuccggaccaccacggugaccggcaagaucauccacgaguggugcugccgcuccugcacccugccgccccugcgguuccgcggggaggacggcugcugguacgggauggagauccggcccgucaaggagaaggaggagaaccucgugcgcagcaugguguccgccggcagcggcgaggucgacagcuucucccuggggcugcucugcgugagcaucaugaucgaggaggugaugcggucccgcuggagccgcaagaugcugaugaccggcacgcuggccgucuucuuccuccugaucauggggcagcugaccuggaacgaccucauccggcugugcaucauggugggcgccaacguguccgaccgcauggggaugggcaccaccuaccuggcccucauggcgacguucaagaugcggccgauguucgccgucggccugcuguuccgccggcucaccagccgcgaggugcugcugcucaccaucgggcugucccuggucgccagcguggagcuccccaacucccuggaggagcugggcgacgggcucgccaugggcaucaugaugcugaagcugcucaccgacuuccagagccaccagcuguggacgacccugcucucccugaccuucaucaagaccacgcugagccucgacuacgccuggaagaccauggcgauggugcuguccaucgucagccuguucccccucugccuguccaccaccagccagaagacgaccuggcugcccgugcuccugggcuccuucgggugcaagccgcugaccauguuccucaucaccgagaacaagaucuggggccgcaagagcuggccccugaacgaggggaucauggccgugggcaucgucuccauccugcucagcagccugcugaagaacgacgugccccucgccgggccccugaucgccggcggcaugcugaucgcgugcuacgugaucuccgggagcuccgccgaccucagccuggagcgcgccgccgaggucuccugggaggaggaggccgagcacagcggcgcgucccacaacauccugguggaggugcaggacgacgggaccaugaagaucaaggacgaggagcgggacgacacgcucaccauccugcugaaggccacccuccuggccgucagcggcguguacccgauguccauccccgccacccuguucgugugguacuucuggcagaagaagaagcagcgcagcgggguccucugggacacgcccagcccgcccgagguggagcgggccgugcuggacgacggcaucuaccgcauccugcagcggggccugcucgggcgcagccaggucggcguggggguguuccaggacggcgucuuccacaccauguggcacgugacccgcggggccgugcugauguaccagggcaagcgccuggagcccuccugggccagcgucaagaaggaccucaucuccuacggcgggggcuggcgguuccaggggagcuggaacaccggcgaggagguccaggugaucgccgucgagcccgggaagaaccccaagaacgugcagacgacccccggcaccuucaagacccccgagggcgaggugggggccaucgcccuggacuucaagcccggcacguccgggagccccaucgucaaccgcgagggcaagaucgugggccuguacgggaacggcguggucaccaccuccgggaccuacgugagcgcgaucgcccaggccaaggccagccaggagggcccgcuccccgagaucgaggacgagguguucaagaagcggaaccugacgaucauggaccugcaccccggguccggcaagacccgccgguaccucccggccaucguccgcgaggcgaucaagcgcaagcugcggacccugauccucgcccccacccgcgugguggccagcgagauggccgaggcgcugaagggcaugcccauccgguaccagacgaccgccgucaaguccgagcacaccgggaaggagaucguggaccugaugugccacgccaccuucacgaugcgccuccugagccccgugcgggucccgaacuacaacaugaucaucauggacgaggcccacuucaccgaccccgccuccaucgcggcccgcggcuacaucagcacccggguggggaugggcgaggccgccgccaucuucaugaccgcgacgccgcccggguccguggagagcuucccgcaguccaacgccgucauccaggacgaggagcgcgacauccccgagcggagcuggaacuccggcuacgacuggaucaccgacuuccccggcaagaccgugugguucgugcccagcaucaaguccgggaacgacaucgccaacugccugcgcaagaacggcaagcgggucauccagcucagccgcaagaccuucgacacggaguaccagaagaccaagaacaacgacugggacuacguggugaccaccgacaucuccgagaugggggccaacuuccgggccgaccgcgucaucgacccgcggcgcugccugaagcccgugauccugaaggacggccccgagcgggucauccucgcggggcccaugccggugacggccgccagcgccgcgcagcgccggggccgcaucggccgcaaccagaacaaggagggggaccaguacaucuacaugggccagccccugaacaacgacgaggaccacgcccacuggaccgaggccaagaugcugcucgacaacaucaacacccccgaggggaucauccccgcccuguucgagccggagcgggagaaguccgccgcgaucgacggcgaguaccgccugcgcggggaggcccgcaagaccuucguggagcucaugcggcgcggcgaccugcccgucuggcugagcuacaagguggccuccgagggcuuccaguacagcgaccggcgcuggugcuucgacggggagcggaacaaccaggugcucgaggagaacauggacgucgagaucuggacgaaggagggcgagcgcaagaagcugcggccccgcuggcuggacgcccggaccuacagcgacccccucgcccugcgcgaguucaaggaguucgcggccgggcggcgcuccgugagcggcgaccugauccucgagaucggcaagcugccgcagcaccugacccuccgggcccagaacgcccuggacaaccuggugaugcuccacaacuccgagcagggcgggaaggccuaccgccacgcgauggaggagcugcccgacaccaucgagacccugaugcuccuggcccugaucgccguccucaccggcggggugacccuguucuuccugagcgggaaggggcucggcaagaccuccaucgggcugcugugcgugauggccagcuccguccuccuguggauggcgagcguggagccccacuggaucgccgccuccaucauccuggaguucuuccucauggugcugcugauccccgagccggaccggcagcgcacgccccaggacaaccagcucgccuacgucgugaucggccugcuguucaugauccucacgguggccgcgaacgagauggggcugcuggagaccaccaagaaggaccucggcaucgggcacgucguggccgagaaccaccaccacgccaccaugcuggacaucgaccugcaccccgccagcgccuggacgcucuacgcgguggccaccaccaucaucaccccgaugaugcggcacacgaucgagaacaccaccgccaacaucucccugaccgccaucgccaaccaggcggccauccugaugggccucgacaagggcuggcccaucagcaagauggacaucggggucccccugcuggcccucggcugcuacucccaggugaacccccugacgcugaccgccgccgugcucaugcuggucgcgcacuacgccaucaucgggccgggccugcaggccaaggccacccgcgaggcgcagaagcgcaccgccgccgggaucaugaagaaccccacgguggacggcaucguggccaucgaccucgaccccgucguguacgacgccaaguucgagaagcagcugggccagaucaugcugcucauccugugcaccagccagauccugcucaugcggaccaccugggcgcugugcgaguccaucacgcuggccaccgggccccucaccacccugugggagggcagcccggggaaguucuggaacacgaccaucgccguguccauggccaacaucuuccgcggcagcuaccuggccggcgcggggcucgccuucucccugaugaagucccugggcgggggccggcgcgggaccggcgcccagggcgagacccucggggagaaguggaagcggcagcugaaccagcugagcaaguccgaguucaacacguacaagcgcagcggcaucauggaggucgaccgguccgaggccaaggaggggcucaagcgcggcgagaccaccaagcacgccgugagccgggggaccgcgaagcugcgcugguucguggagcggaaccuggucaagcccgagggcaaggugaucgaccugggcugcgggcgcggcgggugguccuacuacugcgccggccucaagaaggugacggaggucaagggguacaccaagggcggccccgggcacgaggagcccaucccgauggccaccuacggcuggaacaucgugaagcugcacagcgggcgggacguguucuucacgccgcccgagaagugcgacacccugcucugcgacaucggcgaguccagccccaacccgacgaucgaggaggggcgcacccugcggguccugaagaugguggagcccuggcuccgcggcaaccaguucugcaucaagauccugaaccccuacaugcccuccguggucgagacccuggagcagaugcagcggaagcacggcgggaugcucgugcgcaacccgcugagccggaacuccacccacgagauguacugggugagcugcggcacggggaacaucgucuccgccgugaacaugaccagccgcaugcugcucaaccgcuucaccauggcgcaccggaagcccaccuacgagcgcgacguggaccugggcgccggcacgcggcacgucgccguggagcccgagaucgccaaccuggacaucaucgggcagcgcaucgagaacaucaagaacgagcacaaguccaccuggcacuacgacgaggacaaccccuacaagaccugggccuaccacggcagcuacgaggugaagccguccgggagcgcguccagcauggucaacggcgugguccggcuccugaccaagcccugggacgugauccccauggugacgcagaucgccaugaccgacaccacccccuucgggcagcagcgcgucuucaaggagaagguggacacgcggaccccgcgccccaagcggggcaccgcccagaucauggaggugaccgccaaguggcuguggggcuuccucagccgcaacaagaagccccggaucugcacgcgcgaggaguucacccggaagguccgcuccaacgccgcgaucggggccguguucguggacgagaaccaguggaacagcgccaaggaggccgucgaggacgagcgguucugggaccuggugcaccgcgagcgggagcugcacaagcagggcaagugcgcgaccugcguguacaacaugauggggaagcgcgagaagaagcucggcgaguucgggaaggcgaagggcucccgggccaucugguacauguggcugggcgcccgcuuccuggaguucgaggcccucggguucaugaacgaggaccacugguucagccgggagaacucccugagcggcgucgagggggagggccugcacaagcucggguacauccugcgcgacaucuccaagaucccgggcggcaacauguacgcggacgacaccgccgggugggacacgcgcaucaccgaggacgaccugcagaacgaggccaagaucaccgacaucauggagcccgagcacgcccuccuggccaccagcaucuucaagcugacguaccagaacaagguggugcggguccagcgccccgcgaaguccggcaccgugauggacgugaucagccggcgcgaccagcggggguccggccaggucggcaccuacgggcucaacaccuucacgaacauggaggugcagcugauccgccagauggagagcgagggcaucuucucccccagcgagcuggagaacuccaaccucgccgagcgggugcuggacuggcuggagaagcacggggucgagcgccucaagcggauggccaucagcggcgacgacugcguggugaagccgaccgacgaccgcuucgccaccgcccugaccgcgcugaacgacauggggaagguccggaaggacaucccccagugggagcccuccaagggcuggaacgacuggcagcagguccccuucugcagccaccacuuccaccagcucaucaugaaggacggccgcgagaucguggucccgugccggaaccaggacgagcugguggggcgcgcccgggugagccagggcgccggguggucccugcgcgagacggccugccucggcaagagcuacgcccagauguggcagcugauguacuuccaccggcgcgaccugcggcucgcggccaacgccaucugcuccgccguccccgugaacugggugcccaccagccgcaccaccugguccauccacgcccaccaccaguggaugaccacggaggacaugcugagcgucuggaaccgcguguggaucgaggagaaccccuggauggaggacaagacccacguguccagcugggaggacgucccguaccuggggaagcgggaggaccaguggugcggcucccucaucggccugaccgcgcgcgccaccugggccacgaacauccagguggccaucaaccaggugcggcgccugaucgggaacgagaacuaccucgacuacaugaccagcaugaagcgguucaagaacgaguccgaccccgagggcgcgcugugguga

SEQ ID NO: 8920 - RNA, 9879 nt, Artificial Sequence
  derived and/or modified CDS sequence (opt1) from DENV-1__KM403584__SS-prME
agcgugaccaugcugcucaugcugcugcccaccgcccucgccuuccaccugaccacccggggcggggagccccacaugaucgugagcaagcaggagcggggcaagagccuccuguucaagaccuccgcgggggugaacaugugcacccugaucgccauggaccugggcgagcucugcgaggacacgaugaccuacaagugcccccggaucaccgaggccgagcccgacgacguggacugcuggugcaacgccaccgacaccugggucaccuacgggaccugcagccagaccggcgagcaccggcgcgacaagcgguccguggcccuggcgccccacgugggccuggggcucgagacccgcaccgagaccuggaugagcuccgagggcgccuggcggcagauccagaaggucgagaccugggcccugcgccaccccggguucacggugaucgcccuguuccucgcgcacgccaucggcaccagcaucacccagaaggggaucaucuucauccugcugaugcucgugacccccuccauggccaugcggugcgucggcaucggcaaccgcgacuucguggaggggcugagcggcgccacguggguggacgucgugcuggagcacggguccugcgugaccaccauggccaagaacaagcccacccucgacaucgagcugcugaagacggaggucaccaaccccgcggugcuccggaagcugugcaucgaggccaagaucagcaacaccaccacggacucccgcugccccacccagggcgaggccacccugguggaggagcaggacgccaacuucgucugccggcgcaccuucguggaccggggcugggggaacggcugcggccucuucggcaaggggagccugcugacgugcgccaaguucaagugcgugaccaagcucgagggcaagaucguccaguacgagaaccugaaguacuccgugaucgugaccguccacaccggcgaccagcaccagguggggaacgagacgaccgagcacggcaccaucgcgaccaucacgccccaggcccccacgagcgagguccagcugaccgacuacggggcccucacccuggacugcagcccccggaccggccuggacuucaacgagauggugcuccugacgaugaaggagaaguccuggcuggugcacaagcagugguuccucgaccugccgcugcccuggaccuccggggccagcaccagccaggagaccuggaaccggcaggaccuccuggucacguucaagaccgcccacgcgaagaagcaggagguggugguccugggcucccaggagggcgccaugcacaccgcccucaccggggccacggagauccagaccagcggcaccaccacgaucuucgccgggcaccugaagugccgccugaagauggacaagcucacccugaagggcguguccuacgugaugugcaccgggagcuucaagcuggagaaggaggucgcggagacccagcacggcacggugcuggugcaggucaaguacgagggcaccgacgcccccugcaagauccccaucuccacccaggacgagaagggggugacccagaacggccggcucaucacggccaacccgaucgugaccgacaaggagaagcccgucaacaucgagaccgagccgcccuucggggagagcuacaucgugaucggcgccggcgagaaggcgcugaagcuguccugguucaagaaggggagcuccaucggcaagauguucgaggccaccgcccgcggggcccggcgcauggccauccucggcgacacggcgugggacuucgggagcaucggcggcguguucaccuccgucgggaagcuggugcaccagguguucggcaccgccuacgggguccuguucagcggcguguccuggaccaugaagaucgggaucggcauccuccugacguggcugggccucaacagccgcuccaccagccuguccaugaccugcaucgccguggggauggucacccuguaccucggcgugauggugcaggccgacagcgggugcgucaucaacuggaagggccgggagcugaagugcggguccggcaucuucgugacgaacgaggugcacaccuggaccgagcaguacaaguuccaggccgacagcccgaagcgccugagcgcggccaucggcaaggccugggaggagggggucugcggcauccgguccgccacccgccucgagaacaucauguggaagcagaucagcaacgagcugaaccacauccugcucgagaacgacaugaaguucaccgugguggucggggacgccuacggcauccugacgcaggggaagaagaugauccggccccagcccauggagcacaaguacuccuggaaguccuggggcaaggcgaagaucaucggcgccgacacccagaacaccaccuucaucaucgacgggcccgacacgccggagugccccgacgaccagcgcgccuggaacaucugggagguggaggacuacggcuucgggguguucaccaccaacaucuggcugaagcuccgggacuccuacacccagaugugcgaccaccgccugaugagcgccgcgaucaaggacuccaaggccguccacgccgacaugggcuacuggaucgagagcgagaagaacgagacguggaagcuggcccgggccuccuucaucgaggugaagaccugcaucuggccccgcagccacacccucugguccaacggcgugcuggagagcgagaugaucauccccaagaucuacgggggcccgaucucccagcacaacuaccggcccggguacuucacccagacggcgggccccuggcaccuggggaagcucgagcuggacuucaaccugugcgagggcaccaccgucgugguggacgagcacugcggcaaccgcgggccgagccuccggaccacgaccgucaccggcaagaucauccacgaguggugcugccgcuccugcacccugccgccccugcgguuccgcggggaggacggcugcugguacgggauggagauccggcccgugaaggagaaggaggagaaccucgugcgcagcauggucuccgccggcagcggcgagguggacagcuucucccuggggcugcucugcgugagcaucaugaucgaggaggucaugcggucccgcuggagccgcaagaugcugaugacgggcacccuggccguguucuuccuccugaucauggggcagcugaccuggaacgaccucauccggcugugcaucauggugggcgccaacgucuccgaccgcauggggaugggcaccacguaccuggcccucauggcgaccuucaagaugcggccgauguucgccguggggcugcuguuccgccggcucaccagccgcgagguccugcugcucaccaucgggcugucccugguggccagcguggagcuccccaacucccuggaggagcugggcgacgggcucgccaugggcaucaugaugcugaagcugcucacggacuuccagagccaccagcuguggaccacccugcucucccugaccuucaucaagacgacccugagccucgacuacgccuggaagaccauggcgaugguccuguccaucgugagccuguucccccucugccuguccaccacgagccagaagaccaccuggcugcccgugcuccugggcuccuucgggugcaagccgcugaccauguuccucaucaccgagaacaagaucuggggccgcaagagcuggccccugaacgaggggaucauggccgucggcaucguguccauccugcucagcagccugcugaagaacgacgugccccucgccgggccccugaucgccggcggcaugcugaucgcgugcuacgucaucuccgggagcuccgccgaccucagccuggagcgcgccgccgagguguccugggaggaggaggccgagcacagcggcgcgucccacaacauccugguggagguccaggacgacgggacgaugaagaucaaggacgaggagcgggacgacacccucaccauccugcugaaggccacccuccuggccgugagcggcguguacccgauguccauccccgccacgcuguucgucugguacuucuggcagaagaagaagcagcgcagcggggugcucugggacacccccagcccgcccgagguggagcgggccguccuggacgacggcaucuaccgcauccugcagcggggccugcucgggcgcagccaggugggcgugggggucuuccaggacggcguguuccacaccauguggcacgugacccgcggggcgguccugauguaccagggcaagcgccuggagcccuccugggccagcgugaagaaggaccucaucuccuacggcgggggcuggcgguuccaggggagcuggaacacgggcgaggaggugcaggucaucgccguggagcccgggaagaaccccaagaacgugcagaccacccccggcaccuucaagacgcccgagggcgaggucggggccaucgcccuggacuucaagcccggcaccuccgggagccccaucgugaaccgcgagggcaagaucgugggccuguacgggaacggcgucgugaccaccuccgggacguacgugagcgcgaucgcccaggccaaggccagccaggagggcccgcuccccgagaucgaggacgaggucuucaagaagcggaaccugaccaucauggaccugcaccccggguccggcaagacccgccgguaccucccggccaucgugcgcgaggcgaucaagcgcaagcugcggacccugauccucgcccccacgcgcguggucgccagcgagauggccgaggcgcugaagggcaugcccauccgguaccagaccaccgccgugaaguccgagcacaccgggaaggagaucguggaccugaugugccacgccacguucaccaugcgccuccugagccccguccgggugccgaacuacaacaugaucaucauggacgaggcccacuucaccgaccccgccuccaucgcggcccgcggcuacaucagcacccggguggggaugggcgaggccgccgccaucuucaugacggcgacgccgcccggguccgucgaggccuucccgcagagcaacgccgugauccaggacgaggagcgcgacauccccgagcgguccuggaacagcggcuacgacuggaucaccgacuuccccggcaagaccgugugguucguccccuccaucaagagcgggaacgacaucgccaacugccugcgcaagaacggcaagcgggugauccagcucucccgcaagacguucgacaccgaguaccagaagaccaagaacaacgacugggacuacguggucaccacggacaucagcgagaugggggccaacuuccgggcggaccgcgugaucgacccgcggcgcugccugaagcccgucauccugaaggacggccccgagcgggugauccucgccgggcccaugccggugaccgccgccuccgcggcccagcgccggggccgcaucggccgcaaccagaacaaggagggggaccaguacaucuacaugggccagccccugaacaacgacgaggaccacgcccacuggaccgaggccaagaugcugcucgacaacaucaacacccccgaggggaucauccccgcccuguucgagccggagcgggagaaguccgcggccaucgacggcgaguaccgccugcgcggggaggcccgcaagacguucgucgagcucaugcggcgcggcgaccugcccguguggcuguccuacaagguggccagcgagggcuuccaguacuccgaccggcgcuggugcuucgacggggagcggaacaaccagguccucgaggagaacauggacguggagaucuggaccaaggagggcgagcgcaagaagcugcggccccgcuggcuggacgcccggaccuacagcgacccccucgcgcugcgcgaguucaaggaguucgccgccgggcggcgcagcguguccggcgaccugauccucgagaucggcaagcugccgcagcaccugacccuccgggcccagaacgcccuggacaaccuggucaugcuccacaacagcgagcagggcgggaaggcguaccgccacgccauggaggagcugcccgacaccaucgagacgcugaugcuccuggcccugaucgccgugcucaccgggggcgugacccuguucuuccuguccgggaagggccucggcaagaccagcaucgggcugcugugcgucauggcguccagcgugcuccuguggauggccuccguggagccccacuggaucgccgccagcaucauccuggaguucuuccucaugguccugcugauccccgagccggaccggcagcgcacgccccaggacaaccagcucgccuacguggugaucggccugcuguucaugauccucaccgucgcggccaacgagauggggcugcuggagaccaccaagaaggaccucggcaucgggcacgugguggccgagaaccaccaccacgccacgaugcuggacaucgaccugcaccccgccuccgcguggacccucuacgccgucgccaccaccaucaucacgccgaugaugcggcacaccaucgagaacaccaccgccaacaucagccugacggccaucgcgaaccaggccgccauccugaugggccucgacaagggcuggcccaucuccaagauggacaucggggugccccugcuggcccucggcugcuacagccaggugaacccccugacccugaccgccgcgguccucaugcugguggcccacuacgccaucaucgggccgggccugcaggccaaggcgacccgcgaggcccagaagcgcacggccgccgggaucaugaagaaccccaccguggacggcaucgucgccaucgaccucgaccccgugguguacgacgcgaaguucgagaagcagcugggccagaucaugcugcucauccugugcaccucccagauccugcucaugcggaccacgugggcccugugcgagagcaucacccuggccaccgggccccucaccacgcugugggagggcuccccggggcgcuucuggaacaccaccaucgccgucagcauggccaacaucuuccggggcuccuaccuggcgggcgccgggcucgccuucagccugaugaagucccugggcgggggccgccgggggaccggcgcccagggcgagacgcucggggagaaguggaagcgccagcugaaccagcugagcaagagcgaguucaacaccuacaagcgguccggcaucauggagguggaccgcagcgaggccaaggaggggaugaagcggggcgagaccaccaagcacgcggugucccgcgggacggccaagcuccggugguucgucgagcgcaaccuggugaagcccgagggcaaggugaucgaccugggcugcgggcggggcggguggagcuacuacugcgccggccugaagaaggucaccgaggugaagggguacaccaagggcggccccgggcacgaggagcccaucccgauggccaccuacggcuggaacaucgugaagcuccacuccgggcgcgacgucuucuucacgccgcccgagaagugcgacacgcugcugugcgacaucggcgagagcucccccaacccgaccaucgaggaggggcggacccuccgcgugcugaagaugguggagcccuggcugcggggcaaccaguucugcaucaagauccucaaccccuacaugcccagcgucguggagacccuggagcagaugcagcgcaagcacggcgggaugcuggugcggaacccgcucucccgcaacagcacgcacgagauguacugggucuccugcggcaccgggaacaucgugagcgcggugaacaugaccucccgcaugcugcugaaccgguucaccauggcccaccgcaagcccacguacgagcgggacgucgaccucggcgccggcacccgccacguggccguggagcccgagaucgccaaccuggacaucaucgggcagcggaucgagaacaucaagaacgagcacaagagcaccuggcacuacgacgaggacaaccccuacaagaccugggcguaccacggcuccuacgaggucaagccgagcggguccgccagcuccauggugaacggcgucgugcgccugcucacgaagcccugggacgugauccccauggucacccagaucgccaugaccgacaccacgcccuucgggcagcagcggguguucaaggagaagguggacacccgcaccccgcggcccaagcgcggcaccgcccagaucauggaggucacggccaaguggcuguggggcuuccugagccggaacaagaagccccgcaucugcacccgggaggaguucacccgcaaggugcggagcaacgcggccaucggggccguguucgucgacgagaaccaguggaacuccgccaaggaggccguggaggacgagcgcuucugggaccucgugcaccgggagcgcgagcugcacaagcagggcaagugcgcgaccugcgucuacaacaugauggggaagcgggagaagaagcugggcgaguucgggaaggccaagggcagccgcgccaucugguacauguggcucggcgcccgguuccuggaguucgaggcgcugggguucaugaacgaggaccacugguucucccgcgagaacagccucuccggcguggagggggagggccugcacaagcugggguacauccuccgcgacaucagcaagaucccgggcggcaacauguacgccgacgacacggccgggugggacacccggaucaccgaggacgaccugcagaacgaggccaagaucaccgacaucauggagcccgagcacgcccugcucgcgacguccaucuucaagcugaccuaccagaacaaggugguccgcgugcagcggcccgccaagagcggcaccgugauggacgucaucucccgccgggaccagcgcgggagcggccaggugggcaccuacgggcugaacacguucaccaacauggaggugcagcucauccggcagauggaguccgagggcaucuucagccccuccgagcuggagaacagcaaccuggccgagcgcguccucgacuggcuggagaagcacgggguggagcggcugaagcgcauggccaucuccggcgacgacugcguggucaagccgaccgacgaccgguucgccaccgcgcucacggcccugaacgacauggggaaggugcgcaaggacaucccccagugggagcccagcaagggcuggaacgacuggcagcagguccccuucugcucccaccacuuccaccagcugaucaugaaggacggccgggagaucgucgugccgugccgcaaccaggacgagcucguggggcgggcccgcgucagccagggcgccggguggagccugcgggagaccgccugccugggcaaguccuacgcgcagauguggcagcucauguacuuccaccgccgggaccugcgccuggccgccaacgccaucugcagcgccgugcccgugaacuggguccccaccucccgcaccaccuggagcauccacgcgcaccaccaguggaugacgaccgaggacaugcucuccguguggaaccggguguggaucgaggagaaccccuggauggaggacaagacccacgucagcuccugggaggacgugccguaccuggggaagcgcgaggaccaguggugcggcagccugaucggccucaccgcccgggccacgugggccaccaacauccagguggcgaucaaccagguccgccggcugaucgggaacgagaacuaccuggacuacaugaccuccaugaagcgcuucaagaacgagagcgaccccgagggcgcccucugguga

SEQ ID NO: 8921 - RNA, 9879 nt, Artificial Sequence
  derived and/or modified CDS sequence (opt1) from DENV-1__KM403633__SS-prME
agcgugaccaugcugcucaugcugcugcccaccgcccucgccuuccaccugaccacccggggcggggagccccacaugaucgugagcaagcaggagcggggcaagagccuccuguucaagaccuccgcgggggugaacaugugcacccugaucgccauggaccugggcgagcucugcgaggacacgaugaccuacaagugcccccgcaucaccgaggccgagcccgacgacguggacugcuggugcaacgccaccgacaccugggugaccuacgggaccugcagccagaccggcgagcaccggcgcgacaagcgguccguggcccuggcgccccacgugggccuggggcucgagacccgcaccgagaccuggaugagcuccgagggcgccuggcggcagauccagaagguggagaccugggcccugcgccaccccggguucacggugaucgcccuguuccucgcgcacgccaucggcaccagcaucacccagaaggggaucaucuucauccugcugaugcucgugacccccuccauggccaugcggugcgucggcaucggcaaccgcgacuucguggaggggcugagcggcgccacguggguggacgucgugcuggagcacggguccugcgugaccaccauggccaagaacaagcccacccucgacaucgagcugcugaagacggaggucaccaaccccgcggugcuccggaagcugugcaucgaggccaagaucagcaacaccaccacggacucccgcugccccacccagggcgaggccacccugguggaggagcaggacgccaacuucgucugccggcgcaccuucguggaccggggcugggggaacggcugcggccucuucggcaaggggagccugcugacgugcgccaaguucaagugcgugaccaagcucgagggcaagaucguccaguacgagaaccugaaguacuccgugaucgugaccguccacaccggcgaccagcaccagguggggaacgagacgaccgagcacggcaccaucgcgaccaucacgccccaggcccccacgagcgagauccagcugaccgacuacggggcccucacccuggacugcagcccccggaccggccuggacuucaacgagaugguccuccugacgaugcgggagaaguccuggcuggugcacaagcagugguuccucgaccugccgcugcccuggaccuccggggccagcaccagccaggagaccuggaaccgccaggaccuccuggugacguucaagaccgcccacgcgaagaagcaggaggucguggugcugggcucccaggagggcgccaugcacaccgcccucaccggggccacggagauccagaccagcggcaccaccacgaucuucgccgggcaccugaagugccggcugaagauggacaagcucacccugaagggcgucuccuacgugaugugcaccgggagcuucaagcuggagaaggagguggcggagacccagcacggcacgguccugguccaggugaaguacgagggcaccgacgcccccugcaagauccccaucuccacccaggacgagaagggggucacccagaacggccgccucaucacggccaacccgaucgugaccgacaaggagaagcccgugaacaucgagaccgagccgcccuucggggagagcuacaucgucaucggcgccggcgagaaggcgcugaagcuguccugguucaagaaggggagcuccaucggcaagauguucgaggccaccgcccgcggggcccgccgcauggccauccucggcgacacggcgugggacuucgggagcaucggcggcguguucaccuccguggggaagcugguccaccagguguucggcaccgccuacggggugcuguucagcggcgucuccuggaccaugaagaucgggaucggcauccuccugacguggcugggccucaacagccgguccaccagccuguccaugaccugcaucgccguggggauggugacccuguaccucggcgucauggugcaggccgacagcgggugcgugaucaacuggaagggccgcgagcugaagugcggguccggcaucuucgucacgaacgaggugcacaccuggaccgagcaguacaaguuccaggccgacagcccgaagcggcugagcgcggccaucggcaaggccugggaggagggggugugcggcauccgcuccgccacccggcucgagaacaucauguggaagcagaucagcaacgagcugaaccacauccugcucgagaacgacaugaaguucaccgucguggugggggacgccaacggcauccugacgcaggggaagaagaugauccgcccccagcccauggagcacaaguacuccuggaaguccuggggcaaggcgaagaucaucggcgccgacacccagaacaccaccuucaucaucgacgggcccgacacgccggagugccccgacgaccagcgggccuggaacaucugggaggucgaggacuacggcuucgggguguucaccaccaacaucuggcugaagcuccgcgacuccuacacccagaugugcgaccaccggcugaugagcgccgcgaucaaggacuccaaggccgugcacgccgacaugggcuacuggaucgagagcgagaagaacgagacguggaagcuggcccgcgccuccuucaucgaggucaagaccugcaucuggccccggagccacacccucugguccaacggcgugcuggagagcgagaugaucauccccaagaucuacgggggcccgaucucccagcacaacuaccgccccggguacuucacccagacggcgggccccuggcaccuggggaagcucgagcuggacuucaaccugugcgagggcaccaccguggucguggacgagcacugcggcaaccgggggccgagccuccgcaccacgaccgugaccggcaagaucauccacgaguggugcugccgguccugcacccugccgccccugcgcuuccgcggggaggacggcugcugguacgggauggagauccgccccgucaaggagaaggaggagaaccucgugcggagcaugguguccgccggcagcggcgaggucgacagcuucucccuggggcugcucugcgugagcaucaugaucgaggaggugaugcgcucccgcuggagccggaagaugcugaugacgggcacccuggccgucuucuuccuccugaucauggggcagcugaccuggaacgaccucauccgccugugcaucauggugggcgccaacguguccgaccggauggggaugggcaccacguaccuggcccucauggcgaccuucaagaugcgcccgauguucgccgucgggcugcuguuccggcgccucaccagccgggaggugcugcugcucaccaucgggcugucccuggucgccagcguggagcuccccaacucccuggaggagcugggcgacgggcucgccaugggcaucaugaugcugaagcugcucacggacuuccagagccaccagcuguggaccacccugcucucccugaccuucaucaagacgacccugagccucgacuacgccuggaagaccauggcgauggugcuguccaucgucagccuguucccccucugccuguccaccacgagccagaagaccaccuggcugcccgugcuccugggcuccuucgggugcaagccgcugaccauguuccucaucaccgagaacaagaucuggggccgcaagagcuggccccugaacgaggggaucauggccgugggcaucgucuccauccugcucagcagccugcugaagaacgacgugccccucgccgggccccugaucgccggcggcaugcugaucgcgugcuacgugaucuccgggagcuccgccgaccucagccuggagcgggccgccgaggucuccugggaggaggaggccgagcacagcggcgcgucccacaacauccugguggaggugcaggacgacgggacgaugaagaucaaggacgaggagcgcgacgacacccucaccauccugcugaaggccacccuccuggccgucagcggcguguacccgauguccauccccgccacgcuguucgugugguacuucuggcagaagaagaagcagcggagcgggguccucugggacacccccagcccgcccgagguggagcgcgccgugcuggacgacggcaucuaccggauccugcagcgcggccugcucgggcggagccaggucggcguggggguguuccaggacggcgucuuccacaccauguggcacgugacccgcggggcggugcugauguaccagggcaagcggcuggagcccuccugggccagcgucaagaaggaccucaucuccuacggcgggggcuggcgcuuccaggggagcuggaacacgggcgaggagguccaggugaucgccgucgagcccgggaagaaccccaagaacgugcagaccacccccggcaccuucaagacgcccgagggcgaggugggggccaucgcccuggacuucaagcccggcaccuccgggagccccaucgucaaccgggagggcaagaucgugggccuguacgggaacggcguggucaccaccuccgggacguacgugagcgcgaucgcccaggccaaggccagccaggagggcccgcuccccgagaucgaggacgagguguucaagaagcgcaaccugaccaucauggaccugcaccccggguccggcaagacccggcgcuaccucccggccaucguccgcgaggcgaucaagcggaagcugcgcacccugauccucgcccccacgcgggugguggccagcgagauggccgaggcgcugaagggcaugcccauccgcuaccagaccaccgccgucaaguccgagcacaccgggaaggagaucguggaccugaugugccacgccacguucaccaugcggcuccugagccccgugcgcgucccgaacuacaacaugaucaucauggacgaggcccacuucaccgaccccgccuccaucgcggcccggggcuacaucagcacccgcguggggaugggcgaggccgccgccaucuucaugacggcgacgccgcccggguccguggaggccuucccgcagagcaacgccgucauccaggacgaggagcgggacauccccgagcgcuccuggaacagcggcuacgacuggaucaccgacuuccccggcaagaccgugugguucgugcccuccaucaagagcgggaacgacaucgccaacugccugcggaagaacggcaagcgcgucauccagcucucccggaagacguucgacaccgaguaccagaagaccaagaacaacgacugggacuacguggugaccacggacaucagcgagaugggggccaacuuccgcgcggaccgggucaucgacccgcgccggugccugaagcccgugauccugaaggacggccccgagcgcgucauccucgccgggcccaugccggugaccgccgccuccgcggcccagcggcgcggccgcaucggccggaaccagaacaaggagggggaccaguacaucuacaugggccagccccugaacaacgacgaggaccacgcccacuggaccgaggccaagaugcugcucgacaacaucaacacccccgaggggaucauccccgcccuguucgagccggagcgcgagaaguccgcggccaucgacggcgaguaccggcugcgcggggaggcccggaagacguucguggagcucaugcgccggggcgaccugcccgucuggcuguccuacaagguggccagcgagggcuuccaguacuccgaccgccgguggugcuucgacggggagcgcaacaaccaggugcucgaggagaacauggacgucgagaucuggaccaaggagggcgagcggaagaagcugcgcccccgguggcuggacgcccgcaccuacagcgacccccucgcgcugcgggaguucaaggaguucgccgccgggcgccggagcguguccggcgaccugauccucgagaucggcaagcugccgcagcaccugacccuccgcgcccagaacgcccuggacaaccuggugaugcuccacaacagcgagcagggcgggaaggcguaccggcacgccauggaggagcugcccgacaccaucgagacgcugaugcuccuggcccugaucgccguccucaccgggggcgugacccuguucuuccuguccgggaagggccucggcaagaccagcaucgggcugcugugcgugauggcguccagcguccuccuguggauggccuccguggagccccacuggaucgccgccagcaucauccuggaguucuuccucauggugcugcugauccccgagccggaccgccagcggacgccccaggacaaccagcucgccuacgucgugaucggccugcuguucaugauccucaccguggcggccaacgagauggggcugcuggagaccaccaagaaggaccucggcaucgggcacgucguggccgagaaccaccaccacgccacgaugcuggacaucgaccugcaccccgccuccgcguggacccucuacgccguggccaccaccaucaucacgccgaugaugcgccacaccaucgagaacaccaccgccaacaucagccugacggccaucgcgaaccaggccgccauccugaugggccucgacaagggcuggcccaucuccaagauggacaucggggucccccugcuggcccucggcugcuacagccaggugaacccccugacccugaccgccgcggugcucaugcuggucgcccacuacgccaucaucgggccgggccugcaggccaaggcgacccgcgaggcccagaagcggacggccgccgggaucaugaagaaccccaccguggacggcaucguggccaucgaccucgaccccgucguguacgacgcgaaguucgagaagcagcugggccagaucaugcugcucauccugugcaccucccagauccugcucaugcgcaccacgugggcccugugcgagagcaucacccuggccaccgggccccucaccacgcugugggagggcuccccggggaaguucuggaacaccaccaucgccgugagcauggccaacaucuuccggggcuccuaccuggcgggcgccgggcucgccuucagccugaugaagucccugggcgggggccgccgggggaccggcgcccagggcgagacgcucggggagaaguggaagcgccagcugaaccagcugagcaagagcgaguucaacaccuacaagcgguccggcaucauggaggucgaccgcagcgaggccaaggaggggcucaagcggggcgagaccaccaagcacgcggugucccgcgggacggccaagcugcggugguucguggagcgcaaccuggucaagcccgagggcaaggugaucgaccugggcugcgggcggggcggguggagcuacuacugcgccggccucaagaaggugaccgaggucaagggguacaccaagggcggccccgggcacgaggagcccaucccgauggccaccuacggcuggaacaucgugaagcugcacuccgggcgcgacguguucuucacgccgcccgagaagugcgacacgcugcucugcgacaucggcgagagcucccccaacccgaccaucgaggaggggcggacccugcgcguccugaagaugguggagcccuggcuccggggcaaccaguucugcaucaagauccugaaccccuacaugcccagcguggucgagacccuggagcagaugcagcgcaagcacggcgggaugcucgugcggaacccgcugucccgcaacagcacgcacgagauguacuggguguccugcggcaccgggaacaucgucagcgcggugaacaugaccucccgcaugcugcucaaccgguucaccauggcccaccgcaagcccacguacgagcgggacguggaccugggcgccggcacccgccacgucgccguggagcccgagaucgccaaccuggacaucaucgggcagcggaucgagaacaucaagaacgagcacaagagcaccuggcacuacgacgaggacaaccccuacaagaccugggcguaccacggcuccuacgaggugaagccgagcggguccgccagcuccauggucaacggcgugguccgccuccugacgaagcccugggacgugauccccauggugacccagaucgccaugaccgacaccacgcccuucgggcagcagcgggucuucaaggagaagguggacacccgcaccccgcggcccaagcgcggcaccgcccagaucauggaggugacggccaaguggcuguggggcuuccucagccggaacaagaagccccgcaucugcacccgggaggaguucacccgcaagguccggagcaacgcggccaucggggccguguucguggacgagaaccaguggaacuccgccaaggaggccgucgaggacgagcgcuucugggaccuggugcaccgggagcgcgagcugcacaagcagggcaagugcgcgaccugcguguacaacaugauggggaagcgggagaagaagcucggcgaguucgggaaggccaagggcagccgcgccaucugguacauguggcugggcgcccgguuccuggaguucgaggcgcucggguucaugaacgaggaccacugguucucccgcgagaacagccuguccggcgucgagggggagggccugcacaagcucggguacauccugcgcgacaucagcaagaucccgggcggcaacauguacgccgacgacacggccgggugggacacccggaucaccgaggacgaccugcagaacgaggccaagaucaccgacaucauggagcccgagcacgcccuccuggcgacguccaucuucaagcugaccuaccagaacaagguggugcgcguccagcggcccgccaagagcggcaccgugauggacgugaucucccgccgggaccagcgcgggagcggccaggucggcaccuacgggcucaacacguucaccaacauggaggugcagcugauccggcagauggaguccgagggcaucuucagccccuccgagcuggagaacagcaaccucgccgagcgcgugcuggacuggcuggagaagcacggggucgagcggcucaagcgcauggccaucuccggcgacgacugcguggugaagccgaccgacgaccgguucgccaccgcgcugacggcccugaacgacauggggaagguccgcaaggacaucccccagugggagcccagcaagggcuggaacgacuggcagcagguccccuucugcucccaccacuuccaccagcucaucaugaaggacggccgggagaucguggucccgugccgcaaccaggacgagcugguggggcgggcccgcgugagccagggcgccggguggagccugcgggagaccgccugccucggcaaguccuacgcgcagauguggcagcugauguacuuccaccgccgggaccugcgccucgccgccaacgccaucugcagcgccguccccgugaacugggugcccaccucccgcaccaccuggagcauccacgcgcaccaccaguggaugacgaccgaggacaugcuguccgucuggaaccggguguggaucgaggagaaccccuggauggaggacaagacccacgugagcuccugggaggacgucccguaccuggggaagcgcgaggaccaguggugcggcagccucaucggccugaccgcccgggccacgugggccaccaacauccagguggcgaucaaccaggugcgccggcugaucgggaacgagaacuaccucgacuacaugaccuccaugaagcgcuucaagaacgagagcgaccccgagggcgcccugugguga

SEQ ID NO: 8922 - RNA, 9879 nt, Artificial Sequence
  derived and/or modified CDS sequence (opt1) from DENV-1__KM403592__SS-prME
agcgugaccaugcugcucaugcugcugcccaccgcccucgccuuccaccugaccacccggggcggggagccccacaugaucgugagcaagcaggagcggggcaagagccuccuguucaagaccuccgccggggugaacaugugcacccugaucgccauggaccugggcgagcucugcgaggacaccaugaccuacaagugcccccggaucaccgaggccgagcccgacgacguggacugcuggugcaacgccaccgacaccugggugaccuacgggaccugcagccagaccggcgagcaccggcgcgacaagcgguccguggcccuggcgccccacgugggccuggggcucgagacgcgcaccgagaccuggaugagcuccgagggcgccuggcggcagauccagaaggucgagaccugggcccugcgccaccccggguucaccgugaucgcccuguuccucgcgcacgccaucggcaccagcaucacccagaaggggaucaucuucauccugcugaugcucgugacccccuccauggccaugcggugcgucggcaucggcaaccgcgacuucguggaggggcugagcggcgccacguggguggacgucgugcuggagcacggguccugcgugaccaccauggccaagaacaagcccacccucgacaucgagcugcugaagacggaggucaccaaccccgcggugcuccggaagcugugcaucgaggccaagaucagcaacaccaccacggacucccgcugccccacccagggcgaggccacccugguggaggagcaggacgccaacuucgucugccggcgcaccuucguggaccggggcugggggaacggcugcggccucuucggcaaggggagccugcugacgugcgccaaguucaagugcgugaccaagcucgagggcaagaucguccaguacgagaaccugaaguacuccgugaucgugaccguccacaccggcgaccagcaccagguggggaacgagacgaccgagcacggcaccaucgcgaccaucacgccccaggcccccacgagcgagauccagcugaccgacuacggggcccucacccuggacugcagcccccggaccggccuggacuucaacgagaugguccuccugacgaugaaggagaaguccuggcuggugcacaagcagugguuccucgaccugccgcugcccuggaccuccggggccagcaccagccaggagaccuggaaccggcaggaccuccuggugacguucaagaccgcccacgcgaagaagcaggaggucguggugcugggcucccaggagggcgccaugcacaccgcccucaccggggccacggagauccagaccagcggcaccaccacgaucuucgccgggcaccugaagugccgccugaagauggacaagcucacccugaagggcgucuccuacgugaugugcaccgggagcuucaagcuggagaaggagguggcggagacccagcacggcacgguccugguccaggugaaguacgagggcaccgacgcccccugcaagauccccaucuccacccaggacgagaagggggucgcccagaacggccggcucaucaccgccaacccgaucgugacggacaaggagaagcccgugaacaucgagaccgagccgcccuucggggagagcuacaucgucaucggcgcgggcgagaaggcccugaagcuguccugguucaagaaggggagcuccaucggcaagauguucgaggccaccgcccgcggggcccggcgcauggcgauccucggcgacaccgccugggacuucgggagcaucggcggcguguucacguccguggggaagcugguccaccagguguucggcaccgccuacggggugcuguucagcggcgucuccuggaccaugaagaucgggaucggcauccuccugaccuggcugggccucaacagccgcuccacgagccuguccaugaccugcaucgccguggggauggugacccuguaccucggcgucauggugcaggccgacagcgggugcgugaucaacuggaagggccgggagcugaagugcggguccggcaucuucgucaccaacgaggugcacacguggaccgagcaguacaaguuccaggcggacagcccgaagcgccugagcgccgccaucggcaaggccugggaggagggggugugcggcauccgguccgccacccgccucgagaacaucauguggaagcagaucagcaacgagcugaaccacauccugcucgagaacgacaugaaguucaccgucguggugggggacgcgaacggcauccugacccaggggaagaagaugauccggccccagcccauggagcacaaguacuccuggaaguccuggggcaaggccaagaucaucggcgccgacacgcagaacaccaccuucaucaucgacgggcccgacaccccggagugccccgacgaccagcgcgccuggaacaucugggaggucgaggacuacggcuucgggguguucacgaccaacaucuggcugaagcuccgggacuccuacacccagaugugcgaccaccgccugaugagcgcggccaucaaggacuccaaggccgugcacgccgacaugggcuacuggaucgagagcgagaagaacgagaccuggaagcuggcccgggcguccuucaucgaggucaagacgugcaucuggccccgcagccacacccucugguccaacggcgugcuggagagcgagaugaucauccccaagaucuacgggggcccgaucucccagcacaacuaccggcccggguacuucacccagaccgccggccccuggcaccuggggaagcucgagcuggacuucaaccugugcgagggcacgaccguggucguggacgagcacugcggcaaccgcgggccgagccuccggaccaccacggugaccggcaagaucauccacgaguggugcugccgcuccugcacccugccgccccugcgguuccgcggggaggacggcugcugguacgggauggagauccggcccgucaaggagaaggaggagaaccucgugcgcagcaugguguccgccggcagcggcgaggucgacagcuucucccuggggcugcucugcgugagcaucaugaucgaggaggugaugcggucccgcuggagccgcaagaugcugaugaccggcacgcuggccgucuucuuccuccugaucauggggcagcugaccuggaacgaccucgugcggcugugcaucauggugggcgccaacgucuccgaccgcauggggaugggcaccaccuaccuggcgcucauggccacguucaagaugcggccgauguucgccguggggcugcuguuccgccggcucaccagccgcgagguccugcugcucaccaucgggcugucccugguggccagcguggagcuccccaacucccuggaggagcugggcgacgggcucgccaugggcaucaugaugcugaagcugcucaccgacuuccagagccaccagcuguggacgacccugcucucccugaccuucaucaagaccacgcugagccucgacuacgcguggaagaccauggccaugguccuguccaucgugagccuguucccccucugccuguccaccaccagccagaagacgaccuggcugcccgugcuccugggcuccuucgggugcaagccgcugaccauguuccucaucaccgagaacaagaucuggggccgcaagagcuggccccugaacgaggggaucauggccgucggcaucguguccauccugcucagcagccugcugaagaacgacgugccccucgccgggccccugaucgcgggcggcaugcugaucgccugcuacgucaucuccgggagcuccgccgaccucagccuggagcgcgccgccgagguguccugggaggaggaggcggagcacagcggcgccucccacaacauccugguggagguccaggacgacgggaccaugaagaucaaggacgaggagcgggacgacacgcucaccauccugcugaaggccacccuccuggccgugagcggcguguacccgauguccauccccgccacccuguucgucugguacuucuggcagaagaagaagcagcgcagcggggugcucugggacacgcccagcccgcccgagguggagcgggcgguccuggacgacggcaucuaccgcauccugcagcggggccugcucgggcgcagccaggugggcgugggggucuuccaggacggcguguuccacaccauguggcacgugacccgcggggccguccugauguaccagggcaagcgccuggagcccuccugggccagcgugaagaaggaccucaucuccuacggcgggggcuggcgguuccaggggagcuggaacaccggcgaggaggugcaggucaucgccguggagcccgggaagaaccccaagaacgugcagacgaugcccggcaccuucaagacccccgagggcgaggucggggccaucgcgcuggacuucaagcccggcaccuccgggagccccaucgugaaccgcgagggcaagaucgugggccuguacgggaacggcgucgugacgaccuccgggaccuacgugagcgccaucgcccaggccaaggccagccaggagggcccgcuccccgagaucgaggacgaggucuucaagaagcggaaccugaccaucauggaccugcaccccggguccggcaagacgcgccgguaccucccggcgaucgugcgcgaggccaucaagcgcaagcugcggacccugauccucgcccccacccgcguggucgccagcgagauggcggaggcccugaagggcaugcccauccgguaccagaccacggccgugaaguccgagcacaccgggaaggagaucguggaccugaugugccacgccaccuucaccaugcgccuccugagccccguccgggugccgaacuacaacaugaucaucauggacgaggcccacuucacggaccccgcguccaucgccgcccgcggcuacaucagcacccggguggggaugggcgaggccgccgcgaucuucaugaccgccacgccgcccggguccgucgaggccuucccgcagagcaacgccgugauccaggacgaggagcgcgacauccccgagcgguccuggaacagcggcuacgacuggaucacggacuuccccggcaagaccgugugguucguccccuccaucaagagcgggaacgacaucgccaacugccugcgcaagaacggcaagcgggugauccagcucucccgcaagaccuucgacaccgaguaccagaagacgaagaacaacgacugggacuacguggucaccaccgacaucagcgagaugggggcgaacuuccgggccgaccgcgugaucgacccgcggcgcugccugaagcccgucauccugaaggacggccccgagcgggugauccucgccgggcccaugccggugaccgccgcguccgccgcccagcgccggggccgcaucggccgcaaccagaacaaggagggggaccaguacaucuacaugggccagccccugaacaacgacgaggaccacgcccacuggacggaggccaagaugcugcucgacaacaucaacacccccgaggggaucauccccgcgcuguucgagccggagcgggagaaguccgccgccaucgacggcgaguaccgccugcgcggggaggcccgcaagaccuucgucgagcucaugcggcgcggcgaccugcccguguggcuguccuacaagguggccagcgagggcuuccaguacuccgaccggcgcuggugcuucgacggggagcggaacaaccagguccucgaggagaacauggacguggagaucuggaccaaggagggcgagcgcaagaagcugcggccccgcuggcuggacgcgcggacguacagcgacccccucgcccugcgcgaguucaaggaguucgccgccgggcggcgcagcguguccggcgaccugauccucgagaucggcaagcugccgcagcaccugacccuccgggcccagaacgcgcuggacaaccuggucaugcuccacaacagcgagcagggcgggaaggccuaccgccacgccauggaggagcugcccgacaccaucgagacccugaugcuccuggcccugaucgcggugcucaccgggggcgugacgcuguucuuccuguccgggaagggccucggcaagaccagcaucgggcugcugugcgucauggccuccagcgugcuccuguggauggccuccguggagccccacuggaucgccgccagcaucauccuggaguucuuccucaugguccugcugauccccgagccggaccggcagcgcacgccccaggacaaccagcucgcguacguggugaucggccugcuguucaugauccucaccgucgccgccaacgagauggggcugcuggagacgaccaagaaggaccucggcaucgggcacgugguggccgagaaccaccaccacgccaccaugcuggacaucgaccugcaccccgcguccgccuggacccucuacgccgucgccacgaccaucaucaccccgaugaugcggcacaccaucgagaacacgaccgccaacaucagccugaccgcgaucgccaaccaggccgccauccugaugggccucgacaagggcuggcccaucuccaagauggacaucggggugccccugcuggcccucggcugcuacagccaggugaacccccugacccugacggcggccguccucaugcugguggcccacuacgccaucaucgggccgggccugcaggcgaaggccacccgcgaggcccagaagcgcaccgccgccgggaucaugaagaaccccaccguggacggcaucgucgcgaucgaccucgaccccgugguguacgacgccaaguucgagaagcagcugggccagaucaugcugcucauccugugcacgucccagauccugcucaugcggaccaccugggcccugugcgagagcaucacccuggccacggggccccucaccacccugugggagggcuccccggggaaguucuggaacaccacgaucgccgucagcauggcgaacaucuuccgcggcuccuaccuggccggcgccgggcucgccuucagccugaugaagucccugggcgggggccggcgcgggaccggcgcccagggcgagacccucggggagaaguggaagcggcagcugaaccagcugagcaagagcgaguucaacaccuacaagcgcuccggcaucauggagguggaccggagcgaggcgaaggaggggcucaagcgcggcgagacgaccaagcacgccgugucccgggggaccgccaagcugcgcugguucgucgagcggaaccuggugaagcccgagggcaaggugaucgaccugggcugcgggcgcggcggguggagcuacuacugcgccggccucaagaaggucaccgaggugaagggguacacgaagggcggccccgggcacgaggagcccaucccgauggcgaccuacggcuggaacaucgugaagcugcacuccgggcgggacgucuucuucacgccgcccgagaagugcgacacccugcucugcgacaucggcgagagcucccccaacccgaccaucgaggaggggcgcacgcugcgggugcugaagaugguggagcccuggcuccgcggcaaccaguucugcaucaagauccugaaccccuacaugcccagcgucguggagacccuggagcagaugcagcggaagcacggcgggaugcucgugcgcaacccgcugucccggaacagcacccacgagauguacugggucuccugcggcaccgggaacaucgugagcgccgugaacaugacgucccgcaugcugcucaaccgcuucaccauggcccaccggaagcccaccuacgagcgcgacgucgaccugggcgccggcacccggcacguggccguggagcccgagaucgcgaaccuggacaucaucgggcagcgcaucgagaacaucaagaacgagcacaagagcacguggcacuacgacgaggacaaccccuacaagaccugggccuaccacggcuccuacgaggucaagccgagcggguccgccagcuccauggugaacggcgucgugcggcuccugaccaagcccugggacgugauccccauggucacccagaucgccaugacggacaccacccccuucgggcagcagcgcguguucaaggagaagguggacacccggacgccgcgccccaagcggggcaccgcccagaucauggaggucaccgcgaaguggcuguggggcuuccucagccgcaacaagaagccccggaucugcacccgcgaggaguucacgcggaaggugcgcagcaacgccgccaucggggccguguucgucgacgagaaccaguggaacuccgccaaggaggcgguggaggacgagcgguucugggaccuggugcaccgcgagcgggagcugcacaagcagggcaagugcgcgaccugcgucuacaacaugauggggaagcgcgagaagaagcucggcgaguucgggaaggccaagggcagccgggccaucugguacauguggcugggcgcgcgcuuccuggaguucgaggcccucggguucaugaacgaggaccacugguucucccgggagaacagccuguccggcguggagggggagggccugcacaagcucggguacauccugcgcgacaucagcaagaucccgggcggcaacauguacgccgacgacaccgccgggugggacacccgcaucacggaggacgaccugcagaacgaggccaagaucaccgacaucauggagcccgagcacgcgcuccuggccaccuccaucuucaagcugaccuaccagaacaaggugguccgggugcagcgccccgccaagagcggcacggugauggacgucaucucccggcgcgaccagcgggggagcggccaggugggcaccuacgggcucaacaccuucaccaacauggaggugcagcugauccgccagauggaguccgagggcaucuucagccccuccgagcuggagaacagcaaccucgccgagcggguccuggacuggcuggagaagcacgggguggagcgccucaagcggauggccaucuccggcgacgacugcguggucaagccgacggacgaccgcuucgcgaccgcccugaccgcccugaacgacauggggaaggugcggaaggacaucccccagugggagcccagcaagggcuggaacgacuggcagcagguccccuucugcucccaccacuuccaccagcucaucaugaaggacggccgcgagaucgucgugccgugccggaaccaggacgagcugguggggcgcgcccgggucagccagggcgccggguggagccugcgcgagaccgcgugccucggcaaguccuacgcccagauguggcagcugauguacuuccaccggcgcgaccugcggcucgccgccaacgccaucugcagcgcggugcccgugaacuggguccccacgucccgcaccaccuggagcauccacgcccaccaccaguggaugaccaccgaggacaugcuguccguguggaaccgcguguggaucgaggagaaccccuggauggaggacaagacgcacgucagcuccugggaggacgugccguaccuggggaagcgggaggaccaguggugcggcagccucaucggccugaccgcccgcgccaccugggcgaccaacauccagguggccaucaaccagguccggcgccugaucgggaacgagaacuaccucgacuacaugacguccaugaagcgguucaagaacgagagcgaccccgagggcgcccugugguga

SEQ ID NO: 8923 - RNA, 9879 nt, Artificial Sequence
  derived and/or modified CDS sequence (opt1) from DENV-1__KM403593__SS-prME
agcgugaccaugcugcucaugcugcugcccaccgcccucgccuuccaccugaccacccggggcggggagccccacaugaucgugagcaagcaggagcggggcaagagccuccuguucaagaccuccgccggggugaacaugugcacccugaucgccauggaccugggcgagcucugcgaggacacgaugaccuacaagugcccccggaucaccgaggccgagcccgacgacguggacugcuggugcaacgccaccgacaccugggugaccuacgggaccugcagccagaccggcgagcaccggcgcgacaagcgguccguggcccuggcgccccacgugggccuggggcucgagacgcgcaccgagaccuggaugagcuccgagggcgccuggcggcagauccagaagguggagaccugggcccugcgccaccccggguucacggugaucgcccuguuccucgcgcacgccaucggcaccagcaucacccagaaggggaucaucuucauccugcugaugcucgugacccccuccauggccaugcggugcgucggcaucggcaaccgcgacuucguggaggggcugagcggcgccacguggguggacgucgugcuggagcacggguccugcgugaccaccauggccaagaacaagcccacccucgacaucgagcugcugaagacggaggucaccaaccccgcggugcuccggaagcugugcaucgaggccaagaucagcaacaccaccacggacucccgcugccccacccagggcgaggccacccugguggaggagcaggacgccaacuucgucugccggcgcaccuucguggaccggggcugggggaacggcugcggccucuucggcaaggggagccugcugacgugcgccaaguucaagugcgugaccaagcucgagggcaagaucguccaguacgagaaccugaaguacuccgugaucgugaccguccacaccggcgaccagcaccagguggggaacgagacgaccgagcacggcaccaucgcgaccaucacgccccaggcccccacgagcgagauccagcugaccgacuacggggcccucacccuggacugcagcccccggaccggccuggacuucaacgagaugguccuccugacgaugaaggagaaguccuggcuggugcacaagcagugguuccucgaccugccgcugcccuggaccuccggggccagcaccagccaggagaccuggaaccggcaggaccuccuggugacguucaagaccgcccacgcgaagaagcaggaggucguggugcugggcucccaggagggcgccaugcacaccgcccucaccggggccacggagauccagaccagcggcaccaccacgaucuucgccgggcaccugaagugccgccugaagauggacaagcucacccugaagggcgucuccuacgugaugugcaccgggagcuucaagcuggagaaggagguggcggagacccagcacggcacgguccugguccaggugaaguacgagggcaccgacgcccccugcaagauccccaucuccacccaggacgagaagggggucgcccagaacggccggcucaucaccgccaacccgaucgugacggacaaggagaagcccgugaacaucgagaccgagccgcccuucggggagagcuacaucgucaucggcgcgggcgagaaggcccugaagcuguccugguucaagaaggggagcuccaucggcaagauguucgaggccaccgcccgcggggcccggcgcauggcgauccucggcgacaccgccugggacuucgggagcaucggcggcguguucacguccguggggaagcugguccaccagguguucggcaccgccuacggggugcuguucagcggcgucuccuggaccaugaagaucgggaucggcauccuccugaccuggcugggccucaacagccgcuccacgagccuguccaugaccugcaucgccguggggauggugacccuguaccucggcgucauggugcaggccgacagcgggugcgugaucaacuggaagggccgggagcugaagugcggguccggcaucuucgucaccaacgaggugcacacguggaccgagcaguacaaguuccaggcggacagcccgaagcgccugagcgccgccaucggcaaggccugggaggagggggugugcggcauccgguccgccacccgccucgagaacaucauguggaagcagaucagcaacgagcugaaccacauccugcucgagaacgacaugaaguucaccgucguggugggggacgcgaacggcauccugacccaggggaagaagaugauccggccccagcccauggagcacaaguacuccuggaaguccuggggcaaggccaagaucaucggcgccgacacgcagaacaccaccuucaucaucgacgggcccgacaccccggagugccccgacgaccagcgcgccuggaacaucugggaggucgaggacuacggcuucgggguguucacgaccaacaucuggcugaagcuccgggacuccuacacccagaugugcgaccaccgccugaugagcgcggccaucaaggacuccaaggccgugcacgccgacaugggcuacuggaucgagagcgagaagaacgagaccuggaagcuggcccgggcguccuucaucgaggucaagacgugcaucuggccccgcagccacacccucugguccaacggcgugcuggagagcgagaugaucauccccaagaucuacgggggcccgaucucccagcacaacuaccggcccggguacuucacccagaccgccggccccuggcaccuggggaagcucgagcuggacuucaaccugugcgagggcacgaccguggucguggacgagcacugcggcaaccgcgggccgagccuccggaccaccacggugaccggcaagaucauccacgaguggugcugccgcuccugcacccugccgccccugcgguuccgcggggaggacggcugcugguacgggauggagauccggcccgucaaggagaaggaggagaaccucgugcgcagcaugguguccgccggcagcggcgaggucgacagcuucucccuggggcugcucugcgugagcaucaugaucgaggaggugaugcggucccgcuggagccgcaagaugcugaugaccggcacgcuggccgucuucuuccuccugaucauggggcagcugaccuggaacgaccucauccggcugugcaucauggugggcgccaacguguccgaccgcauggggaugggcaccaccuaccuggcgcucauggccacguucaagaugcggccgauguucgccgucggccugcuguuccgccggcucaccagccgcgaggugcugcugcucaccaucgggcugucccuggucgccagcguggagcuccccaacucccuggaggagcugggcgacgggcucgccaugggcaucaugaugcugaagcugcucaccgacuuccagagccaccagcuguggacgacccugcucucccugaccuucaucaagaccacgcugagccucgacuacgcguggaagaccauggccauggugcuguccaucgucagccuguucccccucugccuguccaccaccagccagaagacgaccuggcugcccgugcuccugggcuccuucgggugcaagccgcugaccauguuccucaucaccgagaacaagaucuggggccgcaagagcuggccccugaacgaggggaucauggccgugggcaucgucuccauccugcucagcagccugcugaagaacgacgugccccucgccgggccccugaucgcgggcggcaugcugaucgccugcuacgugaucuccgggagcuccgccgaccucagccuggagcgcgccgccgaggucuccugggaggaggaggcggagcacagcggcgccucccacaacauccugguggaggugcaggacgacgggaccaugaagaucaaggacgaggagcgggacgacacgcucaccauccugcugaaggccacccuccuggccgucagcggcguguacccgauguccauccccgccacccuguucgugugguacuucuggcagaagaagaagcagcgcagcgggguccucugggacacgcccagcccgcccgagguggagcgggcggugcuggacgacggcaucuaccgcauccugcagcggggccugcucgggcgcagccaggucggcguggggguguuccaggacggcgucuuccacaccauguggcacgugacccgcggggccgugcugauguaccagggcaagcgccuggagcccuccugggccagcgucaagaaggaccucaucuccuacggcgggggcuggcgguuccaggggagcuggaacaccggcgaggagguccaggugaucgccgucgagcccgggaagaaccccaagaacgugcagacgacccccggcaccuucaagacccccgagggcgaggugggggccaucgcgcuggacuucaagcccggcacguccgggagccccaucgucaaccgcgagggcaagaucgugggccuguacgggaacggcguggucaccaccuccgggaccuacgugagcgccaucgcccaggccaaggccagccaggagggcccgcuccccgagaucgaggacgagguguucaagaagcggaaccugacgaucauggaccugcaccccggguccggcaagacccgccgguaccucccggcgaucguccgcgaggccaucaagcgcaagcugcggacccugauccucgcccccacccgcgugguggccagcgagauggcggaggcccugaagggcaugcccauccgguaccagacgaccgccgucaaguccgagcacaccgggaaggagaucguggaccugaugugccacgccaccuucacgaugcgccuccugagccccgugcgggucccgaacuacaacaugaucaucauggacgaggcccacuucaccgaccccgcguccaucgccgcccgcggcuacaucagcacccggguggggaugggcgaggccgccgcgaucuucaugaccgccacgccgcccggguccguggaggccuucccgcagagcaacgccgucauccaggacgaggagcgcgacauccccgagcgguccuggaacagcggcuacgacuggaucaccgacuuccccggcaagaccgugugguucgugcccuccaucaagagcgggaacgacaucgccaacugccugcgcaagaacggcaagcgggucauccagcucucccgcaagaccuucgacacggaguaccagaagaccaagaacaacgacugggacuacguggugaccaccgacaucagcgagaugggggcgaacuuccgggccgaccgcgucaucgacccgcggcgcugccugaagcccgugauccugaaggacggccccgagcgggucauccucgccgggcccaugccggugacggccgcguccgccgcccagcgccggggccgcaucggccgcaaccagaacaaggagggggaccaguacaucuacaugggccagccccugaacaacgacgaggaccacgcccacuggaccgaggccaagaugcugcucgacaacaucaacacccccgaggggaucauccccgcgcuguucgagccggagcgggagaaguccgccgccaucgacggcgaguaccgccugcgcggggaggcccgcaagaccuucguggagcucaugcggcgcggcgaccugcccgucuggcuguccuacaagguggccagcgagggcuuccaguacuccgaccggcgcuggugcuucgacggggagcggaacaaccaggugcucgaggagaacauggacgucgagaucuggacgaaggagggcgagcgcaagaagcugcggccccgcuggcuggacgcgcggaccuacagcgacccccucgcccugcgcgaguucaaggaguucgccgccgggcggcgcagcguguccggcgaccugauccucgagaucggcaagcugccgcagcaccugacccuccgggcccagaacgcgcuggacaaccuggugaugcuccacaacagcgagcagggcgggaaggccuaccgccacgccauggaggagcugcccgacaccaucgagacccugaugcuccuggcccugaucgcgguccucaccggcggggugacccuguucuuccuguccgggaaggggcucggcaagaccagcaucgggcugcugugcgugauggccuccagcguccuccuguggauggccuccguggagccccacuggaucgccgccagcaucauccuggaguucuuccucauggugcugcugauccccgagccggaccggcagcgcacgccccaggacaaccagcucgcguacgucgugaucggccugcuguucaugauccucacgguggccgccaacgagauggggcugcuggagaccaccaagaaggaccucggcaucgggcacgucguggccgagaaccaccaccacgccaccaugcuggacaucgaccugcaccccgcguccgccuggacgcucuacgccguggccaccaccaucaucaccccgaugaugcggcacacgaucgagaacaccaccgccaacaucagccugaccgcgaucgccaaccaggccgccauccugaugggccucgacaagggcuggcccaucuccaagauggacaucggggucccccugcuggcccucggcugcuacagccaggugaacccccugacgcugaccgcggccgugcucaugcuggucgcccacuacgccaucaucgggccgggccugcaggcgaaggccacccgcgaggcccagaagcgcaccgccgccgggaucaugaagaaccccacgguggacggcaucguggcgaucgaccucgaccccgucguguacgacgccaaguucgagaagcagcugggccagaucaugcugcucauccugugcaccucccagauccugcucaugcggaccaccugggcccugugcgagagcaucacgcuggccaccgggccccucaccacccugugggagggcuccccggggaaguucuggaacacgaccaucgccgugagcauggcgaacaucuuccgcggcuccuaccuggccggcgccgggcucgccuucagccugaugaagucccugggcgggggccggcgcgggaccggcgcccagggcgagacccucggggagaaguggaagcggcagcugaaccagcugagcaagagcgaguucaacacguacaagcgcuccggcaucauggaggucgaccggagcgaggcgaaggaggggcucaagcgcggcgagaccaccaagcacgccgugucccgggggaccgccaagcugcgcugguucguggagcggaaccuggucaagcccgagggcaaggugaucgaccugggcugcgggcgcggcggguggagcuacuacugcgccggccucaagaaggugacggaggucaagggguacaccaagggcggccccgggcacgaggagcccaucccgauggcgaccuacggcuggaacaucgugaagcugcacuccgggcgggacguguucuucacgccgcccgagaagugcgacacccugcucugcgacaucggcgagagcucccccaacccgacgaucgaggaggggcgcacccugcggguccugaagaugguggagcccuggcuccgcggcaaccaguucugcaucaagauccugaaccccuacaugcccagcguggucgagacccuggagcagaugcagcggaagcacggcgggaugcucgugcgcaacccgcugucccggaacagcacccacgagauguacuggguguccugcggcacggggaacaucgucagcgccgugaacaugaccucccgcaugcugcucaaccgcuucaccauggcccaccggaagcccaccuacgagcgcgacguggaccugggcgccggcacgcggcacgucgccguggagcccgagaucgcgaaccuggacaucaucgggcagcgcaucgagaacaucaagaacgagcacaagagcaccuggcacuacgacgaggacaaccccuacaagaccugggccuaccacggcuccuacgaggugaagccgagcggguccgccagcuccauggucaacggcgugguccggcuccugaccaagcccugggacgugauccccauggugacgcagaucgccaugaccgacaccacccccuucgggcagcagcgcgucuucaaggagaagguggacacgcggaccccgcgccccaagcggggcaccgcccagaucauggaggugaccgcgaaguggcuguggggcuuccucagccgcaacaagaagccccggaucugcacgcgcgaggaguucacccggaagguccgcagcaacgccgccaucggggccguguucguggacgagaaccaguggaacuccgccaaggaggcggucgaggacgagcgguucugggaccuggugcaccgcgagcgggagcugcacaagcagggcaagugcgcgaccugcguguacaacaugauggggaagcgcgagaagaagcucggcgaguucgggaaggccaagggcagccgggccaucugguacauguggcugggcgcgcgcuuccuggaguucgaggcccucggguucaugaacgaggaccacugguucucccgggagaacagccuguccggcgucgagggggagggccugcacaagcucggguacauccugcgcgacaucagcaagaucccgggcggcaacauguacgccgacgacaccgccgggugggacacgcgcaucaccgaggacgaccugcagaacgaggccaagaucaccgacaucauggagcccgagcacgcgcuccuggccaccuccaucuucaagcugacguaccagaacaagguggugcggguccagcgccccgccaagagcggcaccgugauggacgugaucucccggcgcgaccagcgggggagcggccaggucggcaccuacgggcucaacaccuucacgaacauggaggugcagcugauccgccagauggaguccgagggcaucuucagccccuccgagcuggagaacagcaaccucgccgagcgggugcuggacuggcuggagaagcacggggucgagcgccucaagcggauggccaucuccggcgacgacugcguggugaagccgaccgacgaccgcuucgcgaccgcccugaccgcccugaacgacauggggaagguccggaaggacaucccccagugggagcccagcaagggcuggaacgacuggcagcagguccccuucugcucccaccacuuccaccagcucaucaugaaggacggccgcgagaucguggucccgugccggaaccaggacgagcugguggggcgcgcccgggugagccagggcgccggguggagccugcgcgagacggcgugccucggcaaguccuacgcccagauguggcagcugauguacuuccaccggcgcgaccugcggcucgccgccaacgccaucugcagcgcgguccccgugaacugggugcccaccucccgcaccaccuggagcauccacgcccaccaccaguggaugaccacggaggacaugcuguccgucuggaaccgcguguggaucgaggagaaccccuggauggaggacaagacccacgugagcuccugggaggacgucccguaccuggggaagcgggaggaccaguggugcggcagccucaucggccugaccgcccgcgccaccugggcgacgaacauccagguggccaucaaccaggugcggcgccugaucgggaacgagaacuaccucgacuacaugaccuccaugaagcgguucaagaacgagagcgaccccgagggcgcccugugguga

SEQ ID NO: 8924 - RNA, 9879 nt, Artificial Sequence
  derived and/or modified CDS sequence (opt1) from DENV-1__KM403603__SS-prME
agcgugaccaugcugcucaugcugcugcccaccgcccucgccuuccaccugaccacccggggcggggagccccacaugaucgugagcaagcaggagcggggcaagagccuccuguucaagaccuccgcgggggugaacaugugcacccugaucgccauggaccugggcgagcucugcgaggacacgaugaccuacaagugcccccggaucaccgaggccgagcccgacgacguggacugcuggugcaacgccaccgacaccugggugaccuacgggaccugcagccagaccggcgagcaccggcgcgacaagcgguccguggcccuggcgccccacgugggccuggggcucgagacgcgcaccgagaccuggaugagcuccgagggcgccuggcggcagauccagaagguggagaccugggcccugcgccaccccggguucacggugaucgcccuguuccucgcgcacgccaucggcaccagcaucacccagaaggggaucaucuucauccugcugaugcucgugacccccuccauggccaugcggugcgucggcaucggcaaccgcgacuucguggaggggcugagcggcgccacguggguggacgucgugcuggagcacggguccugcgugaccaccauggccaagaacaagcccacccucgacaucgagcugcugaagacggaggucaccaaccccgcggugcuccggaagcugugcaucgaggccaagaucagcaacaccaccacggacucccgcugccccacccagggcgaggccacccugguggaggagcaggacgccaacuucgucugccggcgcaccuucguggaccggggcugggggaacggcugcggccucuucggcaaggggagccugcugacgugcgccaaguucaagugcgugaccaagcucgagggcaagaucguccaguacgagaaccugaaguacuccgugaucgugaccguccacaccggcgaccagcaccagguggggaacgagacgaccgagcacggcaccaucgcgaccaucacgccccaggcccccacgagcgagauccagcugaccgacuacggggcccucacccuggacugcagcccccggaccggccuggacuucaacgagaugguccuccugacgaugaaggagaaguccuggcuggugcacaagcagugguuccucgaccugccgcugcccuggaccuccggggccagcaccagccaggagaccuggaaccggcaggaccuccuggugacguucaagaccgcccacgcgaagaagcaggaggucguggugcugggcucccaggagggcgccaugcacaccgcccucaccggggccacggagauccagaccagcggcaccaccacgaucuucgccgggcaccugaagugccgccugaagauggacaagcucacccugaagggcgucuccuacgugaugugcaccgggagcuucaagcuggagaaggagguggcggagacccagcacggcacgguccugguccaggugaaguacgagggcaccgacgcccccugcaagauccccaucuccacccaggacgagaagggggucacccagaacggccggcucaucacggccaacccgaucgugaccgacaaggagaagcccgugaacaucgagaccgagccgcccuucggggagagcuacaucgucaucggcgccggcgagaaggcgcugaagcuguccugguucaagaaggggagcuccaucggcaagauguucgaggccaccgcccgcggggcccggcgcauggccauccucggcgacacggcgugggacuucgggagcaucggcggcguguucaccuccguggggaagcugguccaccagguguucggcaccgccuacggggugcuguucagcggcgucuccuggaccaugaagaucgggaucggcauccuccugacguggcugggccucaacagccgcuccaccagccuguccaugaccugcaucgccguggggauggugacccuguaccucggcgucauggugcaggccgacagcgggugcgugaucaacuggaagggccgggagcugaagugcggguccggcaucuucgucacgaacgaggugcacaccuggaccgagcaguacaaguuccaggccgacagcccgaagcgccugagcgcggccaucggcaaggccugggaggagggggugugcggcauccgguccgccacccgccucgagaacaucauguggaagcagaucagcaacgagcugaaccacauccugcucgagaacgacaugaaguucaccgucguggugggggacgccaacggcauccugacgcaggggaagaagaugauccggccccagcccauggagcacaaguacuccuggaaguccuggggcaaggcgaagaucaucggcgccgacacccagaacaccaccuucaucaucgacgggcccgacacgccggagugccccgacgaccagcgcgccuggaacaucugggaggucgaggacuacggcuucgggguguucaccaccaacaucuggcugaagcuccgggacuccuacacccagaugugcgaccaccgccugaugagcgccgcgaucaaggacuccaaggccgugcacgccgacaugggcuacuggaucgagagcgagaagaacgagacguggaagcuggcccgggccuccuucaucgaggucaagaccugcaucuggccccgcagccacacccucugguccaacggcgugcuggagagcgagaugaucauccccaagaucuacgggggcccgaucucccagcacaacuaccggcccggguacuucacccagacggcgggccccuggcaccuggggaagcucgagcuggacuucaaccugugcgagggcaccaccguggucguggacgagcacugcggcaaccgcgggccgagccuccggaccacgaccgugaccggcaagaucauccacgaguggugcugccgcuccugcacccugccgccccugcgguuccgcggggaggacggcugcugguacgggauggagauccggcccgucaaggagaaggaggagaaccucgugcgcagcaugguguccgccggcagcggcgaggucgacagcuucucccuggggcugcucugcgugagcaucaugaucgaggaggugaugcggucccgcuggagccgcaagaugcugaugacgggcacccuggccgucuucuuccuccugaucauggggcagcugaccuggaacgaccucauccggcugugcaucauggugggcgccaacguguccgaccgcauggggaugggcaccacguaccuggcccucauggcgaccuucaagaugcggccgauguucgccgucgggcugcuguuccgccggcucaccagccgcgaggugcugcugcucaccaucgggcugucccuggucgccagcguggagcuccccaacucccuggaggagcugggcgacgggcucgccaugggcaucaugaugcugaagcugcucacggacuuccagagccaccagcuguggaccacccugcucucccugaccuucaucaagacgacccugagccucgacuacgccuggaagaccauggcgauggugcuguccaucgucagccuguucccccucugccuguccaccacgagccagaagaccaccuggcugcccgugcuccugggcuccuucgggugcaagccgcugaccauguuccucaucaccgagaacaagaucuggggccgcaagagcuggccccugaacgaggggaucauggccgugggcaucgucuccauccugcucagcagccugcugaagaacgacgugccccucgccgggccccugaucgccggcggcaugcugaucgcgugcuacgugaucuccgggagcuccgccgaccucagccuggagcgcgccgccgaggucuccugggaggaggaggccgagcacagcggcgcgucccacaacauccugguggaggugcaggacgacgggacgaugaagaucaaggacgaggagcgggacgacacccucaccauccugcugaaggccacccuccuggccgucagcggcguguacccgauguccauccccgccacgcuguucgugugguacuucuggcagaagaagaagcagcgcagcgggguccucugggacacccccagcccgcccgagguggagcgggccgugcuggacgacggcaucuaccgcauccugcagcggggccugcucgggcgcagccaggucggcguggggguguuccaggacggcgucuuccacaccauguggcacgugacccgcggggcggugcugauguaccagggcaagcgccuggagcccuccugggccagcgucaagaaggaccucaucuccuacggcgggggcuggcgguuccaggggagcuggaacacgggcgaggagguccaggugaucgccgucgagcccgggaagaaccccaagaacgugcagaccacccccggcaccuucaagacgcccgagggcgaggugggggccaucgcccuggacuucaagcccggcaccuccgggagccccaucgucaaccgcgagggcaagaucgugggccuguacgggaacggcguggucaccaccuccgggacguacgugagcgcgaucgcccaggccaaggccagccaggagggcccgcuccccgagaucgaggacgagguguucaagaagcggaaccugaccaucauggaccugcaccccggguccggcaagacccgccgguaccucccggccaucguccgcgaggcgaucaagcgcaagcugcggacccugauccucgcccccacgcgcgugguggccagcgagauggccgaggcgcugaagggcaugcccauccgguaccagaccaccgccgucaaguccgagcacaccgggaaggagaucguggaccugaugugccacgccacguucaccaugcgccuccugagccccgugcgggucccgaacuacaacaugaucaucauggacgaggcccacuucaccgaccccgccuccaucgcggcccgcggcuacaucagcacccggguggggaugggcgaggccgccgccaucuucaugacggcgacgccgcccggguccguggaggccuucccgcagagcaacgccgucauccaggacgaggagcgcgacauccccgagcgguccuggaacagcggcuacgacuggaucaccgacuuccccggcaagaccgugugguucgugcccuccaucaagagcgggaacgacaucgccaacugccugcgcaagaacggcaagcgggucauccagcucucccgcaagacguucgacaccgaguaccagaagaccaagaacaacgacugggacuacguggugaccacggacaucagcgagaugggggccaacuuccgggcggaccgcgucaucgacccgcggcgcugccugaagcccgugauccugaaggacggccccgagcgggucauccucgccgggcccaugccggugaccgccgccuccgcggcccagcgccggggccgcaucggccgcaaccagaacaaggagggggaccaguacaucuacaugggccagccccugaacaacgacgaggaccacgcccacuggaccgaggccaagaugcugcucgacaacaucaacacccccgaggggaucauccccgcccuguucgagccggagcgggagaaguccgcggccaucgacggcgaguaccgccugcgcggggaggcccgcaagacguucguggagcucaugcggcgcggcgaccugcccgucuggcuguccuacaagguggccagcgagggcuuccaguacuccgaccggcgcuggugcuucgacggggagcggaacaaccaggugcucgaggagaacauggacgucgagaucuggaccaaggagggcgagcgcaagaagcugcggccccgcuggcuggacgcccggaccuacagcgacccccucgcgcugcgcgaguucaaggaguucgccgccgggcggcgcagcguguccggcgaccugauccucgagaucggcaagcugccgcagcaccugacccuccgggcccagaacgcccuggacaaccuggugaugcuccacaacagcgagcagggcgggaaggcguaccgccacgccauggaggagcugcccgacaccaucgagacgcugaugcuccuggcccugaucgccguccucaccgggggcgugacccuguucuuccuguccgggaagggccucggcaagaccagcaucgggcugcugugcgugauggcguccagcguccuccuguggauggccuccguggagccccacuggaucgccgccagcaucauccuggaguucuuccucauggugcugcugauccccgagccggaccggcagcgcacgccccaggacaaccagcucgccuacgucgugaucggccugcuguucaugauccucaccguggcggccaacgagauggggcugcuggagaccaccaagaaggaccucggcaucgggcacgucguggccgagaaccaccaccacgccacgaugcuggacaucgaccugcaccccgccuccgcguggacccucuacgccguggccaccaccaucaucacgccgaugaugcggcacaccaucgagaacaccaccgccaacaucagccugacggccaucgcgaaccaggccgccauccugaugggccucgacaagggcuggcccaucuccaagauggacaucggggucccccugcuggcccucggcugcuacagccaggugaacccccugacccugaccgccgcggugcucaugcuggucgcccacuacgccaucaucgggccgggccugcaggccaaggcgacccgcgaggcccagaagcgcacggccgccgggaucaugaagaaccccaccguggacggcaucguggccaucgaccucgaccccgucguguacgacgcgaaguucgagaagcagcugggccagaucaugcugcucauccugugcaccucccagauccugcucaugcggaccacgugggcccugugcgagagcaucacccuggccaccgggccccucaccacgcugugggagggcuccccggggaaguucuggaacaccaccaucgccgugagcauggccaacaucuuccgcggcuccuaccuggcgggcgccgggcucgccuucagccugaugaagacccugggcgggggccggcgcgggacgggcgcccagggcgagacccucggggagaaguggaagcggcagcugaaccagcuguccaagagcgaguucaacaccuacaagcgcagcggcaucauggaggucgaccgguccgaggccaaggaggggcucaagcgcggcgagaccacgaagcacgcggugagccgggggaccgccaagcugcgcugguucguggagcggaaccuggucaagcccgagggcaaggugaucgaccugggcugcgggcgcggcgggugguccuacuacugcgccggccucaagaaggugaccgaggucaagggguacaccaagggcggccccgggcacgaggagcccaucccgauggccaccuacggcuggaacaucgugaagcugcacagcgggcgggacguguucuucacgccgcccgagaagugcgacacccugcucugcgacaucggcgaguccagccccaacccgaccaucgaggaggggcgcacccugcggguccugaagaugguggagcccuggcuccgcggcaaccaguucugcaucaagauccugaaccccuacaugcccuccguggucgagacgcuggagcagaugcagcggaagcacggcgggaugcucgugcgcaacccgcugagccggaacuccacccacgagauguacugggugagcugcggcaccgggaacaucgucuccgcggugaacaugaccagccgcaugcugcucaaccgcuucacgauggcccaccggaagcccaccuacgagcgcgacguggaccugggcgccggcacccggcacgucgccguggagcccgagaucgccaaccuggacaucaucgggcagcgcaucgagaacaucaagaacgagcacaaguccaccuggcacuacgacgaggacaaccccuacaagacgugggcguaccacggcagcuacgaggugaagccguccgggagcgccuccagcauggucaacggcgugguccggcuccugaccaagcccugggacgugauccccauggugacccagaucgccaugaccgacacgacccccuucgggcagcagcgcgucuucaaggagaagguggacacccggaccccgcgccccaagcggggcacggcccagaucauggaggugaccgccaaguggcuguggggcuuccucucccgcaacaagaagccccggaucugcacccgcgaggaguucacccggaagguccgcagcaacgcggccaucggggccguguucguggacgagaaccaguggaacagcgccaaggaggccgucgaggacgagcgguucugggaccuggugcaccgcgagcgggagcugcacaagcagggcaagugcgcgacgugcguguacaacaugauggggaagcgcgagaagaagcucggcgaguucgggaaggccaagggcucccgggccaucugguacauguggcugggcgcccgcuuccuggaguucgaggcgcucggguucaugaacgaggaccacugguucagccgggagaacucccugagcggcgucgagggggagggccugcacaagcucggguacauccugcgcgacaucuccaagaucccgggcggcaacauguacgccgacgacaccgccgggugggacacccgcaucaccgaggacgaccugcagaacgaggccaagaucacggacaucauggagcccgagcacgcccuccuggcgaccagcaucuucaagcugaccuaccagaacaagguggugcggguccagcgccccgccaaguccggcaccgugauggacgugaucagccggcgcgaccagcggggguccggccaggucggcacguacgggcucaacaccuucaccaacauggaggugcagcugauccgccagauggagagcgagggcaucuucucccccagcgagcuggagaacuccaaccucgccgagcgggugcuggacuggcuggagaagcacggggucgagcgccucaagcggauggccaucagcggcgacgacugcguggugaagccgaccgacgaccgcuucgccacggcgcugaccgcccugaacgacauggggaagguccggaaggacaucccccagugggagcccuccaagggcuggaacgacuggcagcagguccccuucugcagccaccacuuccaccagcucaucaugaaggacggccgcgagaucguggucccgugccggaaccaggacgagcugguggggcgcgcccgggugucccagggcgccggguggagccugcgcgagaccgccugccucggcaagagcuacgcgcagauguggcagcugauguacuuccaccggcgcgaccugcggcucgccgccaacgccaucugcuccgccguccccgugaacugggugcccaccagccgcaccacgugguccauccacgcgcaccaccaguggaugaccaccgaggacaugcugagcgucuggaaccgcguguggaucgaggagaaccccuggauggaggacaagacccacguguccagcugggaggacgucccguaccuggggaagcgggaggaccaguggugcggcucccucaucggccugacggcccgcgccaccugggccaccaacauccagguggcgaucaaccaggugcggcgccugaucgggaacgagaacuaccucgacuacaugaccagcaugaagcgguucaagaacgaguccgaccccgagggcgcccugugguga

SEQ ID NO: 8925 - RNA, 9879 nt, Artificial Sequence
  derived and/or modified CDS sequence (opt1) from DENV-1__KM403585__SS-prME
agcgugaccaugcugcucaugcugcugcccaccgcccucgccuuccaccugaccacccggggcggggagccccacaugaucgucagcaagcaggagcggggcaagagccuccuguucaagaccuccgcgggggugaacaugugcacccugaucgccauggaccugggcgagcucugcgaggacacgaugaccuacaagugcccccggaucaccgaggccgagcccgacgacguggacugcuggugcaacgccaccgacaccugggucaccuacgggaccugcagccagaccggcgagcaccggcgcgacaagcgguccguggcccuggcgccccacgugggccuggggcucgagacccgcaccgagaccuggaugagcuccgagggcgccuggcggcagauccagaaggucgagaccugggcccugcgccaccccggguucacggugaucgcccuguuccucgcgcacgccaucggcaccagcaucacccagaaggggaucaucuucauccugcugaugcucgugacccccuccauggccaugcggugcgucggcaucggcaaccgcgacuucguggaggggcugagcggcgccacguggguggacgucgugcuggagcacggguccugcgugaccaccauggccaagaacaagcccacccucgacaucgagcugcugaagacggaggucaccaaccccgcggugcuccggaagcugugcaucgaggccaagaucagcaacaccaccacggacucccgcugccccacccagggcgaggccacccugguggaggagcaggacgccaacuucgucugccggcgcaccuucguggaccggggcugggggaacggcugcggccucuucggcaaggggagccugcugacgugcgccaaguucaagugcgugaccaagcucgagggccgcaucguccaguacgagaaccugaaguacuccgugaucgugaccguccacaccggcgaccagcaccagguggggaacgagacgaccgagcacggcaccaucgcgaccaucacgccccaggcccccacgagcgagguccagcugaccgacuacggggcccucacccuggacugcagcccccggaccggccuggacuucaacgagauggugcuccugacgaugaaggagaaguccuggcuggugcacaagcagugguuccucgaccugccgcugcccuggaccuccggggccagcaccagccaggagaccuggaaccgccaggaccuccuggucacguucaagaccgcccacgcgaagaagcaggagguggugguccugggcucccaggagggcgccaugcacaccgcccucaccggggccacggagauccagaccagcggcaccaccacgaucuucgccgggcaccugaagugccggcugaagauggacaagcucacccugaagggcguguccuacgugaugugcaccgggagcuucaagcuggagaaggaggucgcggagacccagcacggcacggugcuggugcaggucaaguacgagggcaccgacgcccccugcaagauccccaucuccacccaggacgagaagggggugacccagaacggccgccucaucacggccaacccgaucgugaccgacaaggagaagcccgucaacaucgagaccgagccgcccuucggggagagcuacaucgugaucggcgccggcgagaaggcgcugaagcuguccugguucaagaaggggagcuccaucggcaagauguucgaggccaccgcccgcggggcccgccgcauggccauccucggcgacacggcgugggacuucgggagcaucggcggcguguucaccuccgucgggaagcuggugcaccagguguucggcaccgccuacgggguccuguucagcggcguguccuggaccaugaagaucgggaucggcauccuccugacguggcugggccucaacagccgguccaccagccuguccaugaccugcaucgccguggggauggucacccuguaccucggcgugauggugcaggccgacagcgggugcgucaucaacuggaagggccgcgagcugaagugcggguccggcaucuucgugacgaacgaggugcacaccuggaccgagcaguacaaguuccaggccgacagcccgaagcggcugagcgcggccaucggcaaggccugggaggagggggucugcggcauccgcuccgccacccggcucgagaacaucauguggaagcagaucagcaacgagcugaaccacauccugcucgagaacgacaugaaguucaccgugguggucggggacgccuacggcauccugacgcaggggaagaagaugauccgcccccagcccauggagcacaaguacuccuggaaguccuggggcaaggcgaagaucaucggcgccgacacccagaacaccaccuucaucaucgacgggcccgacacgccggagugccccgacgaccagcgggccuggaacaucugggagguggaggacuacggcuucgggguguucaccaccaacaucuggcugaagcuccgcgacuccuacacccagaugugcgaccaccggcugaugagcgccgcgaucaaggacuccaaggccguccacgccgacaugggcuacuggaucgagagcgagaagaacgagacguggaagcuggcccgcgccuccuucaucgaggugaagaccugcaucuggccccggagccacacccucugguccaacggcgugcuggagagcgagaugaucauccccaagaucuacgggggcccgaucucccagcacaacuaccgccccggguacuucacccagacggcgggccccuggcaccuggggaagcucgagcuggacuucaaccugugcgagggcaccaccgucgugguggacgagcacugcggcaaccgggggccgagccuccgcaccacgaccgucaccggcaagaucauccacgaguggugcugccgguccugcacccugccgccccugcgcuuccgcggggaggacggcugcugguacgggauggagauccgccccgugaaggagaaggaggagaaccucgugcggagcauggucuccgccggcagcggcgagguggacagcuucucccuggggcugcucugcgugagcaucaugaucgaggaggucaugcgcucccgcuggagccggaagaugcugaugacgggcacccuggccguguucuuccuccugaucauggggcagcugaccuggaacgaccucauccgccugugcaucauggugggcgccaacgucuccgaccggauggggaugggcaccacguaccuggcccucauggcgaccuucaagaugcgcccgauguucgccguggggcugcuguuccggcgccucaccagccgggagguccugcugcucaccaucgggcugucccugguggccagcguggagcuccccaacucccuggaggagcugggcgacgggcucgccaugggcaucaugaugcugaagcugcucacggacuuccagagccaccagcuguggaccacccugcucucccugaccuucaucaagacgacccugagccucgacuacgccuggaagaccauggcgaugguccuguccaucgugagccuguucccccucugccuguccaccacgagccagaagaccaccuggcugcccgugcuccugggcuccuucgggugcaagccgcugaccauguuccucaucaccgagaacaagaucuggggccgcaagagcuggccccugaacgaggggaucauggccgucggcaucguguccauccugcucagcagccugcugaagaacgacgugccccucgccgggccccugaucgccggcggcaugcugaucgcgugcuacgucaucuccgggagcuccgccgaccucagccuggagcgggccgccgagguguccugggaggaggaggccgagcacagcggcgcgucccacaacauccugguggagguccaggacgacgggacgaugaagaucaaggacgaggagcgcgacgacacccucaccauccugcugaaggccacccuccuggccgugagcggcguguacccgauguccauccccgccacgcuguucgucugguacuucuggcagaagaagaagcagcggagcggggugcucugggacacccccagcccgcccgagguggagcgcgccguccuggacgacggcaucuaccggauccugcagcgcggccugcucgggcggagccaggugggcgugggggucuuccaggacggcguguuccacaccauguggcacgugacccgcggggcgguccugauguaccagggcaagcggcuggagcccuccugggccagcgugaagaaggaccucaucuccuacggcgggggcuggcgcuuccaggggagcuggaacacgggcgaggaggugcaggucaucgccguggagcccgggaagaaccccaagaacgugcagaccacccccggcaccuucaagacgcccgagggcgaggucggggccaucgcccuggacuucaagcccggcaccuccgggagccccaucgugaaccgggagggcaagaucgugggccuguacgggaacggcgucgugaccaccuccgggacguacgugagcgcgaucgcccaggccaaggccagccaggagggcccgcuccccgagaucgaggacgaggucuucaagaagcgcaaccugaccaucauggaccugcaccccggguccggcaagacccggcgcuaccucccggccaucgugcgcgaggcgaucaagcggaagcugcgcacccugauccucgcccccacgcggguggucgccagcgagauggccgaggcgcugaagggcaugcccauccgcuaccagaccaccgccgugaaguccgagcacaccgggaaggagaucguggaccugaugugccacgccacguucaccaugcggcuccugagccccguccgcgugccgaacuacaacaugaucaucauggacgaggcccacuucaccgaccccgccuccaucgcggcccggggcuacaucagcacccgcguggggaugggcgaggccgccgccaucuucaugacggcgacgccgcccggguccgucgaggccuucccgcagagcaacgccgugauccaggacgaggagcgggacauccccgagcgcuccuggaacagcggcuacgacuggaucaccgacuuccccggcaagaccgugugguucguccccuccaucaagagcgggaacgacaucgccaacugccugcggaagaacggcaagcgcgugauccagcucucccggaagacguucgacaccgaguaccagaagaccaagaacaacgacugggacuacguggucaccacggacaucagcgagaugggggccaacuuccgcgcggaccgggugaucgacccgcgccggugccugaagcccgucauccugaaggacggccccgagcgcgugauccucgccgggcccaugccggugaccgccgccuccgcggcccagcggcgcggccgcaucggccggaaccagaacaaggagggggaccaguacaucuacaugggccagccccugaacaacgacgaggaccacgcccacuggaccgaggccaagaugcugcucgacaacaucaacacccccgaggggaucauccccgcccuguucgagccggagcgcgagaaguccgcggccaucgacggcgaguaccggcugcgcggggaggcccggaagacguucgucgagcucaugcgccggggcgaccugcccguguggcuguccuacaagguggccagcgagggcuuccaguacuccgaccgccgguggugcuucgacggggagcgcaacaaccagguccucgaggagaacauggacguggagaucuggaccaaggagggcgagcggaagaagcugcgcccccgguggcuggacgcccgcaccuacagcgacccccucgcgcugcgggaguucaaggaguucgccgccgggcgccggagcguguccggcgaccugauccucgagaucggcaagcugccgcagcaccugacccuccgcgcccagaacgcccuggacaaccuggucaugcuccacaacagcgagcagggcgggaaggcguaccggcacgccauggaggagcugcccgacaccaucgagacgcugaugcuccuggcccugaucgccgugcucaccgggggcgugacccuguucuuccuguccgggaagggccucggcaagaccagcaucgggcugcugugcgucauggcguccagcgugcuccuguggauggccuccguggagccccacuggaucgccgccagcaucauccuggaguucuuccucaugguccugcugauccccgagccggaccgccagcggacgccccaggacaaccagcucgccuacguggugaucggccugcuguucaugauccucaccgucgcggccaacgagauggggcugcuggagaccaccaagaaggaccucggcaucgggcacgugguggccgagaaccaccaccacgccacgaugcuggacaucgaccugcaccccgccuccgcguggacccucuacgccgucgccaccaccaucaucacgccgaugaugcgccacaccaucgagaacaccaccgccaacaucagccugacggccaucgcgaaccaggccgccauccugaugggccucgacaagggcuggcccaucuccaagauggacaucggggugccccugcuggcccucggcugcuacagccaggugaacccccugacccugaccgccgcgguccucaugcugguggcccacuacgccaucaucgggccgggccugcaggccaaggcgacccgcgaggcccagaagcggacggccgccgggaucaugaagaaccccaccguggacggcaucgucgccaucgaccucgaccccgugguguacgacgcgaaguucgagaagcagcugggccagaucaugcugcucauccugugcaccucccagauccugcucaugcgcaccacgugggcccugugcgagagcaucacccuggccaccgggccccucaccacgcugugggagggcuccccggggcgguucuggaacaccaccaucgccgucagcauggccaacaucuuccgcggcuccuaccuggcgggcgccgggcucgccuucagccugaugaagucccugggcgggggccggcgcgggaccggcgcccagggcgagacgcucggggagaaguggaagcggcagcugaaccagcugagcaagagcgaguucaacaccuacaagcgcuccggcaucguggagguggaccggagcgaggccaaggaggggaugaagcgcggcgagaccaccaagcacgcggucucccgggggacggccaagcuccgcugguucguggagcggaaccuggugaagcccgagggcaaggucaucgaccugggcugcgggcgcggcggguggagcuacuacugcgccggccugaagaaggugaccgaggugaagggguacaccaagggcggccccgggcacgaggagcccaucccgauggccaccuacggcuggaacaucgucaagcuccacuccgggcgggacguguucuucacgccgcccgagaagugcgacacgcugcugugcgacaucggcgagagcucccccaacccgaccaucgaggaggggcgcacccuccgggugcugaagauggucgagcccuggcugcgcggcaaccaguucugcaucaagauccucaaccccuacaugcccagcgugguggagacccuggagcagaugcagcggaagcacggcgggaugcugguccgcaacccgcucucccgcaacagcacgcacgagauguacuggguguccugcggcaccgggaacaucgugagcgcggucaacaugaccucccggaugcugcugaaccgcuucaccauggcccaccggaagcccacguacgagcgcgacguggaccucggcgccggcacccggcacguggccgucgagcccgagaucgccaaccuggacaucaucgggcagcgcaucgagaacaucaagaacgagcacaagagcaccuggcacuacgacgaggacaaccccuacaagaccugggcguaccacggcuccuacgaggugaagccgagcggguccgccagcuccauggucaacggcguggugcggcugcucacgaagcccugggacgucauccccauggugacccagaucgccaugaccgacaccacgcccuucgggcagcagcgcguguucaaggagaaggucgacacccggaccccgcgccccaagcggggcaccgcccagaucauggaggugacggccaaguggcuguggggcuuccugagccgcaacaagaagccccggaucugcacccgcgaggaguucacccggaaggugcgcagcaacgcggccaucggggccgucuucguggacgagaaccaguggaacuccgccaaggaggccguggaggacgagcgguucugggaccucguccaccgcgagcgggagcugcacaagcagggcaagugcgcgaccugcguguacaacaugauggggaagcgcgagaagaagcugggcgaguucgggaaggccaagggcagccgggccaucugguacauguggcucggcgcccgcuuccuggaguucgaggcgcugggguucaugaacgaggaccacugguucucccgcgagaacagccucuccggcguggagggggagggccugcacaagcugggguacauccuccgggacaucagcaagaucccgggcggcaacauguacgccgacgacacggccgggugggacacccgcaucaccgaggacgaccugcagaacgaggccaagaucaccgacaucauggagcccgagcacgcccugcucgcgacguccaucuucaagcugaccuaccagaacaaggucgugcgggugcagcgccccgccaagagcggcaccgucauggacgugaucucccggcgcgaccagcgggggagcggccaggugggcaccuacgggcugaacacguucaccaacauggagguccagcucauccgccagauggaguccgagggcaucuucagccccuccgagcuggagaacagcaaccuggccgagcgggugcucgacuggcuggagaagcacgggguggagcgccugaagcggauggccaucuccggcgacgacugcgucgugaagccgaccgacgaccgcuucgccaccgcgcucacggcccugaacgacauggggaaggugcggaaggacaucccccagugggagcccagcaagggcuggaacgacuggcagcagguccccuucugcucccaccacuuccaccagcugaucaugaaggacggccgcgagaucguggugccgugccggaaccaggacgagcucgucgggcgcgcccgggugagccagggcgccggguggagccugcgcgagaccgccugccugggcaaguccuacgcgcagauguggcagcucauguacuuccaccggcgcgaccugcgccuggccgccaacgccaucugcagcgccgugcccgucaacugggugcccaccucccggaccaccuggagcauccacgcgcaccaccaguggaugacgaccgaggacaugcucuccguguggaaccgcgucuggaucgaggagaaccccuggauggaggacaagacccacgugagcuccugggaggacgugccguaccuggggaagcgggaggaccaguggugcggcagccugaucggccucaccgcccgcgccacgugggccaccaacauccaggucgcgaucaaccaggugcggcgccugaucgggaacgagaacuaccuggacuacaugaccuccaugaagcgguucaagaacgagagcgaccccgagggcgcccucugguga

SEQ ID NO: 8926 - RNA, 9879 nt, Artificial Sequence
  derived and/or modified CDS sequence (opt1) from DENV-1__KM403595__SS-prME
agcgugaccaugcugcucaugcugcugcccaccgcccucgccuuccaccugaccacccggggcggggagccccacaugaucgugagcaagcaggagcggggcaagagccuccuguucaagaccuccgcgggggugaacaugugcacccugaucgccauggaccugggcgagcucugcgaggacacgaugaccuacaagugcccccggaucaccgaggccgagcccgacgacguggacugcuggugcaacgccaccgacaccugggucaccuacgggaccugcagccagaccggcgagcaccggcgcgaccggcgcuccguggcccuggcgccccacgugggccuggggcucgagacgcggaccgagaccuggaugagcuccgagggcgccuggcgccagauccagcgggucgagaccugggcccugcgccaccccggguucacggugaucgcccuguuccucgcgcacgccaucggcaccagcaucacccagaaggggaucaucuucauccugcugaugcucgugacccccuccauggccaugcggugcgucggcaucggcaaccgcgacuucguggaggggcugagcggcgccacguggguggacgucgugcuggagcacggguccugcgugaccaccauggccaagaacaagcccacccucgacaucgagcugcugaagacggaggucaccaaccccgcggugcuccggaagcugugcaucgaggccaagaucagcaacaccaccacggacucccgcugccccacccagggcgaggccacccugguggaggagcaggacgccaacuucgucugccggcgcaccuucguggaccggggcugggggaacggcugcggccucuucggcaaggggagccugcugacgugcgccaaguucaagugcgugaccaagcucgagggcaagaucguccaguacgagaaccugaaguacuccgugaucgugaccguccacaccggcgaccagcaccagguggggaacgagacgaccgagcacggcaccaucgcgaccaucacgccccaggcccccacgagcgagauccagcugaccgacuacggggcccucacccuggacugcagcccccggaccggccuggacuucaacgagaugguccuccugacgaugaaggagaaguccuggcuggugcacaagcagugguuccucgaccugccgcugcccuggaccuccggggccagcaccagccaggagaccuggaaccggcaggaccuccuggugacguucaagaccgcccacgcgaagaagcaggaggucguggugcugggcucccaggagggcgccaugcacaccgcccucaccggggccacggagauccagaccagcggcaccaccacgaucuucgccgggcaccugaagugccgccugaagauggacaagcucacccugaagggcgucuccuacgugaugugcaccgggagcuucaagcuggagaaggagguggcggagacccagcacggcacgguccugguccaggugaaguacgagggcaccgacgcccccugcaagauccccaucuccacccaggacgagaagggggucacccagaacggccggcucaucacggccaacccgaucgugaccgacaaggagaagcccgugaacaucgagaucgagccgcccuucggggagagcuacaucgucaucggcgccggcgagaaggcgcugaagcuguccugguucaagaaggggagcuccaucggcaagauguucgaggccaccgcccgcggggcccgccggauggccauccucggcgacaccgcgugggacuucgggagcaucggcggcguguucacguccguggggaagcugguccaccagguguucggcaccgccuacggggugcuguucagcggcgucuccuggaccaugaagaucgggaucggcauccuccugaccuggcugggccucaacagccgcuccacgagccuguccaugaccugcaucgccguggggauggugacccuguaccucggcgucauggugcaggccgacagcgggugcgugaucaacuggaagggccgggagcugaagugcggguccggcaucuucgucaccaacgaggugcacacguggaccgagcaguacaaguuccaggccgacagcccgaagcgccugagcgcggccaucggcaaggccugggaggagggggugugcggcauccgguccgccacccgccucgagaacaucauguggaagcagaucagcaacgagcugaaccacauccugcucgagaacgacaugaaguucaccgucguggugggggacgccaacggcauccugacccaggggaagaagaugauccggccccagcccauggagcacaaguacuccuggaaguccuggggcaaggcgaagaucaucggcgccgacacgcagaacaccaccuucaucaucgacgggcccgacaccccggagugccccgacgaccagcgcgccuggaacaucugggaggucgaggacuacggcuucgggguguucacgaccaacaucuggcugaagcuccgggacuccuacacccagaugugcgaccaccgccugaugagcgccgcgaucaaggacuccaaggccgugcacgccgacaugggcuacuggaucgagagcgagaagaacgagaccuggaagcuggcccgggccuccuucaucgaggucaagacgugcaucuggccccgcagccacacccucugguccaacggcgugcuggagagcgagaugaucauccccaagaucuacgggggcccgaucucccagcacaacuaccggcccggguacuucacccagaccgcgggccccuggcaccuggggaagcucgagcuggacuucaaccugugcgagggcacgaccguggucguggacgagcacugcggcaaccgcgggccgagccuccggaccaccacggugaccggcaagaucauccacgaguggugcugccgcuccugcacccugccgccccugcgguuccgcggggaggacggcugcugguacgggauggagauccggcccgucaaggagaaggaggagaaccucgugcgcagcaugguguccgccggcagcggcgaggucgacagcuucucccuggggcugcucugcgugagcaucaugaucgaggaggugaugcgcucccgguggagccgcaagaugcugaugaccggcacgcuggccaucuucuuccuccugaucauggggcagcugaccuggaacgaccucauccggcugugcaucauggucggcgccaacguguccgaccgcauggggaugggcaccaccuaccuggcccucauggcgacguucaagaugcggccgauguucgccgugggccugcuguuccgccggcucaccagccgcgagguccugcugcucaccaucgggcugucccugguggccagcgucgagcuccccaacucccuggaggagcugggcgacgggcucgccaugggcaucaugaugcugaagcugcucaccgacuuccagagccaccagcuguggacgacccugcucucccugaccuucaucaagaccacgcugagccucgacuacgccuggaagaccauggcgauggugcuguccaucgugagccuguucccccucugccuguccaccaccagccagaagacgaccuggcugcccguccuccugggcuccuucgggugcaagccgcugaccauguuccucaucaccgagaacaagaucuggggccgcaagagcuggccccugaacgaggggaucauggccgugggcaucguguccauccugcucagcagccugcugaagaacgacgucccccucgccgggccccugaucgccggcggcaugcugaucgcgugcuacgugaucuccgggagcuccgccgaccucagccuggagcgcgccgccgagguguccugggaggaggaggccgagcacagcggcgcgucccacaacauccuggucgaggugcaggacgacgggaccaugaagaucaaggacgaggagcgggacgacacgcucaccauccugcugaaggccacccuccuggccgugagcggcgucuacccgauguccauccccgccacccuguucgugugguacuucuggcagaagaagaagcagcgcagcggggugcucugggacacgcccagcccgcccgaggucgagcgggccgugcuggacgacggcaucuaccgcauccugcagcggggccugcucgggcgcagccaggugggcgucgggguguuccaggacggcguguuccacaccauguggcacgucacccgcggggcggugcugauguaccagggcaagcgccuggagcccuccugggccagcgugaagaaggaccucaucuccuacggcgggggcuggcgguuccaggggagcuggaacaccggcgaggagguccaggugaucgccguggagcccgggaagaaccccaagaacguccagacgacccccggcaccuucaagacccccgagggcgaggugggggccaucgcccuggacuucaagcccggcacguccgggagccccaucgugaaccgcgagggcaagaucgucggccuguacgggaacggcguggugaccaccuccgggaccuacgucagcgcgaucgcccaggccaaggccagccaggagggcccgcuccccgagaucgaggacgagguguucaagaagcggaaccugacgaucauggaccugcaccccggguccggcaagacccgccgcuaccucccggccaucgugcgggaggcgaucaagcgcaagcugcggacccugauccucgcccccacccgcgucguggccagcgagauggccgaggcgcugaagggcaugcccauccgguaccagacgaccgccgugaaguccgagcacaccgggaaggagaucgucgaccugaugugccacgccaccuucacgaugcgccuccugagccccgugcgggugccgaacuacaacaugaucaucauggacgaggcccacuucaccgaccccgccuccaucgcggcccgcggcuacaucagcacccgggucgggaugggcgaggccgccgccaucuucaugaccgcgacgccgcccggguccguggaggccuucccgcagagcaacgccgugauccaggacgaggagcgcgacauccccgagcgguccuggaacagcggcuacgacuggaucaccgacuuccccggcaagaccgucugguucgugcccuccaucaagagcgggaacgacaucgccaacugccugcgcaagaacggcaagcgggugauccagcucucccgcaagaccuucgacacggaguaccagaagaccaagaacaacgacugggacuacgucgugaccaccgacaucagcgagaugggggccaacuuccgggcggaccgcgugaucgacccgcggcgcugccugaagcccgucauccugaaggacggccccgagcgggugauccucgccgggcccaugccggucacggccgccuccgcggcccagcgccgcggccggaucggccgcaaccagaacaaggagggggaccaguacaucuacaugggccagccccugaacaacgacgaggaccacgcccacuggaccgaggccaagaugcugcucgacaacaucaacacccccgaggggaucauccccgcccuguucgagccggagcgggagaaguccgcggccaucgacggcgaguaccgccugcgcggggaggcccgcaagaccuucguggagcucaugcggcgcggcgaccugcccguguggcuguccuacaaggucgccagcgagggcuuccaguacuccgaccggcgcuggugcuucgacggggagcggaacaaccaggugcucgaggagaacauggacguggagaucuggacgaaggagggcgagcgcaagaagcugcggccccgcuggcuggacgcccggaccuacagcgacccccucgcgcugcgcgaguucaaggaguucgccgccgggcggcgcagcgucuccggcgaccugauccucgagaucggcaagcugccgcagcaccugacccuccgggcccagaacgcccuggacaaccuggugaugcuccacaacagcgagcagggcgggaaggcguaccgccacgccauggaggagcugcccgacaccaucgagacccugaugcuccuggcccugaucgccgugcucaccggcggggucacccuguucuuccuguccgggaaggggcucggcaagaccagcaucgggcugcugugcgugauggcguccagcgugcuccuguggauggccuccgucgagccccacuggaucgccgccagcaucauccuggaguucuuccucauggugcugcugauccccgagccggaccggcagcgcacgccccaggacaaccagcucgccuacguggucaucggccugcuguucaugauccucacgguggcggccaacgagauggggcugcuggagaccaccaagaaggaccucggcaucgggcacguggucgccgagaaccaccaccacgccaccaugcuggacaucgaccugcaccccgccuccgcguggacgcucuacgccguggccaccaccaucaucaccccgaugaugcgccacacgaucgagaacaccaccgccaacaucagccugaccgccaucgcgaaccaggccgccauccugaugggccucgacaagggcuggcccaucuccaagauggacaucggggugccccugcuggcccucggcugcuacagccaggucaacccccugacgcugaccgccgcggugcucaugcugguggcccacuacgccaucaucgggccgggccugcaggccaaggcgacccgggaggcccagaagcgcaccgccgccgggaucaugaagaaccccacggucgacggcaucguggccaucgaccucgaccccguggucuacgacgcgaaguucgagaagcagcugggccagaucaugcugcucauccugugcaccucccagauccugcucaugcggaccaccugggcccugugcgagagcaucacgcuggccaccgggccccucaccacccugugggagggcuccccggggaaguucuggaacacgaccaucgccgugagcauggccaacaucuuccgcggcuccuaccuggcgggcgccgggcucgccuucagccugaugaagucccugggcgggggccggcgcgggaccggcgcccagggcgagacccucggggagaaguggaagcggcagcugaaccagcugagcaagagcgaguucaacacguacaagcgcuccggcaucauggagguggaccggagcgaggccaaggaggggcucaagcgcggcgagaccaccaagcacgcggucucccgggggaccgccaagcugcgcugguucguggagcggaaccuggugaagcccgagggcaaggucaucgaccugggcugcgggcgcggcggguggagcuacuacugcgccggccucaagaaggugacggaggugaagggguacaccaagggcggccccgggcacgaggagcccaucccgauggccaccuacggcuggaacaucgucaagcugcacuccgggcgggacguguucuucacgccgcccgagaagugcgacacccugcucugcgacaucggcgagagcucccccaacccgacgaucgaggaggggcgcacccugcgggugcugaagauggucgagcccuggcuccgcggcaaccaguucugcaucaagauccugaaccccuacaugcccagcgugguggagacccuggagcagaugcagcggaagcacggcgggaugcucguccgcaacccgcugucccgcaacagcacccacgagauguacuggguguccugcggcacggggaacaucgugagcgcggucaacaugaccucccggaugcugcucaaccgcuucaccauggcccaccggaagcccaccuacgagcgcgacguggaccugggcgccggcacgcggcacguggccgucgagcccgagaccgccaaccuggacaucaucgggcagcgcaucgagaacaucaagaacgagcacaagagcaccuggcacuacgacgaggacaaccccuacaagaccugggcguaccacggcuccuacgaggugaagccgagcggguccgccagcuccauggugaacggcgucgugcggcuccugacgaagcccugggacgucauccccauggugacccagaucgccaugaccgacaccacgcccuucgggcagcagcgcguguucaaggagaaggucgacacccggaccccgcgccccaagcggggcaccgcccagaucauggaggugacggccaaguggcuguggggcuuccucagccgcaacaagaagccccggaucugcacccgcgaggaguucacccggaaggugcgcagcaacgcggccaucggggccgucuucguggacgagaaccaguggaacuccgccaaggaggccguggaggacgagcgguucugggaccugguccaccgcgagcgggagcugcacaagcagggcaagugcgcgaccugcguguacaacaugauggggaagcgcgagaagaagcucggcgaguucgggaaggccaagggcagccgggccaucugguacauguggcugggcgcccgcuuccuggaguucgaggcgcucggguucaugaacgaggaccacugguucucccgcgagaacagccuguccggcguggagggggagggccugcacaagcucggguacauccugcgggacaucagcaagaucccgggcggcaacauguacgccgacgacacggccgggugggacacccgcaucaccgaggacgaccugcagaacgaggccaagaucaccgacaucauggagcccgagcacgcccuccuggcgacguccaucuucaagcugaccuaccagaacaaggucgugcgggugcagcgccccgccaagagcggcaccgucauggacgugaucucccggcgcgaccagcgggggagcggccaggugggcaccuacgggcucaacacguucaccaacauggagguccagcugauccgccagauggaguccgagggcaucuucagccccuccgagcuggagaacagcaaccucgccgagcgggugcuggacuggcuggagaagcacgggguggagcgccucaagcggauggccaucuccggcgacgacugcgucgugaagccgaccgacgaccgcuucgccaccgcgcugacggcccugaacgacauggggaaggugcggaaggacaucccccagugggagcccagcaagggcuggaacgacuggcagcagguccccuucugcucccaccacuuccaccagcucaucaugaaggacggccgcgagaucguggugccgugccggaaccaggacgagcuggucgggcgcgcccgggugagccagggcgccggguggagccugcgcgagaccgccugccucggcaaguccuacgcgcagauguggcagcugauguacuuccaccggcgcgaccugcgccucgccgccaacgccaucugcagcgccgugcccgucaacugggugcccaccucccggaccaccuggagcauccacgcgcaccaccaguggaugacgaccgaggacaugcuguccguguggaaccgcgucuggaucgaggagaaccccuggauggaggacaagacccacgugagcuccugggaggacgugccguaccuggggaagcgggaggaccaguggugcggcagccucaucggccugaccgcccgcgccacgugggccaccaacauccaggucgcgaucaaccaggugcggcgccugaucgggaacgagaacuaccucgacuacaugaccuccaugaagcgguucaagaacgagagcgaccccgagggcgcccugugguga

SEQ ID NO: 8927 - RNA, 9879 nt, Artificial Sequence
  derived and/or modified CDS sequence (opt1) from DENV-1__KM403604__SS-prME
agcgugaccaugcugcucaugcugcugcccaccgcccucgccuuccaccugaccacccggggcggggagccccacaugaucgugagcaagcaggagcggggcaagagccuccuguucaagaccuccgcgggggugaacaugugcacccugaucgccauggaccugggcgagcucugcgaggacacgaugaccuacaagugcccccggaucaccgaggccgagcccgacgacguggacugcuggugcaacgccaccgacaccugggugaccuacgggaccugcagccagaccggcgagcaccggcgcgacaagcgguccguggcccuggcgccccacgugggccuggggcucgagacccgcaccgagaccuggaugagcuccgagggcgccuggcggcagauccagaagguggagaccugggcccugcgccaccccggguucacggugaucgcccuguuccucgcgcacgccaucggcaccagcaucacccagaaggggaucaucuucauccugcugaugcucgugacccccuccauggccaugcggugcgucggcaucggcaaccgcgacuucguggaggggcugagcggcgccacguggguggacgucgugcuggagcacggguccugcgugaccaccauggccaagaacaagcccacccucgacaucgagcugcugaagacggaggucaccaaccccgcggugcuccggaagcugugcaucgaggccaagaucagcaacaccaccacggacucccgcugccccacccagggcgaggccacccugguggaggagcaggacgccaacuucgucugccggcgcaccuucguggaccggggcugggggaacggcugcggccucuucggcaaggggagccugcugacgugcgccaaguucaagugcgugaccaagcucgagggcaagaucguccaguacgagaaccugaaguacuccgugaucgugaccguccacaccggcgaccagcaccagguggggaacgagacgaccgagcagggcaccaucgcgaccaucacgccccaggcccccacgagcgagauccagcugaccgacuacggggcccucacccuggacugcagcccccggaccggccuggacuucaacgagaugguccuccugacgaugaaggagaaguccuggcuggugcacaagcagugguuccucgaccugccgcugcccuggaccuccggggccagcaccagccaggagaccuggaaccggcaggaccuccuggugacguucaagaccgcccacgcgaagaagcaggaggucguggugcugggcucccaggagggcgccaugcacaccgcccucaccggggccacggagauccagaccagcggcaccaccacgaucuucgccgggcaccugaagugccgccugaagauggacaagcucacccugaagggcgucuccuacgugaugugcaccgggagcuucaagcuggagaaggagguggcggagacccagcacggcacgguccugguccaggugaaguacgagggcaccgacgcccccugcaagauccccaucuccacccaggacgagaagggggucacccagaacggccggcucaucacggccaacccgaucgugaccgacaaggagaagcccgugaacaucgagaccgagccgcccuucggggagagcuacaucgucaucggcgccggcgagaaggcgcugaagcuguccugguucaagaaggggagcuccaucggcaagauguucgaggccaccgcccgcggggcccggcgcauggccauccucggcgacacggcgugggacuucgggagcaucggcggcguguucaccuccguggggaagcugguccaccagguguucggcaccgccuacggggugcuguucagcggcgucuccuggaccaugaagaucgggaucggcauccuccugacguggcugggccucaacagccgcuccaccagccuguccaugaccugcaucgccguggggauggugacccuguaccucggcgucauggugcaggccgacagcgggugcgugaucaacuggaagggccgggagcugaagugcggguccggcaucuucgucacgaacgaggugcacaccuggaccgagcaguacaaguuccaggccgacagcccgaagcgccugagcgcggccaucggcaaggccugggaggagggggugugcggcauccgguccgccacccgccucgagaacaucauguggaagcagaucagcaacgagcugaaccacauccugcucgagaacgacaugaaguucaccgucguggugggggacgccaacggcauccugacgcaggggaagaagaugauccggccccagcccauggagcacaaguacuccuggaaguccuggggcaaggcgaagaucaucggcgccgacacccagaacaccaccuucaucaucgacgggcccgacacgccggagugccccgacgaccagcgcgccuggaacaucugggaggucgaggacuacggcuucgggguguucaccaccaacaucuggcugaagcuccgggacuccuacacccagaugugcgaccaccgccugaugagcgccgcgaucaaggacuccaaggccgugcacgccgacaugggcuacuggaucgagagcgagaagaacgagacguggaagcuggcccgggccuccuucaucgaggucaagaccugcaucuggccccgcagccacacccucugguccaacggcgugcuggagagcgagaugaucauccccaagaucuacgggggcccgaucucccagcacaacuaccggcccggguacuucacccagacggcgggccccuggcaccuggggaagcucgagcuggacuucaaccugugcgagggcaccaccguggucguggacgagcacugcggcaaccgcgggccgagccuccggaccacgaccgugaccggcaagaucauccacgaguggugcugccgcuccugcacccugccgccccugcgguuccgcggggaggacggcugcugguacgggauggagauccggcccgucaaggagaaggaggagaaccucgugcgcagcaugguguccgccggcagcggcgaggucgacagcuucucccuggggcugcucugcgugagcaucaugaucgaggaggugaugcggucccgcuggagccgcaagaugcugaugacgggcacccuggccgucuucuuccuccugaucauggggcagcugaccuggaacgaccucauccggcugugcaucauggugggcgccaacguguccgaccgcauggggaugggcaccacguaccuggcccucauggcgaccuucaagaugcggccgauguucgccgucgggcugcuguuccgccggcucaccagccgcgaggugcugcugcucaccaucgggcugucccuggucgccagcguggagcuccccaacucccuggaggagcugggcgacgggcucgccaugggcaucaugaugcugaagcugcucacggacuuccagagccaccagcuguggaccacccugcucucccugaccuucaucaagacgacccugagccucgacuacgccuggaagaccauggcgauggugcuguccaucgucagccuguucccccucugccuguccaccacgagccagaagaccaccuggcugcccgugcuccugggcuccuucgggugcaagccgcugaccauguuccucaucaccgagaacaagaucuggggccgcaagagcuggccccugaacgaggggaucauggccgugggcaucgucuccauccugcucagcagccugcugaagaacgacgugccccucgccgggccccugaucgccggcggcaugcugaucgcgugcuacgugaucuccgggagcuccgccgaccucagccuggagcgcgccgccgaggucuccugggaggaggaggccgagcacagcggcgcgucccacaacauccugguggaggugcaggacgacgggacgaugaagaucaaggacgaggagcgggacgacacccucaccauccugcugaaggccacccuccuggccgucagcggcguguacccgauguccauccccgccacgcuguucgugugguacuucuggcagaagaagaagcagcgcagcgggguccucugggacacccccagcccgcccgagguggagcgggccgugcuggacgacggcaucuaccgcauccugcagcggggccugcucgggcgcagccaggucggcguggggguguuccaggacggcgucuuccacaccauguggcacgugacccgcggggcggugcugauguaccagggcaagcgccuggagcccuccugggccagcgucaagaaggaccucaucuccuacggcgggggcuggcgguuccaggggagcuggaacacgggcgaggagguccaggugaucgccgucgagcccgggaagaaccccaagaacgugcagaccacccccggcaccuucaagacgcccgagggcgaggugggggccaucgcccuggacuucaagcccggcaccuccgggagccccaucgucaaccgcgagggcaagaucgugggccuguacgggaacggcguggucaccaccuccgggacguacgugagcgcgaucgcccaggccaaggccagccaggagggcccgcuccccgagaucgaggacgagguguucaagaagcggaaccugaccaucauggaccugcaccccggguccggcaagacccgccgguaccucccggccaucguccgcgaggcgaucaagcgcaagcugcggacccugauccucgcccccacgcgcgugguggccagcgagauggccgaggcgcugaagggcaugcccauccgguaccagaccaccgccgucaaguccgagcacaccgggaaggagaucguggaccugaugugccacgccacguucaccaugcgccuccugagccccgugcgggucccgaacuacaacaugaucaucauggacgaggcccacuucaccgaccccgccuccaucgcggcccgcggcuacaucagcacccggguggggaugggcgaggccgccgccaucuucaugacggcgacgccgcccggguccguggaggccuucccgcagagcaacgccgucauccaggacgaggagcgcgacauccccgagcgguccuggaacagcggcuacgacuggaucaccgacuuccccggcaagaccgugugguucgugcccuccaucaagagcgggaacgacaucgccaacugccugcgcaagaacggcaagcgggucauccagcucucccgcaagacguucgacaccgaguaccagaagaccaagaacaacgacugggacuacguggugaccacggacaucagcgagaugggggccaacuuccgggcggaccgcgucaucgacccgcggcgcugccugaagcccgugauccugaaggacggccccgagcgggucauccucgccgggcccaugccggugaccgccgccuccgcggcccagcgccggggccgcaucggccgcaaccagaacaaggagggggaccaguacaucuacaugggccagccccugaacaacgacgaggaccacgcccacuggaccgaggccaagaugcugcucgacaacaucaacacccccgaggggaucauccccgcccuguucgagccggagcgggagaaguccgcggccaucgacggcgaguaccgccugcgcggggaggcccgcaagacguucguggagcucaugcggcgcggcgaccugcccgucuggcuguccuacaagguggccagcgagggcuuccaguacuccgaccggcgcuggugcuucgacggggagcggaacaaccaggugcucgaggagaacauggacgucgagaucuggaccaaggagggcgagcgcaagaagcugcggccccgcuggcuggacgcccggaccuacagcgacccccucgcgcugcgcgaguucaaggaguucgccgccgggcggcgcagcguguccggcgaccugauccucgagaucggcaagcugccgcagcaccugacccuccgggcccagaacgcccuggacaaccuggugaugcuccacaacagcgagcagggcgggaaggcguaccgccacgccauggaggagcugcccgacaccaucgagacgcugaugcuccuggcccugaucgccguccucaccgggggcgugacccuguucuuccuguccgggaagggccucggcaagaccagcaucgggcugcugugcgugauggcguccagcguccuccuguggauggccuccguggagccccacuggaucgccgccagcaucauccuggaguucuuccucauggugcugcugauccccgagccggaccggcagcgcacgccccaggacaaccagcucgccuacgucgugaucggccugcuguucaugauccucaccguggcggccaacgagauggggcugcuggagaccaccaagaaggaccucggcaucgggcacgucguggccgagaaccaccaccacgccacgaugcuggacaucgaccugcaccccgccuccgcguggacccucuacgccguggccaccaccaucaucacgccgaugaugcggcacaccaucgagaacaccaccgccaacaucagccugacggccaucgcgaaccaggccgccauccugaugggccucgacaagggcuggcccaucuccaagauggacaucggggucccccugcuggcccucggcugcuacagccaggugaacccccugacccugaccgccgcggugcucaugcuggucgcccacuacgccaucaucgggccgggccugcaggccaaggcgacccgcgaggcccagaagcgcacggccgccgggaucaugaagaaccccaccguggacggcaucguggccaucgaccucgaccccgucguguacgacgcgaaguucgagaagcagcugggccagaucaugcugcucauccugugcaccucccagauccugcucaugcggaccacgugggcccugugcgagagcaucacccuggccaccgggccccucaccacgcugugggagggcuccccggggaaguucuggaacaccaccaucgccgugagcauggccaacaucuuccgcggcuccuaccuggcgggcgccgggcucgccuucagccugaugaagucccugggcgggggccggcgcgggaccggcgcccagggcgagacgcucggggagaaguggaagcggcagcugaaccagcugagcaagagcgaguucaacaccuacaagcgcuccggcaucauggaggucgaccggagcgaggccaaggaggggcucaagcgcggcgagaccaccaagcacgcggugucccgggggacggccaagcugcgcugguucguggagcggaaccuggucaagcccgagggcaaggugaucgaccugggcugcgggcgcggcggguggagcuacuacugcgccggccucaagaaggugaccgaggucaagggguacaccaagggcggccccgggcacgaggagcccaucccgauggccaccuacggcuggaacaucgugaagcugcacuccgggcgggacguguucuucacgccgcccgagaagugcgacacgcugcucugcgacaucggcgagagcucccccaacccgaccaucgaggaggggcgcacccugcggguccugaagaugguggagcccuggcuccgcggcaaccaguucugcaucaagauccugaaccccuacaugcccagcguggucgagacccuggagcagaugcagcggaagcacggcgggaugcucgugcgcaacccgcugucccggaacagcacgcacgagauguacuggguguccugcggcaccgggaacaucgucagcgcggugaacaugaccucccgcaugcugcucaaccgcuucaccauggcccaccggaagcccacguacgagcgcgacguggaccugggcgccggcacccggcacgucgccguggagcccgagaucgccaaccuggacaucaucgggcagcgcaucgagaacaucaagaacgagcacaagagcaccuggcacuacgacgaggacaaccccuacaagaccugggcguaccacggcuccuacgaggugaagccgagcggguccgccagcuccauggucaacggcgugguccggcuccugacgaagcccugggacgugauccccauggugacccagaucgccaugaccgacaccacgcccuucgggcagcagcgcgucuucaaggagaagguggacacccggaccccgcgccccaagcggggcaccgcccagaucauggaggugacggccaaguggcuguggggcuuccucagccgcaacaagaagccccggaucugcacccgcgaggaguucacccggaagguccgcagcaacgcggccaucggggccguguucguggacgagaaccaguggaacuccgccaaggaggccgucgaggacgagcgguucugggaccuggugcaccgcgagcgggagcugcacaagcagggcaagugcgcgaccugcguguacaacaugauggggaagcgcgagaagaagcucggcgaguucgggaaggccaagggcagccgggccaucugguacauguggcugggcgcccgcuuccuggaguucgaggcgcucggguucaugaacgaggaccacugguucucccgggagaacagccuguccggcgucgagggggagggccugcacaagcucggguacauccugcgcgacaucagcaagaucccgggcggcaacauguacgccgacgacacggccgggugggacacccgcaucaccgaggacgaccugcagaacgaggccaagaucaccgacaucauggagcccgagcacgcccuccuggcgacguccaucuucaagcugaccuaccagaacaagguggugcggguccagcgccccgccaagagcggcaccgugauggacgugaucucccggcgcgaccagcgggggagcggccaggucggcaccuacgggcucaacacguucaccaacauggaggugcagcugauccgccagauggaguccgagggcaucuucagccccuccgagcuggagaacagcaaccucgccgagcgggugcuggacuggcuggagaagcacggggucgagcgccucaagcggauggccaucuccggcgacgacugcguggugaagccgaccgacgaccgcuucgccaccgcgcugaucgcccugaacgacauggggaagguccggaaggacaucccccagugggagcccagcaagggcuggaacgacuggcagcagguccccuucugcucccaccacuuccaccagcucaucaugaaggacggccgcgagaucguggucccgugccggaaccaggacgagcugguggggcgcgcccgggugagccagggcgccggguggagccugcgcgagacggccugccucggcaaguccuacgcgcagauguggcagcugauguacuuccaccggcgcgaccugcggcucgccgccaacgccaucugcagcgccguccccgugaacugggugcccaccucccgcaccaccuggagcauccacgcgcaccaccaguggaugaccacggaggacaugcuguccgucuggaaccgcguguggaucgaggagaaccccuggauggaggacaagacccacgugagcuccugggaggacgucccguaccuggggaagcgggaggaccaguggugcggcagccucaucggccugaccgcccgcgccaccugggccacgaacauccagguggcgaucaaccaggugcggcgccugaucgggaacgagaacuaccucgacuacaugaccuccaugaagcgguucaagaacgagagcgaccccgagggcgcccugugguga

SEQ ID NO: 8928 - RNA, 9879 nt, Artificial Sequence
  derived and/or modified CDS sequence (opt1) from DENV-1__KM403588__SS-prME
agcgugaccaugcugcucaugcugcugcccaccgcccucgccuuccaccugaccacccgcggcggggagccccacaugaucgugagcaagcaggagcggggcaagagccugcuguucaagaccuccgccggggugaacaugugcacccugaucgccauggaccugggcgagcucugcgaggacaccaugaccuacaagugcccccggaucaccgaggccgagcccgacgacguggacugcuggugcaacgccaccgacacgugggugaccuacgggaccugcagccagaccggcgagcaccggcgcgacaagcgguccguggcccuggcgccccacgugggccuggggcucgagacccgcaccgagaccuggaugagcuccgagggcgccuggcggcagauccagaagguggagaccugggcccugcgccaccccggguucacggugaucgcccuguuccucgcgcacgccaucggcaccagcaucacccagaaggggaucaucuucauccugcugaugcucgugacccccuccauggccaugcggugcgucggcaucggcaaccgcgacuucguggaggggcugagcggcgccacguggguggacgucgugcuggagcacggguccugcgugaccaccauggccaagaacaagcccacccucgacaucgagcugcugaagacggaggucaccaaccccgcggugcuccggaagcugugcaucgaggccaagaucagcaacaccaccacggacucccgcugccccacccagggcgaggccacccugguggaggagcaggacgccaacuucgucugccggcgcaccuucguggaccggggcugggggaacggcugcggccucuucggcaaggggagccugcugacgugcgccaaguucaagugcgugaccaagcucgagggcaagaucguccaguacgagaaccugaaguacuccgugaucgugaccguccacaccggcgaccagcaccagguggggaacgagacgaccgagcacggcaccaucgcgaccaucacgccccaggcccccacgagcgagauccagcugaccgacuacggggcccucacccuggacugcagcccccggaccggccuggacuucaacgagaugguccuccugacgaugaaggagaaguccuggcuggugcacaagcagugguuccucgaccugccgcugcccuggaccuccggggccagcaccagccaggagaccuggaaccggcaggaccuccuggugacguucaagaccgcccacgcgaagaagcaggaggucguggugcugggcucccaggagggcgccaugcacaccgcccucaccggggccacggagauccagaccagcggcaccaccacgaucuucgccgggcaccugaagugccgccugaagaugggcaagcucacccugaagggggucuccuacgugaugugcaccggcagcuucaagcuggagaaggagguggcggagacccagcacggcacgguccugguccaggugaaguacgaggggaccgacgcccccugcaagauccccaucuccacccaggacgagaagggcgucacccagaacgggcggcucaucacggccaacccgaucgugaccgacaaggagaagcccgugaacaucgagaccgagccgcccuucggcgagagcuacaucgucaucggcgccggggagaaggcgcugaagcuguccugguucaagaagggcagcuccaucgggaagauguucgaggccaccgcccgcggcgcccggcgcauggccauccucggggacaucgcgugggacuucggcagcaucggcgggguguucacguccgugggcaagcugguccaccagguguucgggaccgccuacggcgugcuguucagcggggucuccuggaccaugaagaucggcaucggcauccuccugaccuggcuggggcucaacagccgcuccacgagccuguccaugaccugcaucgccgugggcauggugacccuguaccucggggucauggugcaggccgacagcggcugcgugaucaacuggaaggggcgggagcugaagugcggcuccggcaucuucgucaccaacgaggugcacacguggaccgagcaguacaaguuccaggccgacagcccgaagcgccugagcgcggccaucgggaaggccugggaggagggcgugugcgggauccgguccgccacccgccucgagaacaucauguggaagcagaucagcaacgagcugaaccacauccugcucgagaacgacaugaaguucaccgucguggugggcgacgccaacgggauccugacccagggcaagaagaugauccggccccagcccauggagcacaaguacuccuggaaguccuggggcaaggcgaagaucaucggggccgacacgcagaacaccaccuucaucaucgacggccccgacaccccggagugccccgacgaccagcgcgccuggaacaucugggaggucgaggacuacggguucggcguguucacgaccaacaucuggcugaagcuccgggacuccuacacccagaugugcgaccaccgccugaugagcgccgcgauccgggacuccaaggccgugcacgccgacaugggcuacuggaucgagagcgagaagaacgagaccuggaagcuggcccgcgccuccuucaucgaggucaagacgugcaucuggccccggagccacacccucugguccaacggggugcuggagagcgagaugaucauccccaagaucuacggcgggccgaucucccagcacaacuaccgccccggcuacuucacccagaccgcggggcccuggcaccugggcaagcucgagcuggacuucaaccugugcgagggcacgaccguggucguggacgagcacugcgggaaccggggcccgagccuccgcaccaccacggugaccgggaagaucauccacgaguggugcugccgguccugcacccugccgccccugcgcuuccggggcgaggacgggugcugguacggcauggagauccgccccgucaaggagaaggaggagaaccucgugcggagcaugguguccgccggcagcggggaggucgacagcuucucccugggccugcucugcgugagcaucaugaucgaggaggugaugcgcucccgcuggagccggaagaugcugaugaccgggacgcuggccgucuucuuccuccugaucaugggccagcugaccuggaacgaccucauccgccugugcaucauggugggggccaacguguccgaccggaugggcaugggcaccaccuaccuggcccucauggcgacguucaagaugcgcccgauguucgccgucgggcugcuguuccggcgccucaccagccgggaggugcugcugcucaccaucggccugucccuggucgccagcguggagcuccccaacucccuggaggagcugggggacggccucgccaugggcaucaugaugcugaagcugcucaccgacuuccagagccaccagcuguggacgacccugcucucccugaccuucaucaagaccacgcugagccucgacuacgccuggaagaccauggcgauggugcuguccaucgucagccuguucccccucugccuguccaccaccagccagaagacgaccuggcugcccgugcuccugggguccuucggcugcaagccgcugaccauguuccucaucaccgagaacaagaucugggggcgcaagagcuggccccugaacgagggcaucauggccguggggaucgucuccauccugcucagcagccugcugaagaacgacgugccccucgccggcccccugaucgccggcgggaugcugaucgcgugcuacgugaucuccggcagcuccgccgaccucagccuggagcgggccgccgaggucuccugggaggaggaggccgagcacagcggggcgucccacaacauccugguggaggugcaggacgacggcaccaugaagaucaaggacgaggagcgcgacgacacgcucaccauccugcugaaggccacccuccuggccgucagcgggguguacccgauguccauccccgccacccuguucgugugguacuucuggcagaagaagaagcagcggagcggcguccucugggacacgcccagcccgcccgagguggagcgcgccgugcuggacgacggcaucuaccggauccugcagcgcgggcugcucggccggagccaggucggggugggcguguuccaggacggggucuuccacaccauguggcacgugacccgcggcgcggugcugauguaccagggcaagcggcuggagcccuccugggccagcgucaagaaggaccucaucuccuacgggggcggguggcgcuuccagggcagcuggaacaccggggaggagguccaggugaucgccgucgagcccggcaagaaccccaagaacgugcagacgacccccggcaccuucaagacccccgagggggaggugggcgccaucgcccuggacuucaagcccgggacguccggcagccccaucgucaaccgggagggcaagaucguggggcuguacggcaacgggguggucaccaccuccggcaccuacgugagcgcgaucgcccaggccaaggccagccaggaggggccgcuccccgagaucgaggacgagguguucaagaagcgcaaccugacgaucauggaccugcaccccggcuccggcaagacccggcgcuaccucccggccaucguccgcgaggcgaucaagcggaagcugcgcacccugauccucgcccccacccgggugguggccagcgagauggccgaggcgcugaaggggaugcccauccgcuaccagacgaccgccgucaaguccgagcacaccggcaaggagaucguggaccugaugugccacgccaccuucacgaugcggcuccugagccccgugcgcgucccgaacuacaacaugaucaucauggacgaggcccacuucaccgaccccgccuccaucgcggcccggggguacaucagcacccgcgugggcaugggggaggccgccgccaucuucaugaccgcgacgccgcccggcuccguggaggccuucccgcagagcaacgccgucauccaggacgaggagcgggacauccccgagcgcuccuggaacagcggcuacgacuggaucaccgacuuccccgggaagaccgugugguucgugcccuccaucaagagcggcaacgacaucgccaacugccugcggaagaacgggaagcgcgucauccagcucucccggaagaccuucgacacggaguaccagaagaccaagaacaacgacugggacuacguggugaccaccgacaucagcgagaugggcgccaacuuccgcgcggaccgggucaucgacccgcgccggugccugaagcccgugauccugaaggacgggcccgagcgcgucauccucgccggccccaugccgguggccgccgcguccgccgcccagcggcgcggccgcaucgggcggaaccagaacaaggagggcgaccaguacaucuacauggggcagccccugaacaacgacgaggaccacgcccacuggacggaggccaagaugcugcucgacaacaucaacacccccgagggcaucauccccgcgcuguucgagccggagcgcgagaaguccgccgccaucgacggggaguaccggcugcgcggcgaggcccggaagaccuucguggagcucaugcgccggggcgaccugcccgucuggcuguccuacaagguggccagcgagggguuccaguacuccgaccgccgguggugcuucgacggcgagcgcaacaaccaggugcucgaggagaacauggacgucgagaucuggaccaaggagggggagcggaagaagcugcgcccccgguggcuggacgcgcgcacguacagcgacccccucgcccugcgggaguucaaggaguucgccgccggccgccggagcguguccggcgaccugauccucgagaucgggaagcugccgcagcaccugacccuccgcgcccagaacgcgcuggacaaccuggugaugcuccacaacagcgagcagggcgggaaggccuaccggcacgccauggaggagcugcccgacaccaucgagacccugaugcuccuggcccugaucgcgguccucaccggcggggugacgcuguucuuccuguccggcaagggccucgggaagaccagcaucggccugcugugcgugauggccuccagcguccuccuguggauggccuccguggagccccacuggaucgccgccagcaucauccuggaguucuuccucauggugcugcugauccccgagccggaccgccagcggacgccccaggacaaccagcucgcguacgucgugaucgggcugcuguucaugauccucaccguggccgccaacgagaugggccugcuggagacgaccaagaaggaccucgggaucggccacgucguggccgagaaccaccaccacgccaccaugcuggacaucgaccugcaccccgcguccgccuggacccucuacgccguggccacgaccaucaucaccccgaugaugcgccacaccaucgagaacacgaccgccaacaucagccugaccgcgaucgccaaccaggccgccauccugaugggccucgacaagggguggcccaucuccaagauggacaucggcgucccccugcuggcccucgggugcuacagccaggugaacccccugacccugacggcggccgugcucaugcuggucgcccacuacgccaucaucggcccggggcugcaggcgaaggccacccgcgaggcccagaagcggaccgccgccggcaucaugaagaaccccaccguggacggcaucguggcgaucgaccucgaccccgucguguacgacgccaaguucgagaagcagcuggggcagaucaugcugcucauccugugcacgucccagauccugcucaugcgcaccaccugggcccugugcgagagcaucacccuggccacgggcccccucaccacccugugggagggguccccgggcaaguucuggaacaccacgaucgccgugagcauggcgaacaucuuccggggcuccuaccuggccggggccggccucgccuucagccugaugaagucccucgggggcgggcgccgggggaccggcgcccagggggagacccucggcgagaaguggaagcgccagcugaaccagcugagcaagagcgaguucaacaccuacaagcgguccgggaucauggaggucgaccgcagcgaggcgaaggagggccucaagcgcggggagacgaccaagcacgccgugucccgcggcaccgccaagcugcggugguucguggagcgcaaccuggucaagcccgagggcaaggugaucgaccuggggugcggccgcgggggcuggagcuacuacugcgccgggcucaagaaggugaccgaggucaagggcuacacgaagggcgggcccggccacgaggagcccaucccgauggcgaccuacggguggaacaucgugaagcugcacuccggccgcgacguguucuucacgccgcccgagaagugcgacacccugcucugcgacaucggggagagcucccccaacccgaccaucgaggagggccggacgcugcgcguccugaagaugguggagcccuggcuccggggcaaccaguucugcaucaagauccugaaccccuacaugcccagcguggucgagacccuggagcagaugcagcgcaagcacgggggcaugcucgugcggaacccgcugucccgcaacagcacccacgagauguacuggguguccugcgggaccggcaacaucgucagcgccgugaacaugacgucccgcaugcugcucaaccgguucaccauggcccaccgcaagcccaccuacgagcgggacguggaccugggcgccgggacccgccacgucgccguggagcccgagaucgcgaaccuggacaucaucggccagcggaucgagaacaucaagaacgagcacaagagcacguggcacuacgacgaggacaaccccuacaagaccugggccuaccacggguccuacgaggugaagccgagcggcuccgccagcuccauggucaacggggugguccgccuccugaccaagcccugggacgugauccccauggugacccagaucgccaugacggacaccacccccuucggccagcagcgggucuucaaggagaagguggacacccgcacgccgcggcccaagcgcggcaccgcccagaucauggaggugaccgcgaaguggcuguggggguuccucagccggaacaagaagccccgcaucugcacccgggaggaguucacgcgcaagguccggagcaacgccgccaucggcgccguguucguggacgagaaccaguggaacuccgccaaggaggcggucgaggacgagcgcuucugggaccuggugcaccgggagcgcgagcugcacaagcaggggaagugcgcgaccugcguguacaacaugaugggcaagcgggagaagaagcucggggaguucggcaaggccaagggcagccgcgccaucugguacauguggcugggggcgcgguuccuggaguucgaggcccucggcuucaugaacgaggaccacugguucucccgcgagaacagccuguccggggucgagggcgaggggcugcacaagcucggcuacauccugcgcgacaucagcaagaucccgggcgggaacauguacgccgacgacaccgccggcugggacacccggaucacggaggacgaccugcagaacgaggccaagaucaccgacaucauggagcccgagcacgcgcuccuggccaccuccaucuucaagcugaccuaccagaacaagguggugcgcguccagcggcccgccaagagcgggacggugauggacgugaucucccgccgggaccagcgcggcagcggccaggucgggaccuacggccucaacaccuucaccaacauggaggugcagcugauccggcagauggaguccgaggggaucuucagccccuccgagcuggagaacagcaaccucgccgagcgcgugcuggacuggcuggagaagcacggcgucgagcggcucaagcgcauggccaucuccggggacgacugcguggugaagccgacggacgaccgguucgcgaccgcccugaccgcccugaacgacaugggcaagguccgcaaggacaucccccagugggagcccagcaagggcuggaacgacuggcagcagguccccuucugcucccaccacuuccaccagcucaucaugaaggacgggcgggagaucguggucccgugccgcaaccaggacgagcuggugggccgggcccgcgugagccagggggccggcuggagccugcgggagaccgcgugccucgggaaguccuacgcccagauguggcagcugauguacuuccaccgccgggaccugcgccucgccgccaacgccaucugcagcgcgguccccgugaacugggugcccacgucccgcaccaccuggagcauccacgcccaccaccaguggaugaccaccgaggacaugcuguccgucuggaaccggguguggaucgaggagaaccccuggauggaggacaagacgcacgugagcuccugggaggacgucccguaccugggcaagcgcgaggaccaguggugcggcagccucaucgggcugaccgcccgggccaccugggcgaccaacauccagguggccaucaaccaggugcgccggcugaucggcaacgagaacuaccucgacuacaugacguccaugaagcgcuucaagaacgagagcgaccccgagggggcccugugguga

SEQ ID NO: 8929 - RNA, 9879 nt, Artificial Sequence
  derived and/or modified CDS sequence (opt1) from DENV-1__KM403605__SS-prME
agcgugaccaugcugcucaugcugcugcccaccgcccucgccuuccaccugaccacccggggcggggagccccacaugaucgugagcaagcaggagcggggcaagagccuccuguucaagaccuccgcgggggugaacaugugcacccugaucgccauggaccugggcgagcucugcgaggacacgaugaccuacaagugcccccggaucaccgaggccgagcccgacgacguggacugcuggugcaacgccaccgacaccugggugaccuacgggaccugcagccagaccggcgagcaccggcgcgacaagcgguccguggcccuggcgccccacgugggccuggggcucgagacgcgcaccgagaccuggaugagcuccgagggcgccuggcggcagauccagaaggucgagaccugggcccugcgccaccccggguucacggugaucgcccuguuccucgcgcacgccaucggcaccagcaucacccagaaggggaucaucuucauccugcugaugcucgugacccccuccauggccaugcggugcgucggcaucggcaaccgcgacuucguggaggggcugagcggcgccacguggguggacgucgugcuggagcacggguccugcgugaccaccauggccaagaacaagcccacccucgacaucgagcugcugaagacggaggucaccaaccccgcggugcuccggaagcugugcaucgaggccaagaucagcaacaccaccacggacucccgcugccccacccagggcgaggccacccugguggaggagcaggacgccaacuucgucugccggcgcaccuucguggaccggggcugggggaacggcugcggccucuucggcaaggggagccugcugacgugcgccaaguucaagugcgugaccaagcucgagggcaagaucguccaguacgagaaccugaaguacuccgugaucgugaccguccacaccggcgaccagcaccagguggggaacgagacgaccgagcacggcaccaucgcgaccaucacgccccaggcccccacgagcgagauccagcugaccgacuacggggcccucacccuggacugcagcccccggaccggccuggacuucaacgagaugguccuccugacgaugaaggagaaguccuggcuggugcacaagcagugguuccucgaccugccgcugcccuggaccuccggggccagcaccagccaggagaccuggaaccggcaggaccuccuggugacguucaagaccgcccacgcgaagaagcaggaggucguggugcugggcucccaggagggcgccaugcacaccgcccucaccggggccacggagauccagaccagcggcaccaccacgaucuucgccgggcaccugaagugccgccugaagauggacaagcucacccugaagggcgucuccuacgugaugugcaccgggagcuucaagcuggagaaggagguggcggagacccagcacggcacgguccugguccaggugaaguacgagggcaccgacgcccccugcaagauccccaucuccauccaggacgagaagggggucacccagaacggccggcucaucaccgccaacccgaucgugacggacaaggagaagcccgugaacaucgagaccgagccgcccuucggggagagcuacaucgucaucggcgccggcgagaaggcgcugaagcuguccugguucaagaaggggagcuccaucggcaagauguucgaggccaccgcccgcggggcccggcgcauggccauccucggcgacaccgcgugggacuucgggagcaucggcggcguguucacguccguggggaagcugguccaccagguguucggcaccgccuacggggugcuguucagcggcgucuccuggaccaugaagaucgggaucggcauccuccugaccuggcugggccucaacagccgcuccacgagccuguccaugaccugcaucgccguggggauggugacccuguaccucggcgucauggugcaggccgacagcgggugcgugaucaacuggaagggccgggagcugaagugcggguccggcaucuucgucaccaacgaggugcacacguggaccgagcaguacaaguuccaggccgacagcccgaagcgccugagcgcggccaucggcaaggccugggaggagggggugugcggcauccgguccgccacccgccucgagaacaucauguggaagcagaucagcaacgagcugaaccacauccugcucgagaacgacaugaaguucaccgucguggugggggacgccaacggcauccugacccaggggaagaagaugauccggccccagcccauggagcacaaguacuccuggaaguccuggggcaaggcgaagaucaucggcgccgacacgcagaacaccaccuucaucaucgacgggcccgacaccccggagugccccgacgaccagcgcgccuggaacaucugggaggucgaggacuacggcuucgggguguucacgaccaacaucuggcugaagcuccgggacuccuacacccagaugugcgaccaccgccugaugagcgccgcgaucaaggacuccaaggccgugcacgccgacaugggcuacuggaucgagagcgagaagaacgagaccuggaagcuggcccgggccuccuucaucgaggucaagacgugcaucuggccccgcagccacacccucugguccaacggcgugcuggagagcgagaugaucauccccaagaucuacgggggcccgaucucccagcacaacuaccggcccggguacuucacccagaccgcgggccccuggcaccuggggaagcucgagcuggacuucaaccugugcgagggcacgaccguggucguggacgagcacugcggcaaccgcgggccgagccuccggaccaccacggugaccggcaagaucauccacgaguggugcugccgcuccugcacccugccgccccugcgguuccgcggggaggacggcugcugguacgggauggagauccggcccgucaaggagaaggaggagaaccucgugcgcagcaugguguccgccggcagcggcgaggucgacagcuucucccuggggcugcucugcgugagcaucaugaucgaggaggugaugcggucccgcuggagccgcaagaugcugaugaccggcacgcuggccgucuucuuccuccugaucauggggcagcugaccuggaacgaccucauccggcugugcaucauggugggcgccaacguguccgaccgcauggggaugggcaccaccuaccuggcccucauggcgacguucaagaugcggccgauguucgccgucggccugcuguuccgccggcucaccagccgcgaggugcugcugcucaccaucgggcugucccuggucgccagcguggagcuccccaacucccuggaggagcugggcgacgggcucgccaugggcaucaugaugcugaagcugcucaccgacuuccagagccaccagcuguggacgacccugcucucccugaccuucaucaagaccacgcugagccucgacuacgccuggaagaccauggcgauggugcuguccaucgucagccuguucccccucugccuguccaccaccagccagaagacgaccuggcugcccgugcuccugggcuccuucgggugcaagccgcugaccauguuccucaucaccgagaacaagaucuggggccgcaagagcuggccccugaacgaggggaucauggccgugggcaucgucuccauccugcucagcagccugcugaagaacgacgugccccucgccgggccccugaucgccggcggcaugcugaucgcgugcuacgugaucuccgggagcuccgccgaccucagccuggagcgcgccgccgaggucuccugggaggaggaggccgagcacagcggcgcgucccacaacauccugguggaggugcaggacgacgggaccaugaagaucaaggacgaggagcgggacgacacgcucaccauccugcugaaggccacccuccuggccgucagcggcguguacccgauguccauccccgccacccuguucgugugguacuucuggcagaagaagaagcagcgcagcgggguccucugggacacgcccagcccgcccgagguggagcgggccgugcuggacgacggcaucuaccgcauccugcagcggggccugcucgggcgcagccaggucggcguggggguguuccaggacggcgucuuccacaccauguggcacgugacccgcggggcggugcugauguaccagggcaagcgccuggagcccuccugggccagcgucaagaaggaccucaucuccuacggcgggggcuggcgguuccaggggagcuggaacaccggcgaggagguccaggugaucgccgucgagcccgggaagaaccccaagaacgugcagacgacccccggcaccuucaagacccccgagggcgaggugggggccaucgcccuggacuucaagcccggcacguccgggagccccaucgucaaccgcgagggcaagaucgugggccuguacgggaacggcguggucaccaccuccgggaccuacgugagcgcgaucgcccaggccaaggccagccaggagggcccgcuccccgagaucgaggacgagguguucaagaagcggaaccugacgaucauggaccugcaccccggguccggcaagacccgccgguaccucccggccaucguccgcgaggcgaucaagcgcaagcugcggacccugauccucgcccccacccgcgugguggccagcgagauggccgaggcgcugaagggcaugcccauccgguaccagacgaccgccgucaaguccgagcacaccgggaaggagaucguggaccugaugugccacgccaccuucacgaugcgccuccugagccccgugcgggucccgaacuacaacaugaucaucauggacgaggcccacuucaccgaccccgccuccaucgcggcccgcggcuacaucagcacccggguggggaugggcgaggccgccgccaucuucaugaccgcgacgccgcccggguccguggaggccuucccgcagagcaacgccgucauccaggacgaggagcgcgacauccccgagcgguccuggaacagcggcuacgacuggaucaccgacuuccccggcaagaccgugugguucgugcccuccaucaagagcgggaacgacaucgccaacugccugcgcaagaacggcaagcgggucauccagcucucccgcaagaccuucgacacggaguaccagaagaccaagaacaacgacugggacuacguggugaccaccgacaucagcgagaugggggccaacuuccgggcggaccgcgucaucgacccgcggcgcugccugaagcccgugauccugaaggacggccccgagcgggucauccucgccgggcccaugccggugacggccgccuccgcggcccagcgccggggccgcaucggccgcaaccagaacaaggagggggaccaguacaucuacaugggccagccccugaacaacgacgaggaccacgcccacuggaccgaggccaagaugcugcucgacaacaucaacacccccgaggggaucauccccgcccuguucgagccggagcgggagaaguccgcggccaucgacggcgaguaccgccugcgcggggaggcccgcaagaccuucguggagcucaugcggcgcggcgaccugcccgucuggcuguccuacaagguggccagcgagggcuuccaguacuccgaccggcgcuggugcuucgacggggagcggaacaaccaggugcucgaggagaacauggacgucgagaucuggacgaaggagggcgagcgcaagaagcugcggccccgcuggcuggacgcccggaccuacagcgacccccucgcgcugcgcgaguucaaggaguucgccgccgggcggcgcagcguguccggcgaccugauccucgagaucggcaagcugccgcagcaccugacccuccgggcccagaacgcccuggacaaccuggugaugcuccacaacagcgagcagggcgggaaggcguaccgccacgccauggaggagcugcccgacaccaucgagacccugaugcuccuggcccugaucgccguccucaccggcggggugacccuguucuuccuguccgggaaggggcucggcaagaccagcaucgggcugcugugcgugauggcguccagcguccuccuguggauggccuccguggagccccacuggaucgccgccagcaucauccuggaguucuuccucauggugcugcugauccccgagccggaccggcagcgcacgccccaggacaaccagcucgccuacgucgugaucggccugcuguucaugauccucacgguggcggccaacgagauggggcugcuggagaccaccaagaaggaccucggcaucgggcacgucguggccgagaaccaccaccacgccaccaugcuggacaucgaccugcaccccgccuccgcguggacgcucuacgccguggccaccaccaucaucaccccgaugaugcggcacacgaucgagaacaccaccgccaacaucagccugaccgccaucgcgaaccaggccgccauccugaugggccucgacaagggcuggcccaucuccaagauggacaucggggucccccugcuggcccucggcugcuacagccaggugaacccccugacgcugaccgccgcggugcucaugcuggucgcccacuacgccaucaucgggccgggccugcaggccaaggcgacccgcgaggcccagaagcgcaccgccgccgggaucaugaagaaccccacgguggacggcaucguggccaucgaccucgaccccgucguguacgacgcgaaguucgagaagcagcugggccagaucaugcugcucauccugugcaccucccagauccugcucaugcggaccaccugggcccugugcgagagcaucacgcuggccaccgggccccucaccacccugugggagggcuccccggggaaguucuggaacacgaccaucgccgugagcauggccaacaucuuccgcggcuccuaccuggcgggcgccgggcucgccuucagccugaugaagacccugggcgggggccggcgcgggaccggcgcccagggcgagacgcucggggagaaguggaagcggcagcugaaccagcuguccaagagcgaguucaacaccuacaagcgcagcggcaucauggaggucgaccgguccgaggccaaggaggggcucaagcgcggcgagaccaccaagcacgcggugagccgggggacggccaagcugcgcugguucguggagcggaaccuggucaagcccgagggcaaggugaucgaccugggcugcgggcgcggcgggugguccuacuacugcgccggccucaagaaggugaccgaggucaagggguacaccaagggcggccccgggcacgaggagcccaucccgauggccaccuacggcuggaacaucgugaagcugcacagcgggcgggacguguucuucacgccgcccgagaagugcgacacgcugcucugcgacaucggcgaguccagccccaacccgaccaucgaggaggggcgcacccugcggguccugaagaugguggagcccuggcuccgcggcaaccaguucugcaucaagauccugaaccccuacaugcccuccguggucgagacccuggagcagaugcagcggaagcacggcgggaugcucgugcgcaacccgcugagccggaacuccacgcacgagauguacugggugagcugcggcaccgggaacaucgucuccgcggugaacaugaccagccgcaugcugcucaaccgcuucaccauggcccaccggaagcccacguacgagcgcgacguggaccugggcgccggcacccggcacgucgccguggagcccgagaucgccaaccuggacaucaucgggcagcgcaucgagaacaucaagaacgagcacaaguccaccuggcacuacgacgaggacaaccccuacaagaccugggcguaccacggcagcuacgaggugaagccguccgggagcgccuccagcauggucaacggcgugguccggcuccugacgaagcccugggacgugauccccauggugacccagaucgccaugaccgacaccacgcccuucgggcagcagcgcgucuucaaggagaagguggacacccggaccccgcgccccaagcggggcaccgcccagaucauggaggugacggccaaguggcuguggggcuuccucucccgcaacaagaagccccggaucugcacccgcgaggaguucacccggaagguccgcagcaacgcggccaucggggccguguucguggacgagaaccaguggaacagcgccaaggaggccgucgaggacgagcgguucugggaccuggugcaccgcgagcgggagcugcacaagcagggcaagugcgcgaccugcguguacaacaugauggggaagcgcgagaagaagcucggcgaguucgggaaggccaagggcucccgggccaucugguacauguggcugggcgcccgcuuccuggaguucgaggcgcucggguucaugaacgaggaccacugguucagccgggagaacucccugagcggcgucgagggggagggccugcacaagcucggguacauccugcgcgacaucuccaagaucccgggcggcaacauguacgccgacgacacggccgggugggacacccgcaucaccgaggacgaccugcagaacgaggccaagaucaccgacaucauggagcccgagcacgcccuccuggcgacgagcaucuucaagcugaccuaccagaacaagguggugcggguccagcgccccgccaaguccggcaccgugauggacgugaucagccggcgcgaccagcggggguccggccaggucggcaccuacgggcucaacacguucaccaacauggaggugcagcugauccgccagauggagagcgagggcaucuucucccccagcgagcuggagaacuccaaccucgccgagcgggugcuggacuggcuggagaagcacggggucgagcgccucaagcggauggccaucagcggcgacgacugcgaggugaagccgaccgacgaccgcuucgccaccgcgcugacggcccugaacgacauggggaaggugcggaaggacaucccccagugggagcccuccaagggcuggaacgacuggcagcagguccccuucugcagccaccacuuccaccagcucaucaugaaggacggccgcgagaucguggugccgugccggaaccaggacgagcuggucgggcgcgcccgggugucccagggcgccggguggagccugcgcgagaccgccugccucggcaagagcuacgcgcagauguggcagcugauguacuuccaccggcgcgaccugcggcucgccgccaacgccaucugcuccgccgugcccgucaacugggugcccaccagccgcaccaccugguccauccacgcgcaccaccaguggaugacgaccgaggacaugcugagcguguggaaccgcgucuggaucgaggagaaccccuggauggaggacaagacccacguguccagcugggaggacgugccguaccuggggaagcgggaggaccaguggugcggcucccucaucggccugaccgcccgcgccacgugggccaccaacauccaggucgcgaucaaccaggugcggcgccugaucgggaacgagaacuaccucgacuacaugaccagcaugaagcgguucaagaacgaguccgaccccgagggcgcccugugguga

SEQ ID NO: 8930 - RNA, 9879 nt, Artificial Sequence
  derived and/or modified CDS sequence (opt1) from DENV-1__KM403606__SS-prME
agcgugaccaugcugcucaugcugcugcccaccgcccucgccuuccaccugacgacccggggcggggagccccacaugaucguguccaagcaggagcggggcaagagccuccuguucaagaccuccgcgggggugaacaugugcacccugaucgccauggaccugggcgagcucugcgaggacaccaugaccuacaagugcccccggaucaccgaggccgagcccgacgacguggacugcuggugcaacgccaccgacacgugggugaccuacgggaccugcagccagaccggcgagcaccggcgcgacaagcgguccguggcccuggcgccccacgugggccuggggcucgagacgcgcaccgagaccuggaugagcuccgagggcgccuggcggcagauccagaagguggagaccugggcccugcgccaccccggguucacggugaucgcccuguuccucgcgcacgccaucggcaccagcaucacccagaaggggaucaucuucauccugcugaugcucgugacccccuccauggccaugcggugcgugggcaucggcaaccgcgacuucguggaggggcugagcggcgccacguggguggacgucgugcuggagcacggguccugcgugaccaccauggccaagaacaagcccacccucgacaucgagcugcugaagacggaggucaccaaccccgcggugcuccggaagcugugcaucgaggccaagaucagcaacaccaccacggacucccgcugccccacccagggcgaggccacccugguggaggagcaggacgccaacuucgucugccggcgcaccuucguggaccggggcugggggaacggcugcggccuguucggcaaggggagccugcugacgugcgccaaguucaagugcgugaccaagcucgagggcaagaucguccaguacgagaaccugaaguacuccgugaucgugaccguccacaccggcgaccagcaccagguggggaacgagacgaccgagcacggcaccaucgcgaccaucacgccccaggcccccacgcuggagauccagcucaccgacuacggggcccugacccuggacugcagcccccgcaccggccucgacuucaacgagaugguccugcugacgaugaaggagaaguccuggcucgugcacaagcagugguuccuggaccugccgcuccccuggaccagcggggccuccaccagccaggagaccuggaaccggcaggaccugcuggugacguucaagaccgcccacgcgaagaagcaggaggucguggugcucggcagccaggagggcgccaugcacaccgcccugaccggggccacggagauccagaccuccggcaccaccacgaucuucgccgggcaccugaagugccgccucaagauggacaagcugacccugaagggcgucagcuacgugaugugcaccggguccuucaagcuggagaaggagguggcggagacccagcacggcacgguccucguccaggugaaguacgagggcaccgacgcccccugcaagauccccaucagcacccaggacgagaagggggucacccagaacggccggcugaucacggccaacccgaucgugaccgacaaggagaagcccgugaacaucgagaccgagccgcccuucggggaguccuacaucgucaucggcgccggcgagaaggcgcugaagcucagcugguucaagaagggguccagcaucggcaagauguucgaggccaccgcccgcggggcccggcgcauggccauccugggcgacacggcgugggacuucggguccaucggcggcguguucaccagcguggggaagcugguccaccagguguucggcaccgccuacgggguccuguucuccggcgucagcuggaccaugaagaucgggaucggcauccugcugacguggcucggccugaacucccgcagcaccucccugagcaugaccugcaucgccguggggauggugacccucuaccugggcgucauggugcaggccgacuccgggugcgugaucaacuggaagggccgggagcugaagugcgggagcggcaucuucgucacgaacgaggugcacaccuggaccgagcaguacaaguuccaggccgacuccccgaagcgccucagcgcggccaucggcaaggccugggaggagggggugugcggcauccggagcgccacccgccuggagaacaucauguggaagcagaucuccaacgagcugaaccacauccuccuggagaacgacaugaaguucaccgucguggugggggacgccaacggcauccugacgcaggggaagaagaugauccggccccagcccauggagcacaaguacagcuggaaguccuggggcaaggcgaagaucaucggcgccgacacccagaacaccaccuucaucaucgacgggcccgacacgccggagugccccgacgaccagcgcgccuggaacaucugggaggucgaggacuacggcuucgggguguucaccaccaacaucuggcucaagcugcgggacagcuacacccagaugugcgaccaccgccugauguccgccgcgaucaaggacagcaaggccgugcacgccgacaugggcuacuggaucgaguccgagaagaacgagacguggaagcucgcccgggccagcuucaucgaggucaagaccugcaucuggccccgcucccacacccuguggagcaacggcgugcuggaguccgagaugaucauccccaagaucuacgggggcccgaucagccagcacaacuaccggcccggguacuucacccagacggcgggccccuggcaccucgggaagcuggagcuggacuucaaccucugcgagggcaccaccguggucguggacgagcacugcggcaaccgcgggccgucccugcggaccacgaccgugaccggcaagaucauccacgaguggugcugccgcagcugcacccugccgccccuccgguuccgcggggaggacggcugcugguacgggauggagauccggcccgucaaggagaaggaggagaaccuggugcgcuccauggugagcgccggcuccggcgaggucgacagcuucagccuggggcuccugugcguguccaucaugaucgaggaggugaugcggagccgcuggucccgcaagaugcugaugacgggcacccucgccgucuucuuccugcugaucauggggcagcucaccuggaacgaccugauccggcugugcaucauggugggcgccaacgugagcgaccgcauggggaugggcaccacguaccucgcccugauggcgaccuucaagaugcggccgauguucgccgucgggcuccucuuccgccggcugaccucccgcgaggugcugcuccugaccaucgggcugagccucgucgccuccguggagcugcccaacagccuggaggagcucggcgacgggcuggccaugggcaucaugaugcugaagcuccugacggacuuccagucccaccagcuguggaccacccuccugagccugaccuucaucaagacgacccucucccuggacuacgccuggaagaccauggcgauggugcugagcaucgucucccucuucccccugugccugagcaccacgucccagaagaccaccuggcuccccgugcugcugggcagcuucgggugcaagccgcucaccauguuccugaucaccgagaacaagaucuggggccggaaguccuggccccugaacgaggggaucauggccgugggcaucgucagcauccuccuguccagccugcucaagaacgacgugccccuggccgggccccugaucgccggcggcaugcucaucgcgugcuacgugaucagcggguccagcgccgaccugucccuggagcgcgccgccgaggucagcugggaggaggaggccgagcacuccggcgcgagccacaacauccucguggaggugcaggacgacgggacgaugaagaucaaggacgaggagcgggacgacacccugaccauccugcucaaggccacccugcuggccgucuccggcguguacccgaugagcauccccgccacccucuucgugugguacuucuggcagaagaagaagcagcgcuccgggguccugugggacacccccagcccgcccgagguggagcgggccgugcuggacgacggcaucuaccgcauccugcagcggggccuccuggggcgcucccaggucggcguggggguguuccaggacggcgucuuccacaccauguggcacgugacccgcggggcggugcugauguaccagggcaagcgccucgagcccagcugggccuccgucaagaaggaccugaucagcuacggcgggggcuggcgguuccagggguccuggaacacgggcgaggagguccaggugaucgccgucgagcccgggaagaaccccaagaacgugcagaccacccccggcaccuucaagacgcccgagggcgaggugggggccaucgcccuggacuucaagcccggcaccagcgggucccccaucgucaaccgcgagggcaagaucgugggccucuacgggaacggcguggucaccaccagcgggacguacguguccgcgaucgcccaggccaaggccagccaggagggcccgcugcccgagaucgaggacgagguguucaagaagcggaaccugaccaucauggaccuccaccccgggagcggcaagacccgccgguaccugccggccaucguccgcgaggcgaucaagcgcaagcugcggacccucauccuggcccccacgcgcgugguggccuccgagauggccgaggcgcugaagggcaugcccauccgguaccagaccaccgccgucaagagcgagcacaccgggaaggagaucguggaccucaugugccacgccacguucaccaugcgccugcugucccccgugcgggucccgaacuacaacaugaucaucauggacgaggcccacuucaccgaccccgccagcaucgcggcccgcggcuacaucuccacccggguggggaugggcgaggccgccgccaucuucaugacggcgacgccgcccgggagcguggaggccuucccgcaguccaacgccgucauccaggacgaggagcgcgacauccccgagcggagcuggaacuccggcuacgacuggaucaccgacuuccccggcaagaccgugugguucgugcccagcaucaaguccgggaacgacaucgccaacugccuccgcaagaacggcaagcgggucauccagcugagccgcaagacguucgacaccgaguaccagaagaccaagaacaacgacugggacuacguggugaccacggacaucuccgagaugggggccaacuuccgggcggaccgcgucaucgacccgcggcgcugccugaagcccgugauccucaaggacggccccgagcgggucauccuggccgggcccaugccggugaccgccgccagcgcggcccagcgccggggccgcaucggccgcaaccagaacaaggagggggaccaguacaucuacaugggccagccccugaacaacgacgaggaccacgcccacuggaccgaggccaagaugcuccuggacaacaucaacacccccgaggggaucauccccgcccuguucgagccggagcgggagaaguccgcggccaucgacggcgaguaccgccuccgcggggaggcccgcaagacguucguggagcugaugcggcgcggcgaccugcccgucuggcucagcuacaagguggccuccgagggcuuccaguacagcgaccggcgcuggugcuucgacggggagcggaacaaccaggugcuggaggagaacauggacgucgagaucuggaccaaggagggcgagcgcaagaagcugcggccccgcuggcucgacgcccggaccuacuccgacccccuggcgcugcgcgaguucaaggaguucgccgccgggcggcgcagcgugagcggcgaccucauccuggagaucggcaagcugccgcagcaccucacccugcgggcccagaacgcccuggacaaccucgugaugcugcacaacuccgagcagggcgggaaggcguaccgccacgccauggaggagcugcccgacaccaucgagacgcucaugcugcuggcccucaucgccguccugaccgggggcgugacccuguucuuccucagcgggaagggccugggcaagaccuccaucgggcugcucugcgugauggcgagcuccguccugcuguggauggccagcguggagccccacuggaucgccgccuccaucauccucgaguucuuccugauggugcugcucauccccgagccggaccggcagcgcacgccccaggacaaccagcuggccuacgucgugaucggccuccucuucaugauccugaccguggcggccaacgagauggggcugcucgagaccaccaagaaggaccugggcaucgggcacgucguggccgagaaccaccaccacgccacgaugcuggacaucgaccuccaccccgccagcgcguggacccuguacgccguggccaccaccaucaucacgccgaugaugcggcacaccaucgagaacaccaccgccaacaucucccugacggccaucgcgaaccaggccgccauccucaugggccuggacaagggcuggcccaucagcaagauggacaucggggucccccugcucgcccugggcugcuacucccaggugaacccccugacccucaccgccgcggugcugaugcuggucgcccacuacgccaucaucgggccgggccuccaggccaaggcgacccgcgaggcccagaagcgcacggccgccgggaucaugaagaaccccaccguggacggcaucguggccaucgaccuggaccccgucguguacgacgcgaaguucgagaagcagcugggccagaucaugcuccugauccugugcaccagccagauccuccugaugcggaccacgugggcccugugcgaguccaucacccucgccaccgggccccugaccacgcugugggagggcagcccggggaaguucuggaacaccaccaucgccguguccauggccaacaucuuccgcggcagcuaccucgcgggcgccgggcuggccuucucccugaugaagacccucggcgggggccggcgcgggacgggcgcccagggcgagacccugggggagaaguggaagcggcagcugaaccagcucagcaaguccgaguucaacaccuacaagcgcagcggcaucauggaggucgaccggagcgaggccaaggaggggcugaagcgcggcgagaccacgaagcacgcggugucccgggggaccgccaagcugcgcugguucguggagcggaaccuggucaagcccgagggcaaggugaucgaccucggcugcgggcgcggcggguggagcuacuacugcgccggccugaagaaggugaccgaggucaagggguacaccaagggcggccccgggcacgaggagcccaucccgauggccaccuacggcuggaacaucgugaagcugcacuccgggcgggacguguucuucacgccgcccgagaagugcgacacccuccugugcgacaucggcgagagcucccccaacccgaccaucgaggaggggcgcacccugcggguccucaagaugguggagcccuggcugcgcggcaaccaguucugcaucaagauccugaaccccuacaugcccagcguggucgagacgcucgagcagaugcagcggaagcacggcgggaugcuggugcgcaacccgcugucccggaacagcacccacgagauguacuggguguccugcggcaccgggaacaucgucagcgcggugaacaugaccucccgcaugcuccugaaccgcuucacgauggcccaccggaagcccaccuacgagcgcgacguggaccugggcgccggcacccggcacgucgccguggagcccgagaucgccaaccucgacaucaucgggcagcgcaucgagaacaucaagaacgagcacaagagcaccuggcacuacgacgaggacaaccccuacaagacgugggcguaccacggcuccuacgaggugaagccgagcggguccgccagcuccauggucaacggcgugguccggcugcugaccaagcccugggacgugauccccauggugacccagaucgccaugaccgacacgacccccuucgggcagcagcgcgucuucaaggagaagguggacacccggaccccgcgccccaagcggggcacggcccagaucauggaggugaccgccaaguggcucuggggcuuccugagccgcaacaagaagccccggaucugcacccgcgaggaguucacccggaagguccgcuccaacgcggccaucggggccguguucguggacgagaaccaguggaacagcgccaaggaggccgucgaggacgagcgguucugggaccuggugcaccgcgagcgggagcuccacaagcagggcaagugcgcgacgugcguguacaacaugauggggaagcgcgagaagaagcugggcgaguucgggaaggccaagggcagccgggccaucugguacauguggcugggcgcccgcuuccucgaguucgaggcgcugggguucaugaacgaggaccacugguucucccgggagaacagccuguccggcgucgagggggagggccuccacaagcugggguacauccugcgcgacaucagcaagaucccgggcggcaacauguacgccgacgacaccgccgggugggacacccgcaucaccgaggacgaccuccagaacgaggccaagaucacggacaucauggagcccgagcacgcccugcuggcgaccuccaucuucaagcucaccuaccagaacaagguggugcggguccagcgccccgccaagagcggcaccgugauggacgugaucucccggcgcgaccagcgggggagcggccaggucggcacguacgggcugaacaccuucaccaacauggaggugcagcugauccgccagauggaguccgagggcaucuucagccccuccgagcucgagaacagcaaccuggccgagcgggugcuggacuggcucgagaagcacggggucgagcgccugaagcggauggccaucuccggcgacgacugcguggugaagccgaccgacgaccgcuucgccacggcgcugaccgcccucaacgacauggggaagguccggaaggacaucccccagugggagcccagcaagggcuggaacgacuggcagcagguccccuucugcucccaccacuuccaccagcugaucaugaaggacggccgcgagaucguggucccgugccggaaccaggacgagcugguggggcgcgcccgggugagccagggcgccggguggucccuccgcgagaccgccugccugggcaagagcuacgcgcagauguggcagcugauguacuuccaccggcgcgaccuccggcuggccgccaacgccaucugcagcgccguccccgugaacugggugcccaccucccgcaccacguggagcauccacgcgcaccaccaguggaugaccaccgaggacaugcuguccgucuggaaccgcguguggaucgaggagaaccccuggauggaggacaagacccacgugagcuccugggaggacgucccguaccucgggaagcgggaggaccaguggugcggcagccugaucggccugacggcccgcgccaccugggccaccaacauccagguggcgaucaaccaggugcggcgccucaucgggaacgagaacuaccuggacuacaugaccuccaugaagcgguucaagaacgagagcgaccccgagggcgcccugugguga

SEQ ID NO: 8931 - RNA, 9879 nt, Artificial Sequence
  derived and/or modified CDS sequence (opt1) from DENV-1__KM403591__SS-prME
agcgugaccaugcugcucaugcugcugcccaccgcccucgccuuccaccugaccacccggggcggggagccccacaugaucgugagcaagcaggagcggggcaagagccugcuguucaagaccuccgcgggggugaacaugugcacccugaucgccauggaccugggcgagcucugcgaggacacgaugaccuacaagugcccccggaucaccgaggccgagcccgacgacguggacugcuggugcaacgccaccgacaccugggugaccuacgggaccugcagccagaccggcgagcaccggcgcgacaagcgguccguggcccuggcgccccacgugggccuggggcucgagacccgcaccgagaccuggaugagcuccgagggcgccuggcggcagauccagaagguggagaccugggcccugcgccaccccggguucacggugaucgcccuguuccucgcgcacgccaucggcaccagcaucacccagaaggggaucaucuucauccugcugaugcucgugacccccuccauggccaugcggugcgucggcaucggcaaccgcgacuucguggaggggcugagcggcgccacguggguggacgucgugcuggagcacggguccugcgugaccaccauggccaagaacaagcccacccucgacaucgagcugcugaagacggaggucaccaaccccgcggugcuccggaagcugugcaucgaggccaagaucagcaacaccaccacggacucccgcugccccacccagggcgaggccacccugguggaggagcaggacgccaacuucgucugccggcgcaccuucguggaccggggcugggggaacggcugcggccucuucggcaaggggagccugcugacgugcgccaaguucaagugcgugaccaagcucgagggcaagaucguccaguacgagaaccugaaguacuccgugaucgugaccguccacaccggcgaccagcaccagguggggaacgagacgaccgagcacggcaccaucgcgaccaucacgccccaggcccccacgagcgagauccagcugaccgacuacggggcccucacccuggacugcagcccccggaccggccuggacuucaacgagaugguccuccugacgaugaaggagaaguccuggcuggugcacaagcagugguuccucgaccugccgcugcccuggaccuccggggccagcaccagccaggagaccuggaaccggcaggaccuccuggugacguucaagaccgcccacgcgaagaagcaggaggucguggugcugggcucccaggagggcgccaugcacaccgcccucaccggggccacggagauccagaccagcggcaccaccacgaucuucgccgggcaccugaagugccgccugaagaugggcaagcucacccugaagggggucuccuacgugaugugcaccggcagcuucaagcuggagaaggagguggcggagacccagcacggcacgguccugguccaggugaaguacgaggggaccgacgcccccugcaagauccccaucuccacccaggacgagaagggcgucacccagaacgggcggcucaucacggccaacccgaucgugaccgacaaggagaagcccgugaacaucgagaccgagccgcccuucggcgagagcuacaucgucaucggcgccggggagaaggcgcugaagcuguccugguucaagaagggcagcuccaucgggaagauguucgaggccaccgcccgcggcgcccggcgcauggccauccucggggacacggcgugggacuucggcagcaucggcgggguguucaccuccgugggcaagcugguccaccagguguucgggaccgccuacggcgugcuguucagcggggucuccuggaccaugaagaucggcaucggcauccuccugacguggcuggggcucaacagccgcuccaccagccuguccaugaccugcaucgccgugggcauggugacccuguaccucggggucauggugcaggccgacagcggcugcgugaucaacuggaaggggcgggagcugaagugcggcuccggcaucuucgucacgaacgaggugcacaccuggaccgagcaguacaaguuccaggccgacagcccgaagcgccugagcgcggccaucgggaaggccugggaggagggcgugugcgggauccgguccgccacccgccucgagaacaucauguggaagcagaucagcaacgagcugaaccacauccugcucgagaacgacaugaaguucaccgucguggugggcgacgccaacgggauccugacgcagggcaagaagaugauccggccccagcccauggagcacaaguacuccuggaaguccuggggcaaggcgaagaucaucggggccgacacccagaacaccaccuucaucaucgacggccccgacacgccggagugccccgacgaccagcgcgccuggaacaucugggaggucgaggacuacggguucggcguguucaccaccaacaucuggcugaagcuccgggacuccuacacccagaugugcgaccaccgccugaugagcgccgcgaucaaggacuccaaggccgugcacgccgacaugggcuacuggaucgagagcgagaagaacgagacguggaagcuggcccgggccuccuucaucgaggucaagaccugcaucuggccccgcagccacacccucugguccaacggggugcuggagagcgagaugaucauccccaagaucuacggcgggccgaucucccagcacaacuaccggcccggcuacuucacccagacggcggggcccuggcaccugggcaagcucgagcuggacuucaaccugugcgagggcaccaccguggucguggacgagcacugcgggaaccgcggcccgagccuccggaccacgaccgugaccgggaagaucauccacgaguggugcugccgcuccugcacccugccgccccugcgguuccgcggcgaggacgggugcugguacggcauggagauccggcccgucaaggagaaggaggagaaccucgugcgcagcaugguguccgccggcagcggggaggucgacagcuucucccugggccugcucugcgugagcaucaugaucgaggaggugaugcggucccgcuggagccgcaagaugcugaugacggggacccuggccgucuucuuccuccugaucaugggccagcugaccuggaacgaccucauccggcugugcaucauggugggggccaacguguccgaccgcaugggcaugggcaccacguaccuggcccucauggcgaccuucaagaugcggccgauguucgccgucgggcugcuguuccgccggcucaccagccgcgaggugcugcugcucaccaucggccugucccuggucgccagcguggagcuccccaacucccuggaggagcugggggacggccucgccaugggcaucaugaugcugaagcugcucacggacuuccagagccaccagcuguggaccacccugcucucccugaccuucaucaagacgacccugagccucgacuacgccuggaagaccauggcgauggugcuguccaucgucagccuguucccccucugccuguccaccacgagccagaagaccaccuggcugcccgugcuccugggguccuucggcugcaagccgcugaccauguuccucaucaccgagaacaagaucugggggcgcaagagcuggccccugaacgagggcaucauggccguggggaucgucuccauccugcucagcagccugcugaagaacgacgugccccucgccggcccccugaucgccggcgggaugcugaucgcgugcuacgugaucuccggcagcuccgccgaccucagccuggagcgcgccgccgaggucuccugggaggaggaggccgagcacagcggggcgucccacaacauccugguggaggugcaggacgacggcacgaugaagaucaaggacgaggagcgggacgacacccucaccauccugcugaaggccacccuccuggccgucagcgggguguacccgauguccauccccgccacgcuguucgugugguacuucuggcagaagaagaagcagcgcagcggcguccucugggacacccccagcccgcccgagguggagcgggccgugcuggacgacggcaucuaccgcauccugcagcgggggcugcucggccgcagccaggucggggugggcguguuccaggacggggucuuccacaccauguggcacgugacccggggcgcggugcugauguaccagggcaagcgccuggagcccuccugggccagcgucaagaaggaccucaucuccuacgggggcggguggcgguuccagggcagcuggaacacgggggaggagguccaggugaucgccgucgagcccggcaagaaccccaagaacgugcagaccacccccggcaccuucaagacgcccgagggggaggugggcgccaucgcccuggacuucaagcccgggaccuccggcagccccaucgucaaccgcgagggcaagaucguggggcuguacggcaacgggguggucaccaccuccggcacguacgugagcgcgaucgcccaggccaaggccagccaggaggggccgcuccccgagaucgaggacgagguguucaagaagcggaaccugaccaucauggaccugcaccccggcuccggcaagaccaagcgcuaccucccggccaucguccgggaggcgaucaagcgcaagcugcgcacccugauccucgcccccacgcgggugguggccagcgagauggccgaggcgcugaaggggaugcccauccgcuaccagaccaccgccgucaaguccgagcacaccggcaaggagaucguggaccugaugugccacgccacguucaccaugcggcuccugagccccgugcgcgucccgaacuacaacaugaucaucauggacgaggcccacuucaccgaccccgccuccaucgcggcccggggguacaucagcacccgcgugggcaugggggaggccgccgccaucuucaugacggcgacgccgcccggcuccguggaggccuucccgcagagcaacgccgucauccaggacgaggagcgggacauccccgagcgcuccuggaacagcggcuacgacuggaucaccgacuuccccgggaagaccgugugguucgugcccuccaucaagagcggcaacgacaucgccaacugccugcggaagaacgggaagcgcgucauccagcucucccggaagacguucgacaccgaguaccagaagaccaagaacaacgacugggacuacguggugaccacggacaucagcgagaugggcgccaacuuccgcgcggaccgggucaucgacccgcgccggugccugaagcccgugauccugaaggacgggcccgagcgcgucauccucgccggccccaugccggugaccgccgccuccgcggcccagcggcgcggccggaucgggcgcaaccagaacaaggagggcgaccaguacaucuacauggggcagccccugaacaacgacgaggaccacgcccacuggaccgaggccaagaugcugcucgacaacaucaacacccccgagggcaucauccccgcccuguucgagccggagcgcgagaaguccgcggccaucgacggggaguaccggcugcgcggcgaggcccggaagacguucguggagcucaugcgccggggcgaccugcccgucuggcuguccuacaagguggccagcgagggguuccaguacuccgaccgccgguggugcuucgacggcgagcgcaacaaccaggugcucgaggagaacauggacgucgagaucuggaccaaggagggggagcggaagaagcugcgcccccgguggcuggacgcccgcaccuacagcgacccccucgcgcugcgggaguucaaggaguucgccgccggccgccggagcguguccggcgaccugauccucgagaucgggaagcugccgcagcaccugacccuccgcgcccagaacgcccuggacaaccuggugaugcuccacaacagcgagcagggcgggaaggcguaccggcacgccauggaggagcugcccgacaccaucgagacgcugaugcuccuggcccugaucgccguccucaccggcggggugacccuguucuuccuguccggcaagggccucgggaagaccagcaucggccugcugugcgugauggcguccagcguccuccuguggauggccuccguggagccccacuggaucgccgccagcaucauccuggaguucuuccucauggugcugcugauccccgagccggaccgccagcggacgccccaggacaaccagcucgccuacgucgugaucgggcugcuguucaugauccucaccguggcggccaacgagaugggccugcuggagaccaccaagaaggaccucgggaucggccacgucguggccgagaaccaccaccacgccacgaugcuggacaucgaccugcaccccgccuccgcguggacccucuacgccguggccaccaccaucaucacgccgaugaugcgccacaccaucgagaacaccaccgccaacaucagccugacggccaucgcgaaccaggccgccauccugaugggccucgacaagggguggcccaucuccaagauggacaucggcgucccccugcuggcccucgggugcuacagccaggugaacccccugacccugaccgccgcggugcucaugcuggucgcccacuacgccaucaucggcccggggcugcaggccaaggcgacccgggaggcccagaagcgcacggccgccggcaucaugaagaaccccaccguggacggcaucguggccaucgaccucgaccccgucguguacgacgcgaaguucgagaagcagcuggggcagaucaugcugcucauccugugcaccucccagauccugcucaugcgcaccacgugggcccugugcgagagcaucacccuggccaccggcccccucaccacgcugugggagggguccccgggcaaguucuggaacaccaccaucgccgugagcauggccaacaucuuccggggcuccuaccuggcgggggccggccucgccuucagccugaugaagucccucgggggcgggcgccgggggaccggcgcccagggggagacgcucggcgagaaguggaagcgccagcugaaccagcugagcaagagcgaguucaacaccuacaagcgguccgggaucauggaggucgaccgcagcgaggccaaggagggccucaagcgcggggagaccaccaagcacgcggugucccgcggcacggccaagcugcggugguucguggagcgcaaccuggucaagcccgagggcaaggugaucgaccuggggugcggccgcgggggcuggagcuacuacugcgccgggcucaagaaggugaccgaggucaagggcuacaccaagggcgggcccggccacgaggagcccaucccgauggccaccuacggguggaacaucgugaagcugcacuccggccgcgacguguucuucacgccgcccgagaagugcgacacgcugcucugcgacaucggggagagcucccccaacccgaccaucgaggagggccggacccugcgcguccugaagaugguggagcccuggcuccggggcaaccaguucugcaucaagauccugaaccccuacaugcccagcguggucgagacccuggagcagaugcagcgcaagcacgggggcaugcucgugcggaacccgcugucccgcaacagcacgcacgagauguacuggguguccugcgggaccggcaacaucgucagcgcggugaacaugaccucccggaugcugcucaaccgcuucaccauggcccaccgcaagcccacguacgagcgggacguggaccugggcgccgggacccgccacgucgccguggagcccgagaucgccaaccuggacaucaucggccagcggaucgagaacaucaagaacgagcacaagagcaccuggcacuacgacgaggacaaccccuacaagaccugggcguaccacggguccuacgaggugaagccgagcggcuccgccagcuccauggucaacggggugguccgccuccugacgaagcccugggacgugauccccauggugacccagaucgccaugaccgacaccacgcccuucggccagcagcgggucuucaaggagaagguggacacccgcaccccgcggcccaagcgcggcaccgcccagaucauggaggugacggccaaguggcuguggggguuccucagccggaacaagaagccccgcaucugcacccgggaggaguucacccgcaagguccggagcaacgcggccaucggcgccguguucguggacgagaaccaguggaacuccgccaaggaggccgucgaggacgagcgcuucugggaccuggugcaccgggagcgcgagcugcacaagcaggggaagugcgcgaccugcguguacaacaugaugggcaagcgggagaagaagcucggggaguucggcaaggccaagggcagccgcgccaucugguacauguggcugggggcccgguuccuggaguucgaggcgcucggcuucaugaacgaggaccacugguucucccgcgagaacagccuguccggggucgagggcgaggggcugcacaagcucggcuacauccugcgggacaucagcaagaucccgggcgggaacauguacgccgacgacacggccggcugggacacccgcaucaccgaggacgaccugcagaacgaggccaagaucaccgacaucauggagcccgagcacgcccuccuggcgacguccaucuucaagcugaccuaccagaacaagguggugcgcguccagcggcccgccaagagcgggaccgugauggacgugaucucccgccgggaccagcgcggcagcggccaggucgggaccuacggccucaacacguucaccaacauggaggugcagcugauccggcagauggaguccgaggggaucuucagccccuccgagcuggagaacagcaaccucgccgagcgcgugcuggacuggcuggagaagcacggcgucgagcggcucaagcgcauggccaucuccggggacgacugcguggugaagccgaccgacgaccgguucgccaccgcgcugacggcccugaacgacaugggcaagguccgcaaggacaucccccagugggagcccagcaagggcuggaacgacuggcagcagguccccuucugcucccaccacuuccaccagcucaucaugaaggacgggcgggagaucguggucccgugccgcaaccaggacgagcuggugggccgggcccgcgugagccagggggccggcuggagccugcgggagaccgccugccucgggaaguccuacgcgcagauguggcagcugauguacuuccaccgccgggaccugcgccucgccgccaacgccaucugcagcgccguccccgugaacugggugcccaccucccggaccaccuggagcauccacgcgcaccaccaguggaugacgaccgaggacaugcuguccgucuggaaccgcguguggaucgaggagaaccccuggauggaggacaagacccacgugagcuccugggaggacgucccguaccugggcaagcgcgaggaccaguggugcggcagccucaucgggcugaccgcccgggccacgugggccaccaacauccagguggcgaucaaccaggugcgccggcugaucggcaacgagaacuaccucgacuacaugaccuccaugaagcgcuucaagaacgagagcgaccccgagggggcccugugguga

SEQ ID NO: 8932 - RNA, 9879 nt, Artificial Sequence
  derived and/or modified CDS sequence (opt1) from DENV-1__KM403607__SS-prME
agcgugaccaugcugcucaugcugcugcccaccgcccucgccuuccaccugaccacccggggcggggagccccacaugaucgugagcaagcaggagcggggcaagagccuccuguucaagaccuccgcgggggugaacaugugcacccugaucgccauggaccugggcgagcucugcgaggacacgaugaccuacaagugcccccggaucaccgaggccgagcccgacgacguggacugcuggugcaacgccaccgacaccugggugaccuacgggaccugcagccagaccggcgagcaccggcgcgacaagcgguccguggcccuggcgccccacgugggccuggggcucgagacgcgcaccgagaccuggaugagcuccgagggcgccuggcggcagauccagaagguggagaccugggcccugcgccaccccggguucacggugaucgcccuguuccucgcgcacgccaucggcaccagcaucacccagaaggggaucaucuucauccugcugaugcucgugacccccuccauggccaugcggugcgucggcaucggcaaccgcgacuucguggaggggcugagcggcgccacguggguggacgucgugcuggagcacggguccugcgugaccaccauggccaagaacaagcccacccucgacaucgagcugcugaagacggaggucaccaaccccgcggugcuccggaagcugugcaucgaggccaagaucagcaacaccaccacggacucccgcugccccacccagggcgaggccacccugguggaggagcaggacgccaacuucgucugccggcgcaccuucguggaccggggcugggggaacggcugcggccucuucggcaaggggagccugcugacgugcgccaaguucaagugcgugaccaagcucgagggcaagaucguccaguacgagaaccugaaguacuccgugaucgugaccguccacaccggcgaccagcaccagguggggaacgagacgaccgagcacggcaccaucgcgaccaucacgccccaggcccccacgagcgagauccagcugaccgacuacggggcccucacccuggacugcagcccccggaccggccuggacuucaacgagaugguccuccugacgaugaaggagaaguccuggcuggugcacaagcagugguuccucgaccugccgcugcccuggaccuccggggccagcaccagccaggagaccuggaaccggcaggaccuccuggugacguucaagaccgcccacgcgaagaagcaggaggucguggugcugggcucccaggagggcgccaugcacaccgcccucaccggggccacggagauccagaccagcggcaccaccacgaucuucgccgggcaccugaagugccgccugaagauggacaagcucacccugaagggcgucuccuacgugaugugcaccgggagcuucaagcuggagaaggagguggcggagacccagcacggcacgguccugguccaggugaaguacgagggcaccgacgcccccugcaagauccccaucuccauccaggacgagaagggggucacccagaacggccggcucaucaccgccaacccgaucgugacggacaaggagaagcccgugaacaucgagaccgagccgcccuucggggagagcuacaucgucaucggcgccggcgagaaggcgcugaagcuguccugguucaagaaggggagcuccaucggcaagauguucgaggccaccgcccgcggggcccggcgcauggccauccucggcgacaccgcgugggacuucgggagcaucggcggcguguucacguccguggggaagcugguccaccagguguucggcaccgccuacggggugcuguucagcggcgucuccuggaccaugaagaucgggaucggcauccuccugaccuggcugggccucaacagccgcuccacgagccuguccaugaccugcaucgccguggggauggugacccuguaccucggcgucauggugcaggccgacagcgggugcgugaucaacuggaagggccgggagcugaagugcggguccggcaucuucgucaccaacgaggugcacacguggaccgagcaguacaaguuccaggccgacagcccgaagcgccugagcgcggccaucggcaaggccugggaggagggggugugcggcauccgguccgccacccgccucgagaacaucauguggaagcagaucagcaacgagcugaaccacauccugcucgagaacgacaugaaguucaccgucguggugggggacgccaacggcauccugacccaggggaagaagaugauccggccccagcccauggagcacaaguacuccuggaaguccuggggcaaggcgaagaucaucggcgccgacacgcagaacaccaccuucaucaucgacgggcccgacaccccggagugccccgacgaccagcgcgccuggaacaucugggaggucgaggacuacggcuucgggguguucacgaccaacaucuggcugaagcuccgggacuccuacacccagaugugcgaccaccgccugaugagcgccgcgaucaaggacuccaaggccgugcacgccgacaugggcuacuggaucgagagcgagaagaacgagaccuggaagcuggcccgggccuccuucaucgaggucaagacgugcaucuggccccgcagccacacccucugguccaacggcgugcuggagagcgagaugaucauccccaagaucuacgggggcccgaucucccagcacaacuaccggcccggguacuucacccagaccgcgggccccuggcaccuggggaagcucgagcuggacuucaaccugugcgagggcacgaccguggucguggacgagcacugcggcaaccgcgggccgagccuccggaccaccacggugaccggcaagaucauccacgaguggugcugccgcuccugcacccugccgccccugcgguuccgcggggaggacggcugcugguacgggauggagauccggcccgucaaggagaaggaggagaaccucgugcgcagcaugguguccgccggcagcggcgaggucgacagcuucucccuggggcugcucugcgugagcaucaugaucgaggaggugaugcggucccgcuggagccgcaagaugcugaugaccggcacgcuggccgucuucuuccuccugaucauggggcagcugaccuggaacgaccucauccggcugugcaucauggugggcgccaacguguccgaccgcauggggaugggcaccaccuaccuggcccucauggcgacguucaagaugcggccgauguucgccgucggccugcuguuccgccggcucaccagccgcgaggugcugcugcucaccaucgggcugucccuggucgccagcguggagcuccccaacucccuggaggagcugggcgacgggcucgccaugggcaucaugaugcugaagcugcucaccgacuuccagagccaccagcuguggacgacccugcucucccugaccuucaucaagaccacgcugagccucgacuacgccuggaagaccauggcgauggugcuguccaucgucagccuguucccccucugccuguccaccaccagccagaagacgaccuggcugcccgugcuccugggcuccuucgggugcaagccgcugaccauguuccucaucaccgagaacaagaucuggggccgcaagagcuggccccugaacgaggggaucauggccgugggcaucgucuccauccugcucagcagccugcugaagaacgacgugccccucgccgggccccugaucgccggcggcaugcugaucgcgugcuacgugaucuccgggagcuccgccgaccucagccuggagcgcgccgccgaggucuccugggaggaggaggccgagcacagcggcgcgucccacaacauccugguggaggugcaggacgacgggaccaugaagaucaaggacgaggagcgggacgacacgcucaccauccugcugaaggccacccuccuggccgucagcggcguguacccgauguccauccccgccacccuguucgugugguacuucuggcagaagaagaagcagcgcagcgggguccucugggacacgcccagcccgcccgagguggagcgggccgugcuggacgacggcaucuaccgcauccugcagcggggccugcucgggcgcagccaggucggcguggggguguuccaggacggcgucuuccacaccauguggcacgugacccgcggggcggugcugauguaccagggcaagcgccuggagcccuccugggccagcgucaagaaggaccucaucuccuacggcgggggcuggcgguuccaggggagcuggaacaccggcgaggagguccaggugaucgccgucgagcccgggaagaaccccaagaacgugcagacgacccccggcaccuucaagacccccgagggcgaggugggggccaucgcccuggacuucaagcccggcacguccgggagccccaucgucaaccgcgagggcaagaucgugggccuguacgggaacggcguggucaccaccuccgggaccuacgugagcgcgaucgcccaggccaaggccagccaggagggcccgcuccccgagaucgaggacgagguguucaagaagcggaaccugacgaucauggaccugcaccccggguccggcaagacccgccgguaccucccggccaucguccgcgaggcgaucaagcgcaagcugcggacccugauccucgcccccacccgcgugguggccagcgagauggccgaggcgcugaagggcaugcccauccgguaccagacgaccgccgucaaguccgagcacaccgggaaggagaucguggaccugaugugccacgccaccuucacgaugcgccuccugagccccgugcgggucccgaacuacaacaugaucaucauggacgaggcccacuucaccgaccccgccuccaucgcggcccgcggcuacaucagcacccggguggggaugggcgaggccgccgccaucuucaugaccgcgacgccgcccggguccguggaggccuucccgcagagcaacgccgucauccaggacgaggagcgcgacauccccgagcgguccuggaacagcggcuacgacuggaucaccgacuuccccggcaagaccgugugguucgugcccuccaucaagagcgggaacgacaucgccaacugccugcgcaagaacggcaagcgggucauccagcucucccgcaagaccuucgacacggaguaccagaagaccaagaacaacgacugggacuacguggugaccaccgacaucagcgagaugggggccaacuuccgggcggaccgcgucaucgacccgcggcgcugccugaagcccgugauccugaaggacggccccgagcgggucauccucgccgggcccaugccggugacggccgccuccgcggcccagcgccggggccgcaucggccgcaaccagaacaaggagggggaccaguacaucuacaugggccagccccugaacaacgacgaggaccacgcccacuggaccgaggccaagaugcugcucgacaacaucaacacccccgaggggaucauccccgcccuguucgagccggagcgggagaaguccgcggccaucgacggcgaguaccgccugcgcggggaggcccgcaagaccuucguggagcucaugcggcgcggcgaccugcccgucuggcuguccuacaagguggccagcgagggcuuccaguacuccgaccggcgcuggugcuucgacggggagcggaacaaccaggugcucgaggagaacauggacgucgagaucuggacgaaggagggcgagcgcaagaagcugcggccccgcuggcuggacgcccggaccuacagcgacccccucgcgcugcgcgaguucaaggaguucgccgccgggcggcgcagcguguccggcgaccugauccucgagaucggcaagcugccgcagcaccugacccuccgggcccagaacgcccuggacaaccuggugaugcuccacaacagcgagcagggcgggaaggcguaccgccacgccauggaggagcugcccgacaccaucgagacccugaugcuccuggcccugaucgccguccucaccggcggggugacccuguucuuccuguccgggaaggggcucggcaagaccagcaucgggcugcugugcgugauggcguccagcguccuccuguggauggccuccguggagccccacuggaucgccgccagcaucauccuggaguucuuccucauggugcugcugauccccgagccggaccggcagcgcacgccccaggacaaccagcucgccuacgucgugaucggccugcuguucaugauccucacgguggcggccaacgagauggggcugcuggagaccaccaagaaggaccucggcaucgggcacgucguggccgagaaccaccaccacgccaccaugcuggacaucgaccugcaccccgccuccgcguggacgcucuacgccguggccaccaccaucaucaccccgaugaugcggcacacgaucgagaacaccaccgccaacaucagccugaccgccaucgcgaaccaggccgccauccugaugggccucgacaagggcuggcccaucuccaagauggacaucggggucccccugcuggcccucggcugcuacagccaggugaacccccugacgcugaccgccgcggugcucaugcuggucgcccacuacgccaucaucgggccgggccugcaggccaaggcgacccgcgaggcccagaagcgcaccgccgccgggaucaugaagaaccccacgguggacggcaucguggccaucgaccucgaccccgucguguacgacgcgaaguucgagaagcagcugggccagaucaugcugcucauccugugcaccucccagauccugcucaugcggaccaccugggcccugugcgagagcaucacgcuggccaccgggccccucaccacccugugggagggcuccccggggaaguucuggaacacgaccaucgccgugagcauggccaacaucuuccgcggcuccuaccuggcgggcgccgggcucgccuucagccugaugaagacccugggcgggggccggcgcgggaccggcgcccagggcgagacgcucggggagaaguggaagcggcagcugaaccagcuguccaagagcgaguucaacaccuacaagcgcagcggcaucauggaggucgaccgguccgaggccaaggaggggcucaagcgcggcgagaccaccaagcacgcggugagccgggggacggccaagcugcgcugguucguggagcggaaccuggucaagcccgagggcaaggugaucgaccugggcugcgggcgcggcgggugguccuacuacugcgccggccucaagaaggugaccgaggucaagggguacaccaagggcggccccgggcacgaggagcccaucccgauggccaccuacggcuggaacaucgugaagcugcacagcgggcgggacguguucuucacgccgcccgagaagugcgacacgcugcucugcgacaucggcgaguccagccccaacccgaccaucgaggaggggcgcacccugcggguccugaagaugguggagcccuggcuccgcggcaaccaguucugcaucaagauccugaaccccuacaugcccuccguggucgagacccuggagcagaugcagcggaagcacggcgggaugcucgugcgcaacccgcugagccggaacuccacgcacgagauguacugggugagcugcggcaccgggaacaucgucuccgcggugaacaugaccagccgcaugcugcucaaccgcuucaccauggcccaccggaagcccacguacgagcgcgacguggaccugggcgccggcacccggcacgucgccguggagcccgagaucgccaaccuggacaucaucgggcagcgcaucgagaacaucaagaacgagcacaaguccaccuggcacuacgacgaggacaaccccuacaagaccugggcguaccacggcagcuacgaggugaagccguccgggagcgccuccagcauggucaacggcgugguccggcuccugacgaagcccugggacgugauccccauggugacccagaucgccaugaccgacaccacgcccuucgggcagcagcgcgucuucaaggagaagguggacacccggaccccgcgccccaagcggggcaccgcccagaucauggaggugacggccaaguggcuguggggcuuccucucccgcaacaagaagccccggaucugcacccgcgaggaguucacccggaagguccgcagcaacgcggccaucggggccguguucguggacgagaaccaguggaacagcgccaaggaggccgucgaggacgagcgguucugggaccuggugcaccgcgagcgggagcugcacaagcagggcaagugcgcgaccugcguguacaacaugauggggaagcgcgagaagaagcucggcgaguucgggaaggccaagggcucccgggccaucugguacauguggcugggcgcccgcuuccuggaguucgaggcgcucggguucaugaacgaggaccacugguucagccgggagaacucccugagcggcgucgagggggagggccugcacaagcucggguacauccugcgcgacaucuccaagaucccgggcggcaacauguacgccgacgacacggccgggugggacacccgcaucaccgaggacgaccugcagaacgaggccaagaucaccgacaucauggagcccgagcacgcccuccuggcgacgagcaucuucaagcugaccuaccagaacaagguggugcggguccagcgccccgccaaguccggcaccgugauggacgugaucagccggcgcgaccagcggggguccggccaggucggcaccuacgggcucaacacguucaccaacauggaggugcagcugauccgccagauggagagcgagggcaucuucucccccagcgagcuggagaacuccaaccucgccgagcgggugcuggacuggcuggagaagcacggggucgagcgccucaagcggauggccaucagcggcgacgacugcguggugaagccgaccgacgaccgcuucgccaccgcgcugacggcccugaacgacauggggaagguccggaaggacaucccccagugggagcccuccaagggcuggaacgacuggcagcagguccccuucugcagccaccacuuccaccagcucaucaugaaggacggccgcgagaucguggucccgugccggaaccaggacgagcugguggggcgcgcccgggugucccagggcgccggguggagccugcgcgagaccgccugccucggcaagagcuacgcgcagauguggcagcugauguacuuccaccggcgcgaccugcggcucgccgccaacgccaucugcuccgccguccccgugaacugggugcccaccagccgcaccaccugguccauccacgcgcaccaccaguggaugacgaccgaggacaugcugagcgucuggaaccgcguguggaucgaggagaaccccuggauggaggacaagacccacguguccagcugggaggacgucccguaccuggggaagcgggaggaccaguggugcggcucccucaucggccugaccgcccgcgccacgugggccaccaacauccagguggcgaucaaccaggugcggcgccugaucgggaacgagaacuaccucgacuacaugaccagcaugaagcgguucaagaacgaguccgaccccgagggcgcccugugguga

SEQ ID NO: 8933 - RNA, 9879 nt, Artificial Sequence
  derived and/or modified CDS sequence (opt1) from DENV-1__KM403581__SS-prME
agcgugaccaugcugcucaugcugcugcccaccgcccucgccuuccaccugacgacccggggcggggagccccacaugaucgugagcaagcaggagcggggcaagagccuccuguucaagaccuccgcgggggugaacaugugcacccugaucgccauggaccugggcgagcucugcgaggacaccaugaccuacaagugcccccggaucaccgaggccgagcccgacgacguggacugcuggugcaacgccaccgacaccugggucaccuacgggaccugcagccagaccggcgagcaccggcgcgaccggcgcuccguggcccuggcgccccacgugggccuggggcucgagacgcggaccgagaccuggaugagcuccgagggcgccuggcgccagauccagcgggucgagaccugggcccugcgccaccccggguucacggugaucgcccuguuccucgcgcacgccaucggcaccagcaucacccagaaggggaucaucuucauccugcugaugcucgugacccccuccauggccaugcggugcgucggcaucggcaaccgcgacuucguggaggggcugagcggcgccacguggguggacgucgugcuggagcacggguccugcgugaccaccauggccaagaacaagcccacccucgacaucgagcugcugaagacggaggucaccaaccccgcggugcuccggaagcugugcaucgaggccaagaucagcaacaccaccacggacucccgcugccccacccagggcgaggccacccugguggaggagcaggacgccaacuucgucugccggcgcaccuucguggaccggggcugggggaacggcugcggccuguucggcaaggggagccugcugacgugcgccaaguucaagugcgugaccaagcucgagggcaagaucguccaguacgagaaccugaaguacuccgugaucgugaccguccacaccggcgaccagcaccagguggggaacgagacgaccgagcacggcaccaucgcgaccaucacgccccaggcccccacgagcgagauccagcugaccgacuacggggcccucacccuggacugcagcccccggaccggccuggacuucaacgagaugguccuccugacgaugaaggagaaguccuggcuggugcacaagcagugguuccucgaccugccgcugcccuggaccuccggggccagcaccagccaggagaccuggaaccggcaggaccuccuggugacguucaagaccgcccacgcgaagaagcaggaggucguggugcugggcucccaggagggcgccaugcacaccgcccucaccggggccacggagauccagaccagcggcaccaccacgaucuucgccgggcaccugaagugccgccugaagauggacaagcucacccugaagggcgucuccuacgugaugugcaccgggagcuucaagcuggagaaggagguggcggagacccagcacggcacgguccugguccaggugaaguacgagggcaccgacgcccccugcaagauccccaucuccacccaggacgagaagggggucacccagaacggccggcucaucacggccaacccgaucgugaccgacaaggagaagcccgugaacaucgagaccgagccgcccuucggggagagcuacaucgucaucggcgccggcgagaaggcgcugaagcuguccugguucaagaaggggagcuccaucggcaagauguucgaggccaccgcccgcggggcccgccggauggccauccucggcgacacggcgugggacuucgggagcaucggcggcguguucaccuccguggggaagcugguccaccagguguucggcaccgccuacggggugcuguucagcggcgucuccuggaccaugaagaucgggaucggcauccuccugacguggcugggccucaacagccgcuccaccagccuguccaugaccugcaucgccguggggauggugacccuguaccucggcgucauggugcaggccgacagcgggugcgugaucaacuggaagggccgggagcugaagugcggguccggcaucuucgucacgaacgaggugcacaccuggaccgagcaguacaaguuccaggccgacagcccgaagcgccugagcgcggccaucggcaaggccugggaggagggggugugcggcauccgguccgccacccgccucgagaacaucauguggaagcagaucagcaacgagcugaaccacauccugcucgagaacgacaugaaguucaccgucguggugggggacgccaacggcauccugacgcaggggaagaagaugauccggccccagcccauggagcacaaguacuccuggaaguccuggggcaaggcgaagaucaucggcgccgacacccagaacaccaccuucaucaucgacgggcccgacacgccggagugccccgacgaccagcgcgccuggaacaucugggaggucgaggacuacggcuucgggguguucaccaccaacaucuggcugaagcuccgggacuccuacacccagcugugcgaccaccgccugaugagcgccgcgaucaaggacuccaaggccgugcacgccgacaugggcuacuggaucgagagcgagaagaacgagacguggaagcucgcccgggccuccuucaucgaggucaagaccugcaucuggccccgcagccacacccugugguccaacggcgugcuggagagcgagaugaucauccccaagaucuacgggggcccgaucucccagcacaacuaccggcccggguacuucacccagacggcgggccccuggcaccucgggaagcuggagcuggacuucaaccucugcgagggcaccaccguggucguggacgagcacugcggcaaccgcgggccgagccugcggaccacgaccgugaccggcaagaucauccacgaguggugcugccgcuccugcacccugccgccccugcgguuccgcggggaggacggcugcugguacgggauggagauccggcccgucaaggagaaggaggagaaccuggugcgcagcaugguguccgccggcagcggcgaggucgacagcuucucccuggggcuccugugcgugagcaucaugaucgaggaggugaugcgcucccgguggagccgcaagaugcugaugacgggcacccucgccaucuucuuccugcugaucauggggcagcucaccuggaacgaccugauccggcugugcaucauggucggcgccaacguguccgaccgcauggggaugggcaccacguaccucgcccugauggcgaccuucaagaugcggccgauguucgccguggggcuccucuuccgccggcugaccagccgcgagguccugcuccugaccaucgggcugucccucguggccagcgucgagcugcccaacucccuggaggagcucggcgacgggcuggccaugggcaucaugaugcugaagcuccugacggacuuccagagccaccagcuguggaccacccuccugucccugaccuucaucaagacgacccucagccuggacuacgccuggaagaccauggcgauggugcuguccaucgugagccucuucccccugugccuguccaccacgagccagaagaccaccuggcuccccguccugcugggcuccuucgggugcaagccgcucaccauguuccugaucaccgagaacaagaucuggggccgcaagagcuggccccugaacgaggggaucauggccgugggcaucguguccauccuccugagcagccugcucaagaacgacgucccccuggccgggccccugaucgccggcggcaugcucaucgcgugcuacgugaucuccgggagcuccgccgaccugagccuggagcgcgccgccgagguguccugggaggaggaggccgagcacagcggcgcgucccacaacauccucgucgaggugcaggacgacgggacgaugaagaucaaggacgaggagcgggacgacacccugaccauccugcucaaggccacccugcuggccgugagcggcgucuacccgauguccauccccgccacccucuucgugugguacuucuggcagaagaagaagcagcgcagcggggugcugugggacacccccagcccgcccgaggucgagcgggccgugcuggacgacggcaucuaccgcauccugcagcggggccuccuggggcgcagccaggugggcgucgggguguuccaggacggcguguuccacaccauguggcacgucacccgcggggcggugcugauguaccagggcaagcgccucgagcccuccugggccagcgugaagaaggaccugaucuccuacggcgggggcuggcgguuccaggggagcuggaacacgggcgaggagguccaggugaucgccguggagcccgggaagaaccccaagaacguccagaccacccccggcaccuucaagacgcccgagggcgaggugggggccaucgcccuggacuucaagcccggcaccuccgggagccccaucgugaaccgcgagggcaagaucgucggccucuacgggaacggcguggugaccaccuccgggacguacgucagcgcgaucgcccaggccaaggccagccaggagggcccgcugcccgagaucgaggacgagguguucaagaagcggaaccugaccaucauggaccuccaccccggguccggcaagacccgccgcuaccugccggccaucgugcgggaggcgaucaagcgcaagcugcggacccucauccuggcccccacgcgcgucguggccagcgagauggccgaggcgcugaagggcaugcccauccgguaccagaccaccgccgugaaguccgagcacaccgggaaggagaucgucgaccucaugugccacgccacguucaccaugcgccugcugagccccgugcgggugccgaacuacaacaugaucaucauggacgaggcccacuucaccgaccccgccuccaucgcggcccgcggcuacaucagcacccgggucgggaugggcgaggccgccgccaucuucaugacggcgacgccgcccggguccguggaggccuucccgcagagcaacgccgugauccaggacgaggagcgcgacauccccgagcgguccuggaacagcggcuacgacuggaucaccgacuuccccggcaagaccgucugguucgugcccuccaucaagagcgggaacgacaucgccaacugccuccgcaagaacggcaagcgggugauccagcugucccgcaagacguucgacaccgaguaccagaagaccaagaacaacgacugggacuacgucgugaccacggacaucagcgagaugggggccaacuuccgggcggaccgcgugaucgacccgcggcgcugccugaagcccgucauccucaaggacggccccgagcgggugauccuggccgggcccaugccggucaccgccgccuccgcggcccagcgccgcggccggaucggccgcaaccagaacaaggagggggaccaguacaucuacaugggccagccccugaacaacgacgaggaccacgcccacuggaccgaggccaagaugcuccuggacaacaucaacacccccgaggggaucauccccgcccuguucgagccggagcgggagaaguccgcggccaucgacggcgaguaccgccuccgcggggaggcccgcaagacguucguggagcugaugcggcgcggcgaccugcccguguggcucuccuacaaggucgccagcgagggcuuccaguacuccgaccggcgcuggugcuucgacggggagcggaacaaccaggugcuggaggagaacauggacguggagaucuggaccaaggagggcgagcgcaagaagcugcggccccgcuggcucgacgcccggaccuacagcgacccccuggcgcugcgcgaguucaaggaguucgccgccgggcggcgcagcgucuccggcgaccucauccuggagaucggcaagcugccgcagcaccucacccugcgggcccagaacgcccuggacaaccucgugaugcugcacaacagcgagcagggcgggaaggcguaccgccacgccauggaggagcugcccgacaccaucgagacgcucaugcugcuggcccucaucgccgugcugaccgggggcgucacccuguucuuccucuccgggaagggccugggcaagaccagcaucgggcugcucugcgugauggcguccagcgugcugcuguggauggccuccgucgagccccacuggaucgccgccagcaucauccucgaguucuuccugauggugcugcucauccccgagccggaccggcagcgcacgccccaggacaaccagcuggccuacguggucaucggccuccucuucaugauccugaccguggcggccaacgagauggggcugcucgagaccaccaagaaggaccugggcaucgggcacguggucgccgagaaccaccaccacgccacgaugcuggacaucgaccuccaccccgccuccgcguggacccuguacgccguggccaccaccaucaucacgccgaugaugcgccacaccaucgagaacaccaccgccaacaucagccugacggccaucgcgaaccaggccgccauccucaugggccuggacaagggcuggcccaucuccaagauggacaucggggugccccugcucgcccugggcugcuacagccaggucaacccccugacccucaccgccgcggugcugaugcugguggcccacuacgccaucaucgggccgggccuccaggccaaggcgacccgggaggcccagaagcgcacggccgccgggaucaugaagaaccccaccgucgacggcaucguggccaucgaccuggaccccguggucuacgacgcgaaguucgagaagcagcugggccagaucaugcuccugauccugugcaccucccagauccuccugaugcggaccacgugggcccugugcgagagcaucacccucgccaccgggccccugaccacgcugugggagggcuccccggggaaguucuggaacaccaccaucgccgugagcauggccaacaucuuccgcggcuccuaccucgcgggcgccgggcuggccuucagccugaugaagucccucggcgggggccggcgcgggaccggcgcccagggcgagacgcugggggagaaguggaagcggcagcugaaccagcucagcaagagcgaguucaacaccuacaagcgcuccggcaucauggagguggaccggagcgaggccaaggaggggcugaagcgcggcgagaccaccaagcacgcggucucccgggggacggccaagcugcgcugguucguggagcggaaccuggugaagcccgagggcaaggucaucgaccucggcugcgggcgcggcggguggagcuacuacugcgccggccugaagaaggugaccgaggugaagggguacaccaagggcggccccgggcacgaggagcccaucccgauggccaccuacggcuggaacaucgucaagcugcacuccgggcgggacguguucuucacgccgcccgagaagugcgacacgcuccugugcgacaucggcgagagcucccccaacccgaccaucgaggaggggcgcacccugcgggugcucaagauggucgagcccuggcugcgcggcaaccaguucugcaucaagauccugaaccccuacaugcccagcgugguggagacccucgagcagaugcagcggaagcacggcgggaugcugguccgcaacccgcugucccgcaacagcacgcacgagauguacuggguguccugcggcaccgggaacaucgugagcgcggucaacaugaccucccggaugcuccugaaccgcuucaccauggcccaccggaagcccacguacgagcgcgacguggaccugggcgccggcacccggcacguggccgucgagcccgagaucgccaaccucgacaucaucgggcagcgcaucgagaacaucaagaacgagcacaagagcaccuggcacuacgacgaggacaaccccuacaagaccugggcguaccacggcuccuacgaggugaagccgagcggguccgccagcuccauggugaacggcgucgugcggcugcugacgaagcccugggacgucauccccauggugacccagaucgccaugaccgacaccacgcccuucgggcagcagcgcguguucaaggagaaggucgacacccggaccccgcgccccaagcggggcaccgcccagaucauggaggugacggccaaguggcucuggggcuuccugagccgcaacaagaagccccggaucugcacccgcgaggaguucacccggaaggugcgcagcaacgcggccaucggggccgucuucguggacgagaaccaguggaacuccgccaaggaggccguggaggacgagcgguucugggaccugguccaccgcgagcgggagcuccacaagcagggcaagugcgcgaccugcguguacaacaugauggggaagcgcgagaagaagcugggcgaguucgggaaggccaagggcagccgggccaucugguacauguggcugggcgcccgcuuccucgaguucgaggcgcugggguucaugaacgaggaccacugguucucccgcgagaacagccuguccggcguggagggggagggccuccacaagcugggguacauccugcgggacaucagcaagaucccgggcggcaacauguacgccgacgacacggccgggugggacacccgcaucaccgaggacgaccuccagaacgaggccaagaucaccgacaucauggagcccgagcacgcccugcuggcgacguccaucuucaagcucaccuaccagaacaaggucgugcgggugcagcgccccgccaagagcggcaccgucauggacgugaucucccggcgcgaccagcgggggagcggccaggugggcaccuacgggcugaacacguucaccaacauggagguccagcugauccgccagauggaguccgagggcaucuucagccccuccgagcucgagaacagcaaccuggccgagcgggugcuggacuggcucgagaagcacgggguggagcgccugaagcggauggccaucuccggcgacgacugcgucgugaagccgaccgacgaccgcuucgccaccgcgcugacggcccucaacgacauggggaaggugcggaaggacaucccccagugggagcccagcaagggcuggaacgacuggcagcagguccccuucugcucccaccacuuccaccagcugaucaugaaggacggccgcgagaucguggugccgugccggaaccaggacgagcuggucgggcgcgcccgggugagccagggcgccggguggagccuccgcgagaccgccugccugggcaaguccuacgcgcagauguggcagcugauguacuuccaccggcgcgaccuccgccuggccgccaacgccaucugcagcgccgugcccgucaacugggugcccaccucccggaccaccuggagcauccacgcgcaccaccaguggaugacgaccgaggacaugcuguccguguggaaccgcgucuggaucgaggagaaccccuggauggaggacaagacccacgugagcuccugggaggacgugccguaccucgggaagcgggaggaccaguggugcggcagccugaucggccugaccgcccgcgccacgugggccaccaacauccaggucgcgaucaaccaggugcggcgccucaucgggaacgagaacuaccuggacuacaugaccuccaugaagcgguucaagaacgagagcgaccccgagggcgcccugugguga

SEQ ID NO: 8934 - RNA, 9879 nt, Artificial Sequence
  derived and/or modified CDS sequence (opt1) from DENV-1__KM403597__SS-prME
agcgugaccaugcugcucaugcugcugcccaccgcccucgccuuccaccugaccacccggggcggggagccccacaugaucgugagcaagcaggagcggggcaagagccuccuguucaagaccuccgcgggggugaacaugugcacccugaucgccauggaccugggcgagcucugcgaggacacgaugaccuacaagugcccccggaucaccgaggccgagcccgacgacguggacugcuggugcaacgccaccgacaccugggucaccuacgggaccugcagccagaccggcgagcaccggcgcgaccggcgcuccguggcccuggcgccccacgugggccuggggcucgagacccggaccgagaccuggaugagcuccgagggcgccuggcgccagauccagcgggucgagaccugggcccugcgccaccccggguucacggugaucgcccuguuccucgcgcacgccaucggcaccagcaucacccagaaggggaucaucuucauccugcugaugcucgugacccccuccauggccaugcggugcgucggcaucggcaaccgcgacuucguggaggggcugagcggcgccacguggguggacgucgugcuggagcacggguccugcgugaccaccauggccaagaacaagcccacccucgacaucgagcugcugaagacggaggucaccaaccccgcggugcuccggaagcugugcaucgaggccaagaucagcaacaccaccacggacucccgcugccccacccagggcgaggccacccugguggaggagcaggacgccaacuucgucugccggcgcaccuucguggaccggggcugggggaacggcugcggccucuucggcaaggggagccugcugacgugcgccaaguucaagugcgugaccaagcucgagggcaagaucguccaguacgagaaccugaaguacuccgugaucgugaccguccacaccggcgaccagcaccagguggggaacgagacgaccgagcacggcaccaucgcgaccaucacgccccaggcccccacgagcgagauccagcugaccgacuacggggcccucacccuggacugcagcccccggaccggccuggacuucaacgagaugguccuccugacgaugaaggagaaguccuggcuggugcacaagcagugguuccucgaccugccgcugcccuggaccuccggggccagcaccagccaggagaccuggaaccggcaggaccuccuggugacguucaagaccgcccacgcgaagaagcaggaggucguggugcugggcucccaggagggcgccaugcacaccgcccucaccggggccacggagauccagaccagcggcaccaccacgaucuucgccgggcaccugaagugccgccugaagauggacaagcucacccugaagggcgucuccuacgugaugugcaccgggagcuucaagcuggagaaggagguggcggagacccagcacggcacgguccugguccaggugaaguacgagggcaccgacgcccccugcaagauccccaucuccacccaggacgagaagggggucacccagaacggccggcucaucacggccaacccgaucgugaccgacaaggagaagcccgugaacaucgagaccgagccgcccuucggggagagcuacaucgucaucggcgccggcgagaaggcgcugaagcuguccugguucaagaaggggagcuccaucggcaagauguucgaggccaccgcccgcggggcccgccggauggccauccucggcgacacggcgugggacuucgggagcaucggcggcguguucaccuccguggggaagcugguccaccagguguucggcaccgccuacggggugcuguucagcggcgucuccuggaccaugaagaucgggaucggcauccuccugacguggcugggccucaacagccgcuccaccagccuguccaugaccugcaucgccguggggauggugacccuguaccucggcgucauggugcaggccgacagcgggugcgugaucaacuggaagggccgggagcugaagugcggguccggcaucuucgucacgaacgaggugcacaccuggaccgagcaguacaaguuccaggccgacagcccgaagcgccugagcgcggccaucggcaaggccugggaggagggggugugcggcauccgguccgccacccgccucgagaacaucauguggaagcagaucagcaacgagcugaaccacauccugcucgagaacgacaugaaguucaccgucguggugggggacgccaacggcauccugacgcaggggaagaagaugauccggccccagcccauggagcacaaguacuccuggaaguccuggggcaaggcgaagaucaucggcgccgacacccagaacaccaccuucaucaucgacgggcccgacacgccggagugccccgacgaccagcgcgccuggaacaucugggaggucgaggacuacggcuucgggguguucaccaccaacaucuggcugaagcuccgggacuccuacacccagaugugcgaccaccgccugaugagcgccgcgaucaaggacuccaaggccgugcacgccgacaugggcuacuggaucgagagcgagaagaacgagacguggaagcuggcccgggccuccuucaucgaggucaagaccugcaucuggccccgcagccacacccucugguccaacggcgugcuggagagcgagaugaucauccccaagaucuacgggggcccgaucucccagcacaacuaccggcccggguacuucacccagacggcgggccccuggcaccuggggaagcucgagcuggacuucaaccugugcgagggcaccaccguggucguggacgagcacugcggcaaccgcgggccgagccuccggaccacgaccgugaccggcaagaucauccacgaguggugcugccgcuccugcacccugccgccccugcgguuccgcggggaggacggcugcugguacgggauggagauccggcccgucaaggagaaggaggagaaccucgugcgcagcaugguguccgccggcagcggcgaggucgacagcuucucccuggggcugcucugcgugagcaucaugaucgaggaggugaugcgcucccgguggagccgcaagaugcugaugacgggcacccuggccaucuucuuccuccugaucauggggcagcugaccuggaacgaccucauccggcugugcaucauggucggcgccaacguguccgaccgcauggggaugggcaccacguaccuggcccucauggcgaccuucaagaugcggccgauguucgccguggggcugcuguuccgccggcucaccagccgcgagguccugcugcucaccaucgggcugucccugguggccagcgucgagcuccccaacucccuggaggagcugggcgacgggcucgccaugggcaucaugaugcugaagcugcucacggacuuccagagccaccagcuguggaccacccugcucucccugaccuucaucaagacgacccugagccucgacuacgccuggaagaccauggcgauggugcuguccaucgugagccuguucccccucugccuguccaccacgagccagaagaccaccuggcugcccguccuccugggcuccuucgggugcaagccgcugaccauguuccucaucaccgagaacaagaucuggggccgcaagagcuggccccugaacgaggggaucauggccgugggcaucguguccauccugcucagcagccugcugaagaacgacgucccccucgccgggccccugaucgccggcggcaugcugaucgcgugcuacgugaucuccgggagcuccgccgaccucagccuggagcgcgccgccgagguguccugggaggaggaggccgagcacagcggcgcgucccacaacauccuggucgaggugcaggacgacgggacgaugaagaucaaggacgaggagcgggacgacacccucaccauccugcugaaggccacccuccuggccgugagcggcgucuacccgauguccauccccgccacgcuguucgugugguacuucuggcagaagaagaagcagcgcagcggggugcucugggacacccccagcccgcccgaggucgagcgggccgugcuggacgacggcaucuaccgcauccugcagcggggccugcucgggcgcagccaggugggcgucgggguguuccaggacggcguguuccacaccauguggcacgucacccgcggggcggugcugauguaccagggcaagcgccuggagcccuccugggccagcgugaagaaggaccucaucuccuacggcgggggcuggcgguuccaggggagcuggaacacgggcgaggagguccaggugaucgccguggagcccgggaagaaccccaagaacguccagaccacccccggcaccuucaagacgcccgagggcgaggugggggccaucgcccuggacuucaagcccggcaccuccgggagccccaucgugaaccgcgagggcaagaucgucggccuguacgggaacggcguggugaccaccuccgggacguacgucagcgcgaucgcccaggccaaggccagccaggagggcccgcuccccgagaucgaggacgagguguucaagaagcggaaccugaccaucauggaccugcaccccggguccggcaagacccgccgcuaccucccggccaucgugcgggaggcgaucaagcgcaagcugcggacccugauccucgcccccacgcgcgucguggccagcgagauggccgaggcgcugaagggcaugcccauccgguaccagaccaccgccgugaaguccgagcacaccgggaaggagaucgucgaccugaucugccacgccacguucaccaugcgccuccugagccccgugcgggugccgaacuacaacaugaucaucauggacgaggcccacuucaccgaccccgccuccaucgcggcccgcggcuacaucagcacccgggucgggaugggcgaggccgccgccaucuucaugacggcgacgccgcccggguccguggaggccuucccgcagagcaacgccgugauccaggacgaggagcgcgacauccccgagcgguccuggaacagcggcuacgacuggaucaccgacuuccccggcaagaccgucugguucgugcccuccaucaagagcgggaacgacaucgccaacugccugcgcaagaacggcaagcgggugauccagcucucccgcaagacguucgacaccgaguaccagaagaccaagaacaacgacugggacuacgucgugaccacggacaucagcgagaugggggccaacuuccgggcggaccgcgugaucgacccgcggcgcugccugaagcccgucauccugaaggacggccccgagcgggugauccucgccgggcccaugccggucaccgccgccuccgcggcccagcgccgcggccggaucggccgcaaccagaacaaggagggggaccaguacaucuacaugggccagccccugaacaacgacgaggaccacgcccacuggaccgaggccaagaugcugcucgacaacaucaacacccccgaggggaucauccccgcccuguucgagccggagcgggagaaguccgcggccaucgacggcgaguaccgccugcgcggggaggcccgcaagacguucguggagcucaugcggcgcggcgaccugcccguguggcuguccuacaaggucgccagcgagggcuuccaguacuccgaccggcgcuggugcuucgacggggagcggaacaaccaggugcucgaggagaacauggacguggagaucuggaccaaggagggcgagcgcaagaagcugcggccccgcuggcuggacgcccggaccuacagcgacccccucgcgcugcgcgaguucaaggaguucgccgccgggcggcgcagcgucuccggcgaccugauccucgagaucggcaagcugccgcagcaccugacccuccgggcccagaacgcccuggacaaccuggugaugcuccacaacagcgagcagggcgggaaggcguaccgccacgccauggaggagcugcccgacaccaucgagacgcugaugcuccuggcccugaucgccgugcucaccgggggcgucacccuguucuuccuguccgggaagggccucggcaagaccagcaucgggcugcugugcgugauggcguccagcgugcuccuguggauggccuccgucgagccccacuggaucgccgccagcaucauccuggaguucuuccucauggugcugcugauccccgagccggaccggcagcgcacgccccaggacaaccagcucgccuacguggucaucggccugcuguucaugauccucaccguggcggccaacgagauggggcugcuggagaccaccaagaaggaccucggcaucgggcacguggucgccgagaaccaccaccacgccacgaugcuggacaucgaccugcaccccgccuccgcguggacccucuacgccguggccaccaccaucaucacgccgaugaugcgccacaccaucgagaacaccaccgccaacaucagccugacggccaucgcgaaccaggccgccauccugaugggccucgacaagggcuggcccaucuccaagauggacaucggggugccccugcuggcccucggcugcuacagccaggucaacccccugacccugaccgccgcggugcucaugcugguggcccacuacgccaucaucgggccgggccugcaggccaaggcgacccgggaggcccagaagcgcacggccgccgggaucaugaagaaccccaccgucgacggcaucguggccaucgaccucgaccccguggucuacgacgcgaaguucgagaagcagcugggccagaucaugcugcucauccugugcaccucccagauccugcucaugcggaccacgugggcccugugcgagagcaucacccuggccaccgggccccucaccacgcugugggagggcuccccggggaaguucuggaacaccaccaucgccgugagcauggccaacaucuuccgcggcuccuaccuggcgggcgccgggcucgccuucagccugaugaagucccugggcgggggccggcgcgggaccggcgcccagggcgagacgcucggggagaaguggaagcggcagcugaaccagcugagcaagagcgaguucaacaccuacaagcgcuccggcaucauggagguggaccggagcgaggccaaggaggggcucaagcgcggcgagaccaccaagcacgcggucucccgggggacggccaagcugcgcugguucguggagcggaaccuggugaagcccgagggcaaggucaucgaccugggcugcgggcgcggcggguggagcuacuacugcgccggccucaagaaggugaccgaggugaagggguacaccaagggcggccccgggcacgaggagcccaucccgauggccaccuacggcuggaacaucgucaagcugcacuccgggcgggacguguucuucacgccgcccgagaagugcgacacgcugcucugcgacaucggcgagagcucccccaacccgaccaucgaggaggggcgcacccugcgggugcugaagauggucgagcccuggcuccgcggcaaccaguucugcaucaagauccugaaccccuacaugcccagcgugguggagacccuggagcagaugcagcggaagcacggcgggaugcucguccgcaacccgcugucccgcaacagcacgcacgagauguacuggguguccugcggcaccgggaacaucgugagcgcggucaacaugaccucccggaugcugcucaaccgcuucaccauggcccaccggaagcccacguacgagcgcgacguggaccugggcgccggcacccggcacguggccgucgagcccgagaucgccaaccuggacaucaucgggcagcgcaucgagaacaucaagaacgagcacaagagcaccuggcacuacgacgaggacaaccccuacaagaccugggcguaccacggcuccuacgaggugaagccgagcggguccgccagcuccauggugaacggcgucgugcggcuccugacgaagcccugggacgucauccccauggugacccagaucgccaugaccgacaccacgcccuucgggcagcagcgcguguucaaggagaaggucgacacccggaccccgcgccccaagcggggcaccgcccagaucauggaggugacggccaaguggcuguggggcuuccucagccgcaacaagaagccccggaucugcacccgcgaggaguucacccggaaggugcgcagcaacgcggccaucggggccgucuucguggacgagaaccaguggaacuccgccaaggaggccguggaggacgagcgguucugggaccugguccaccgcgagcgggagcugcacaagcagggcaagugcgcgaccugcguguacaacaugauggggaagcgcgagaagaagcucggcgaguucgggaaggccaagggcagccgggccaucugguacauguggcugggcgcccgcuuccuggaguucgaggcgcucggguucaugaacgaggaccacugguucucccgcgagaacagccuguccggcguggagggggagggccugcacaagcucggguacauccugcgggacaucagcaagaucccgggcggcaacauguacgccgacgacacggccgggugggacacccgcaucaccgaggacgaccugcagaacgaggccaagaucaccgacaucauggagcccgagcacgcccuccuggcgacguccaucuucaagcugaccuaccagaacaaggucgugcgggugcagcgccccgccaagagcggcaccgucauggacgugaucucccggcgcgaccagcgggggagcggccaggugggcaccuacgggcucaacacguucaccaacauggagguccagcugauccgccagauggaguccgagggcaucuucagccccuccgagcuggagaacagcaaccucgccgagcgggugcuggacuggcuggagaagcacgggguggagcgccucaagcggauggccaucuccggcgacgacugcgucgugaagccgaccgacgaccgcuucgccaccgcgcugacggcccugaacgacauggggaaggugcggaaggacaucccccagugggagcccagcaagggcuggaacgacuggcagcagguccccuucugcucccaccacuuccaccagcucaucaugaaggacggccgcgagaucguggugccgugccggaaccaggacgagcuggucgggcgcgcccgggugagccagggcgccggguggagccugcgcgagaccgccugccucggcaaguccuacgcgcagauguggcagcugauguacuuccaccggcgcgaccugcgccucgccgccaacgccaucugcagcgccgugcccgucaacugggugcccaccucccggaccaccuggagcauccacgcgcaccaccaguggaugacgaccgaggacaugcuguccguguggaaccgcgucuggaucgaggagaaccccuggauggaggacaagacccacgugagcuccugggaggacgugccguaccuggggaagcgggaggaccaguggugcggcagccucaucggccugaccgcccgcgccacgugggccaccaacauccaggucgcgaucaaccaggugcggcgccugaucgggaacgagaacuaccucgacuacaugaccuccaugaagcgguucaagaacgagagcgaccccgagggcgcccugugguga

SEQ ID NO: 8935 - RNA, 9879 nt, Artificial Sequence
  derived and/or modified CDS sequence (opt1) from DENV-1__KM403610__SS-prME
agcgugaccaugcugcucaugcugcugcccaccgcccucgccuuccaccugaccacccgcggcggggagccccacaugaucgugagcaagcaggagcggggcaagagccuccuguucaagaccuccgcgggggugaacaugugcacccugaucgccauggaccugggcgagcucugcgaggacacgaugaccuacaagugcccccgcaucaccgaggccgagcccgacgacguggacugcuggugcaacgccaccgacaccugggucaccuacgggaccugcagccagaccggcgagcaccggcgcgacaagcgguccguggcccuggcgccccacgugggccuggggcucgagacccgcaccgagaccuggaugagcuccgagggcgccuggcggcagauccagaaggucgagaccugggcccugcgccaccccggguucacggugaucgcccuguuccucgcgcacgccaucggcaccagcaucacccagaaggggaucaucuucauccugcugaugcucgugacccccuccauggccaugcggugcgucggcaucggcaaccgcgacuucguggaggggcugagcggcgccacguggguggacgucgugcuggagcacggguccugcgugaccaccauggccaagaacaagcccacccucgacaucgagcugcugaagacggaggucaccaaccccgcggugcuccggaagcugugcaucgaggccaagaucagcaacaccaccacggacucccgcugccccacccagggcgaggccacccugguggaggagcaggacgccaacuucgucugccggcgcaccuucguggaccggggcugggggaacggcugcggccucuucggcaaggggagccugcugacgugcgccaaguucaagugcgugaccaagcucgagggcaagaucguccaguacgagaaccugaaguacuccgugaucgugaccauccacaccggcgaccagcaccaggucgggaacgagacgaccgagcacggcaccaucgcgaccaucacgccccaggcccccacgagcgagauccagcugaccgacuacggggcccucacccuggacugcagcccccgcaccggccuggacuucaacgagauggugcuccugacgaugaaggagaaguccuggcugguccacaagcagugguuccucgaccugccgcugcccuggaccuccggggccagcaccagccaggagaccuggaaccggcaggaccuccuggugacguucaagaccgcccacgcgaagaagcaggagguggucgugcugggcucccaggagggcgccaugcacaccgcccucaccggggccacggagauccagaccagcggcaccaccacgaucuucgccgggcaccugaagugccgccugaagauggacaagcucacccugaagggcguguccuacgucaugugcaccgggagcuucaagcuggagaaggagguggcggagacccagcacggcacggugcugguccaggugaaguacgagggcaccgacgcccccugcaagauccccaucuccacccaggacgagaagggggugacccagaacggccggcucaucacggccaacccgaucgucaccgacaaggagaagcccgugaacaucgagaccgagccgcccuucggggagagcuacaucgugaucggcgccggcgagaaggcgcugaagcuguccugguucaagaaggggagcuccaucggcaagauguucgaggccaccgcccgcggggcccggcgcauggccauccucggcgacacggcgugggacuucgggagcaucggcggcgucuucaccuccguggggaagcuggugcaccaggucuucggcaccgccuacggggugcuguucagcggcguguccuggaccaugaagaucgggaucggcauccuccugacguggcugggccucaacagccgcuccaccagccuguccaugaccugcaucgccgucgggauggugacccuguaccucggcgugaugguccaggccgacagcgggugcgugaucaacuggaagggccgggagcugaagugcggguccggcaucuucgugacgaacgagguccacaccuggaccgagcaguacaaguuccaggccgacagcccgaagcgccugagcgcggccaucggcaaggccugggaggagggggugugcggcauccgguccgccacccgccucgagaacaucauguggaagcagaucagcuccgagcugaaccacauccugcucgagaacgacaugaaguucaccguggucgugggggacgccaacggcauccugacgcaggggaagaagaugauccggccccagcccauggagcacaaguacagcuggaaguccuggggcaaggcgaagaucaucggcgccgacacccagaacaccaccuucaucaucgacgggcccgacacgccggagugccccgacgaccagcgcgccuggaacaucugggagguggaggacuacggcuucggggucuucaccaccaacaucuggcugaagcuccgggacagcuacacccagaugugcgaccaccgccugauguccgccgcgaucaaggacagcaaggccgugcacgccgacaugggcuacuggaucgaguccgagaagaacgagacguggaagcuggcccgggccagcuucaucgaggugaagaccugcaucuggccccgcucccacacccucuggagcaacggcguccuggaguccgagaugaucauccccaagaucuacgggggcccgaucagccagcacaacuaccggcccggguacuucacccagacggcgggccccuggcaccuggggaagcucgagcuggacuucaaccugugcgagggcaccaccgugguggucgacgagcacugcggcaaccgcgggccgucccuccggaccacgaccgugaccggcaagaucauccacgaguggugcugccgcagcugcacccugccgccccugcgguuccgcggggaggacggcugcugguacgggauggagauccggcccgugaaggagaaggaggagaaccucguccgcuccauggugagcgccggcagcggcgagguggacuccuucagccuggggcugcucugcgucuccaucaugaucgaggaggugaugcggagccgcugguccaagaagaugcugaugacgggcacccuggccguguucuuccuccugaucauggggcagcugaccuggaacgaccucauccgccugugcaucauggucggcgccaacgugagcgaccggauggggaugggcaccacguaccuggcccucauggcgaccuucaagaugcgcccgauguucgccguggggcugcuguuccggcgccucaccucccgggagguccugcugcucaccaucgggcugagccugguggccuccgucgagcuccccaacagccuggaggagcugggcgacgggcucgccaugggcaucaugaugcugaagcugcucacggacuuccagucccaccagcuguggaccacccugcucagccugaccuucaucaagacgacccugucccucgacuacgccuggaagaccauggcgauggugcugagcaucgugucccuguucccccucugccugagcaccacgucccagaagaccaccuggcugcccguccuccugggcagcuucgggugcaagccgcugaccauguuccucaucaccgagaacaagaucuggggccgcaaguccuggccccugaacgaggggaucauggccgugggcaucgugagcauccugcucagcucccugcugaagaacgacgucccccucgccgggccccugaucgccggcggcaugcugaucgcgugcuacgugaucagcggguccagcgccgaccucucccuggagcgggccgccgaggugagcugggaggaggaggccgagcacuccggcgcgagccacaacauccuggucgaggugcaggacgacgggacgaugaagaucaaggacgaggagcgcgacgacacccucaccauccugcugaaggccacccuccuggccguguccggcgucuacccgaugagcauccccgccacgcuguucgugugguacuucuggcagaagaagaagcagcgguccggggugcucugggacacccccagcccgcccgaggucgagcgcgccgugcuggacgacggcaucuaccggauccugcagcgcggccugcucgggcggucccaggugggcgucgggguguuccaggacggcguguuccacaccauguggcacgucacccgcggggcggugcugauguaccagggcaagcggcuggagcccagcugggccuccgugaagaaggaccucaucagcuacggcgggggcuggcgcuuccagggguccuggaacacgggcgaggagguccaggugaucgccguggagcccgggaagaaccccaagaacguccagaccacccccggcaccuucaagacgcccgagggcgaggugggggccaucgcccuggacuucaagcccggcaccagcgggucccccaucgugaaccgggagggcaagaucgucggccuguacgggaacggcguggugaccaccagcgggacguacgucagcgcgaucgcccaggccaaggccucccaggagggcccgcuccccgagaucgaggacgagguguucaagaagcgcaaccugaccaucauggaccugcaccccgggagcggcaagacccggcgcuaccucccggccaucgugcgggaggcgaucaagcgcaagcugcgcacccugauccucgcccccacgcgggucguggccuccgagauggccgaggcgcugaagggcaugcccauccgcuaccagaccaccgccgucaagagcgagcacaccgggaaggagaucgucgaccugaugugccacgccacguucaccaugcggcuccugucccccgugcgcgugccgaacuacaacaugaucaucauggacgaggcccacuucaccgaccccgccagcaucgcggcccggggcuacaucuccacccgcgucgggaugggcgaggccgccgccaucuucaugacggcgacgccgcccgggagcguggaggccuucccgcaguccaacgccgugauccaggacgaggagcgggacauccccgagcgcagcuggaacuccggcuacgacuggaucaccgacuuccccggcaagaccgucugguucgugcccagcaucaaguccgggaacgacaucgccaacugccugcggaagaacggcaagcgcgugauccagcucagccggaagacguucgacaccgaguaccagaagaccaagaacaacgacugggacuacgucgugaccacggacaucuccgagaugggggccaacuuccgcgcggaccgggugaucgacccgcgccggugccugaagcccgucauccugaaggacggccccgagcgcgugauccucgccgggcccaugccggucaccgccgccagcgcggcccagcggcgcggccggaucggccgcaaccagaacaaggagggggaccaguacaucuacaugggccagccccugaacaacgacgaggaccacgcccacuggaccgaggccaagaugcugcucgacaacaucaacacccccgaggggaucauccccgcccuguucgagccggagcgcgagaaguccgcggccaucgacggcgaguaccggcugcgcggggaggcccggaagacguucguggagcucaugcgccggggcgaccugcccguguggcugagcuacaaggucgccuccgagggcuuccaguacagcgaccgccgguggugcuucgacggggagcgcaacaaccaggugcucgaggagaacauggacguggagaucuggaccaaggagggcgagcggaagaagcugcgcccccgguggcuggacgcccgcaccuacagcgacccccucgcgcugcgggaguucaaggaguucgccgccgggcgccgguccgucagcggcgaccugauccucgagaucggcaagcugccgcagcaccugacccuccgcgcccagaacgcccuggacaaccuggugaugcuccacaacuccgagcagggcgggaaggcguaccggcacgccauggaggagcugcccgacaccaucgagacgcugaugcuccuggcccugaucgccgugcucaccgggggcgucacccuguucuuccugagcgggaagggccucggcaagaccuccaucgggcugcugugcgugauggcgagcuccgugcuccuguggauggccagcgucgagccccacuggaucgccgccuccaucauccuggaguucuuccucauggugcugcugauccccgagccggaccgccagcggacgccccaggacaaccagcucgccuacguggucaucggccugcuguucaugauccucaccguggcggccaacgagauggggcugcuggagaccaccaagaaggaccucggcaucgggcacguggucgccgagaaccaccaccacgccacgaugcuggacaucgaccugcaccccgccagcgcguggacccucuacgccguggccaccaccaucaucacgccgaugaugcgccacaccaucgagaacaccaccgccaacaucucccugacggccaucgcgaaccaggccgccauccugaugggccucgacaagggcuggcccaucagcaagauggacaucggggugccccugcuggcccucggcugcuacucccaggucaacccccugacccugaccgccgcggugcucaugcugguggcccacuacgccaucaucgggccgggccugcaggccaaggcgacccgggaggcccagaagcgcacggccgccgggaucaugaagaaccccaccgucgacggcaucguggccaucgaccucgaccccguggucuacgacgcgaaguucgagaagcagcugggccagaucaugcugcucauccugugcaccagccagauccugcucaugcgcaccacgugggcccugugcgaguccaucacccuggccaccgggccccucaccacgcugugggagggcagcccggggaaguucuggaacaccaccaucgccguguccauggccaacaucuuccggggcagcuaccuggcgggcgccgggcucgccuucucccugaugaagucccugggcgggggccgccgggggaccggcgcccagggcgagacgcucggggagaaguggaagcgccagcugaaccagcugagcaaguccgaguucaacaccuacaagcggagcggcaucauggagguggaccgcuccgaggccaaggaggggcucaagcggggcgagaccaccaagcacgcggucagccgcgggacggccaagcugcggugguucguggagcgcaaccuggugaagcccgagggcaaggucaucgaccugggcugcgggcggggcgggugguccuacuacugcgccggccucaagaaggugaccgaggugaagggguacaccaagggcggccccgggcacgaggagcccaucccgauggccaccuacggcuggaacaucgucaagcugcacagcgggcgcgacguguucuucacgccgcccgagaagugcgacacgcugcucugcgacaucggcgaguccagccccaacccgaccaucgaggaggggcggacccugcgcgugcugaagauggucgagcccuggcuccggggcaaccaguucugcaucaagauccugaaccccuacaugcccuccgugguggagacccuggagcagaugcagcgcaagcacggcgggaugcucguccggaacccgcugagccgcaacuccacgcacgagauguacugggugagcugcggcaccgggaacaucguguccgcggucaacaugaccagccggaugcugcucaaccgcuucaccauggcccaccgcaagcccacguacgagcgggacguggaccugggcgccggcacccgccacguggccgucgagcccgagaucgccaaccuggacaucaucgggcagcggaucgagaacaucaagaacgagcacaaguccaccuggcacuacgacgaggacaaccccuacaagaccugggcguaccacggcagcuacgaggugaagccguccgggagcgccuccagcauggugaacggcgucgugcgccuccugacgaagcccugggacgucauccccauggugacccagaucgccaugaccgacaccacgcccuucgggcagcagcggguguucaaggagaaggucgacacccgcaccccgcggcccaagcgcggcaccgcccagaucauggaggugacggccaaguggcuguggggcuuccucagccggaacaagaagccccgcaucugcacccgggaggaguucacccgcaaggugcgguccaacgcggccaucggggccgucuucguggacgagaaccaguggaacagcgccaaggaggccguggaggacgagcgcuucugggaccugguccaccgggagcgcgagcugcacaagcagggcaagugcgcgaccugcguguacaacaugauggggaagcgggagaagaagcucggcgaguucgggaaggccaagggcucccgcgccaucugguacauguggcugggcgcccgguuccuggaguucgaggcgcucggguucaugaacgaggaccacugguucagccgcgagaacucccugagcggcguggagggggagggccugcacaagcucggguacauccugcgggacaucuccaagaucccgggcggcaacauguacgccgacgacacggccgggugggacacccgcaucaccgaggacgaccugcagaacgaggccaagaucaccgacaucauggagcccgagcacgcccuccuggcgacgagcaucuucaagcugaccuaccagaacaaggucgugcgcgugcagcggcccgccaaguccggcaccgucauggacgugaucagccgccgggaccagcgcggguccggccaggugggcaccuacgggcucaacacguucaccaacauggagguccagcugauccggcagauggagagcgagggcaucuuccugcccuccgagcucgagaacagcaaccuggccgagcgcgugcuggacuggcucgagaagcacgggguggagcggcugaagcgcauggccaucuccggcgacgacugcgucgugaagccgaccgacgaccgguucgccaccgcgcugacggcccucaacgacauggggaaggugcgcaaggacaucccccagugggagcccagcaagggcuggaacgacuggcagcagguccccuucugcucccaccacuuccaccagcugaucaugaaggacggccgggagaucguggugccgugccgcaaccaggacgagcuggucgggcgggcccgcgugagccagggcgccggguggagccuccgggagaccgccugccugggcaaguccuacgcgcagauguggcagcugauguacuuccaccgccgggaccuccgccuggccgccaacgccaucugcagcgccgugcccgucaacugggugcccaccucccggaccaccuggagcauccacgcgcaccaccaguggaugacgaccgaggacaugcuguccguguggaaccgcgucuggaucgaggagaaccccuggauggaggacaagacccacgugagcuccugggaggacgugccguaccucgggaagcgcgaggaccaguggugcggcagccugaucggccugaccgcccgggccacgugggccaccaacauccaggucgcgaucaaccaggugcgccggcucaucgggaacgagaacuaccuggacuacaugaccuccaugaagcgcuucaagaacgagagcgaccccgagggcgcccugugguga

SEQ ID NO: 8936 - RNA, 9879 nt, Artificial Sequence
  derived and/or modified CDS sequence (opt1) from DENV-1__KM403596__SS-prME
agcgugaccaugcugcucaugcugcugcccaccgcccucgccuuccaccugaccacccggggcggggagccccacaugaucgugagcaagcaggagcggggcaagagccuccuguucaagaccuccgcgggggugaacaugugcacccugaucgccauggaccugggcgagcucugcgaggacaccaugaccuacaagugcccccggaucaccgaggccgagcccgacgacguggacugcuggugcaacgccaccgacaccugggugaccuacgggaccugcagccagaccggcgagcaccggcgcgaccggcgcuccguggcccuggcgccccacgugggccuggggcucgagacgcggaccgagaccuggaugagcuccgagggcgccuggcgccagauccagcgggucgagaccugggcccugcgccaccccggguucaccgugaucgcccuguuccucgcgcacgccaucggcaccagcaucacccagaaggggaucaucuucauccugcugaugcucgugacccccuccauggccaugcggugcgucggcaucggcaaccgcgacuucguggaggggcugagcggcgccacguggguggacgucgugcuggagcacggguccugcgugaccaccauggccaagaacaagcccacccucgacaucgagcugcugaagacggaggucaccaaccccgcggugcuccggaagcugugcaucgaggccaagaucagcaacaccaccacggacucccgcugccccacccagggcgaggccacccugguggaggagcaggacgccaacuucgucugccggcgcaccuucguggaccggggcugggggaacggcugcggccucuucggcaaggggagccugcugacgugcgccaaguucaagugcgugaccaagcucgagggcaagaucguccaguacgagaaccugaaguacuccgugaucgugaccguccacaccggcgaccagcaccagguggggaacgagacgaccgagcacggcaccaucgcgaccaucacgccccaggcccccacgagcgagauccagcugaccgacuacggggcccucucccuggacugcagcccccgcaccggccuggacuucaacgagaugguccuccugaccaugaaggagaaguccuggcuggugcacaagcagugguuccucgaccugccgcugcccuggacgagcggggccagcaccucccaggagaccuggaaccggcaggaccuccuggugaccuucaagacggcccacgcgaagaagcaggaggucguggugcugggcagccaggagggcgccaugcacaccgcccucaccggggccaccgagauccagacguccggcaccaccaccaucuucgccgggcaccugaagugccgccugaagauggacaagcucacgcugaagggcgucagcuacgugaugugcaccggguccuucaagcuggagaaggagguggcggagacccagcacggcaccguccugguccaggugaaguacgagggcacggacgcccccugcaagauccccaucagcacccaggacgagaagggggucacccagaacggccggcucaucaccgccaacccgaucgugacggacaaggagaagcccgugaacaucgagaucgagccgcccuucggggaguccuacaucgucaucggcgccggcgagaaggcgcugaagcugagcugguucaagaagggguccagcaucggcaagauguucgaggccaccgcccgcggggcccgccggauggccauccucggcgacaccgcgugggacuucggguccaucggcggcguguucaccagcguggggaagcugguccaccagguguucggcacggccuacggggugcuguucuccggcgucagcuggaccaugaagaucgggaucggcauccuccugaccuggcugggccucaacucccgcagcaccucccugagcaugacgugcaucgccguggggauggugacccuguaccucggcgucauggugcaggccgacuccgggugcgugaucaacuggaagggccgggagcugaagugcgggagcggcaucuucgucaccaacgaggugcacaccuggacggagcaguacaaguuccaggccgacagcccgaagcgccuguccgcggccaucggcaaggccugggaggagggggugugcggcauccggagcgccacccgccucgagaacaucauguggaagcagaucuccaacgagcugaaccacauccugcucgagaacgacaugaaguucaccgucguggugggggacgccaacggcauccugacccaggggaagaagaugauccggccccagcccauggagcacaaguacagcuggaaguccuggggcaaggcgaagaucaucggcgccgacacccagaacacgaccuucaucaucgacgggcccgacaccccggagugccccgacgaccagcgcgccuggaacaucugggaggucgaggacuacggcuucgggguguucaccacgaacaucuggcugaagcuccgggacagcuacacccagaugugcgaccaccgccugauguccgccgcgaucaaggacagcaaggccgugcacgccgacaugggcuacuggaucgaguccgagaagaacgagaccuggaagcuggcccgggccagcuucaucgaggucaagaccugcaucuggccccgcucccacacgcucuggagcaacggcgugcuggaguccgagaugaucauccccaagaucuacgggggcccgaucagccagcacaacuaccggcccggguacuucacccagaccgcgggccccuggcaccuggggaagcucgagcuggacuucaaccugugcgagggcaccacgguggucguggacgagcacugcggcaaccgcgggccgucccuccggaccaccaccgugacgggcaagaucauccacgaguggugcugccgcagcugcacccugccgccccugcgguuccgcggggaggacggcugcugguacgggauggagauccggcccgucaaggagaaggaggagaaccucgugcgcuccauggugagcgccggcagcggcgaggucgacuccuucagccuggggcugcucugcguguccaucaugaucgaggaggugaugcgcagccgguggucccgcaagaugcugaugaccggcacccuggccaucuucuuccuccugaucauggggcagcugacguggaacgaccucauccggcugugcaucauggucggcgccaacgugagcgaccgcauggggaugggcaccaccuaccuggcccucauggcgaccuucaagaugcggccgauguucgccguggggcugcuguuccgccggcucacgucccgcgagguccugcugcucaccaucgggcugagccugguggccuccgucgagcuccccaacagccuggaggagcugggcgacgggcucgccaugggcaucaugaugcugaagcugcucaccgacuuccagucccaccagcuguggaccacgcugcucagccugaccuucaucaagaccacccugucccucgacuacgccuggaagacgauggcgauggugcugagcaucgugucccuguucccccucugccugagcaccaccucccagaagaccacguggcugcccguccuccugggcagcuucgggugcaagccgcugaccauguuccucaucaccgagaacaagaucuggggccggaaguccuggccccugaacgaggggaucauggccgugggcaucgugagcauccugcucagcucccugcugaagaacgacgucccccucgccgggccccugaucgccggcggcaugcugaucgcgugcuacgugaucagcggguccagcgccgaccucucccuggagcgcgccgccgaggugagcugggaggaggaggccgagcacuccggcgcgagccacaacauccuggucgaggugcaggacgacgggaccaugaagaucaaggacgaggagcgggacgacacccucacgauccugcugaaggccacccuccuggccguguccggcgucuacccgaugagcauccccgccacccuguucgugugguacuucuggcagaagaagaagcagcgcuccggggugcucugggacacccccagcccgcccgaggucgagcgggccgugcuggacgacggcaucuaccgcauccugcagcggggccugcucgggcgcucccaggugggcgucgggguguuccaggacggcguguuccacacgauguggcacgucacccgcggggcggugcugauguaccagggcaagcgccuggagcccagcugggccuccgugaagaaggaccucaucagcuacggcgggggcuggcgguuccagggguccuggaacaccggcgaggagguccaggugaucgccguggagcccgggaagaaccccaagaacguccagaccacgcccggcaccuucaagacccccgagggcgaggugggggccaucgcccuggacuucaagcccggcaccagcgggucccccaucgugaaccgcgagggcaagaucgucggccuguacgggaacggcguggugacgaccagcgggaccuacgucagcgcgaucgcccaggccaaggccucccaggagggcccgcuccccgagaucgaggacgagguguucaagaagcggaaccugaccaucauggaccugcaccccgggagcggcaagacgcgccgcuaccucccggccaucgugcgggaggcgaucaagcgcaagcugcggacccugauccucgcccccacccgcgucguggccuccgagauggccgaggcgcugaagggcaugcccauccgguaccagaccacggccgucaagagcgagcacaccgggaaggagaucgucgaccugaugugccacgccaccuucaccaugcgccuccugucccccgugcgggugccgaacuacaacaugaucaucauggacgaggcccacuucacggaccccgccagcaucgcggcccgcggcuacaucuccacccgggucgggaugggcgaggccgccgccaucuucaugaccgcgacgccgcccgggagcguggaggccuucccgcaguccaacgccgugauccaggacgaggagcgcgacauccccgagcggagcuggaacuccggcuacgacuggaucacggacuuccccggcaagaccgucugguucgugcccagcaucaaguccgggaacgacaucgccaacugccugcgcaagaacggcaagcgggugauccagcucagccgcaagaccuucgacaccgaguaccagaagacgaagaacaacgacugggacuacgucgugaccaccgacaucuccgagaugggggccaacuuccgggcggaccgcgugaucgacccgcggcgcugccugaagcccgucauccugaaggacggccccgagcgggugauccucgccgggcccaugccggucaccgccgccagcgcggcccagcgccgcggccggaucggccgcaaccagaacaaggagggggaccaguacaucuacaugggccagccccugaacaacgacgaggaccacgcccacuggacggaggccaagaugcugcucgacaacaucaacacccccgaggggaucauccccgcccuguucgagccggagcgggagaaguccgcggccaucgacggcgaguaccgccugcgcggggaggcccgcaagaccuucguggagcucaugcggcgcggcgaccugcccguguggcugagcuacaaggucgccuccgagggcuuccaguacagcgaccggcgcuggugcuucgacggggagcggaacaaccaggugcucgaggagaacauggacguggagaucuggaccaaggagggcgagcgcaagaagcugcggccccgcuggcuggacgcccggacguacagcgacccccucgcgcugcgcgaguucaaggaguucgccgccgggcggcgcuccgucagcggcgaccugauccucgagaucggcaagcugccgcagcaccugacccuccgggcccagaacgcccuggacaaccuggugaugcuccacaacuccgagcagggcgggaaggcguaccgccacgccauggaggagcugcccgacaccaucgagacccugaugcuccuggcccugaucgccgugcucaccgggggcgucacgcuguucuuccugagcgggaagggccucggcaagaccuccaucgggcugcugugcgugauggcgagcuccgugcuccuguggauggccagcgucgagccccacuggaucgccgccuccaucauccuggaguucuuccucauggugcugcugauccccgagccggaccggcagcgcacgccccaggacaaccagcucgccuacguggucaucggccugcuguucaugauccucaccguggcggccaacgagauggggcugcuggagacgaccaagaaggaccucggcaucgggcacguggucgccgagaaccaccaccacgccaccaugcuggacaucgaccugcaccccgccagcgcguggacccucuacgccguggccacgaccaucaucaccccgaugaugcgccacaccaucgagaacacgaccgccaacaucucccugaccgccaucgcgaaccaggccgccauccugaugggccucgacaagggcuggcccaucagcaagauggacaucggggugccccugcuggcccucggcugcuacucccaggucaacccccugacccugacggccgcggugcucaugcugguggcccacuacgccaucaucgggccgggccugcaggccaaggcgacccgggaggcccagaagcgcaccgccgccgggaucaugaagaaccccaccgucgacggcaucguggccaucgaccucgaccccguggucuacgacgcgaaguucgagaagcagcugggccagaucaugcugcucauccugugcacgagccagauccugcucaugcggaccaccugggcccugugcgaguccaucacccuggccacggggccccucaccacccugugggagggcagcccggggaaguucuggaacaccacgaucgccguguccauggccaacaucuuccgcggcagcuaccuggcgggcgccgggcucgccuucucccugaugaagucccugggcgggggccggcgcgggaccggcgcccagggcgagacccucggggagaaguggaagcggcagcugaaccagcugagcaaguccgaguucaacaccuacaagcgcagcggcaucauggagguggaccgguccgaggccaaggaggggcucaagcgcggcgagacgaccaagcacgcggucagccgggggaccgccaagcugcgcugguucguggagcggaaccuggugaagcccgagggcaaggucaucgaccugggcugcgggcgcggcgggugguccuacuacugcgccggccucaagaaggugaccgaggugaagggguacacgaagggcggccccgggcacgaggagcccaucccgauggccaccuacggcuggaacaucgucaagcugcacagcgggcgggacguguucuucacgccgcccgagaagugcgacacccugcucugcgacaucggcgaguccagccccaacccgaccaucgaggaggggcgcacgcugcgggugcugaagauggucgagcccuggcuccgcggcaaccaguucugcaucaagauccugaaccccuacaugcccuccgugguggagacccuggagcagaugcagcggaagcacggcgggaugcucguccgcaacccgcugagccgcaacuccacccacgagauguacugggugagcugcggcaccgggaacaucguguccgcggucaacaugacgagccggaugcugcucaaccgcuucaccauggcccaccggaagcccaccuacgagcgcgacguggaccugggcgccggcacccggcacguggccgucgagcccgagacggccaaccuggacaucaucgggcagcgcaucgagaacaucaagaacgagcacaaguccaccuggcacuacgacgaggacaaccccuacaagaccugggcguaccacggcagcuacgaggugaagccguccgggagcgccuccagcauggugaacggcgucgugcggcuccugaccaagcccugggacgucauccccauggugacgcagaucgccaugaccgacaccacccccuucgggcagcagcgcguguucaaggagaaggucgacacgcggaccccgcgccccaagcggggcaccgcccagaucauggaggugaccgccaaguggcuguggggcuuccucagccgcaacaagaagccccggaucugcacgcgcgaggaguucacccggaaggugcgcuccaacgcggccaucggggccgucuucguggacgagaaccaguggaacagcgccaaggaggccguggaggacgagcgguucugggaccugguccaccgcgagcgggagcugcacaagcagggcaagugcgcgaccugcguguacaacaugauggggaagcgcgagaagaagcucggcgaguucgggaaggccaagggcucccgggccaucugguacauguggcugggcgcccgcuuccuggaguucgaggcgcucggguucaugaacgaggaccacugguucagccgcgagaacucccugagcggcguggagggggagggccugcacaagcucggguacauccugcgggacaucuccaagaucccgggcggcaacauguacgccgacgacaccgccgggugggacacgcgcaucaccgaggacgaccugcagaacgaggccaagaucaccgacaucauggagcccgagcacgcccuccuggcgaccagcaucuucaagcugacguaccagaacaaggucgugcgggugcagcgccccgccaaguccggcaccgucauggacgugaucagccggcgcgaccagcggggguccggccaggugggcaccuacgggcucaacaccuucacgaacauggagguccagcugauccgccagauggagagcgagggcaucuucucccccagcgagcuggagaacuccaaccucgccgagcgggugcuggacuggcuggagaagcacgggguggagcgccucaagcggauggccaucagcggcgacgacugcgucgugaagccgaccgacgaccgcuucgccaccgcgcugaccgcccugaacgacauggggaaggugcggaaggacaucccccagugggagcccuccaagggcuggaacgacuggcagcagguccccuucugcagccaccacuuccaccagcucaucaugaaggacggccgcgagaucguggugccgugccggaaccaggacgagcuggucgggcgcgcccgggugagccagggcgccggguggucccugcgcgagacggccugccucggcaagagcuacgcgcagauguggcagcugauguacuuccaccggcgcgaccugcgccucgccgccaacgccaucugcuccgccgugcccgucaacugggugcccaccagccggaccaccugguccauccacgcgcaccaccaguggaugaccacggaggacaugcugagcguguggaaccgcgucuggaucgaggagaaccccuggauggaggacaagacccacguguccagcugggaggacgugccguaccuggggaagcgggaggaccaguggugcggcucccucaucggccugaccgcccgcgccaccugggccacgaacauccaggucgcgaucaaccaggugcggcgccugaucgggaacgagaacuaccucgacuacaugaccagcaugaagcgguucaagaacgaguccgaccccgagggcgcccugugguga

SEQ ID NO: 8937 - RNA, 9879 nt, Artificial Sequence
  derived and/or modified CDS sequence (opt1) from DENV-1__KM403616__SS-prME
agcgugaccaugcugcucaugcugcugcccaccgcccucgccuuccaccugaccacccggggcggggagccccacaugaucgugagcaagcaggagcggggcaagagccuccuguucaagaccuccgccggggugaacaugugcacccugaucgccauggaccugggcgagcucugcgaggacacgaugaccuacaagugcccccggaucaccgaggccgagcccgacgacguggacugcuggugcaacgccaccgacaccugggugaccuacgggaccugcagccagaccggcgagcaccggcgcgacaagcgguccguggcccuggcgccccacgugggccuggggcucgagacccgcaccgagaccuggaugagcuccgagggcgccuggcggcagauccagaaggucgagaccugggcccugcgccaccccggguucacggugaucgcccuguuccucgcgcacgccaucggcaccagcaucacccagaaggggaucaucuucauccugcugaugcucgugacccccuccauggccaugcggugcgucggcaucggcaaccgcgacuucguggaggggcugagcggcgccacguggguggacgucgugcuggagcacggguccugcgugaccaccauggccaagaacaagcccacccucgacaucgagcugcugaagacggaggucaccaaccccgcggugcuccggaagcugugcaucgaggccaagaucagcaacaccaccacggacucccgcugccccacccagggcgaggccacccugguggaggagcaggacgccaacuucgucugccggcgcaccuucguggaccggggcugggggaacggcugcggccucuucggcaaggggagccugcugacgugcgccaaguucaagugcgugaccaagcucgagggcaagaucguccaguacgagaaccugaaguacuccgugguggucaccgugcacaccggcgaccagcaccaggucgggaacgagacgaccgagcacggcaccaucgcgaccaucacgccccaggcccccacgagcgagauccagcugaccgacuacggggcccucacccuggacugcagcccccggaccggccuggacuucaacgagauggugcuccugacgaugaaggagaaguccuggcuggugcacaagcagugguuccucgaccugccgcugcccuggaccuccggggccagcaccagccaggagaccuggaaccggcaggaccuccuggucacguucaagaccgcccacgcgaagaagcaggagguggugguccugggcucccaggagggcgccaugcacaccgcccucaccggggccacggagauccagaccagcggcaccaccacgaucuucgccgggcaccugaagugccgccugaagauggacaagcucacccugaagggcguguccuacgugaugugcaccgggagcuucaagcuggagaaggaggucgcggagacccagcacggcacggugcuggugcaggucaaguacgagggcaccgacgcccccugcaagauccccaucuccacccaggacgagaagggggugacccagaacggccggcucaucacggccaacccgaucgugaccgacaaggagaagcccgucaacaucgagaccgagccgcccuucggggagagcuacaucgugaucggcgccggcgagaaggcgcugaagcuguccugguucaagaaggggagcuccaucggcaagauguucgaggccaccgcccgcggggcccggcgcauggccauccucggcgacacggcgugggacuucgggagcaucggcggcguguucaccuccgucgggaagcuggugcaccagguguucggcaccgccuacgggguccuguucagcggcguguccuggaccaugaagaucgggaucggcauccuccugacguggcugggccucaacagccgcuccaccagccuguccaugaccugcaucgccguggggauggucacccuguaccucggcgugauggugcaggccgacagcgggugcgucaucaacuggaagggccgggagcugaagugcggguccggcaucuucgugacgaacgaggugcacaccuggaccgagcaguacaaguuccaggccgacagcccgaagcgccugagcgcggccaucggcaaggccugggaggagggggucugcggcauccgguccgccacccgccucgagaacaucauguggaagcagaucagcaacgagcugaaccacauccugcucgagaacgacaugaaguucaccgugguggucggggacgccaacggcauccugacgcaggggaagaagaugauccggccccagcccauggagcacaaguacuccuggaaguccuggggcaaggcgaagaucaucggcgccgacacccagaacaccaccuucaucaucgacgggcccgacacgccggagugccccgacgaccagcgcgccuggaacaucugggagguggaggacuacggcuucgggguguucaccaccaacaucuggcugaagcuccgggacuccuacacccagaugugcgaccaccgccugaugagcgccgcgaucaaggacuccaaggccguccacgccgacaugggcuacuggaucgagagcgagaagaacgagacguggaagcuggcccgggccuccuucaucgaggugaagaccugcaucuggccccgcagccacacccucugguccaacggcgugcuggagagcgagaugaucauccccaagaucuacgggggcccgaucucccagcacaacuaccggcccggguacuucacccagacggcgggccccuggcaccuggggaagcucgagcuggacuucaaccugugcgagggcaccaccgucgugguggacgagcacugcggcaaccgcgggccgagccuccggaccacgaccgucaccggcaagaucauccacgaguggugcugccgcuccugcacccugccgccccugcgguuccgcggggaggacggcugcugguacgggauggagauccggcccgugaaggagaaggaggagaaccucgugcgcagcauggucuccgccggcagcggcgagguggacagcuucucccuggggcugcucugcgugagcaucaugaucgaggaggucaugcggucccgcuggagccgcaagaugcugaugacgggcacccuggccgccuucuuccuccugaucauggggcagcugaccuggaacgaccucauccggcugugcaucauggugggcgccaacguguccgaccgcauggggaugggcaccacguaccuggcgcucauggccaccuucaagaugcggccgauguucgccgucgggcugcuguuccgccggcucaccagccgcgaggugcugcugcucaccaucgggcugucccuggucgccagcguggagcuccccaacucccuggaggagcugggcgacgggcucgccaugggcaucaugaugcugaagcugcucacggacuuccagagccaccagcuguggaccacccugcucucccugaccuucaucaagacgacccugagccucgacuacgcguggaagaccauggccauggugcuguccaucgucagccuguucccccucugccuguccaccacgagccagaagaccaccuggcugcccgugcuccugggcuccuucgggugcaagccgcugaccauguuccucaucaccgagaacaagaucuggggccgcaagagcuggccccugaacgaggggaucauggccgugggcaucgucuccauccugcucagcagccugcugaagaacgacgugccccucgccgggccccugaucgcgggcggcaugcugaucgccugcuacgugaucuccgggagcuccgccgaccucagccuggagcgcgccgccgaggucuccugggaggaggaggcggagcacagcggcgccucccacaacauccugguggaggugcaggacgacgggacgaugaagaucaaggacgaggagcgggacgacacccucaccauccugcugaaggccacccuccuggccgucagcggcguguacccgauguccauccccgccacgcuguucgugugguacuucuggcagaagaagaagcagcgcagcgggguccucugggacacccccagcccgcccgagguggagcgggcggugcuggacgacggcaucuaccgcauccugcagcggggccugcucgggcgcagccaggucggcguggggguguuccaggacggcgucuuccacaccauguggcacgugacccgcggggccgugcugauguaccagggcaagcgccuggagcccuccugggccagcgucaagaaggaccucaucuccuacggcgggggcuggcgguuccaggggagcuggaacacgggcgaggagguccaggugaucgccgucgagcccgggaagaaccccaagaacgugcagaccacccccggcaccuucaagacgcccgagggcgaggugggggccaucgcgcuggacuucaagcccggcaccuccgggagccccaucgucaaccgcgagggcaagaucgugggccuguacgggaacggcguggucaccaccuccgggacguacgugagcgccaucgcccaggccaaggccagccaggagggcccgcuccccgagaucgaggacgagguguucaagaagcggaaccugaccaucauggaccugcaccccggguccggcaagacccgccgguaccucccggcgaucguccgcgaggccaucaagcgcaagcugcggacccugauccucgcccccacgcgcgugguggccagcgagauggcggaggcccugaagggcaugcccauccgguaccagaccaccgccgucaaguccgagcacaccgggaaggagaucguggaccugaugugccacgccacguucaccaugcgccuccugagccccgugcgggucccgaacuacaacaugaucaucauggacgaggcccacuucaccgaccccgcguccaucgccgcccgcggcuacaucagcacccggguggggaugggcgaggccgccgcgaucuucaugacggccacgccgcccggguccguggaggccuucccgcagagcaacgccgucauccaggacgaggagcgcgacauccccgagcgguccuggaacagcggcuacgacuggaucaccgacuuccccggcaagaccgugugguucgugcccuccaucaagagcgggaacgacaucgccaacugccugcgcaagaacggcaagcgggucauccagcucucccgcaagacguucgacaccgaguaccagaagaccaagaacaacgacugggacuacguggugaccacggacaucagcgagaugggggcgaacuuccgggccgaccgcgucaucgacccgcggcgcugccugaagcccgugauccugaaggacggccccgagcgggucauccucgccgggcccaugccggugaccgccgcguccgccgcccagcgccggggccgcaucggccgcaaccagaacaaggagggggaccaguacaucuacaugggccagccccugaacaacgacgaggaccacgcccacuggaccgaggccaagaugcugcucgacaacaucaacacccccgaggggaucauccccgcgcuguucgagccggagcgggagaaguccgccgccaucgacggcgaguaccgccugcgcggggaggcccgcaagacguucguggagcucaugcggcgcggcgaccugcccgucuggcuguccuacaagguggccagcgagggcuuccaguacuccgaccggcgcuggugcuucgacggggagcggaacaaccaggugcucgaggagaacauggacgucgagaucuggaccaaggagggcgagcgcaagaagcugcggccccgcuggcuggacgcgcggaccuacagcgacccccucgcccugcgcgaguucaaggaguucgccgccgggcggcgcagcguguccggcgaccugauccucgagaucggcaagcugccgcagcaccugacccuccgggcccagaacgcgcuggacaaccuggugaugcuccacaacagcgagcagggcgggaaggccuaccgccacgccauggaggagcugcccgacaccaucgagacgcugaugcuccuggcccugaucgcgguccucaccgggggcgugacccuguucuuccuguccgggaagggccucggcaagaccagcaucgggcugcugugcgugauggccuccagcguccuccuguggauggccuccguggagccccacuggaucgccgccagcaucauccuggaguucuuccucauggugcugcugauccccgagccggaccggcagcgcacgccccaggacaaccagcucgcguacgucgugaucggccugcuguucaugauccucaccguggccgccaacgagauggggcugcuggagaccaccaagaaggaccucggcaucgggcacgucguggccgagaaccaccaccacgccacgaugcuggacaucgaccugcaccccgcguccgccuggacccucuacgccguggccaccaccaucaucacgccgaugaugcggcacaccaucgagaacaccaccgccaacaucagccugacggcgaucgccaaccaggccgccauccugaugggccucgacaagggcuggcccaucuccaagauggacaucggggucccccugcuggcccucggcugcuacagccaggugaacccccugacccugaccgcggccgugcucaugcuggucgcccacuacgccaucaucgggccgggccugcaggcgaaggccacccgcgaggcccagaagcgcacggccgccgggaucaugaagaaccccaccguggacggcaucguggcgaucgaccucgaccccgucguguacgacgccaaguucgagaagcagcugggccagaucaugcugcucauccugugcaccucccagauccugcucaugcggaccacgugggcccugugcgagagcaucacccuggccaccgggccccucaccacgcugugggagggcuccccggggaaguucuggaacaccaccaucgccgugagcauggcgaacaucuuccgcggcuccuaccuggccggcgccgggcucgccuucagccugaugaagucccugggcgggggccggcgcgggaccggcgcccagggcgagacgcucggggagaaguggaagcggcagcugaaccagcugagcaagagcgaguucaacaccuacaagcgcuccggcaucauggaggucgaccggagcgaggcgaaggaggggcucaagcgcggcgagaccaccaagcacgccgugucccgggggacggccaagcugcgcugguucguggagcggaaccuggucaagcccgagggcaaggugaucgaccugggcugcgggcgcggcggguggagcuacuacugcgccggccucaagaaggugaccgaggucaagggguacaccaagggcggccccgggcacgaggagcccaucccgauggcgaccuacggcuggaacaucgugaagcugcacuccgggcgggacguguucuucacgccgcccgagaagugcgacacgcugcucugcgacaucggcgagagcucccccaacccgaccaucgaggaggggcgcacccugcggguccugaagaugguggagcccuggcuccgcggcaaccaguucugcaucaagauccugaaccccuacaugcccagcguggucgagacccuggagcagaugcagcggaagcacggcgggaugcucgugcgcaacccgcugucccggaacagcacgcacgagauguacuggguguccugcggcaccgggaacaucgucagcgccgugaacaugaccucccgcaugcugcucaaccgcuucaccauggcccaccggaagcccacguacgagcgcgacguggaccugggcgccggcacccggcacgucgccguggagcccgagaucgcgaaccuggacaucaucgggcagcgcaucgagaacaucaagaacgagcacaagagcaccuggcacuacgacgaggacaaccccuacaagaccugggccuaccacggcuccuacgaggugaagccgagcggguccgccagcuccauggucaacggcgugguccggcuccugacgaagcccugggacgugauccccauggugacccagaucgccaugaccgacaccacgcccuucgggcagcagcgcgucuucaaggagaagguggacacccggaccccgcgccccaagcggggcaccgcccagaucauggaggugacggcgaaguggcuguggggcuuccucagccgcaacaagaagccccggaucugcacccgcgaggaguucacccggaagguccgcagcaacgccgccaucggggccguguucguggacgagaaccaguggaacuccgccaaggaggcggucgaggacgagcgguucugggaccuggugcaccgcgagcgggagcugcacaagcagggcaagugcgcgaccugcguguacaacaugauggggaagcgcgagaagaagcucggcgaguucgggaaggccaagggcagccgggccaucugguacauguggcugggcgcgcgcuuccuggaguucgaggcccucggguucaugaacgaggaccacugguucucccgggagaacagccuguccggcgucgagggggagggccugcacaagcucggguacauccugcgcgacaucagcaagaucccgggcggcaacauguacgccgacgacacggccgggugggacacccgcaucaccgaggacgaccugcagaacgaggccaagaucaccgacaucauggagcccgagcacgcgcuccuggccacguccaucuucaagcugaccuaccagaacaagguggugcggguccagcgccccgccaagagcggcaccgugauggacgugaucucccggcgcgaccagcgggggagcggccaggucggcaccuacgggcucaacacguucaccaacauggaggugcagcugauccgccagauggaguccgagggcaucuucagccccuccgagcuggagaacagcaaccucgccgagcgggugcuggacuggcuggagaagcacggggucgagcgccucaagcggauggccaucuccggcgacgacugcguggugaagccgaccgacgaccgcuucgcgaccgcccugacggcccugaacgacauggggaagguccggaaggacaucccccagugggagcccagcaagggcuggaacgacuggcagcagguccccuucugcucccaccacuuccaccagcucaucaugaaggacggccgcgagaucguggucccgugccggaaccaggacgagcugguggggcgcgcccgggugagccagggcgccggguggagccugcgcgagaccgcgugccucggcaaguccuacgcccagauguggcagcugauguacuuccaccggcgcgaccugcggcucgccgccaacgccaucugcagcgcgguccccgugaacugggugcccaccucccgcaccaccuggagcauccacgcccaccaccaguggaugacgaccgaggacaugcuguccgucuggaaccgcguguggaucgaggagaaccccuggauggaggacaagacccacgugagcuccugggaggacgucccguaccuggggaagcgggaggaccaguggugcggcagccucaucggccugaccgcccgcgccacgugggcgaccaacauccagguggccaucaaccaggugcggcgccugaucgggaacgagaacuaccucgacuacaugaccuccaugaagcgguucaagaacgagagcgaccccgagggcgcccugugguga

SEQ ID NO: 8938 - RNA, 9879 nt, Artificial Sequence
  derived and/or modified CDS sequence (opt1) from DENV-1__KM403617__SS-prME
agcgugaccaugcugcucaugcugcugcccaccgcccucgccuuccaccugaccacccggggcggggagccccacaugaucgugagcaagcaggagcggggcaagagccuccuguucaagaccuccgcgggggugaacaugugcacccugaucgccauggaccugggcgagcucugcgaggacacgaugaccuacaagugcccccggaucaccgaggccgagcccgacgacguggacugcuggugcaacgccaccgacaccugggucaccuacgggaccugcagccagaccggcgagcaccggcgcgacaagcgguccguggcccuggcgccccacgugggccuggggcucgagacccgcaccgagaccuggaugagcuccgagggcgccuggcggcagauccagaaggucgagaccugggcccugcgccaccccggguucacggugaucgcccuguuccucgcgcacgccaucggcaccagcaucacccagaaggggaucaucuucauccugcugaugcucgugacccccuccauggccaugcggugcgucggcaucggcaaccgcgacuucguggaggggcugagcggcgccacguggguggacgucgugcuggagcacggguccugcgugaccaccauggccaagaacaagcccacccucgacaucgagcugcugaagacggaggucaccaaccccgcggugcuccggaagcugugcaucgaggccaagaucagcaacaccaccacggacucccgcugccccacccagggcgaggccacccugguggaggagcaggacgccaacuucgucugccggcgcaccuucguggaccggggcugggggaacggcugcggccucuucggcaaggggagccugcugacgugcgccaaguucaagugcgugaccaagcucgagggcaagaucguccaguacgagaaccugaaguacuccgugguggucaccgugcacaccggcgaccagcaccaggucgggaacgagacgaccgagcacggcaccaucgcgaccaucacgccccaggcccccacgagcgagauccagcugaccgacuacggggcccucacccuggacugcagcccccggaccggccuggacuucaacgagauggugcuccugacgaugaaggagaaguccuggcuggugcacaagcagugguuccucgaccugccgcugcccuggaccuccggggccagcaccagccaggagaccuggaaccggcaggaccuccuggucacguucaagaccgcccacgcgaagaagcaggagguggugguccugggcucccaggagggcgccaugcacaccgcccucaccggggccacggagauccagaccagcggcaccaccacgaucuucgccgggcaccugaagugccgccugaagauggacaagcucacccugaagggcguguccuacgugaugugcaccgggagcuucaagcuggagaaggaggucgcggagacccagcacggcacggugcuggugcaggucaaguacgagggcaccgacgcccccugcaagauccccaucuccacccaggacgagaagggggugacccagaacggccggcucaucacggccaacccgaucgugaccgacaaggagaagcccgucaacaucgagaccgagccgcccuucggggagagcuacaucgugaucggcgccggcgagaaggcgcugaagcuguccugguucaagaaggggagcuccaucggcaagauguucgaggccaccgcccgcggggcccggcgcauggccauccucggcgacacggcgugggacuucgggagcaucggcggcguguucaccuccgucgggaagcuggugcaccagguguucggcaccgccuacgggguccuguucagcggcguguccuggaccaugaagaucgggaucggcauccuccugacguggcugggccucaacagccgcuccaccagccuguccaugaccugcaucgccguggggauggucacccuguaccucggcgugauggugcaggccgacagcgggugcgucaucaacuggaagggccgggagcugaagugcggguccggcaucuucgugacgaacgaggugcacaccuggaccgagcaguacaaguuccaggccgacagcccgaagcgccugagcgcggccaucggcaaggccugggaggagggggucugcggcauccgguccgccacccgccucgagaacaucauguggaagcagaucagcaacgagcugaaccacauccugcucgagaacgacaugaaguucaccgugguggucggggacgccaacggcauccugacgcaggggaagaagaugauccggccccagcccauggagcacaaguacuccuggaaguccuggggcaaggcgaagaucaucggcgccgacacccagaacaccaccuucaucaucgacgggcccgacacgccggagugccccgacgaccagcgcgccuggaacaucugggagguggaggacuacggcuucgggguguucaccaccaacaucuggcugaagcuccgggacuccuacacccagaugugcgaccaccgccugaugagcgccgcgaucaaggacuccaaggccguccacgccgacaugggcuacuggaucgagagcgagaagaacgagacguggaagcuggcccgggccuccuucaucgaggugaagaccugcaucuggccccgcagccacacccucugguccaacggcgugcuggagagcgagaugaucauccccaagaucuacgggggcccgaucucccagcacaacuaccggcccggguacuucacccagacggcgggccccuggcaccuggggaagcucgagcuggacuucaaccugugcgagggcaccaccgucgugguggacgagcacugcggcaaccgcgggccgagccuccggaccacgaccgucaccggcaagaucauccacgaguggugcugccgcuccugcacccugccgccccugcgguuccgcggggaggacggcugcugguacgggauggagauccggcccgugaaggagaaggaggagaaccucgugcgcagcauggucuccgccggcagcggcgagguggacagcuucucccuggggcugcucugcgugagcaucaugaucgaggaggucaugcggucccgcuggagccgcaagaugcugaugacgggcacccuggccguguucuuccuccugaucauggggcagcugaccuggaacgaccucauccggcugugcaucauggugggcgccaacgucuccgaccgcauggggaugggcaccacguaccuggcccucauggcgaccuucaagaugcggccgauguucgccguggggcugcuguuccgccggcucaccagccgcgagguccugcugcucaccaucgggcugucccugguggccagcguggagcuccccaacucccuggaggagcugggcgacgggcucgccaugggcaucaugaugcugaagcugcucacggacuuccagagccaccagcuguggaccacccugcucucccugaccuucaucaagacgacccugagccucgacuacgccuggaagaccauggcgaugguccuguccaucgugagccuguucccccucugccuguccaccacgagccagaagaccaccuggcugcccgugcuccugggcuccuucgggugcaagccgcugaccauguuccucaucaccgagaacaagaucuggggccgcaagagcuggccccugaacgaggggaucauggccgucggcaucguguccauccugcucagcagccugcugaagaacgacgugccccucgccgggccccugaucgccggcggcaugcugaucgcgugcuacgucaucuccgggagcuccgccgaccucagccuggagcgcgccgccgagguguccugggaggaggaggccgagcacagcggcgcgucccacaacauccugguggagguccaggacgacgggacgaugaagaucaaggacgaggagcgggacgacacccucaccauccugcugaaggccacccuccuggccgugagcggcguguacccgauguccauccccgccacgcuguucgucugguacuucuggcagaagaagaagcagcgcagcggggugcucugggacacccccagcccgcccgagguggagcgggccguccuggacgacggcaucuaccgcauccugcagcggggccugcucgggcgcagccaggugggcgugggggucuuccaggacggcguguuccacaccauguggcacgugacccgcggggcgguccugauguaccagggcaagcgccuggagcccuccugggccagcgugaagaaggaccucaucuccuacggcgggggcuggcgguuccaggggagcuggaacacgggcgaggaggugcaggucaucgccguggagcccgggaagaaccccaagaacgugcagaccacccccggcaccuucaagacgcccgagggcgaggucggggccaucgcccuggacuucaagcccggcaccuccgggagccccaucgugaaccgcgagggcaagaucgugggccuguacgggaacggcgucgugaccaccuccgggacguacgugagcgcgaucgcccaggccaaggccagccaggagggcccgcuccccgagaucgaggacgaggucuucaagaagcggaaccugaccaucauggaccugcaccccggguccggcaagacccgccgguaccucccggccaucgugcgcgaggcgaucaagcgcaagcugcggacccugauccucgcccccacgcgcguggucgccagcgagauggccgaggcgcugaagggcaugcccauccgguaccagaccaccgccgugaaguccgagcacaccgggaaggagaucguggaccugaugugccacgccacguucaccaugcgccuccugagccccguccgggugccgaacuacaacaugaucaucauggacgaggcccacuucaccgaccccgccuccaucgcggcccgcggcuacaucagcacccggguggggaugggcgaggccgccgccaucuucaugacggcgacgccgcccggguccgucgaggccuucccgcagagcaacgccgugauccaggacgaggagcgcgacauccccgagcgguccuggaacagcggcuacgacuggaucaccgacuuccccggcaagaccgugugguucguccccuccaucaagagcgggaacgacaucgccaacugccugcgcaagaacggcaagcgggugauccagcucucccgcaagacguucgacaccgaguaccagaagaccaagaacaacgacugggacuacguggucaccacggacaucagcgagaugggggccaacuuccgggcggaccgcgugaucgacccgcggcgcugccugaagcccgucauccugaaggacggccccgagcgggugauccucgccgggcccaugccggugaccgccgccuccgcggcccagcgccggggccgcaucggccgcaaccagaacaaggagggggaccaguacaucuacaugggccagccccugaacaacgacgaggaccacgcccacuggaccgaggccaagaugcugcucgacaacaucaacacccccgaggggaucauccccgcccuguucgagccggagcgggagaaguccgcggccaucgacggcgaguaccgccugcgcggggaggcccgcaagacguucgucgagcucaugcggcgcggcgaccugcccguguggcuguccuacaagguggccagcgagggcuuccaguacuccgaccggcgcuggugcuucgacggggagcggaacaaccagguccucgaggagaacauggacguggagaucuggaccaaggagggcgagcgcaagaagcugcggccccgcuggcuggacgcccggaccuacagcgacccccucgcgcugcgcgaguucaaggaguucgccgccgggcggcgcagcguguccggcgaccugauccucgagaucggcaagcugccgcagcaccugacccuccgggcccagaacgcccuggacaaccuggucaugcuccacaacagcgagcagggcgggaaggcguaccgccacgccauggaggagcugcccgacaccaucgagacgcugaugcuccuggcccugaucgccgugcucaccgggggcgugacccuguucuuccuguccgggaagggccucggcaagaccagcaucgggcugcugugcgucauggcguccagcgugcuccuguggauggccuccguggagccccacuggaucgccgccagcaucauccuggaguucuuccucaugguccugcugauccccgagccggaccggcagcgcacgccccaggacaaccagcucgccuacguggugaucggccugcuguucaugauccucaccgucgcggccaacgagauggggcugcuggagaccaccaagaaggaccucggcaucgggcacgugguggccgagaaccaccaccacgccacgaugcuggacaucgaccugcaccccgccuccgcguggacccucuacgccgucgccaccaccaucaucacgccgaugaugcggcacaccaucgagaacaccaccgccaacaucagccugacggccaucgcgaaccaggccgccauccugaugggccucgacaagggcuggcccaucuccaagauggacaucggggugccccugcuggcccucggcugcuacagccaggugaacccccugacccugaccgccgcgguccucaugcugguggcccacuacgccaucaucgggccgggccugcaggccaaggcgacccgcgaggcccagaagcgcacggccgccgggaucaugaagaaccccaccguggacggcaucgucgccaucgaccucgaccccgugguguacgacgcgaaguucgagaagcagcugggccagaucaugcugcucauccugugcaccucccagauccugcucaugcggaccacgugggcccugugcgagagcaucacccuggccaccgggccccucaccacgcugugggagggcuccccggggaaguucuggaacaccaccaucgccgucagcauggccaacaucuuccgcggcuccuaccuggcgggcgccgggcucgccuucagccugaugaagucccugggcgggggccggcgcgggaccggcgcccagggcgagacgcucggggagaaguggaagcggcagcugaaccagcugagcaagagcgaguucaacaccuacaagcgcuccggcaucauggagguggaccggagcgaggccaaggaggggcucaagcgcggcgagaccaccaagcacgcggugucccgggggacggccaagcugcgcugguucgucgagcggaaccuggugaagcccgagggcaaggugaucgaccugggcugcgggcgcggcggguggagcuacuacugcgccggccucaagaaggucaccgaggugaagggguacaccaagggcggccccgggcacgaggagcccaucccgauggccaccuacggcuggaacaucgugaagcugcacuccgggcgggacgucuucuucacgccgcccgagaagugcgacacgcugcucugcgacaucggcgagagcucccccaacccgaccaucgaggaggggcgcacccugcgggugcugaagaugguggagcccuggcuccgcggcaaccaguucugcaucaagauccugaaccccuacaugcccagcgucguggagacccuggagcagaugcagcggaagcacggcgggaugcucgugcgcaacccgcugucccggaacagcacgcacgagauguacugggucuccugcggcaccgggaacaucgugagcgcggugaacaugaccucccgcaugcugcucaaccgcuucaccauggcccaccggaagcccacguacgagcgcgacgucgaccugggcgccggcacccggcacguggccguggagcccgagaucgccaaccuggacaucaucgggcagcgcaucgagaacaucaagaacgagcacaagagcaccuggcacuacgacgaggacaaccccuacaagaccugggcguaccacggcuccuacgaggucaagccgagcggguccgccagcuccauggugaacggcgucgugcggcuccugacgaagcccugggacgugauccccauggucacccagaucgccaugaccgacaccacgcccuucgggcagcagcgcguguucaaggagaagguggacacccggaccccgcgccccaagcggggcaccgcccagaucauggaggucacggccaaguggcuguggggcuuccucagccgcaacaagaagccccggaucugcacccgcgaggaguucacccggaaggugcgcagcaacgcggccaucggggccguguucgucgacgagaaccaguggaacuccgccaaggaggccguggaggacgagcgguucugggaccuggugcaccgcgagcgggagcugcacaagcagggcaagugcgcgaccugcgucuacaacaugauggggaagcgcgagaagaagcucggcgaguucgggaaggccaagggcagccgggccaucugguacauguggcugggcgcccgcuuccuggaguucgaggcgcucggguucaugaacgaggaccacugguucucccgggagaacagccuguccggcguggagggggagggccugcacaagcucggguacauccugcgcgacaucagcaagaucccgggcggcaacauguacgccgacgacacggccgggugggacacccgcaucaccgaggacgaccugcagaacgaggccaagaucaccgacaucauggagcccgagcacgcccuccuggcgacguccaucuucaagcugaccuaccagaacaaggugguccgggugcagcgccccgccaagagcggcaccgugauggacgucaucucccggcgcgaccagcgggggagcggccaggugggcaccuacgggcucaacacguucaccaacauggaggugcagcugauccgccagauggaguccgagggcaucuucagccccuccgagcuggagaacagcaaccucgccgagcggguccuggacuggcuggagaagcacgggguggagcgccucaagcggauggccaucuccggcgacgacugcguggucaagccgaccgacgaccgcuucgccaccgcgcugacggcccugaacgacauggggaaggugcggaaggacaucccccagugggagcccagcaagggcuggaacgacuggcagcagguccccuucugcucccaccacuuccaccagcucaucaugaaggacggccgcgagaucgucgugccgugccggaaccaggacgagcugguggggcgcgcccgggucagccagggcgccggguggagccugcgcgagaccgccugccucggcaaguccuacgcgcagauguggcagcugauguacuuccaccggcgcgaccugcggcucgccgccaacgccaucugcagcgccgugcccgugaacuggguccccaccucccgcaccaccuggagcauccacgcgcaccaccaguggaugacgaccgaggacaugcuguccguguggaaccgcguguggaucgaggagaaccccuggauggaggacaagacccacgucagcuccugggaggacgugccguaccuggggaagcgggaggaccaguggugcggcagccucaucggccugaccgcccgcgccacgugggccaccaacauccagguggcgaucaaccagguccggcgccugaucgggaacgagaacuaccucgacuacaugaccuccaugaagcgguucaagaacgagagcgaccccgagggcgcccugugguga

SEQ ID NO: 8939 - RNA, 9879 nt, Artificial Sequence
  derived and/or modified CDS sequence (opt1) from DENV-1__KM403635__SS-prME
agcgugaccaugcugcucaugcugcugcccaccgcccucgccuuccaccugaccacccggggcggggagccccacaugaucgugagcaagcaggagcggggcaagagccuccuguucaagaccuccgccggggugaacaugugcacccugaucgccauggaccugggcgagcucugcgaggacacgaugaccuacaagugcccccggaucaccgaggccgagcccgacgacguggacugcuggugcaacgccaccgacaccugggugaccuacgggaccugcagccagaccggcgagcaccggcgcgacaagcgguccguggcccuggcgccccacgugggccuggggcucgagacgcgcaccgagaccuggaugagcuccgagggcgccuggcggcagauccagaagguggagaccugggcccugcgccaccccggguucacggugaucgcccuguuccucgcgcacgccaucggcaccagcaucacccagaaggggaucaucuucauccugcugaugcucgugacccccuccauggccaugcggugcgucggcaucggcaaccgcgacuucguggaggggcugagcggcgccacguggguggacgucgugcuggagcacggguccugcgugaccaccauggccaagaacaagcccacccucgacaucgagcugcugaagacggaggucaccaaccccgcggugcuccggaagcugugcaucgaggccaagaucagcaacaccaccacggacucccgcugccccacccagggcgaggccacccugguggaggagcaggacgccaacuucgucugccggcgcaccuucguggaccggggcugggggaacggcugcggccucuucggcaaggggagccugcugacgugcgccaaguucaagugcgugaccaagcucgagggcaagaucguccaguacgagaaccugaaguacuccgugaucgugaccguccacaccggcgaccagcaccagguggggaacgagacgaccgagcacggcaccaucgcgaccaucacgccccaggcccccacgagcgagauccagcugaccgacuacggggcccucacccuggacugcagcccccggaccggccuggacuucaacgagaugguccuccugacgaugaaggagaaguccuggcuggugcacaagcagugguuccucgaccugccgcugcccuggaccuccggggccagcgccagccaggagaccuggaaccggcaggaccuccuggugaccuucaagacggcgcacgccaagaagcaggaggucguggugcugggcucccaggagggcgccaugcacaccgcccucaccggggccaccgagauccagacgagcggcaccaccaccaucuucgcggggcaccugaagugccgccugaagauggacaagcucacgcugaagggcgucuccuacgugaugugcaccgggagcuucaagcuggagaaggagguggccgagacccagcacggcaccguccugguccaggugaaguacgagggcacggacgcccccugcaagauccccaucuccacccaggacgagaagggggucacccagaacggccggcucaucaccgccaacccgaucgugacggacaaggagaagcccgugaacaucgagaccgagccgcccuucggggagagcuacaucgucaucggcgcgggcgagaaggcccugaagcuguccugguucaagaaggggagcuccaucggcaagauguucgaggccaccgcccgcggggcccggcgcauggcgauccucggcgacaccgccugggacuucgggagcaucggcggcguguucacguccguggggaagcugguccaccagguguucggcaccgccuacggggugcuguucagcggcgucuccuggaccaugaagaucgggaucggcauccuccugaccuggcugggccucaacagccgcuccacgagccuguccaugaccugcaucgccguggggauggugacccuguaccucggcgucauggugcaggccgacagcgggugcgugaucaacuggaagggccgggagcugaagugcggguccggcaucuucgucaccaacgaggugcacacguggaccgagcaguacaaguuccaggcggacagcccgaagcgccugagcgccgccaucggcaaggccugggaggagggggugugcggcauccgguccgccacccgccucgagaacaucauguggaagcagaucagcaacgagcugaaccacauccugcucgagaacgacaugaaguucaccgucguggugggggacgcgaacggcauccugacccaggggaagaagaugauccggccccagcccauggagcacaaguacuccuggaaguccuggggcaaggccaagaucaucggcgccgacacgcagaacaccaccuucaucaucgacgggcccgacaccccggagugccccgacgaccagcgcgccuggaacaucugggaggucgaggacuacggcuucgggguguucacgaccaacaucuggcugaagcuccgggacuccuacacccagaugugcgaccaccgccugaugagcgcggccaucaaggacuccaaggccgugcacgccgacaugggcuacuggaucgagagcgagaagaacgagaccuggaagcuggcccgggcguccuucaucgaggucaagacgugcaucuggccccgcagccacacccucugguccaacggcgugcuggagagcgagaugaucauccccaagaucuacgggggcccgaucucccagcacaacuaccggcccggguacuucacccagaccgccggccccuggcaccuggggaagcucgagcuggacuucaaccugugcgagggcacgaccguggucguggacgagcacugcggcaaccgcgggccgagccuccggaccaccacggugaccggcaagaucauccacgaguggugcugccgcuccugcacccugccgccccugcgguuccgcggggaggacggcugcugguacgggauggagauccggcccgucaaggagaaggaggagaaccucgugcgcagcaugguguccgccggcagcggcgaggucgacagcuucucccuggggcugcucugcgugagcaucaugaucgaggaggugaugcggucccgcuggagccgcaagaugcugaugaccggcacgcuggccgucuucuuccuccugaucauggggcagcugaccuggaacgaccucauccggcugugcaucauggugggcgccaacguguccgaccgcauggggaugggcaccaccuaccuggcgcucauggccacguucaagaugcggccgauguucgccgucggccugcuguuccgccggcucaccagccgcgaggugcugcugcucaccaucgggcugucccuggucgccagcguggagcuccccaacucccuggaggagcugggcgacgggcucgccaugggcaucaugaugcugaagcugcucaccgacuuccagagccaccagcuguggacgacccugcucucccugaccuucaucaagaccacgcugagccucgacuacgcguggaagaccauggccauggugcuguccaucgucagccuguucccccucugccuguccaccaccagccagaagacgaccuggcugcccgugcuccugggcuccuucgggugcaagccgcugaccauguuccucaucaccgagaacaagaucuggggccgcaagagcuggccccugaacgaggggaucauggccgugggcaucgucuccauccugcucagcagccugcugaagaacgacgugccccucgccgggccccugaucgcgggcggcaugcugaucgccugcuacgugaucuccgggagcuccgccgaccucagccuggagcgcgccgccgaggucuccugggaggaggaggcggagcacagcggcgccucccacaacauccugguggaggugcaggacgacgggaccaugaagaucaaggacgaggagcgggacgacacgcucaccauccugcugaaggccacccuccuggccgucagcggcguguacccgauguccauccccgccacccuguucgugugguacuucuggcagaagaagaagcagcgcagcgggguccucugggacacgcccagcccgcccgagguggagcgggcggugcuggacgacggcaucuaccgcauccugcagcggggccugcucgggcgcagccaggucggcguggggguguuccaggacggcgucuuccacaccauguggcacgugacccgcggggccgugcugauguaccagggcaagcgccuggagcccuccugggccagcgucaagaaggaccucaucuccuacggcgggggcuggcgguuccaggggagcuggaacaccggcgaggagguccaggugaucgccgucgagcccgggaagaaccccaagaacgugcagacgacccccggcaccuucaagacccccgagggcgaggugggggccaucgcgcuggacuucaagcccggcacguccgggagccccaucgucaaccgcgagggcaagaucgugggccuguacgggaacggcguggucaccaccuccgggaccuacgugagcgccaucgcccaggccaaggccagccaggagggcccgcuccccgagaucgaggacgagguguucaagaagcggaaccugacgaucauggaccugcaccccggguccggcaagacccgccgguaccucccggcgaucguccgcgaggccaucaagcgcaagcugcggacccugauccucgcccccacccgcgugguggccagcgagauggcggaggcccugaagggcaugcccauccgguaccagacgaccgccgucaaguccgagcacaccgggaaggagaucguggaccugaugugccacgccaccuucacgaugcgccuccugagccccgugcgggucccgaacuacaacaugaucaucauggacgaggcccacuucaccgaccccgcguccaucgccgcccgcggcuacaucagcacccggguggggaugggcgaggccgccgcgaucuucaugaccgccacgccgcccggguccguggaggccuucccgcagagcaacgccgucauccaggacgaggagcgcgacauccccgagcgguccuggaacagcggcuacgacuggaucaccgacuuccccggcaagaccgugugguucgugcccuccaucaagagcgggaacgacaucgccaacugccugcgcaagaacggcaagcgggucauccagcucucccgcaagaccuucgacacggaguaccagaagaccaagaacaacgacugggacuacguggugaccaccgacaucagcgagaugggggcgaacuuccgggccgaccgcgucaucgacccgcggcgcugccugaagcccgugauccugaaggacggccccgagcgggucauccucgccgggcccaugccggugacggccgcguccgccgcccagcgccggggccgcaucggccgcaaccagaacaaggagggggaccaguacaucuacaugggccagccccugaacaacgacgaggaccacgcccacuggaccgaggccaagaugcugcucgacaacaucaacacccccgaggggaucauccccgcgcuguucgagccggagcgggagaaguccgccgccaucgacggcgaguaccgccugcgcggggaggcccgcaagaccuucguggagcucaugcggcgcggcgaccugcccgucuggcuguccuacaagguggccagcgagggcuuccaguacuccgaccggcgcuggugcuucgacggggagcggaacaaccaggugcucgaggagaacauggacgucgagaucuggacgaaggagggcgagcgcaagaagcugcggccccgcuggcuggacgcgcggaccuacagcgacccccucgcccugcgcgaguucaaggaguucgccgccgggcggcgcagcguguccggcgaccugauccucgagaucggcaagcugccgcagcaccugacccuccgggcccagaacgcgcuggacaaccuggugaugcuccacaacagcgagcagggcgggaaggccuaccgccacgccauggaggagcugcccgacaccaucgagacccugaugcuccuggcccugaucgcgguccucaccggcggggugacccuguucuuccuguccgggaaggggcucggcaagaccagcaucgggcugcugugcgugauggccuccagcguccuccuguggauggccuccguggagccccacuggaucgccgccagcaucauccuggaguucuuccucauggugcugcugauccccgagccggaccggcagcgcacgccccaggacaaccagcucgcguacgucgugaucggccugcuguucaugauccucacgguggccgccaacgagauggggcugcuggagaccaccaagaaggaccucggcaucgggcacgucguggccgagaaccaccaccacgccaccaugcuggacaucgaccugcaccccgcguccgccuggacgcucuacgccguggccaccaccaucaucaccccgaugaugcggcacacgaucgagaacaccaccgccaacaucagccugaccgcgaucgccaaccaggccgccauccugaugggccucgacaagggcuggcccaucuccaagauggacaucggggucccccugcuggcccucggcugcuacagccaggugaacccccugacgcugaccgcggccgugcucaugcuggucgcccacuacgccaucaucgggccgggccugcaggcgaaggccacccgcgaggcccagaagcgcaccgccgccgggaucaugaagaaccccacgguggacggcaucguggcgaucgaccucgaccccgucguguacgacgccaaguucgagaagcagcugggccagaucaugcugcucauccugugcaccucccagauccugcucaugcggaccaccugggcccugugcgagagcaucacgcuggccaccgggccccucaccacccugugggagggcuccccggggaaguucuggaacacgaccaucgccgugagcauggcgaacaucuuccgcggcuccuaccuggccggcgccgggcucgccuucagccugaugaagucccugggcgggggccggcgcgggaccggcgcccagggcgagacccucggggagaaguggaagcggcagcugaaccagcugagcaagagcgaguucaacacguacaagcgcuccggcaucauggaggucgaccggagcgaggcgaaggaggggcucaagcgcggcgagaccaccaagcacgccgugucccgggggaccgccaagcugcgcugguucguggagcggaaccuggucaagcccgagggcaaggugaucgaccugggcugcgggcgcggcggguggagcuacuacugcgccggccucaagaaggugacggaggucaagggguacaccaagggcggccccgggcacgaggagcccaucccgauggcgaccuacggcuggaacaucgugaagcugcacuccgggcgggacguguucuucacgccgcccgagaagugcgacacccugcucugcgacaucggcgagagcucccccaacccgacgaucgaggaggggcgcacccugcggguccugaagaugguggagcccuggcuccgcggcaaccaguucugcaucaagauccugaaccccuacaugcccagcguggucgagacccuggagcagaugcagcggaagcacggcgggaugcucgugcgcaacccgcugucccggaacagcacccacgagauguacuggguguccugcggcacggggaacaucgucagcgccgugaacaugaccucccgcaugcugcucaaccgcuucaccauggcccaccggaagcccaccuacgagcgcgacguggaccugggcgccggcacgcggcacgucgccguggagcccgagaucgcgaaccuggacaucaucgggcagcgcaucgagaacaucaagaacgagcacaagagcaccuggcacuacgacgaggacaaccccuacaagaccugggccuaccacggcuccuacgaggugaagccgagcggguccgccagcuccauggucaacggcgugguccggcuccugaccaagcccugggacgugauccccauggugacgcagaucgccaugaccgacaccacccccuucgggcagcagcgcgucuucaaggagaagguggacacgcggaccccgcgccccaagcggggcaccgcccagaucauggaggugaccgcgaaguggcuguggggcuuccucagccgcaacaagaagccccggaucugcacgcgcgaggaguucacccggaagguccgcagcaacgccgccaucggggccguguucguggacgagaaccaguggaacuccgccaaggaggcggucgaggacgagcgguucugggaccuggugcaccgcgagcgggagcugcacaagcagggcaagugcgcgaccugcguguacaacaugauggggaagcgcgagaagaagcucggcgaguucgggaaggccaagggcagccgggccaucugguacauguggcugggcgcgcgcuuccuggaguucgaggcccucggguucaugaacgaggaccacugguucucccgggagaacagccuguccggcgucgagggggagggccugcacaagcucggguacauccugcgcgacaucagcaagaucccgggcggcaacauguacgccgacgacaccgccgggugggacacgcgcaucaccgaggacgaccugcagaacgaggccaagaucaccgacaucauggagcccgagcacgcgcuccuggccaccuccaucuucaagcugacguaccagaacaagguggugcggguccagcgccccgccaagagcggcaccgugauggacgugaucucccggcgcgaccagcgggggagcggccaggucggcaccuacgggcucaacaccuucacgaacauggaggugcagcugauccgccagauggaguccgagggcaucuucagccccuccgagcuggagaacagcaaccucgccgagcgggugcuggacuggcuggagaagcacggggucgagcgccucaagcggauggccaucuccggcgacgacugcguggugaagccgaccgacgaccgcuucgcgaccgcccugaccgcccugaacgacauggggaagguccggaaggacaucccccagugggagcccagcaagggcuggaacgacuggcagcagguccccuucugcucccaccacuuccaccagcucaucaugaaggacggccgcgagaucguggucccgugccggaaccaggacgagcugguggggcgcgcccgggugagccagggcgccggguggagccugcgcgagacggcgugccucggcaaguccuacgcccagauguggcagcugauguacuuccaccggcgcgaccugcggcucgccgccaacgccaucugcagcgcgguccccgugaacugggugcccaccucccgcaccaccuggagcauccacgcccaccaccaguggaugaccacggaggacaugcuguccgucuggaaccgcguguggaucgaggagaaccccuggauggaggacaagacccacgugagcuccugggaggacgucccguaccuggggaagcgggaggaccaguggugcggcagccucaucggccugaccgcccgcgccaccugggcgacgaacauccagguggccaucaaccaggugcggcgccuggucgggaacgagaacuaccucgacuacaugaccuccaugaagcgguucaagaacgagagcgaccccgagggcgcccugugguga

SEQ ID NO: 8940 - RNA, 9879 nt, Artificial Sequence
  derived and/or modified CDS sequence (opt1) from DENV-1__KM403621__SS-prME
agcgugaccaugcugcucaugcugcugcccaccgcccucgccuuccaccugaccacccggggcggggagccccacaugaucgugagcaagcaggagcggggcaagagccuccuguucaagaccuccgcgggggugaacaugugcacccugaucgccauggaccugggcgagcucugcgaggacacgaugaccuacaagugcccccggaucaccgaggccgagcccgacgacguggacugcuggugcaacgccaccgacaccugggugaccuacgggaccugcagccagaccggcgagcaccggcgcgacaagcgguccguggcccuggcgccccacgugggccuggggcucgagacccgcaccgagaccuggaugagcuccgagggcgccuggcggcagauccagaagguggagaccugggcccugcgccaccccggguucacggugaucgcccuguuccucgcgcacgccaucggcaccagcaucacccagaaggggaucaucuucauccugcugaugcucgugacccccuccauggccaugcggugcgucggcaucggcaaccgcgacuucguggaggggcugagcggcgccacguggguggacgucgugcuggagcacggguccugcgugaccaccauggccaagaacaagcccacccucgacaucgagcugcugaagacggaggucaccaaccccgcggugcuccggaagcugugcaucgaggccaagaucagcaacaccaccacggacucccgcugccccacccagggcgaggccacccugguggaggagcaggacgccaacuucgucugccggcgcaccuucguggaccggggcugggggaacggcugcggccucuucggcaaggggagccugcugacgugcgccaaguucaagugcgugaccaagcucgagggcaagaucguccaguacgagaaccugaaguacuccgugaucgugaccguccacaccggcgaccagcaccagguggggaacgagacgaccgagcacggcaccaucgcgaccaucacgccccaggcccccacgagcgagauccagcugaccgacuacggggcccucacccuggacugcagcccccggaccggccuggacuucaacgagaugguccuccugacgaugaaggagaaguccuggcuggugcacaagcagugguuccucgaccugccgcugcccuggaccuccggggccagcaccagccaggagaccuggaaccggcaggaccuccuggugacguucaagaccgcccacgcgaagaagcaggaggucguggugcugggcucccaggagggcgccaugcacaccgcccucaccggggccacggagauccagaccagcggcaccaccacgaucuucgccgggcaccugaagugccgccugaagauggacaagcucacccugaagggcgucuccuacgugaugugcaccgggagcuucaagcuggagaaggagguggcggagacccagcacggcacgguccugguccaggugaaguacgagggcaccgacgcccccugcaagauccccaucuccacccaggacgagaagggggucacccagaacggccggcucaucacggccaacccgaucgugaccgacaaggagaagcccgugaacaucgagaccgagccgcccuucggggagagcuacaucgucaucggcgccggcgagaaggcgcugaagcuguccugguucaagaaggggagcuccaucggcaagauguucgaggccaccgcccgcggggcccggcgcauggccauccucggcgacacggcgugggacuucgggagcaucggcggcguguucaccuccguggggaagcugguccaccagguguucggcaccgccuacggggugcuguucagcggcgucuccuggaccaugaagaucgggaucggcauccuccugacguggcugggccucaacagccgcuccaccagccuguccaugaccugcaucgccguggggauggugacccuguaccucggcgucauggugcaggccgacagcgggugcgugaucaacuggaagggccgggagcugaagugcggguccggcaucuucgucacgaacgaggugcacaccuggaccgagcaguacaaguuccaggccgacagcccgaagcgccugagcgcggccaucggcaaggccugggaggagggggugugcggcauccgguccgccacccgccucgagaacaucauguggaagcagaucagcaacgagcugaaccacauccugcucgagaacgacaugaaguucaccgucguggugggggacgccaacggcauccugacgcaggggaagaagaugauccggccccagcccauggagcacaaguacuccuggaaguccuggggcaaggcgaagaucaucggcgccgacacccagaacaccaccuucaucaucgacgggcccgacacgccggagugccccgacgaccagcgcgccuggaacaucugggaggucgaggacuacggcuucgggguguucaccaccaacaucuggcugaagcuccgggacuccuacacccagaugugcgaccaccgccugaugagcgccgcgaucaaggacuccaaggccgugcacgccgacaugggcuacuggaucgagagcgagaagaacgagacguggaagcuggcccgggccuccuucaucgaggucaagaccugcaucuggccccgcagccacacccucugguccaacggcgugcuggagagcgagaugaucauccccaagaucuacgggggcccgaucucccagcacaacuaccggcccggguacuucacccagacggcgggccccuggcaccuggggaagcucgagcuggacuucaaccugugcgagggcaccaccguggucguggacgagcacugcggcaaccgcgggccgagccuccggaccacgaccgugaccggcaagaucauccacgaguggugcugccgcuccugcacccugccgccccugcgguuccgcggggaggacggcugcugguacgggauggagauccggcccgucaaggagaaggaggagaaccucgugcgcagcaugguguccgccggcagcggcgaggucgacagcuucucccuggggcugcucugcgugagcaucaugaucgaggaggugaugcggucccgcuggagccgcaagaugcugaugacgggcacccuggccgucuucuuccuccugaucauggggcagcugaccuggaacgaccucauccggcugugcaucauggugggcgccaacguguccgaccgcauggggaugggcaccacguaccuggcccucauggcgaccuucaagaugcggccgauguucgccgucgggcugcuguuccgccggcucaccagccgcgaggugcugcugcucaccaucgggcugucccuggucgccagcguggagcuccccaacucccuggaggagcugggcgacgggcucgccaugggcaucaugaugcugaagcugcucacggacuuccagagccaccagcuguggaccacccugcucucccugaccuucaucaagacgacccugagccucgacuacgccuggaagaccauggcgauggugcuguccaucgucagccuguucccccucugccuguccaccacgagccagaagaccaccuggcugcccgugcuccugggcuccuucgggugcaagccgcugaccauguuccucaucaccgagaacaagaucuggggccgcaagagcuggccccugaacgaggggaucauggccgugggcaucgucuccauccugcucagcagccugcugaagaacgacgugccccucgccgggccccugaucgccggcggcaugcugaucgcgugcuacgugaucuccgggagcuccgccgaccucagccuggagcgcgccgccgaggucuccugggaggaggaggccgagcacagcggcgcgucccacaacauccugguggaggugcaggacgacgggacgaugaagaucaaggacgaggagcgggacgacacccucaccauccugcugaaggccacccuccuggccgucagcggcguguacccgauguccauccccgccacgcuguucgugugguacuucuggcagaagaagaagcagcgcagcgggguccucugggacacccccagcccgcccgagguggagcgggccgugcuggacgacggcaucuaccgcauccugcagcggggccugcucgggcgcagccaggucggcguggggguguuccaggacggcgucuuccacaccauguggcacgugacccgcggggccgugcugauguaccagggcaagcgccuggagcccuccugggccagcgucaagaaggaccucaucuccuacggcgggggcuggcgguuccaggggagcuggaacacgggcgaggagguccaggugaucgccgucgagcccgggaagaaccccaagaacgugcagaccacccccggcaccuucaagacgcccgagggcgaggugggggccaucgcccuggacuucaagcccggcaccuccgggagccccaucgucaaccgcgagggcaagaucgugggccuguacgggaacggcguggucaccaccuccgggacguacgugagcgcgaucgcccaggccaaggccagccaggagggcccgcuccccgagaucgaggacgagguguucaagaagcggaaccugaccaucauggaccugcaccccggguccggcaagacccgccgguaccucccggccaucguccgcgaggcgaucaagcgcaagcugcggacccugauccucgcccccacgcgcgugguggccagcgagauggccgaggcgcugaagggcaugcccauccgguaccagaccaccgccgucaaguccgagcacaccgggaaggagaucguggaccugaugugccacgccacguucaccaugcgccuccugagccccgugcgggucccgaacuacaacaugaucaucauggacgaggcccacuucaccgaccccgccuccaucgcggcccgcggcuacaucagcacccggguggggaugggcgaggccgccgccaucuucaugacggcgacgccgcccggguccguggagagcuucccgcaguccaacgccgucauccaggacgaggagcgcgacauccccgagcggagcuggaacuccggcuacgacuggaucaccgacuuccccggcaagaccgugugguucgugcccagcaucaaguccgggaacgacaucgccaacugccugcgcaagaacggcaagcgggucauccagcucagccgcaagacguucgacaccgaguaccagaagaccaagaacaacgacugggacuacguggugaccacggacaucuccgagaugggggccaacuuccgggccgaccgcgucaucgacccgcggcgcugccugaagcccgugauccugaaggacggccccgagcgggucauccucgcggggcccaugccggugaccgccgccagcgccgcgcagcgccggggccgcaucggccgcaaccagaacaaggagggggaccaguacaucuacaugggccagccccugaacaacgacgaggaccacgcccacuggaccgaggccaagaugcugcucgacaacaucaacacccccgaggggaucauccccgcccuguucgagccggagcgggagaaguccgccgcgaucgacggcgaguaccgccugcgcggggaggcccgcaagacguucguggagcucaugcggcgcggcgaccugcccgucuggcugagcuacaagguggccuccgagggcuuccaguacagcgaccggcgcuggugcuucgacggggagcggaacaaccaggugcucgaggagaacauggacgucgagaucuggaccaaggagggcgagcgcaagaagcugcggccccgcuggcuggacgcccggaccuacagcgacccccucgcccugcgcgaguucaaggaguucgcggccgggcggcgcuccgugagcggcgaccugauccucgagaucggcaagcugccgcagcaccugacccuccgggcccagaacgcccuggacaaccuggugaugcuccacaacuccgagcagggcgggaaggccuaccgccacgcgauggaggagcugcccgacaccaucgagacgcugaugcuccuggcccugaucgccguccucaccgggggcgugacccuguucuuccugagcgggaagggccucggcaagaccuccaucgggcugcugugcgugauggccagcuccguccuccuguggauggcgagcguggagccccacuggaucgccgccuccaucauccuggaguucuuccucauggugcugcugauccccgagccggaccggcagcgcacgccccaggacaaccagcucgccuacgucgugaucggccugcuguucaugauccucaccguggccgcgaacgagauggggcugcuggagaccaccaagaaggaccucggcaucgggcacgucguggccgagaaccaccaccacgccacgaugcuggacaucgaccugcaccccgccagcgccuggacccucuacgcgguggccaccaccaucaucacgccgaugaugcggcacaccaucgagaacaccaccgccaacaucucccugacggccaucgccaaccaggcggccauccugaugggccucgacaagggcuggcccaucagcaagauggacaucggggucccccugcuggcccucggcugcuacucccaggugaacccccugacccugaccgccgccgugcucaugcuggucgcgcacuacgccaucaucgggccgggccugcaggccaaggccacccgcgaggcgcagaagcgcacggccgccgggaucaugaagaaccccaccguggacggcaucguggccaucgaccucgaccccgucguguacgacgccaaguucgagaagcagcugggccagaucaugcugcucauccugugcaccagccagauccugcucaugcggaccacgugggcgcugugcgaguccaucacccuggccaccgggccccucaccacgcugugggagggcagcccggggaaguucuggaacaccaccaucgccguguccauggccaacaucuuccgcggcagcuaccuggccggcgcggggcucgccuucucccugaugaagucccugggcgggggccggcgcgggaccggcgcccagggcgagacgcucggggagaaguggaagcggcagcugaaccagcugagcaaguccgaguucaacaccuacaagcgcagcggcaucauggaggucgaccgguccgaggccaaggaggggcucaagcgcggcgagaccaccaagcacgccgugagccgggggacggcgaagcugcgcugguucguggagcggaaccuggucaagcccgagggcaaggugaucgaccugggcugcgggcgcggcgggugguccuacuacugcgccggccucaagaaggugaccgaggucaagggguacaccaagggcggccccgggcacgaggagcccaucccgauggccaccuacggcuggaacaucgugaagcugcacagcgggcgggacguguucuucacgccgcccgagaagugcgacacgcugcucugcgacaucggcgaguccagccccaacccgaccaucgaggaggggcgcacccugcggguccugaagaugguggagcccuggcuccgcggcaaccaguucugcaucaagauccugaaccccuacaugcccuccguggucgagacccuggagcagaugcagcggaagcacggcgggaugcucgugcgcaacccgcugagccggaacuccacgcacgagauguacugggugagcugcggcaccgggaacaucgucuccgccgugaacaugaccagccgcaugcugcucaaccgcuucaccauggcgcaccggaagcccacguacgagcgcgacguggaccugggcgccggcacccggcacgucgccguggagcccgagaucgccaaccuggacaucaucgggcagcgcaucgagaacaucaagaacgagcacaaguccaccuggcacuacgacgaggacaaccccuacaagaccugggccuaccacggcagcuacgaggugaagccguccgggagcgcguccagcauggucaacggcgugguccggcuccugacgaagcccugggacgugauccccauggugacccagaucgccaugaccgacaccacgcccuucgggcagcagcgcgucuucaaggagaagguggacacccggaccccgcgccccaagcggggcaccgcccagaucauggaggugacggccaaguggcuguggggcuuccucagccgcaacaagaagccccggaucugcacccgcgaggaguucacccggaagguccgcuccaacgccgcgaucggggccguguucguggacgagaaccaguggaacagcgccaaggaggccgucgaggacgagcgguucugggaccuggugcaccgcgagcgggagcugcacaagcagggcaagugcgcgaccugcguguacaacaugauggggaagcgcgagaagaagcucggcgaguucgggaaggcgaagggcucccgggccaucugguacauguggcugggcgcccgcuuccuggaguucgaggcccucggguucaugaacgaggaccacugguucagccgggagaacucccugagcggcgucgagggggagggccugcacaagcucggguacauccugcgcgacaucuccaagaucccgggcggcaacauguacgcggacgacacggccgggugggacacccgcaucaccgaggacgaccugcagaacgaggccaagaucaccgacaucauggagcccgagcacgcccuccuggccacgagcaucuucaagcugaccuaccagaacaagguggugcggguccagcgccccgcgaaguccggcaccgugauggacgugaucagccggcgcgaccagcggggguccggccaggucggcaccuacgggcucaacacguucaccaacauggaggugcagcugauccgccagauggagagcgagggcaucuucucccccagcgagcuggagaacuccaaccucgccgagcgggugcuggacuggcuggagaagcacggggucgagcgccucaagcggauggccaucagcggcgacgacugcguggugaagccgaccgacgaccgcuucgccaccgcccugacggcgcugaacgacauggggaagguccggaaggacaucccccagugggagcccuccaagggcuggaacgacuggcagcagguccccuucugcagccaccacuuccaccagcucaucaugaaggacggccgcgagaucguggucccgugccggaaccaggacgagcugguggggcgcgcccgggugagccagggcgccggguggucccugcgcgagaccgccugccucggcaagagcuacgcccagauguggcagcugauguacuuccaccggcgcgaccugcggcucgcggccaacgccaucugcuccgccguccccgugaacugggugcccaccagccgcaccaccugguccauccacgcccaccaccaguggaugacgaccgaggacaugcugagcgucuggaaccgcguguggaucgaggagaaccccuggauggaggacaagacccacguguccagcugggaggacgucccguaccuggggaagcgggaggaccaguggugcggcucccucaucggccugaccgcgcgcgccacgugggccaccaacauccagguggccaucaaccaggugcggcgccugaucgggaacgagaacuaccucgacuacaugaccagcaugaagcgguucaagaacgaguccgaccccgagggcgcgcugugguga

SEQ ID NO: 8941 - RNA, 9879 nt, Artificial Sequence
  derived and/or modified CDS sequence (opt1) from DENV-1__KM403623__SS-prME
agcgugaccaugcugcucaugcugcugcccaccgcccucgccuuccaccugaccacccggggcggggagccccacaugaucgugagcaagcaggagcggggcaagagccuccucuucaagaccuccgcgggggugaacaugugcacccugaucgccauggaccugggcgagcucugcgaggacacgaugaccuacaagugcccccggaucaccgaggccgagcccgacgacguggacugcuggugcaacgccaccgacaccugggugaccuacgggaccugcagccagaccggcgagcaccggcgcgacaagcgguccguggcccuggcgccccacgugggccuggggcucgagacccgcaccgagaccuggaugagcuccgagggcgccuggcggcagauccagaagguggagaccugggcccugcgccaccccggguucacggugaucgccuucuuccuggcgcacgccaucggcaccagcaucacccagaaggggaucaucuucauccuccugaugcuggugacccccuccauggccaugcggugcgucggcaucggcaaccgcgacuucguggaggggcucagcggcgccacguggguggacgucgugcuggagcacggguccugcgugaccaccauggccaagaacaagcccacccuggacaucgagcuccugaagacggaggucaccaaccccgcggugcugcggaagcucugcaucgaggccaagaucagcaacaccaccacggacucccgcugccccacccagggcgaggccacccugguggaggagcaggacgccaacuucgucugccggcgcaccuucguggaccggggcugggggaacggcugcgggcuguucggcaaggggagccuccugacgugcgccaaguucaagugcgugaccaagcuggagggcaagaucguccaguacgagaaccucaaguacuccgugaucgugaccguccacaccggcgaccagcaccagguggggaacgagacgaccgagcacggcaccaucgcgaccaucacgccccaggcccccacgagcgagauccagcugaccgacuacggggcccugacccucgacugcagcccccggaccggccuggacuucaacgagaugguccugcucacgaugaaggagaaguccuggcuggugcacaagcagugguuccuggaccucccgcugcccuggaccuccggggccagcaccagccaggagaccuggaaccggcaggaccugcucgugacguucaagaccgcccacgcgaagaagcaggaggucguggugcugggcucccaggagggcgccaugcacaccgcccugaccggggccacggagauccagaccagcggcaccaccacgaucuucgccgggcaccucaagugccgccugaagauggacaagcugacccucaagggcgucuccuacgugaugugcaccgggagcuucaagcuggagaaggagguggcggagacccagcacggcacgguccugguccaggugaaguacgagggcaccgacgcccccugcaagauccccaucuccacccaggacgagaagggggucacccagaacggccggcugaucacggccaacccgaucgugaccgacaaggagaagcccgugaacaucgagaccgagccgcccuucggggagagcuacaucgucaucggcgccggcgagaaggcgcucaagcuguccugguucaagaaggggagcuccaucggcaagauguucgaggccaccgcccgcggggcccggcgcauggccauccugggcgacacggcgugggacuucgggagcaucggcggcguguucaccuccguggggaagcucguccaccagguguucggcaccgccuacggggugcuguucagcggcgucuccuggaccaugaagaucgggaucggcauccugcucacguggcugggccugaacagccgcuccaccagccucuccaugaccugcaucgccguggggauggugacccuguaccugggcgucauggugcaggccgacagcgggugcgugaucaacuggaagggccgggagcucaagugcggguccggcaucuucgucacgaacgaggugcacaccuggaccgagcaguacaaguuccaggccgacagcccgaagcgccugagcgcggccaucggcaaggccugggaggagggggugugcggcauccgguccgccacccgccuggagaacaucauguggaagcagaucagcaacgagcucaaccacauccugcuggagaacgacaugaaguucaccgucguggugggggacgccaacggcauccucacgcaggggaagaagaugauccggccccagcccauggagcacaaguacuccuggaaguccuggggcaaggcgaagaucaucggcgccgacacccagaacaccaccuucaucaucgacgggcccgacacgccggagugccccgacgaccagcgcgccuggaacaucugggaggucgaggacuacggcuucgggguguucaccaccaacaucuggcugaagcugcgggacuccuacacccagaugugcgaccaccgccucaugagcgccgcgaucaaggacuccaaggccgugcacgccgacaugggcuacuggaucgagagcgagaagaacgagacguggaagcuggcccgggccuccuucaucgaggucaagaccugcaucuggccccgcagccacacccugugguccaacggcgugcucgagagcgagaugaucauccccaagaucuacgggggcccgaucucccagcacaacuaccggcccggguacuucacccagacggcgggccccuggcaccuggggaagcuggagcucgacuucaaccugugcgagggcaccaccguggucguggacgagcacugcggcaaccgcgggccgagccugcggaccacgaccgugaccggcaagaucauccacgaguggugcugccgcuccugcacccugccgccccugcgguuccgcggggaggacggcugcugguacgggauggagauccggcccgucaaggagaaggaggagaaccuggugcgcagcaugguguccgccggcagcggcgaggucgacagcuucucccucgggcugcugugcgugagcaucaugaucgaggaggugaugcggucccgcuggagccgcaagaugcucaugacgggcacccuggccgucuucuuccugcucaucauggggcagcugaccuggaacgaccugauccggcucugcaucauggugggcgccaacguguccgaccgcauggggaugggcaccacguaccuggcccugauggcgaccuucaagaugcggccgauguucgccgucggccuccuguuccgccggcugaccagccgcgaggugcuccugcugaccaucgggcucucccuggucgccagcguggagcugcccaacucccucgaggagcugggcgacgggcuggccaugggcaucaugaugcucaagcugcugacggacuuccagagccaccagcucuggaccacccugcugucccucaccuucaucaagacgacccugagccuggacuacgccuggaagaccauggcgauggugcucuccaucgucagccuguucccccugugccucuccaccacgagccagaagaccaccuggcugcccgugcugcucggcuccuucgggugcaagccgcugaccauguuccugaucaccgagaacaagaucuggggccgcaagagcuggccccucaacgaggggaucauggccgugggcaucgucuccauccugcugagcagccuccugaagaacgacgugccccuggccgggccccucaucgccggcggcaugcugaucgcgugcuacgugaucuccgggagcuccgccgaccugagccucgagcgcgccgccgaggucuccugggaggaggaggccgagcacagcggcgcgucccacaacauccugguggaggugcaggacgacgggacgaugaagaucaaggacgaggagcgggacgacacccugaccauccuccugaaggccacccugcucgccgucagcggcguguacccgauguccauccccgccacgcuguucgugugguacuucuggcagaagaagaagcagcgcagcgggguccugugggacacccccagcccgcccgagguggagcgggccgugcucgacgacggcaucuaccgcauccugcagcggggccugcuggggcgcagccaggucggcguggggguguuccaggacggcgucuuccacaccauguggcacgugacccgcggggccgugcucauguaccagggcaagcgccuggagcccuccugggccagcgucaagaaggaccugaucuccuacggcgggggcuggcgguuccaggggagcuggaacacgggcgaggagguccaggugaucgccgucgagcccgggaagaaccccaagaacgugcagaccacccccggcaccuucaagacgcccgagggcgaggugggggccaucgcccucgacuucaagcccggcaccuccgggagccccaucgucaaccgcgagggcaagaucgugggccuguacgggaacggcguggucaccaccuccgggacguacgugagcgcgaucgcccaggccaaggccagccaggagggcccgcugcccgagaucgaggacgagguguucaagaagcggaaccucaccaucauggaccugcaccccggguccggcaagacccgccgguaccugccggccaucguccgcgaggcgaucaagcgcaagcuccggacccugauccuggcccccacgcgcgugguggccagcgagauggccgaggcgcucaagggcaugcccauccgguaccagaccaccgccgucaaguccgagcacaccgggaaggagaucguggaccugaugugccacgccacguucaccaugcgccugcucagccccgugcgggucccgaacuacaacaugaucaucauggacgaggcccacuucaccgaccccgccuccaucgcggcccgcggcuacaucagcacccggguggggaugggcgaggccgccgccaucuucaugacggcgacgccgcccggguccguggagagcuucccgcaguccaacgccgucauccaggacgaggagcgcgacauccccgagcggagcuggaacuccggcuacgacuggaucaccgacuuccccggcaagaccgugugguucgugcccagcaucaaguccgggaacgacaucgccaacugccugcgcaagaacggcaagcgggucauccagcugagccgcaagacguucgacaccgaguaccagaagaccaagaacaacgacugggacuacguggugaccacggacaucuccgagaugggggccaacuuccgggccgaccgcgucaucgacccgcggcgcugccucaagcccgugauccugaaggacggccccgagcgggucauccuggcggggcccaugccggugaccgccgccagcgccgcgcagcgccggggccgcaucggccgcaaccagaacaaggagggggaccaguacaucuacaugggccagccccucaacaacgacgaggaccacgcccacuggaccgaggccaagaugcugcuggacaacaucaacacccccgaggggaucauccccgcccucuucgagccggagcgggagaaguccgccgcgaucgacggcgaguaccgccugcgcggggaggcccgcaagacguucguggagcugaugcggcgcggcgaccuccccgucuggcugagcuacaagguggccuccgagggcuuccaguacagcgaccggcgcuggugcuucgacggggagcggaacaaccaggugcuggaggagaacauggacgucgagaucuggaccaaggagggcgagcgcaagaagcuccggccccgcuggcuggacgcccggaccuacagcgacccccuggcccuccgcgaguucaaggaguucgcggccgggcggcgcuccgugagcggcgaccugauccuggagaucggcaagcucccgcagcaccugacccugcgggcccagaacgcccucgacaaccuggugaugcugcacaacuccgagcagggcgggaaggccuaccgccacgcgauggaggagcuccccgacaccaucgagacgcugaugcugcucgcccugaucgccguccugaccgggggcgugacccucuucuuccugagcgggaagggccugggcaagaccuccaucgggcuccugugcgugauggccagcuccguccugcucuggauggcgagcguggagccccacuggaucgccgccuccaucauccuggaguucuuccugauggugcuccugauccccgagccggaccggcagcgcacgccccaggacaaccagcuggccuacgucgugaucggccuccuguucaugauccugaccguggccgcgaacgagauggggcuccuggagaccaccaagaaggaccugggcaucgggcacgucguggccgagaaccaccaccacgccacgaugcucgacaucgaccugcaccccgccagcgccuggacccuguacgcgguggccaccaccaucaucacgccgaugaugcggcacaccaucgagaacaccaccgccaacaucucccucacggccaucgccaaccaggcggccauccugaugggccuggacaagggcuggcccaucagcaagauggacaucggggucccccuccuggcccugggcugcuacucccaggugaacccccucacccugaccgccgccgugcugaugcucgucgcgcacuacgccaucaucgggccgggccugcaggccaaggccacccgcgaggcgcagaagcgcacggccgccgggaucaugaagaaccccaccguggacggcaucguggccaucgaccuggaccccgucguguacgacgccaaguucgagaagcagcucggccagaucaugcugcugauccucugcaccagccagauccugcugaugcggaccacgugggcgcucugcgaguccaucacccuggccaccgggccccugaccacgcucugggagggcagcccggggaaguucuggaacaccaccaucgccguguccauggccaacaucuuccgcggcagcuaccuggccggcgcggggcuggccuucucccucaugaagucccugggcgggggccggcgcgggaccggcgcccagggcgagacgcugggggagaaguggaagcggcagcucaaccagcugagcaaguccgaguucaacaccuacaagcgcagcggcaucauggaggucgaccgguccgaggccaaggaggggcugaagcgcggcgagaccaccaagcacgccgugagccgggggacggcgaagcuccgcugguucguggagcggaaccuggucaagcccgagggcaaggugaucgaccugggcugcgggcgcggcgggugguccuacuacugcgccggccugaagaaggugaccgaggucaagggguacaccaagggcggccccgggcacgaggagcccaucccgauggccaccuacggcuggaacaucgugaagcuccacagcgggcgggacguguucuucacgccgcccgagaagugcgacacgcugcugugcgacaucggcgaguccagccccaacccgaccaucgaggaggggcgcacccuccggguccugaagaugguggagcccuggcugcgcggcaaccaguucugcaucaagauccucaaccccuacaugcccuccguggucgagacccuggagcagaugcagcggaagcacggcgggaugcuggugcgcaacccgcucagccggaacuccacgcacgagauguacugggugagcugcggcaccgggaacaucgucuccgccgugaacaugaccagccgcaugcugcugaaccgcuucaccauggcgcaccggaagcccacguacgagcgcgacguggaccucggcgccggcacccggcacgucgccguggagcccgagaucgccaaccuggacaucaucgggcagcgcaucgagaacaucaagaacgagcacaaguccaccuggcacuacgacgaggacaaccccuacaagaccugggccuaccacggcagcuacgaggugaagccguccgggagcgcguccagcauggucaacggcgugguccggcugcucacgaagcccugggacgugauccccauggugacccagaucgccaugaccgacaccacgcccuucgggcagcagcgcgucuucaaggagaagguggacacccggaccccgcgccccaagcggggcaccgcccagaucauggaggugacggccaaguggcuguggggcuuccugagccgcaacaagaagccccggaucugcacccgcgaggaguucacccggaagguccgcuccaacgccgcgaucggggccguguucguggacgagaaccaguggaacagcgccaaggaggccgucgaggacgagcgguucugggaccucgugcaccgcgagcgggagcugcacaagcagggcaagugcgcgaccugcguguacaacaugauggggaagcgcgagaagaagcugggcgaguucgggaaggcgaagggcucccgggccaucugguacauguggcucggcgcccgcuuccuggaguucgaggcccugggguucaugaacgaggaccacugguucagccgggagaacucccucagcggcgucgagggggagggccugcacaagcugggguacauccuccgcgacaucuccaagaucccgggcggcaacauguacgcggacgacacggccgggugggacacccgcaucaccgaggacgaccugcagaacgaggccaagaucaccgacaucauggagcccgagcacgcccugcucgccacgagcaucuucaagcugaccuaccagaacaagguggugcggguccagcgccccgcgaaguccggcaccgugauggacgugaucagccggcgcgaccagcggggguccggccaggucggcaccuacgggcugaacacguucaccaacauggaggugcagcucauccgccagauggagagcgagggcaucuucucccccagcgagcuggagaacuccaaccuggccgagcgggugcucgacuggcuggagaagcacggggucgagcgccugaagcggauggccaucagcggcgacgacugcguggugaagccgaccgacgaccgcuucgccaccgcccucacggcgcugaacgacauggggaagguccggaaggacaucccccagugggagcccuccaagggcuggaacgacuggcagcagguccccuucugcagccaccacuuccaccagcugaucaugaaggacggccgcgagaucguggucccgugccggaaccaggacgagcucguggggcgcgcccgggugagccagggcgccggguggucccugcgcgagaccgccugccugggcaagagcuacgcccagauguggcagcucauguacuuccaccggcgcgaccugcggcuggcggccaacgccaucugcuccgccguccccgugaacugggugcccaccagccgcaccaccugguccauccacgcccaccaccaguggaugacgaccgaggacaugcucagcgucuggaaccgcguguggaucgaggagaaccccuggauggaggacaagacccacguguccagcugggaggacgucccguaccuggggaagcgggaggaccaguggugcggcucccugaucggccucaccgcgcgcgccacgugggccaccaacauccagguggccaucaaccaggugcggcgccugaucgggaacgagaacuaccuggacuacaugaccagcaugaagcgguucaagaacgaguccgaccccgagggcgcgcucugguga

SEQ ID NO: 8942 - RNA, 9879 nt, Artificial Sequence
  derived and/or modified CDS sequence (opt1) from DENV-1__KM403575__SS-prME
agcgugaccaugcugcucaugcugcugcccaccgcccucgccuuccaccugaccacccggggcggggagccccacaugaucgugagcaagcaggagcggggcaagagccuccuguucaagaccuccgcgggggugaacaugugcacccugaucgccauggaccugggcgagcucugcgaggacacgaugaccuacaagugcccccggaucaccgaggccgagcccgacgacguggacugcuggugcaacgccaccgacaccugggugaccuacgggaccugcagccagaccggcgagcaccggcgcgacaagcgguccguggcccuggcgccccacgugggccuggggcucgagacccgcaccgagaccuggaugagcuccgagggcgccuggcggcagauccagaagguggagaccugggcccugcgccaccccggguucacggugaucgcccuguuccucgcgcacgccaucggcaccagcaucacccagaaggggaucaucuucauccugcugaugcucgugacccccuccauggccaugcggugcgucggcaucggcaaccgcgacuucguggaggggcugagcggcgccacguggguggacgucgugcuggagcacggguccugcgugaccaccauggccaagaacaagcccacccucgacaucgagcugcugaagacggaggucaccaaccccgcggugcuccggaagcugugcaucgaggccaagaucagcaacaccaccacggacucccgcugccccacccagggcgaggccacccugguggaggagcaggacgccaacuucgucugccggcgcaccuucguggaccggggcugggggaacggcugcggccucuucggcaaggggagccugcugacgugcgccaaguucaagugcgugaccaagcucgagggcaagaucguccaguacgagaaccugaaguacuccgugaucgugaccguccacaccggcgaccagcaccagguggggaacgagacgaccgagcacggcaccaucgcgaccaucacgccccaggcccccacgagcgagauccagcugaccgacuacggggcccucacccuggacugcagcccccggaccggccuggacuucaacgagaugguccuccugacgaugaaggagaaguccuggcuggugcacaagcagugguuccucgaccugccgcugcccuggaccuccggggccagcaccagccaggagaccuggaaccggcaggaccuccuggugacguucaagaccgcccacgcgaagaagcaggaggucguggugcugggcucccaggagggcgccaugcacaccgcccucaccggggccacggagauccagaccagcggcaccaccacgaucuucgccgggcaccugaagugccgccugaagauggacaagcucacccugaagggcgucuccuacgugaugugcaccgggagcuucaagcuggagaaggagguggcggagacccagcacggcacgguccugguccaggugaaguacgagggcaccgacgcccccugcaagauccccaucuccacccaggacgagaagggggucacccagaacggccggcucaucacggccaacccgaucgugaccgacaaggagaagcccgugaacaucgagaccgagccgcccuucggggagagcuacaucgucaucggcgccggcgagaaggcgcugaagcuguccugguucaagaaggggagcuccaucggcaagauguucgaggccaccgcccgcggggcccggcgcauggccauccucggcgacacggcgugggacuucgggagcaucggcggcguguucaccuccguggggaagcugguccaccagguguucggcaccgccuacggggugcuguucagcggcgucuccuggaccaugaagaucgggaucggcauccuccugacguggcugggccucaacagccgcuccaccagccuguccaugaccugcaucgccguggggauggugacccuguaccucggcgucauggugcaggccgacagcgggugcgugaucaacuggaagggccgggagcugaagugcggguccggcaucuucgucacgaacgaggugcacaccuggaccgagcaguacaaguuccaggccgacagcccgaagcgccugagcgcggccaucggcaaggccugggaggagggggugugcggcauccgguccgccacccgccucgagaacaucauguggaagcagaucagcaacgagcugaaccacauccugcucgagaacgacaugaaguucaccgucguggugggggacgccaacggcauccugacgcaggggaagaagaugauccggccccagcccauggagcacaaguacuccuggaaguccuggggcaaggcgaagaucaucggcgccgacacccagaacaccaccuucaucaucgacgggcccgacacgccggagugccccgacgaccagcgcgccuggaacaucugggaggucgaggacuacggcuucgggguguucaccaccaacaucuggcugaagcuccgggacuccuacacccagaugugcgaccaccgccugaugagcgccgcgaucaaggacuccaaggccgugcacgccgacaugggcuacuggaucgagagcgagaagaacgagacguggaagcuggcccgggccuccuucaucgaggucaagaccugcaucuggccccgcagccacacccucugguccaacggcgugcuggagagcgagaugaucauccccaagaucuacgggggcccgaucucccagcacaacuaccggcccggguacuucacccagacggcgggccccuggcaccuggggaagcucgagcuggacuucaaccugugcgagggcaccaccguggucguggacgagcacugcggcaaccgcgggccgagccuccggaccacgaccgugaccggcaagaucauccacgaguggugcugccgcuccugcacccugccgccccugcgguuccgcggggaggacggcugcugguacgggauggagauccggcccgucaaggagaaggaggagaaccucgugcgcagcaugguguccgccggcagcggcgaggucgacagcuucucccuggggcugcucugcgugagcaucaugaucgaggaggugaugcggucccgcuggagccgcaagaugcugaugacgggcacccuggccgucuucuuccuccugaucauggggcagcugaccuggaacgaccucauccggcugugcaucauggugggcgccaacguguccgaccgcauggggaugggcaccacguaccuggcccucauggcgaccuucaagaugcggccgauguucgccgucgggcugcuguuccgccggcucaccagccgcgaggugcugcugcucaccaucgggcugucccuggucgccagcguggagcuccccaacucccuggaggagcugggcgacgggcucgccaugggcaucaugaugcugaagcugcucacggacuuccagagccaccagcuguggaccacccugcucucccugaccuucaucaagacgacccugagccucgacuacgccuggaagaccauggcgauggugcuguccaucgucagccuguucccccucugccuguccaccacgagccagaagaccaccuggcugcccgugcuccugggcuccuucgggugcaagccgcugaccauguuccucaucaccgagaacaagaucuggggccgcaagagcuggccccugaacgaggggaucauggccgugggcaucgucuccauccugcucagcagccugcugaagaacgacgugccccucgccgggccccugaucgccggcggcaugcugaucgcgugcuacgugaucuccgggagcuccgccgaccucagccuggagcgcgccgccgaggucuccugggaggaggaggccgagcacagcggcgcgucccacaacauccugguggaggugcaggacgacgggacgaugaagaucaaggacgaggagcgggacgacacccucaccauccugcugaaggccacccuccuggccgucagcggcguguacccgauguccauccccgccacgcuguucgugugguacuucuggcagaagaagaagcagcgcagcgggguccucugggacacccccagcccgcccgagguggagcgggccgugcuggacgacggcaucuaccgcauccugcagcggggccugcucgggcgcagccaggucggcguggggguguuccaggacggcgucuuccacaccauguggcacgugacccgcggggcggugcugauguaccagggcaagcgccuggagcccuccugggccagcgucaagaaggaccucaucuccuacggcgggggcuggcgguuccaggggagcuggaacacgggcgaggagguccaggugaucgccgucgagcccgggaagaaccccaagaacgugcagaccacccccggcaccuucaagacgcccgagggcgaggugggggccaucgcccuggacuucaagcccggcaccuccgggagccccaucgucaaccgcgagggcaagaucgugggccuguacgggaacggcguggucaccaccuccgggacguacgugagcgcgaucgcccaggccaaggccagccaggagggcccgcuccccgagaucgaggacgagguguucaagaagcggaaccugaccaucauggaccugcaccccggguccggcaagacccgccgguaccucccggccaucguccgcgaggcgaucaagcgcaagcugcggacccugauccucgcccccacgcgcgugguggccagcgagauggccgaggcgcugaagggcaugcccauccgguaccagaccaccgccgucaaguccgagcacaccgggaaggagaucguggaccugaugugccacgccacguucaccaugcgccuccugagccccgugcgggucccgaacuacaacaugaucaucauggacgaggcccacuucaccgaccccgccuccaucgcggcccgcggcuacaucagcacccggguggggaugggcgaggccgccgccaucuucaugacggcgacgccgcccggguccguggaggccuucccgcagagcaacgccgucauccaggacgaggagcgcgacauccccgagcgguccuggaacagcggcuacgacuggaucaccgacuuccccggcaagaccgugugguucgugcccuccaucaagagcgggaacgacaucgccaacugccugcgcaagaacggcaagcgggucauccagcucucccgcaagacguucgacaccgaguaccagaagaccaagaacaacgacugggacuacguggugaccacggacaucagcgagaugggggccaacuuccgggcggaccgcgucaucgacccgcggcgcugccugaagcccgugauccugaaggacggccccgagcgggucauccucgccgggcccaugccggugaccgccgccuccgcggcccagcgccggggccgcaucggccgcaaccagaacaaggagggggaccaguacaucuacaugggccagccccugaacaacgacgaggaccacgcccacuggaccgaggccaagaugcugcucgacaacaucaacacccccgaggggaucauccccgcccuguucgagccggagcgggagaaguccgcggccaucgacggcgaguaccgccugcgcggggaggcccgcaagacguucguggagcucaugcggcgcggcgaccugcccgucuggcuguccuacaagguggccagcgagggcuuccaguacuccgaccggcgcuggugcuucgacggggagcggaacaaccaggugcucgaggagaacauggacgucgagaucuggaccaaggagggcgagcgcaagaagcugcggccccgcuggcuggacgcccggaccuacagcgacccccucgcgcugcgcgaguucaaggaguucgccgccgggcggcgcagcguguccggcgaccugauccucgagaucggcaagcugccgcagcaccugacccuccgggcccagaacgcccuggacaaccuggugaugcuccacaacagcgagcagggcgggaaggcguaccgccacgccauggaggagcugcccgacaccaucgagacgcugaugcuccuggcccugaucgccguccucaccgggggcgugacccuguucuuccuguccgggaagggccucggcaagaccagcaucgggcugcugugcgugauggcguccagcguccuccuguggauggccuccguggagccccacuggaucgccgccagcaucauccuggaguucuuccucauggugcugcugauccccgagccggaccggcagcgcacgccccaggacaaccagcucgccuacgucgugaucggccugcuguucaugauccucaccguggcggccaacgagauggggcugcuggagaccaccaagaaggaccucggcaucgggcacgucguggccgagaaccaccaccacgccacgaugcuggacaucgaccugcaccccgccuccgcguggacccucuacgccguggccaccaccaucaucacgccgaugaugcggcacaccaucgagaacaccaccgccaacaucagccugacggccaucgcgaaccaggccgccauccugaugggccucgacaagggcuggcccaucuccaagauggacaucggggucccccugcuggcccucggcugcuacagccaggugaacccccugacccugaccgccgcggugcucaugcuggucgcccacuacgccaucaucgggccgggccugcaggccaaggcgacccgcgaggcccagaagcgcacggccgccgggaucaugaagaaccccaccguggacggcaucguggccaucgaccucgaccccgucguguacgacgcgaaguucgagaagcagcugggccagaucaugcugcucauccugugcaccucccagauccugcucaugcggaccacgugggcccugugcgagagcaucacccuggccaccgggccccucaccacgcugugggagggcuccccggggaaguucuggaacaccaccaucgccgugagcauggccaacaucuuccgcggcuccuaccuggcgggcgccgggcucgccuucagccugaugaagucccugggcgggggccggcgcgggaccggcgcccagggcgagacgcucggggagaaguggaagcggcagcugaaccagcugagcaagagcgaguucaacaccuacaagcgcuccggcaucauggaggucgaccggagcgaggccaaggaggggcucaagcgcggcgagaccaccaagcacgcggugucccgggggacggccaagcugcgcugguucguggagcggaaccuggucaagcccgagggcaaggugaucgaccugggcugcgggcgcggcggguggagcuacuacugcgccggccucaagaaggugaccgaggucaagggguacaccaagggcggccccgggcacgaggagcccaucccgauggccaccuacggcuggaacaucgugaagcugcacuccgggcgggacguguucuucacgccgcccgagaagugcgacacgcugcucugcgacaucggcgagagcucccccaacccgaccaucgaggaggggcgcacccugcggguccugaagaugguggagcccuggcuccgcggcaaccaguucugcaucaagauccugaaccccuacaugcccagcguggucgagacccuggagcagaugcagcggaagcacggcgggaugcucgugcgcaacccgcugucccggaacagcacgcacgagauguacuggguguccugcggcaccgggaacaucgucagcgcggugaacaugaccucccgcaugcugcucaaccgcuucaccauggcccaccggaagcccacguacgagcgcgacguggaccugggcgccggcacccggcacgucgccguggagcccgagaucgccaaccuggacaucaucgggcagcgcaucgagaacaucaagaacgagcacaagagcaccuggcacuacgacgaggacaaccccuacaagaccugggcguaccacggcuccuacgaggugaagccgagcggguccgccagcuccauggucaacggcgugguccggcuccugacgaagcccugggacgugauccccauggugacccagaucgccaugaccgacaccacgcccuucgggcagcagcgcgucuucaaggagaagguggacacccggaccccgcgccccaagcggggcaccgcccagaucauggaggugacggccaaguggcuguggggcuuccucagccgcaacaagaagccccggaucugcacccgcgaggaguucacccggaagguccgcagcaacgcggccaucggggccguguucguggacgagaaccaguggaacuccgccaaggaggccgucgaggacgagcgguucugggaccuggugcaccgcgagcgggagcugcacaagcagggcaagugcgcgaccugcguguacaacaugauggggaagcgcgagaagaagcucggcgaguucgggaaggccaagggcagccgggccaucugguacauguggcugggcgcccgcuuccuggaguucgaggcgcucggguucaugaacgaggaccacugguucucccgggagaacagccuguccggcgucgagggggagggccugcacaagcucggguacauccugcgcgacaucagcaagaucccgggcggcaacauguacgccgacgacacggccgggugggacacccgcaucaccgaggacgaccugcagaacgaggccaagaucaccgacaucauggagcccgagcacgcccuccuggcgacguccaucuucaagcugaccuaccagaacaagguggugcggguccagcgccccgccaagagcggcaccgugauggacgugaucucccggcgcgaccagcgggggagcggccaggucggcaccuacgggcucaacacguucaccaacauggaggugcagcugauccgccagauggaguccgagggcaucuucagccccuccgagcuggagaacagcaaccucgccgagcgggugcuggacuggcuggagaagcacggggucgagcgccucaagcggauggccaucuccggcgacgacugcguggugaagccgaccgacgaccgcuucgccaccgcgcugacggcccugaacgacauggggaagguccggaaggacaucccccagugggagcccagcaagggcuggaacgacuggcagcagguccccuucugcucccaccacuuccaccagcucaucaugaaggacggccgcgagaucguggucccgugccggaaccaggacgagcugguggggcgcgcccgggugagccagggcgccggguggagccugcgcgagaccgccugccucggcaaguccuacgcgcagauguggcagcugauguacuuccaccggcgcgaccugcggcucgccgccaacgccaucugcagcgccguccccgugaacugggugcccaccucccgcaccaccuggagcauccacgcgcaccaccaguggaugacgaccgaggacaugcuguccgucuggaaccgcguguggaucgaggagaaccccuggauggaggacaagacccacgugagcuccugggaggacgucccguaccuggggaagcgggaggaccaguggugcggcagccucaucggccugaccgcccgcgccacgugggccaccaacauccagguggcgaucaaccaggugcggcgccugaucgggaacgagaacuaccucgacuacaugaccuccaugaagcgguucaagaacgagagcgaccccgagggcgcccugugguga

SEQ ID NO: 8943 - RNA, 9879 nt, Artificial Sequence
  derived and/or modified CDS sequence (opt1) from DENV-1__KM403586__SS-prME
agcgugaccaugcugcucaugcugcugcccaccgcccucgccuuccaccugaccacccggggcggggagccccacaugaucgugagcaagcaggagcggggcaagagccuccucuucaagaccuccgcgggggugaacaugugcacccugaucgccauggaccugggcgagcucugcgaggacacgaugaccuacaagugcccccggaucaccgaggccgagcccgacgacguggacugcuggugcaacgccaccgacaccugggucaccuacgggaccugcagccagaccggcgagcaccggcgcgacaagcgguccguggcccuggcgccccacgugggccuggggcucgagacccgcaccgagaccuggaugagcuccgagggcgccuggcggcagauccagaaggucgagaccugggcccugcgccaccccggguucacggugaucgccuucuuccuggcgcacgccaucggcaccagcaucacccagaaggggaucaucuucauccuccugaugcuggugacccccuccauggccaugcggugcgucggcaucggcaaccgcgacuucguggaggggcucagcggcgccacguggguggacgucgugcuggagcacggguccugcgugaccaccauggccaagaacaagcccacccuggacaucgagcuccugaagacggaggucaccaaccccgcggugcugcggaagcucugcaucgaggccaagaucagcaacaccaccacggacucccgcugccccacccagggcgaggccacccugguggaggagcaggacgccaacuucgucugccggcgcaccuucguggaccggggcugggggaacggcugcgggcuguucggcaaggggagccuccugacgugcgccaaguucaagugcgugaccaagcuggagggcaagaucguccaguacgagaaccucaaguacuccgugaucgugaccguccacaccggcgaccagcaccagguggggaacgagacgaccgagcacggcaccaucgcgaccaucacgccccaggcccccacgagcgagguccagcugaccgacuacggggcccugacccucgacugcagcccccggaccggccuggacuucaacgagauggugcugcucacgaugaaggagaaguccuggcuggugcacaagcagugguuccuggaccucccgcugcccuggaccuccggggccagcaccagccaggagaccuggaaccggcaggaccugcucgucacguucaagaccgcccacgcgaagaagcaggagguggugguccugggcucccaggagggcgccaugcacaccgcccugaccggggccacggagauccagaccagcggcaccaccacgaucuucgccgggcaccucaagugccgccugaagauggacaagcugacccucaagggcguguccuacgugaugugcaccgggagcuucaagcuggagaaggaggucgcggagacccagcacggcacggugcuggugcaggucaaguacgagggcaccgacgcccccugcaagauccccaucuccacccaggacgagaagggggugacccagaacggccggcugaucacggccaacccgaucgugaccgacaaggagaagcccgucaacaucgagaccgagccgcccuucggggagagcuacaucgugaucggcgccggcgagaaggcgcucaagcuguccugguucaagaaggggagcuccaucggcaagauguucgaggccaccgcccgcggggcccggcgcauggccauccugggcgacacggcgugggacuucgggagcaucggcggcguguucaccuccgucgggaagcucgugcaccagguguucggcaccgccuacgggguccuguucagcggcguguccuggaccaugaagaucgggaucggcauccugcucacguggcugggccugaacagccgcuccaccagccucuccaugaccugcaucgccguggggauggucacccuguaccugggcgugauggugcaggccgacagcgggugcgucaucaacuggaagggccgggagcucaagugcggguccggcaucuucgugacgaacgaggugcacaccuggaccgagcaguacaaguuccaggccgacagcccgaagcgccugagcgcggccaucggcaaggccugggaggagggggucugcggcauccgguccgccacccgccuggagaacaucauguggaagcagaucagcaacgagcucaaccacauccugcuggagaacgacaugaaguucaccgugguggucggggacgccuacggcauccucacgcaggggaagaagaugauccggccccagcccauggagcacaaguacuccuggaaguccuggggcaaggcgaagaucaucggcgccgacacccagaacaccaccuucaucaucgacgggcccgacacgccggagugccccgacgaccagcgcgccuggaacaucugggagguggaggacuacggcuucgggguguucaccaccaacaucuggcugaagcugcgggacuccuacacccagaugugcgaccaccgccucaugagcgccgcgaucaaggacuccaaggccguccacgccgacaugggcuacuggaucgagagcgagaagaacgagacguggaagcuggcccgggccuccuucaucgaggugaagaccugcaucuggccccgcagccacacccugugguccaacggcgugcucgagagcgagaugaucauccccaagaucuacgggggcccgaucucccagcacaacuaccggcccggguacuucacccagacggcgggccccuggcaccuggggaagcuggagcucgacuucaaccugugcgagggcaccaccgucgugguggacgagcacugcggcaaccgcgggccgagccugcggaccacgaccgucaccggcaagaucauccacgaguggugcugccgcuccugcacccugccgccccugcgguuccgcggggaggacggcugcugguacgggauggagauccggcccgugaaggagaaggaggagaaccuggugcgcagcauggucuccgccggcagcggcgagguggacagcuucucccucgggcugcugugcgugagcaucaugaucgaggaggucaugcggucccgcuggagccgcaagaugcucaugacgggcacccuggccguguucuuccugcucaucauggggcagcugaccuggaacgaccugauccggcucugcaucauggugggcgccaacgucuccgaccgcauggggaugggcaccacguaccuggcccugauggcgaccuucaagaugcggccgauguucgccgugggccuccuguuccgccggcugaccagccgcgagguccuccugcugaccaucgggcucucccugguggccagcguggagcugcccaacucccucgaggagcugggcgacgggcuggccaugggcaucaugaugcucaagcugcugacggacuuccagagccaccagcucuggaccacccugcugucccucaccuucaucaagacgacccugagccuggacuacgccuggaagaccauggcgaugguccucuccaucgugagccuguucccccugugccucuccaccacgagccagaagaccaccuggcugcccgugcugcucggcuccuucgggugcaagccgcugaccauguuccugaucaccgagaacaagaucuggggccgcaagagcuggccccucaacgaggggaucauggccgucggcaucguguccauccugcugagcagccuccugaagaacgacgugccccuggccgggccccucaucgccggcggcaugcugaucgcgugcuacgucaucuccgggagcuccgccgaccugagccucgagcgcgccgccgagguguccugggaggaggaggccgagcacagcggcgcgucccacaacauccugguggagguccaggacgacgggacgaugaagaucaaggacgaggagcgggacgacacccugaccauccuccugaaggccacccugcucgccgugagcggcguguacccgauguccauccccgccacgcuguucgucugguacuucuggcagaagaagaagcagcgcagcggggugcugugggacacccccagcccgcccgagguggagcgggccguccucgacgacggcaucuaccgcauccugcagcggggccugcuggggcgcagccaggugggcgugggggucuuccaggacggcguguuccacaccauguggcacgugacccgcggggcgguccucauguaccagggcaagcgccuggagcccuccugggccagcgugaagaaggaccugaucuccuacggcgggggcuggcgguuccaggggagcuggaacacgggcgaggaggugcaggucaucgccguggagcccgggaagaaccccaagaacgugcagaccacccccggcaccuucaagacgcccgagggcgaggucggggccaucgcccucgacuucaagcccggcaccuccgggagccccaucgugaaccgcgagggcaagaucgugggccuguacgggaacggcgucgugaccaccuccgggacguacgugagcgcgaucgcccaggccaaggccagccaggagggcccgcugcccgagaucgaggacgaggucuucaagaagcggaaccucaccaucauggaccugcaccccggguccggcaagacccgccgguaccugccggccaucgugcgcgaggcgaucaagcgcaagcuccggacccugauccuggcccccacgcgcguggucgccagcgagauggccgaggcgcucaagggcaugcccauccgguaccagaccaccgccgugaaguccgagcacaccgggaaggagaucguggaccugaugugccacgccacguucaccaugcgccugcucagccccguccgggugccgaacuacaacaugaucaucauggacgaggcccacuucaccgaccccgccuccaucgcggcccgcggcuacaucagcacccggguggggaugggcgaggccgccgccaucuucaugacggcgacgccgcccggguccgucgaggccuucccgcagagcaacgccgugauccaggacgaggagcgcgacauccccgagcgguccuggaacagcggcuacgacuggaucaccgacuuccccggcaagaccgugugguucguccccuccaucaagagcgggaacgacaucgccaacugccugcgcaagaacggcaagcgggugauccagcugucccgcaagacguucgacaccgaguaccagaagaccaagaacaacgacugggacuacguggucaccacggacaucagcgagaugggggccaacuuccgggcggaccgcgugaucgacccgcggcgcugccucaagcccgucauccugaaggacggccccgagcgggugauccuggccgggcccaugccggugaccgccgccuccgcggcccagcgccggggccgcaucggccgcaaccagaacaaggagggggaccaguacaucuacaugggccagccccucaacaacgacgaggaccacgcccacuggaccgaggccaagaugcugcuggacaacaucaacacccccgaggggaucauccccgcccucuucgagccggagcgggagaaguccgcggccaucgacggcgaguaccgccugcgcggggaggcccgcaagacguucgucgagcugaugcggcgcggcgaccuccccguguggcuguccuacaagguggccagcgagggcuuccaguacuccgaccggcgcuggugcuucgacggggagcggaacaaccagguccuggaggagaacauggacguggagaucuggaccaaggagggcgagcgcaagaagcuccggccccgcuggcuggacgcccggaccuacagcgacccccuggcgcuccgcgaguucaaggaguucgccgccgggcggcgcagcguguccggcgaccugauccuggagaucggcaagcucccgcagcaccugacccugcgggcccagaacgcccucgacaaccuggucaugcugcacaacagcgagcagggcgggaaggcguaccgccacgccauggaggagcuccccgacaccaucgagacgcugaugcugcucgcccugaucgccgugcugaccgggggcgugacccucuucuuccuguccgggaagggccugggcaagaccagcaucgggcuccugugcgucauggcguccagcgugcugcucuggauggccuccguggagccccacuggaucgccgccagcaucauccuggaguucuuccugaugguccuccugauccccgagccggaccggcagcgcacgccccaggacaaccagcuggccuacguggugaucggccuccuguucaugauccugaccgucgcggccaacgagauggggcuccuggagaccaccaagaaggaccugggcaucgggcacgugguggccgagaaccaccaccacgccacgaugcucgacaucgaccugcaccccgccuccgcguggacccuguacgccgucgccaccaccaucaucacgccgaugaugcggcacaccaucgagaacaccaccgccaacaucagccucacggccaucgcgaaccaggccgccauccugaugggccuggacaagggcuggcccaucuccaagauggacaucggggugccccuccuggcccugggcugcuacagccaggugaacccccucacccugaccgccgcgguccugaugcucguggcccacuacgccaucaucgggccgggccugcaggccaaggcgacccgcgaggcccagaagcgcacggccgccgggaucaugaagaaccccaccguggacggcaucgucgccaucgaccuggaccccgugguguacgacgcgaaguucgagaagcagcucggccagaucaugcugcugauccucugcaccucccagauccugcugaugcggaccacgugggcccucugcgagagcaucacccuggccaccgggccccugaccacgcucugggagggcuccccggggcgcuucuggaacaccaccaucgccgucagcauggccaacaucuuccggggcuccuaccuggcgggcgccgggcuggccuucagccucaugaagucccugggcgggggccgccgggggaccggcgcccagggcgagacgcugggggagaaguggaagcgccagcucaaccagcugagcaagagcgaguucaacaccuacaagcgguccggcaucauggagguggaccgcagcgaggccaaggaggggaugaagcggggcgagaccaccaagcacgcggugucccgcgggacggccaagcugcggugguucgucgagcgcaaccucgugaagcccgagggcaaggugaucgaccugggcugcgggcggggcggguggagcuacuacugcgccggccugaagaaggucaccgaggugaagggguacaccaagggcggccccgggcacgaggagcccaucccgauggccaccuacggcuggaacaucgugaagcugcacuccgggcgcgacgucuucuucacgccgcccgagaagugcgacacgcuccugugcgacaucggcgagagcucccccaacccgaccaucgaggaggggcggacccugcgcgugcucaagaugguggagcccuggcugcggggcaaccaguucugcaucaagauccugaaccccuacaugcccagcgucguggagacccucgagcagaugcagcgcaagcacggcgggaugcuggugcggaacccgcugucccgcaacagcacgcacgagauguacugggucuccugcggcaccgggaacaucgugagcgcggugaacaugaccucccgcaugcuccugaaccgguucaccauggcccaccgcaagcccacguacgagcgggacgucgaccugggcgccggcacccgccacguggccguggagcccgagaucgccaaccucgacaucaucgggcagcggaucgagaacaucaagaacgagcacaagagcaccuggcacuacgacgaggacaaccccuacaagaccugggcguaccacggcuccuacgaggucaagccgagcggguccgccagcuccauggugaacggcgucgugcgccugcugacgaagcccugggacgugauccccauggucacccagaucgccaugaccgacaccacgcccuucgggcagcagcggguguucaaggagaagguggacacccgcaccccgcggcccaagcgcggcaccgcccagaucauggaggucacggccaaguggcucuggggcuuccugagccggaacaagaagccccgcaucugcacccgggaggaguucacccgcaaggugcggagcaacgcggccaucggggccguguucgucgacgagaaccaguggaacuccgccaaggaggccguggaggacgagcgcuucugggaccuggugcaccgggagcgcgagcuccacaagcagggcaagugcgcgaccugcgucuacaacaugauggggaagcgggagaagaagcugggcgaguucgggaaggccaagggcagccgcgccaucugguacauguggcugggcgcccgguuccucgaguucgaggcgcugggguucaugaacgaggaccacugguucucccgcgagaacagccuguccggcguggagggggagggccuccacaagcugggguacauccugcgcgacaucagcaagaucccgggcggcaacauguacgccgacgacacggccgggugggacacccggaucaccgaggacgaccuccagaacgaggccaagaucaccgacaucauggagcccgagcacgcccugcuggcgacguccaucuucaagcucaccuaccagaacaaggugguccgcgugcagcggcccgccaagagcggcaccgugauggacgucaucucccgccgggaccagcgcgggagcggccaggugggcaccuacgggcugaacacguucaccaacauggaggugcagcugauccggcagauggaguccgagggcaucuucagccccuccgagcucgagaacagcaaccuggccgagcgcguccuggacuggcucgagaagcacgggguggagcggcugaagcgcauggccaucuccggcgacgacugcguggucaagccgaccgacgaccgguucgccaccgcgcugacggcccucaacgacauggggaaggugcgcaaggacaucccccagugggagcccagcaagggcuggaacgacuggcagcagguccccuucugcucccaccacuuccaccagcugaucaugaaggacggccgggagaucgucgugccgugccgcaaccaggacgagcugguggggcgggcccgcgucagccagggcgccggguggagccuccgggagaccgccugccugggcaaguccuacgcgcagauguggcagcugauguacuuccaccgccgggaccuccgccuggccgccaacgccaucugcagcgccgugcccgugaacuggguccccaccucccgcaccaccuggagcauccacgcgcaccaccaguggaugacgaccgaggacaugcuguccguguggaaccggguguggaucgaggagaaccccuggauggaggacaagacccacgucagcuccugggaggacgugccguaccucgggaagcgcgaggaccaguggugcggcagccugaucggccugaccgcccgggccacgugggccaccaacauccagguggcgaucaaccagguccgccggcucaucgggaacgagaacuaccuggacuacaugaccuccaugaagcgcuucaagaacgagagcgaccccgagggcgcccugugguga

SEQ ID NO: 8944 - RNA, 9879 nt, Artificial Sequence
  derived and/or modified CDS sequence (opt1) from DENV-1__KM403602__SS-prME
agcgugaccaugcugcucaugcugcugcccaccgcccucgccuuccaccugaccacccgcggcggggagccccacaugaucgugagcaagcaggagcggggcaagagccuccucuucaagaccuccgcgggggugaacaugugcacccugaucgccauggaccugggcgagcucugcgaggacacgaugaccuacaagugcccccgcaucaccgaggccgagcccgacgacguggacugcuggugcaacgccaccgacaccugggugaccuacgggaccugcagccagaccggcgagcaccggcgcgacaagcgguccguggcccuggcgccccacgugggccuggggcucgagacccgcaccgagaccuggaugagcuccgagggcgccuggcggcagauccagaagguggagaccugggcccugcgccaccccggguucacggugaucgcccuguuccucgcgcacgccaucggcaccagcaucacccagaaggggaucaucuucauccugcugaugcucgugacccccuccauggccaugcggugcgucggcaucggcaaccgcgacuucguggaggggcugagcggcgccacguggguggacgucgugcuggagcacggguccugcgugaccaccauggccaagaacaagcccacccucgacaucgagcugcugaagacggaggucaccaaccccgcggugcuccggaagcugugcaucgaggccaagaucagcaacaccaccacggacucccgcugccccacccagggcgaggccacccugguggaggagcaggacgccaacuucgucugccggcgcaccuucguggaccggggcugggggaacggcugcggccucuucggcaaggggagccugcugacgugcgccaaguucaagugcgugaccaagcucgagggcaagaucguccaguacgagaaccugaaguacuccgugaucgugaccguccacaccggcgaccagcaccagguggggaacgagacgaccgagcacggcaccaucgcgaccaucacgccccaggcccccacgagcgagauccagcugaccgacuacggggccaucacccucgacugcagcccccgcaccggccuggacuucaacgagaugguccugcucacgaugaaggagaaguccuggcuggugcacaagcagugguuccuggaccucccgcugcccuggaccuccggggccagcaccagccaggagaccuggaaccggcaggaccugcucgugacguucaagaccgcccacgcgaagaagcaggaggucguggugcugggcucccaggagggcgccaugcacaccgcccugaccggggccacggagauccagaccagcggcaccaccacgaucuucgccgggcaccucaagugccgccugaagauggacaagcugacccucaagggcgucuccuacgugaugugcaccgggagcuucaagcuggagaaggagguggcggagacccagcacggcacgguccugguccaggugaaguacgagggcaccgacgcccccugcaagauccccaucuccacccaggacgagaagggggucacccagaacggccggcugaucacggccaacccgaucgugaccgacaaggagaagcccgugaacaucgagaccgagccgcccuucggggagagcuacaucgucaucggcgccggcgagaaggcgcucaagcuguccugguucaagaaggggagcuccaucggcaagauguucgaggccaccgcccgcggggcccggcgcauggccauccugggcgacacggcgugggacuucgggagcaucggcggcguguucaccuccguggggaagcucguccaccagguguucggcaccgccuacggggugcuguucagcggcgucuccuggaccaugaagaucgggaucggcauccugcucacguggcugggccugaacagccgcuccaccagccucuccaugaccugcaucgccguggggauggugacccuguaccugggcgucauggugcaggccgacagcgggugcgugaucaacuggaagggccgggagcucaagugcggguccggcaucuucgucacgaacgaggugcacaccuggaccgagcaguacaaguuccaggccgacagcccgaagcgccugagcgcggccaucggcaaggccugggaggagggggugugcggcauccgguccgccacccgccuggagaacaucauguggaagcagaucagcuccgagcucaaccacauccugcuggagaacgacaugaaguucaccgucguggugggggacgccaacggcauccucacgcaggggaagaagaugauccggccccagcccauggagcacaaguacagcuggaaguccuggggcaaggcgaagaucaucggcgccgacacccagaacaccaccuucaucaucgacgggcccgacacgccggagugccccgacgaccagcgcgccuggaacaucugggaggucgaggacuacggcuucgggguguucaccaccaacaucuggcugaagcugcgggacagcuacacccagaugugcgaccaccgccucauguccgccgcgaucaaggacagcaaggccgugcacgccgacaugggcuacuggaucgaguccgagaagaacgagacguggaagcuggcccgggccagcuucaucgaggucaagaccugcaucuggccccgcucccacacccuguggagcaacggcgugcucgaguccgagaugaucauccccaagaucuacgggggcccgaucagccagcacaacuaccggcccggguacuucacccagacggcgggccccuggcaccuggggaagcuggagcucgacuucaaccugugcgagggcaccaccguggucguggacgagcacugcggcaaccgcgggccgucccugcggaccacgaccgugaccggcaagaucauccacgaguggugcugccgcagcugcacccugccgccccugcgguuccgcggggaggacggcugcugguacgggauggagauccggcccgucaaggagaaggaggagaaccuggugcgcuccauggugagcgccggcagcggcgaggucgacuccuucagccucgggcugcugugcguguccaucaugaucgaggaggugaugcggagccgcugguccaagaagaugcucaugacgggcacccuggccgucuucuuccugcucaucauggggcagcugaccuggaacgaccugauccgccucugcaucauggugggcgccaacgugagcgaccggauggggaugggcaccacguaccuggcccugauggcgaccuucaagaugcgcccgauguucgccgucgggcuccuguuccggcgccugaccucccgggaggugcuccugcugaccaucgggcucagccuggucgccuccguggagcugcccaacagccucgaggagcugggcgacgggcuggccaugggcaucaugaugcucaagcugcugacggacuuccagucccaccagcucuggaccacccugcugagccucaccuucaucaagacgacccugucccuggacuacgccuggaagaccauggcgauggugcucagcaucgucucccuguucccccugugccucagcaccacgucccagaagaccaccuggcugcccgugcugcucggcagcuucgggugcaagccgcugaccauguuccugaucaccgagaacaagaucuggggccgcaaguccuggccccucaacgaggggaucauggccgugggcaucgucagcauccugcugagcucccuccugaagaacgacgugccccuggccgggccccucaucgccggcggcaugcugaucgcgugcuacgugaucagcggguccagcgccgaccugucccucgagcgggccgccgaggucagcugggaggaggaggccgagcacuccggcgcgagccacaacauccugguggaggugcaggacgacgggacgaugaagaucaaggacgaggagcgcgacgacacccugaccauccuccugaaggccacccugcucgccgucuccggcguguacccgaugagcauccccgccacgcuguucgugugguacuucuggcagaagaagaagcagcgguccgggguccugugggacacccccagcccgcccgagguggagcgcgccgugcucgacgacggcaucuaccggauccugcagcgcggccugcuggggcggucccaggucggcguggggguguuccaggacggcgucuuccacaccauguggcacgugacccgcggggcggugcucauguaccagggcaagcggcuggagcccagcugggccuccgucaagaaggaccugaucagcuacggcgggggcuggcgcuuccagggguccuggaacacgggcgaggagguccaggugaucgccgucgagcccgggaagaaccccaagaacgugcagaccacccccggcaccuucaagacgcccgagggcgaggugggggccaucgcccucgacuucaagcccggcaccagcgggucccccaucgucaaccgggagggcaagaucgugggccuguacgggaacggcguggucaccaccagcgggacguacgugagcgcgaucgcccaggccaaggccucccaggagggcccgcugcccgagaucgaggacgagguguucaagaagcgcaaccucaccaucauggaccugcaccccgggagcggcaagacccggcgcuaccugccggccaucguccgggaggcgaucaagcgcaagcuccgcacccugauccuggcccccacgcgggugguggccuccgagauggccgaggcgcucaagggcaugcccauccgcuaccagaccaccgccgucaagagcgagcacaccgggaaggagaucguggaccugaugugccacgccacguucaccaugcggcugcucucccccgugcgcgucccgaacuacaacaugaucaucauggacgaggcccacuucaccgaccccgccagcaucgcggcccggggcuacaucuccacccgcguggggaugggcgaggccgccgccaucuucaugacggcgacgccgcccgggagcguggaggccuucccgcaguccaacgccgucauccaggacgaggagcgggacauccccgagcgcagcuggaacuccggcuacgacuggaucaccgacuuccccggcaagaccgugugguucgugcccagcaucaaguccgggaacgacaucgccaacugccugcggaagaacggcaagcgcgucauccagcugagccggaagacguucgacaccgaguaccagaagaccaagaacaacgacugggacuacguggugaccacggacaucuccgagaugggggccaacuuccgcgcggaccgggucaucgacccgcgccggugccucaagcccgugauccugaaggacggccccgagcgcgucauccuggccgggcccaugccggugaccgccgccagcgcggcccagcggcgcggccggaucggccgcaaccagaacaaggagggggaccaguacaucuacaugggccagccccucaacaacgacgaggaccacgcccacuggaccgaggccaagaugcugcuggacaacaucaacacccccgaggggaucauccccgcccucuucgagccggagcgcgagaaguccgcggccaucgacggcgaguaccggcugcgcggggaggcccggaagacguucguggagcugaugcgccggggcgaccuccccgucuggcugagcuacaagguggccuccgagggcuuccaguacagcgaccgccgguggugcuucgacggggagcgcaacaaccaggugcuggaggagaacauggacgucgagaucuggaccaaggagggcgagcggaagaagcuccgcccccgguggcuggacgcccgcaccuacagcgacccccuggcgcuccgggaguucaaggaguucgccgccgggcgccgguccgugagcggcgaccugauccuggagaucggcaagcucccgcagcaccugacccugcgcgcccagaacgcccucgacaaccuggugaugcugcacaacuccgagcagggcgggaaggcguaccggcacgccauggaggagcuccccgacaccaucgagacgcugaugcugcucgcccugaucgccguccugaccgggggcgugacccucuucuuccugagcgggaagggccugggcaagaccuccaucgggcuccugugcgugauggcgagcuccguccugcucuggauggccagcguggagccccacuggaucgccgccuccaucauccuggaguucuuccugauggugcuccugauccccgagccggaccgccagcggacgccccaggacaaccagcuggccuacgucgugaucggccuccuguucaugauccugaccguggcggccaacgagauggggcuccuggagaccaccaagaaggaccugggcaucgggcacgucguggccgagaaccaccaccacgccacgaugcucgacaucgaccugcaccccgccagcgcguggacccuguacgccguggccaccaccaucaucacgccgaugaugcgccacaccaucgagaacaccaccgccaacaucucccucacggccaucgcgaaccaggccgccauccugaugggccuggacaagggcuggcccaucagcaagauggacaucggggucccccuccuggcccugggcugcuacucccaggugaacccccucacccugaccgccgcggugcugaugcucgucgcccacuacgccaucaucgggccgggccugcaggccaaggcgacccgggaggcccagaagcgcacggccgccgggaucaugaagaaccccaccguggacggcaucguggccaucgaccuggaccccgucguguacgacgcgaaguucgagaagcagcucggccagaucaugcugcugauccucugcaccagccagauccugcugaugcgcaccacgugggcccucugcgaguccaucacccuggccaccgggccccugaccacgcucugggagggcagcccggggaaguucuggaacaccaccaucgccguguccauggccaacaucuuccggggcagcuaccuggcgggcgccgggcuggccuucucccucaugaagucccugggcgggggccgccgggggaccggcgcccagggcgagacgcugggggagaaguggaagcgccagcucaaccagcugagcaaguccgaguucaacaccuacaagcggagcggcaucauggaggucgaccgcuccgaggccaaggaggggcugaagcggggcgagaccaccaagcacgcggugagccgcgggacggccaagcuccggugguucguggagcgcaaccuggucaagcccgagggcaaggugaucgaccugggcugcgggcggggcgggugguccuacuacugcgccggccugaagaaggugaccgaggucaagggguacaccaagggcggccccgggcacgaggagcccaucccgauggccaccuacggcuggaacaucgugaagcuccacagcgggcgcgacguguucuucacgccgcccgagaagugcgacacgcugcugugcgacaucggcgaguccagccccaacccgaccaucgaggaggggcggacccuccgcguccugaagaugguggagcccuggcugcggggcaaccaguucugcaucaagauccucaaccccuacaugcccuccguggucgagacccuggagcagaugcagcgcaagcacggcgggaugcuggugcggaacccgcucagccgcaacuccacgcacgagauguacugggugagcugcggcaccgggaacaucgucuccgcggugaacaugaccagccggaugcugcugaaccgcuucaccauggcccaccgcaagcccacguacgagcgggacguggaccucggcgccggcacccgccacgucgccguggagcccgagaucgccaaccuggacaucaucgggcagcggaucgagaacaucaagaacgagcacaaguccaccuggcacuacgacgaggacaaccccuacaagaccugggcguaccacggcagcuacgaggugaagccguccgggagcgccuccagcauggucaacggcgugguccgccugcucacgaagcccugggacgugauccccauggugacccagaucgccaugaccgacaccacgcccuucgggcagcagcgggucuucaaggagaagguggacacccgcaccccgcggcccaagcgcggcaccgcccagaucauggaggugacggccaaguggcuguggggcuuccugagccggaacaagaagccccgcaucugcacccgggaggaguucacccgcaagguccgguccaacgcggccaucggggccguguucguggacgagaaccaguggaacagcgccaaggaggccgucgaggacgagcgcuucugggaccucgugcaccgggagcgcgagcugcacaagcagggcaagugcgcgaccugcguguacaacaugauggggaagcgggagaagaagcugggcgaguucgggaaggccaagggcucccgcgccaucugguacauguggcucggcgcccgguuccuggaguucgaggcgcugggguucaugaacgaggaccacugguucagccgcgagaacucccucagcggcgucgagggggagggccugcacaagcugggguacauccuccgggacaucuccaagaucccgggcggcaacauguacgccgacgacacggccgggugggacacccgcaucaccgaggacgaccugcagaacgaggccaagaucaccgacaucauggagcccgagcacgcccugcucgcgacgagcaucuucaagcugaccuaccagaacaagguggugcgcguccagcggcccgccaaguccggcaccgugauggacgugaucagccgccgggaccagcgcggguccggccaggucggcaccuacgggcugaacacguucaccaacauggaggugcagcucauccggcagauggagagcgagggcaucuucucccccagcgagcuggagaacuccaaccuggccgagcgcgugcucgacuggcuggagaagcacggggucgagcggcugaagcgcauggccaucagcggcgacgacugcguggugaagccgaccgacgaccgguucgccaccgcgcucacggcccugaacgacauggggaagguccgcaaggacaucccccagugggagcccuccaagggcuggaacgacuggcagcagguccccuucugcagccaccacuuccaccagcugaucaugaaggacggccgggagaucguggucccgugccgcaaccaggacgagcucguggggcgggcccgcgugagccagggcgccggguggucccugcgggagaccgccugccugggcaagagcuacgcgcagauguggcagcucauguacuuccaccgccgggaccugcgccuggccgccaacgccaucugcuccgccguccccgugaacugggugcccaccagccggaccaccugguccauccacgcgcaccaccaguggaugacgaccgaggacaugcucagcgucuggaaccgcguguggaucgaggagaaccccuggauggaggacaagacccacguguccagcugggaggacgucccguaccuggggaagcgcgaggaccaguggugcggcucccugaucggccucaccgcccgggccacgugggccaccaacauccagguggcgaucaaccaggugcgccggcugaucgggaacgagaacuaccuggacuacaugaccagcaugaagcgcuucaagaacgaguccgaccccgagggcgcccucugguga

SEQ ID NO: 8945 - RNA, 9879 nt, Artificial Sequence
  derived and/or modified CDS sequence (opt1) from DENV-1__KM403582__SS-prME
agcgugaccaugcugcucaugcugcugcccaccgcccucgccuuccaccugaccacccggggcggggagccccacaugaucgugagcaagcaggagcggggcaagagccuccuguucaagaccuccgccggggugaacaugugcacccugaucgccauggaccugggcgagcucugcgaggacaccaugaccuacaagugcccccggaucaccgaggccgagcccgacgacguggacugcuggugcaacgccaccgacaccugggugaccuacgggaccugcagccagaccggcgagcaccggcgcgaccggcgcuccguggcccuggcgccccacgugggccuggggcucgagacgcggaccgagaccuggaugagcuccgagggcgccuggcgccagauccagcggguggagaccugggcccugcgccaccccggguucacggugaucgcccuguuccucgcgcacgccaucggcaccagcaucacccagaaggggaucaucuucauccugcugaugcucgugacccccuccauggccaugcggugcgucggcaucggcaaccgcgacuucguggaggggcugagcggcgccacguggguggacgucgugcuggagcacggguccugcgugaccaccauggccaagaacaagcccacccucgacaucgagcugcugaagacggaggucaccaaccccgcggugcuccggaagcugugcaucgaggccaagaucagcaacaccaccacggacucccgcugccccacccagggcgaggccacccugguggaggagcaggacgccaacuucgucugccggcgcaccuucguggaccggggcugggggaacggcugcggccucuucggcaaggggagccugcugacgugcgccaaguucaagugcgugaccaagcucgagggcaagaucguccaguacgagaaccugaaguacuccgugaucgugaccguccacaccggcgaccagcaccagguggggaacgagacgaccgagcacggcaccaucgcgaccaucacgccccaggcccccacgagcgagauccagcugaccgacuacggggcccucacccuggacugcagcccccggaccggccuggacuucaacgagaugguccuccugacgaugaaggagaaguccuggcuggugcacaagcagugguuccucgaccugccgcugcccuggaccuccggggccagcaccagccaggagaccuggaaccggcaggaccuccuggugacguucaagaccgcccacgcgaagaagcaggaggucguggugcugggcucccaggagggcgccaugcacaccgcccucaccggggccacggagauccagaccagcggcaccaccacgaucuucgccgggcaccugaagugccgccugaagauggacaagcucacccugaagggcgucuccuacgugaugugcaccgggagcuucaagcuggagaaggagguggcggagacccagcacggcacgguccugguccaggugaaguacgagggcaccgacgcccccugcaagauccccaucuccacccaggacgagaagggggucacccagaacggccggcucaucacggccaacccgaucgugaccgacaaggagaagcccgugaacaucgagaccgagccgcccuucggggagagcuacaucgucaucggcgccggcgagaaggcgcugaagcuguccugguucaagaaggggagcuccaucggcaagauguucgaggccaccgcccgcggggcccgccggauggccauccucggcgacacggcgugggacuucgggagcaucggcggcguguucaccuccguggggaagcugguccaccagguguucggcaccgccuacggggugcuguucagcggcgucuccuggaccaugaagaucgggaucggcauccuccugacguggcugggccucaacagccgcuccaccagccuguccaugaccugcaucgccguggggauggugacccuguaccucggcgucauggugcaggccgacagcgggugcgugaucaacuggaagggccgggagcugaagugcggguccggcaucuucgucacgaacgaggugcacaccuggaccgagcaguacaaguuccaggccgacagcccgaagcgccugagcgcggccaucggcaaggccugggaggagggggugugcggcauccgguccaccacccgccucgagaacaucauguggaagcagaucagcaacgagcugaaccacauccugcucgagaacgacaugaaguucacggucguggugggggacgccaacggcauccugacccaggggaagaagaugauccggccccagcccauggagcacaaguacuccuggaaguccuggggcaaggccaagaucaucggcgcggacacccagaacaccacguucaucaucgacgggcccgacaccccggagugccccgacgaccagcgcgccuggaacaucugggaggucgaggacuacggcuucgggguguucaccaccaacaucuggcugaagcuccgggacuccuacacgcagaugugcgaccaccgccugaugagcgccgccaucaaggacuccaaggcggugcacgccgacaugggcuacuggaucgagagcgagaagaacgagaccuggaagcuggcccgggccuccuucaucgaggucaagaccugcaucuggccccgcagccacacccucugguccaacggcgugcuggagagcgagauggugauccccaagaucuacgggggcccgaucucccagcacaacuaccggcccggguacuucacgcagaccgccggccccuggcaccuggggaagcucgagcuggacuucaaccugugcgagggcaccaccgucgugguggacgagcacugcggcaaccgcgggccgagccuccggacgaccaccgucaccggcaagaucauccacgaguggugcugccgcuccugcacgcugccgccccugcgguuccgcggggaggacggcugcugguacgggauggagauccggcccgugaaggagaaggaggagaaccucgugcgcagcauggucuccgcgggcagcggcgagguggacagcuucucccuggggcugcucugcgugagcaucaugaucgaggaggucaugcgcucccgguggagccgcaagaugcugaugaccggcacccuggccaucuucuuccuccugaucauggggcagcugaccuggaacgaccucauccggcugugcaucauggugggcgccaacguguccgaccgcauggggaugggcacgaccuaccuggcccucauggccaccuucaagaugcggccgauguucgcggucgggcugcuguuccgccggcucaccagccgcgaggugcugcugcucacgaucgggcugucccuggucgccagcguggagcuccccaacucccuggaggagcugggcgacgggcucgccaugggcaucaugaugcugaagcugcucaccgacuuccagagccaccagcuguggaccacccugcucucccugacguucaucaagaccacccugagccucgacuacgccuggaagaccauggccauggugcuguccaucgucagccuguucccccucugccuguccacgaccagccagaagaccaccuggcugcccgugcuccugggcuccuucgggugcaagccgcugaccauguuccucaucacggagaacaagaucuggggccgcaagagcuggccccugaacgaggggaucauggcggugggcaucgucuccauccugcucagcagccugcugaagaacgacgugccccucgccgggccccugaucgccggcggcaugcugaucgccugcuacgugaucuccgggagcuccgcggaccucagccuggagcgcgccgccgaggucuccugggaggaggaggccgagcacagcggcgccucccacaacauccugguggaggugcaggacgacgggaccaugaagaucaaggacgaggagcgggacgacacccucaccauccugcugaaggcgacgcuccuggccgucagcggcguguacccgauguccauccccgccacccuguucgugugguacuucuggcagaagaagaagcagcgcagcgggguccucugggacacccccagcccgcccgagguggagcgggccgugcuggacgacggcaucuaccgcauccugcagcggggccugcucgggcgcagccaggucggcguggggguguuccaggacggcgucuuccacaccauguggcacgugacgcgcggggccgugcugauguaccagggcaagcgccuggagcccuccugggcgagcgucaagaaggaccucaucuccuacggcgggggcuggcgguuccaggggagcuggaacaccggcgaggagguccaggugaucgccgucgagcccgggaagaaccccaagaacgugcagaccacccccggcacguucaagacccccgagggcgaggugggggccaucgcccuggacuucaagcccggcaccuccgggagccccaucgucaaccgcgagggcaagaucgugggccuguacgggaacggcguggucaccacguccgggaccuacgugagcgccaucgcgcaggccaaggccagccaggagggcccgcuccccgagaucgaggacgagguguucaagaagcggaaccugaccaucauggaccugcaccccggguccggcaagacccgccgcuaccucccggccaucguccgggaggccaucaagcgcaagcugcggacgcugauccucgcgcccacccgcgugguggccagcgagauggccgaggcccugaagggcaugcccauccgguaccagaccaccgcggucaaguccgagcacacggggaaggagaucguggaccugaugugccacgccaccuucaccaugcgccuccugagccccgugcgggucccgaacuacaacaugaucaucauggacgaggcccacuucaccgaccccgccuccaucgccgcgcgcggcuacaucagcacgcggguggggaugggcgaggccgccgccaucuucaugaccgccacgccgcccggguccguggaggcguucccgcagagcaacgccgucauccaggacgaggagcgcgacauccccgagcgguccuggaacagcggcuacgacuggaucaccgacuuccccggcaagacggugugguucgugcccuccaucaagagcgggaacgacaucgccaacugccugcgcaagaacggcaagcgggucauccagcucucccgcaagaccuucgacaccgaguaccagaagaccaagaacaacgacugggacuacguggugacgaccgacaucagcgagaugggggccaacuuccgggccgaccgcgucaucgacccgcggcgcugccugaagcccgugauccugaaggacggccccgagcgggucauccucgcggggcccaugccggugaccgccgccuccgccgcgcagcgccgcggccggaucggccgcaaccagaacaaggagggggaccaguacaucuacaugggccagccccugaacaacgacgaggaccacgcccacuggaccgaggccaagaugcugcucgacaacaucaacacgcccgaggggaucauccccgcccuguucgagccggagcgggagaaguccgccgcgaucgacggcgaguaccgccugcgcggggaggcccgcaagaccuucguggagcucaugcggcgcggcgaccugcccgucuggcuguccuacaagguggccagcgagggcuuccaguacuccgaccggcgcuggugcuucgacggggagcggaacaaccaggugcucgaggagaacauggacgucgagaucuggaccaaggagggcgagcgcaagaagcugcggccccgcuggcuggacgcccggaccuacagcgacccccucgcccugcgcgaguucaaggaguucgcggccgggcggcgcagcguguccggcgaccugauccucgagaucggcaagcugccgcagcaccugacccuccgggcccagaacgcccuggacaaccuggugaugcuccacaacagcgagcagggcgggaaggccuaccgccacgcgauggaggagcugcccgacacgaucgagacccugaugcuccuggcccugaucgccguccucaccgggggcgugacccuguucuuccuguccgggaagggccucggcaagacgagcaucgggcugcugugcgugauggccuccagcguccuccuguggauggcguccguggagccccacuggaucgccgccagcaucauccuggaguucuuccucauggugcugcugauccccgagccggaccggcagcgcacgccccaggacaaccagcucgccuacgucgugaucggccugcuguucaugauccucaccguggccgcgaacgagauggggcugcuggagaccacgaagaaggaccucggcaucgggcacgucguggccgagaaccaccaccacgccaccaugcuggacaucgaccugcaccccgccuccgccuggacccucuacgcgguggccaccacgaucaucaccccgaugaugcgccacaccaucgagaacaccacggccaacaucagccugaccgccaucgccaaccaggcggccauccugaugggccucgacaagggcuggcccaucuccaagauggacaucggggucccccugcuggcccucggcugcuacagccaggugaacccccugacccugaccgccgccgugcucaugcuggucgcgcacuacgccaucaucgggccgggccugcaggccaaggccacgcgggaggcgcagaagcgcaccgccgccgggaucaugaagaaccccaccguggacggcaucguggccaucgaccucgaccccgucguguacgacgccaaguucgagaagcagcugggccagaucaugcugcucauccugugcaccucccagauccugcucaugcggacgaccugggcgcugugcgagagcaucacccuggccaccgggccccucacgacccugugggagggcuccccggggaaguucuggaacaccaccaucgccgugagcauggccaacaucuuccgcggcuccuaccuggccggcgcggggcucgccuucagccugaugaagucccugggcgggggccggcgcgggacgggcgcccagggcgagacccucggggagaaguggaagcggcagcugaaccagcugagcaagagcgaguucaacaccuacaagcgcuccggcaucauggaggucgaccggagcgaggccaaggaggggcucaagcgcggcgagaccacgaagcacgccgugucccgggggaccgcgaagcugcgcugguucguggagcggaaccuggucaagcccgagggcaaggugaucgaccugggcugcgggcgcggcggguggagcuacuacugcgccggccucaagaaggugaccgaggucaagggguacaccaagggcggccccgggcacgaggagcccaucccgauggccaccuacggcuggaacaucgugaagcugcacuccgggcgggacguguucuucacgccgcccgagaagugcgacacccugcucugcgacaucggcgagagcucccccaacccgaccaucgaggaggggcgcacccugcggguccugaagaugguggagcccuggcuccgcggcaaccaguucugcaucaagauccugaaccccuacaugcccagcguggucgagacgcuggagcagaugcagcggaagcacggcgggaugcucgugcgcaacccgcugucccgcaacagcacccacgagauguacuggguguccugcggcaccgggaacaucgucagcgccgugaacaugaccucccggaugcugcucaaccgcuucacgauggcgcaccggaagcccaccuacgagcgcgacguggaccugggcgccggcacccggcacgucgccguggagcccgagaccgccaaccuggacaucaucgggcagcgcaucgagaacaucaagaacgagcacaagagcacguggcacuacgacgaggacaaccccuacaagaccugggccuaccacggcuccuacgaggugaagccgagcggguccgcgagcuccauggucaacggcgugguccggcuccugaccaagcccugggacgugauccccauggugacccagaucgccaugacggacaccacccccuucgggcagcagcgcgucuucaaggagaagguggacacccggacgccgcgccccaagcggggcaccgcccagaucauggaggugaccgccaaguggcuguggggcuuccucagccgcaacaagaagccccggaucugcacccgcgaggaguucacgcggaagguccgcagcaacgccgcgaucggggccguguucguggacgagaaccaguggaacuccgccaaggaggccgucgaggacgagcgguucugggaccuggugcaccgcgagcgggagcugcacaagcagggcaagugcgcgaccugcguguacaacaugauggggaagcgcgagaagaagcucggcgaguucgggaaggcgaagggcagccgggccaucugguacauguggcugggcgcccgcuuccuggaguucgaggcccucggguucaugaacgaggaccacugguucucccgcgagaacagccuguccggcgucgagggggagggccugcacaagcucggguacauccugcgggacaucagcaagaucccgggcggcaacauguacgcggacgacaccgccgggugggacacccgcaucacggaggacgaccugcagaacgaggccaagaucaccgacaucauggagcccgagcacgcccuccuggccaccuccaucuucaagcugaccuaccagaacaagguggugcggguccagcgccccgccaagagcggcacggugauggacgugaucucccggcgcgaccagcgggggagcggccaggucggcaccuacgggcucaacaccuucaccaacauggaggugcagcugauccgccagauggaguccgagggcaucuucagccccuccgagcuggagaacagcaaccucgcggagcgggugcuggacuggcuggagaagcacggggucgagcgccucaagcggauggccaucuccggcgacgacugcguggugaagccgacggacgaccgcuucgccaccgcccugaccgcgcugaacgacauggggaagguccggaaggacaucccccagugggagcccagcaagggcuggaacgacuggcagcagguccccuucugcucccaccacuuccaccagcucaucaugaaggacggccgcgagaucguggucccgugccggaaccaggacgagcugguggggcgcgcccgggugagccagggcgccggguggagccugcgcgagaccgccugccucggcaaguccuacgcccagauguggcagcugauguacuuccaccggcgcgaccugcgccucgcggccaacgccaucugcagcgccguccccgugaacugggugcccaccucccggacgaccuggagcauccacgcccaccaccaguggaugaccaccgaggacaugcuguccgucuggaaccgcguguggaucgaggagaaccccuggauggaggacaagacgcacgugagcuccugggaggacgucccguaccuggggaagcgggaggaccaguggugcggcagccucaucggccugaccgcgcgcgccaccugggccaccaacauccagguggccaucaaccaggugcggcgccugaucgggaacgagaacuaccucgacuacaugacguccaugaagcgguucaagaacgagagcgaccccgagggcgcgcugugguga

SEQ ID NO: 8946 - RNA, 9879 nt, Artificial Sequence
  derived and/or modified CDS sequence (opt1) from DENV-1__KM403577__SS-prME
agcgugaccaugcugcucaugcugcugcccaccgcccucgccuuccaccugaccacccggggcggggagccccacaugaucgugagcaagcaggagcggggcaagagccuccucuucaagaccuccgcgggggugaacaugugcacccugaucgccauggaccugggcgagcucugcgaggacacgaugaccuacaagugcccccggaucaccgaggccgagcccgacgacguggacugcuggugcaacgccaccgacaccugggugaccuacgggaccugcagccagaccggcgagcaccggcgcgacaagcgguccguggcccuggcgccccacgugggccuggggcucgagacccgcaccgagaccuggaugagcuccgagggcgccuggcggcagauccagaagguggagaccugggcccugcgccaccccggguucacggugaucgccuucuuccuggcgcacgccaucggcaccagcaucacccagaaggggaucaucuucauccuccugaugcuggugacccccuccauggccaugcggugcgucggcaucggcaaccgcgacuucguggaggggcucagcggcgccacguggguggacgucgugcuggagcacggguccugcgugaccaccauggccaagaacaagcccacccuggacaucgagcuccugaagacggaggucaccaaccccgcggugcugcggaagcucugcaucgaggccaagaucagcaacaccaccacggacucccgcugccccacccagggcgaggccacccugguggaggagcaggacgccaacuucgucugccggcgcaccuucguggaccggggcugggggaacggcugcgggcuguucggcaaggggagccuccugacgugcgccaaguucaagugcgugaccaagcuggagggcaagaucguccaguacgagaaccucaaguacuccgugaucgugaccguccacaccggcgaccagcaccagguggggaacgagacgaccgagcacggcaccaucgcgaccaucacgccccaggcccccacgagcgagauccagcugaccgacuacggggcccugacccucgacugcagcccccggaccggccuggacuucaacgagaugguccugcucacgaugaaggagaaguccuggcuggugcacaagcagugguuccuggaccucccgcugcccuggaccuccggggccagcaccagccaggagaccuggaaccggcaggaccugcucgugacguucaagaccgcccacgcgaagaagcaggaggucguggugcugggcucccaggagggcgccaugcacaccgcccugaccggggccacggagauccagaccagcggcaccaccacgaucuucgccgggcaccucaagugccgccugaagauggacaagcugacccucaagggcgucuccuacgugaugugcaccgggagcuucaagcuggagaaggagguggcggagacccagcacggcacgguccugguccaggugaaguacgagggcaccgacgcccccugcaagauccccaucuccacccaggacgagaagggggucacccagaacggccggcugaucacggccaacccgaucgugaccgacaaggagaagcccgugaacaucgagaccgagccgcccuucggggagagcuacaucgucaucggcgccggcgagaaggcgcucaagcuguccugguucaagaaggggagcuccaucggcaagauguucgaggccaccgcccgcggggcccggcgcauggccauccugggcgacacggcgugggacuucgggagcaucggcggcguguucaccuccguggggaagcucguccaccagguguucggcaccgccuacggggugcuguucagcggcgucuccuggaccaugaagaucgggaucggcauccugcucacguggcugggccugaacagccgcuccaccagccucuccaugaccugcaucgccguggggauggugacccuguaccugggcgucauggugcaggccgacagcgggugcgugaucaacuggaagggccgggagcucaagugcggguccggcaucuucgucacgaacgaggugcacaccuggaccgagcaguacaaguuccaggccgacagcccgaagcgccugagcgcggccaucggcaaggccugggaggagggggugugcggcauccgguccgccacccgccuggagaacaucauguggaagcagaucagcaacgagcucaaccacauccugcuggagaacgacaugaaguucaccgucguggugggggacgccaacggcauccucacgcaggggaagaagaugauccggccccagcccauggagcacaaguacuccuggaaguccuggggcaaggcgaagaucaucggcgccgacacccagaacaccaccuucaucaucgacgggcccgacacgccggagugccccgacgaccagcgcgccuggaacaucugggaggucgaggacuacggcuucgggguguucaccaccaacaucuggcugaagcugcgggacuccuacacccagaugugcgaccaccgccucaugagcgccgcgaucaaggacuccaaggccgugcacgccgacaugggcuacuggaucgagagcgagaagaacgagacguggaagcuggcccgggccuccuucaucgaggucaagaccugcaucuggccccgcagccacacccugugguccaacggcgugcucgagagcgagaugaucauccccaagaucuacgggggcccgaucucccagcacaacuaccggcccggguacuucacccagacggcgggccccuggcaccuggggaagcuggagcucgacuucaaccugugcgagggcaccaccguggucguggacgagcacugcggcaaccgcgggccgagccugcggaccacgaccgugaccggcaagaucauccacgaguggugcugccgcuccugcacccugccgccccugcgguuccgcggggaggacggcugcugguacgggauggagauccggcccgucaaggagaaggaggagaaccuggugcgcagcaugguguccgccggcagcggcgaggucgacagcuucucccucgggcugcugugcgugagcaucaugaucgaggaggugaugcggucccgcuggagccgcaagaugcucaugacgggcacccuggccgucuucuuccugcucaucauggggcagcugaccuggaacgaccugauccggcucugcaucauggugggcgccaacguguccgaccgcauggggaugggcaccacguaccuggcccugauggcgaccuucaagaugcggccgauguucgccgucggccuccuguuccgccggcugaccagccgcgaggugcuccugcugaccaucgggcucucccuggucgccagcguggagcugcccaacucccucgaggagcugggcgacgggcuggccaugggcaucaugaugcucaagcugcugacggacuuccagagccaccagcucuggaccacccugcugucccucaccuucaucaagacgacccugagccuggacuacgccuggaagaccauggcgauggugcucuccaucgucagccuguucccccugugccucuccaccacgagccagaagaccaccuggcugcccgugcugcucggcuccuucgggugcaagccgcugaccauguuccugaucaccgagaacaagaucuggggccgcaagagcuggccccucaacgaggggaucauggccgugggcaucgucuccauccugcugagcagccuccugaagaacgacgugccccuggccgggccccucaucgccggcggcaugcugaucgcgugcuacgugaucuccgggagcuccgccgaccugagccucgagcgcgccgccgaggucuccugggaggaggaggccgagcacagcggcgcgucccacaacauccugguggaggugcaggacgacgggacgaugaagaucaaggacgaggagcgggacgacacccugaccauccuccugaaggccacccugcucgccgucagcggcguguacccgauguccauccccgccacgcuguucgugugguacuucuggcagaagaagaagcagcgcagcgggguccugugggacacccccagcccgcccgagguggagcgggccgugcucgacgacggcaucuaccgcauccugcagcggggccugcuggggcgcagccaggucggcguggggguguuccaggacggcgucuuccacaccauguggcacgugacccgcggggcggugcucauguaccagggcaagcgccuggagcccuccugggccagcgucaagaaggaccugaucuccuacggcgggggcuggcgguuccaggggagcuggaacacgggcgaggagguccaggugaucgccgucgagcccgggaagaaccccaagaacgugcagaccacccccggcaccuucaagacgcccgagggcgaggugggggccaucgcccucgacuucaagcccggcaccuccgggagccccaucgucaaccgcgagggcaagaucgugggccuguacgggaacggcguggucaccaccuccgggacguacgugagcgcgaucgcccaggccaaggccagccaggagggcccgcugcccgagaucgaggacgagguguucaagaagcggaaccucaccaucauggaccugcaccccggguccggcaagacccgccgguaccugccggccaucguccgcgaggcgaucaagcgcaagcuccggacccugauccuggcccccacgcgcgugguggccagcgagauggccgaggcgcucaagggcaugcccauccgguaccagaccaccgccgucaaguccgagcacaccgggaaggagaucguggaccugaugugccacgccacguucaccaugcgccugcucagccccgugcgggucccgaacuacaacaugaucaucauggacgaggcccacuucaccgaccccgccuccaucgcggcccgcggcuacaucagcacccggguggggaugggcgaggccgccgccaucuucaugacggcgacgccgcccggguccguggaggccuucccgcagagcaacgccgucauccaggacgaggagcgcgacauccccgagcgguccuggaacagcggcuacgacuggaucaccgacuuccccggcaagaccgugugguucgugcccuccaucaagagcgggaacgacaucgccaacugccugcgcaagaacggcaagcgggucauccagcugucccgcaagacguucgacaccgaguaccagaagaccaagaacaacgacugggacuacguggugaccacggacaucagcgagaugggggccaacuuccgggcggaccgcgucaucgacccgcggcgcugccucaagcccgugauccugaaggacggccccgagcgggucauccuggccgggcccaugccggugaccgccgccuccgcggcccagcgccggggccgcaucggccgcaaccagaacaaggagggggaccaguacaucuacaugggccagccccucaacaacgacgaggaccacgcccacuggaccgaggccaagaugcugcuggacaacaucaacacccccgaggggaucauccccgcccucuucgagccggagcgggagaaguccgcggccaucgacggcgaguaccgccugcgcggggaggcccgcaagacguucguggagcugaugcggcgcggcgaccuccccgucuggcuguccuacaagguggccagcgagggcuuccaguacuccgaccggcgcuggugcuucgacggggagcggaacaaccaggugcuggaggagaacauggacgucgagaucuggaccaaggagggcgagcgcaagaagcuccggccccgcuggcuggacgcccggaccuacagcgacccccuggcgcuccgcgaguucaaggaguucgccgccgggcggcgcagcguguccggcgaccugauccuggagaucggcaagcucccgcagcaccugacccugcgggcccagaacgcccucgacaaccuggugaugcugcacaacagcgagcagggcgggaaggcguaccgccacgccauggaggagcuccccgacaccaucgagacgcugaugcugcucgcccugaucgccguccugaccgggggcgugacccucuucuuccuguccgggaagggccugggcaagaccagcaucgggcuccugugcgugauggcguccagcguccugcucuggauggccuccguggagccccacuggaucgccgccagcaucauccuggaguucuuccugauggugcuccugauccccgagccggaccggcagcgcacgccccaggacaaccagcuggccuacgucgugaucggccuccuguucaugauccugaccguggcggccaacgagauggggcuccuggagaccaccaagaaggaccugggcaucgggcacgucguggccgagaaccaccaccacgccacgaugcucgacaucgaccugcaccccgccuccgcguggacccuguacgccguggccaccaccaucaucacgccgaugaugcggcacaccaucgagaacaccaccgccaacaucagccucacggccaucgcgaaccaggccgccauccugaugggccuggacaagggcuggcccaucuccaagauggacaucggggucccccuccuggcccugggcugcuacagccaggugaacccccucacccugaccgccgcggugcugaugcucgucgcccacuacgccaucaucgggccgggccugcaggccaaggcgacccgcgaggcccagaagcgcacggccgccgggaucaugaagaaccccaccguggacggcaucguggccaucgaccuggaccccgucguguacgacgcgaaguucgagaagcagcucggccagaucaugcugcugauccucugcaccucccagauccugcugaugcggaccacgugggcccucugcgagagcaucacccuggccaccgggccccugaccacgcucugggagggcuccccggggaaguucuggaacaccaccaucgccgugagcauggccaacaucuuccgcggcuccuaccuggcgggcgccgggcuggccuucagccucaugaagucccugggcgggggccggcgcgggaccggcgcccagggcgagacgcugggggagaaguggaagcggcagcucaaccagcugagcaagagcgaguucaacaccuacaagcgcuccggcaucauggaggucgaccggagcgaggccaaggaggggcugaagcgcggcgagaccaccaagcacgcggugucccgggggacggccaagcuccgcugguucguggagcggaaccuggucaagcccgagggcaaggugaucgaccugggcugcgggcgcggcggguggagcuacuacugcgccggccugaagaaggugaccgaggucaagggguacaccaagggcggccccgggcacgaggagcccaucccgauggccaccuacggcuggaacaucgugaagcuccacuccgggcgggacguguucuucacgccgcccgagaagugcgacacgcugcugugcgacaucggcgagagcucccccaacccgaccaucgaggaggggcgcacccuccggguccugaagaugguggagcccuggcugcgcggcaaccaguucugcaucaagauccucaaccccuacaugcccagcguggucgagacccuggagcagaugcagcggaagcacggcgggaugcuggugcgcaacccgcucucccggaacagcacgcacgagauguacuggguguccugcggcaccgggaacaucgucagcgcggugaacaugaccucccgcaugcugcugaaccgcuucaccauggcccaccggaagcccacguacgagcgcgacguggaccucggcgccggcacccggcacgucgccguggagcccgagaucgccaaccuggacaucaucgggcagcgcaucgagaacaucaagaacgagcacaagagcaccuggcacuacgacgaggacaaccccuacaagaccugggcguaccacggcuccuacgaggugaagccgagcggguccgccagcuccauggucaacggcgugguccggcugcucacgaagcccugggacgugauccccauggugacccagaucgccaugaccgacaccacgcccuucgggcagcagcgcgucuucaaggagaagguggacacccggaccccgcgccccaagcggggcaccgcccagaucauggaggugacggccaaguggcuguggggcuuccugagccgcaacaagaagccccggaucugcacccgcgaggaguucacccggaagguccgcagcaacgcggccaucggggccguguucguggacgagaaccaguggaacuccgccaaggaggccgucgaggacgagcgguucugggaccucgugcaccgcgagcgggagcugcacaagcagggcaagugcgcgaccugcguguacaacaugauggggaagcgcgagaagaagcugggcgaguucgggaaggccaagggcagccgggccaucugguacauguggcucggcgcccgcuuccuggaguucgaggcgcugggguucaugaacgaggaccacugguucucccgggagaacagccucuccggcgucgagggggagggccugcacaagcugggguacauccuccgcgacaucagcaagaucccgggcggcaacauguacgccgacgacacggccgggugggacacccgcaucaccgaggacgaccugcagaacgaggccaagaucaccgacaucauggagcccgagcacgcccugcucgcgacguccaucuucaagcugaccuaccagaacaagguggugcggguccagcgccccgccaagagcggcaccgugauggacgugaucucccggcgcgaccagcgggggagcggccaggucggcaccuacgggcugaacacguucaccaacauggaggugcagcucauccgccagauggaguccgagggcaucuucagccccuccgagcuggagaacagcaaccuggccgagcgggugcucgacuggcuggagaagcacggggucgagcgccugaagcggauggccaucuccggcgacgacugcguggugaagccgaccgacgaccgcuucgccaccgcgcucacggcccugaacgacauggggaagguccggaaggacaucccccagugggagcccagcaagggcuggaacgacuggcagcagguccccuucugcucccaccacuuccaccagcugaucaugaaggacggccgcgagaucguggucccgugccggaaccaggacgagcucguggggcgcgcccgggugagccagggcgccggguggagccugcgcgagaccgccugccugggcaaguccuacgcgcagauguggcagcucauguacuuccaccggcgcgaccugcggcuggccgccaacgccaucugcagcgccguccccgugaacugggugcccaccucccgcaccaccuggagcauccacgcgcaccaccaguggaugacgaccgaggacaugcucuccgucuggaaccgcguguggaucgaggagaaccccuggauggaggacaagacccacgugagcuccugggaggacgucccguaccuggggaagcgggaggaccaguggugcggcagccugaucggccucaccgcccgcgccacgugggccaccaacauccagguggcgaucaaccaggugcggcgccugaucgggaacgagaacuaccuggacuacaugaccuccaugaagcgguucaagaacgagagcgaccccgagggcgcccucugguga

SEQ ID NO: 8947 - RNA, 9879 nt, Artificial Sequence
  derived and/or modified CDS sequence (opt1) from DENV-1__KM403631__SS-prME
agcgugaccaugcugcucaugcugcugcccaccgcccucgccuuccaccugaccacccggggcggggagccccacaugaucgugagcaagcaggagcggggcaagagccuccuguucaagaccuccgcgggggugaacaugugcacccugaucgccauggaccugggcgagcucugcgaggacacgaugaccuacaagugcccccggaucaccgaggccgagcccgacgacguggacugcuggugcaacgccaccgacaccugggucaccuacgggaccugcagccagaccggcgagcaccggcgcgacaagcgguccguggcccuggcgccccacgugggccuggggcucgagacccgcaccgagaccuggaugagcuccgagggcgccuggcggcagauccagaaggucgagaccugggcccugcgccaccccggguucacggugaucgcccuguuccucgcgcacgccaucggcaccagcaucacccagaaggggaucaucuucauccugcugaugcucgugacccccuccauggccaugcggugcgucggcaucggcaaccgcgacuucguggaggggcugagcggcgccacguggguggacgucgugcuggagcacggguccugcgugaccaccauggccaagaacaagcccacccucgacaucgagcugcugaagacggaggucaccaaccccgcggugcuccggaagcugugcaucgaggccaagaucagcaacaccaccacggacucccgcugccccacccagggcgaggccacccugguggaggagcaggacgccaacuucgucugccggcgcaccuucguggaccggggcugggggaacggcugcggccucuucggcaaggggagccugcugacgugcgccaaguucaagugcgugaccaagcucgagggcaagaucguccaguacgagaaccugaaguacuccgugaucgugaccguccacaccggcgaccagcaccagguggggaacgagacgaccgagcacggcaccaucgcgaccaucacgccccaggcccccacgagcgagauccagcugaccgacuacggggcccucacccuggacugcagcccccggaccggccuggacuucaacgagaugguccuccugacgaugaaggagaaguccuggcuggugcacaagcagugguuccucgaccugccgcugcccuggaccuccggggccagcaccagccaggagaccuggaaccggcaggaccuccuggugacguucaagaccgcccacgcgaagaagcaggaggucguggugcugggcucccaggagggcgccaugcacaccgcccucaccggggccacggagauccagaccagcggcaccaccacgaucuucgccgggcaccugaagugccgccugaagauggacaagcucacccugaagggcgucuccuacgugaugugcaccgggagcuucaagcuggagaaggagguggcggagacccagcacggcacgguccugguccaggugaaguacgagggcaccgacgcccccugcaagauccccaucuccacccaggacgagaagggggucacccagaacggccggcucaucacggccaacccgaucgugaccgacaaggagaagcccaucaacaucgagaccgagccgcccuucggggagagcuacaucgugaucggcgccggcgagaaggcgcugaagcuguccugguucaagaaggggagcuccaucggcaagauguucgaggccaccgcccgcggggcccggcgcauggccauccucggcgacacggcgugggacuucgggagcaucggcggcgucuucaccuccguggggaagcuggugcaccaggucuucggcaccgccuacggggugcuguucagcggcguguccuggaccaugaagaucgggaucggcauccuccugacguggcugggccucaacagccgcuccaccagccuguccaugaccugcaucgccgucgggauggugacccuguaccucggcgugaugguccaggccgacagcgggugcgugaucaacuggaagggccgggagcugaagugcggguccggcaucuucgugacgaacgagguccacaccuggaccgagcaguacaaguuccaggccgacagcccgaagcgccugagcgcggccaucggcaaggccugggaggagggggugugcggcauccgguccgccacccgccucgagaacaucauguggaagcagaucagcaacgagcugaaccacauccugcucgagaacgacaugaaguucaccguggucgugggggacgccaacggcauccugacgcaggggaagaagaugauccggccccagcccauggagcacaaguacuccuggaaguccuggggcaaggcgaagaucaucggcgccgacacccagaacaccaccuucaucaucgacgggcccgacacgccggagugccccgacgaccagcgcgccuggaacaucugggagguggaggacuacggcuucggggucuucaccaccaacaucuggcugaagcuccgggacuccuacacccagaugugcgaccaccgccugaugagcgccgcgaucaaggacuccaaggccgugcacgccgacaugggcuacuggaucgagagcgagaagaacgagacguggaagcuggcccgggccuccuucaucgaggugaagaccugcaucuggccccgcagccacacccucugguccaacggcguccuggagagcgagaugaucauccccaagaucuacgggggcccgaucucccagcacaacuaccggcccggguacuucacccagacggcgggccccuggcaccuggggaagcucgagcuggacuucaaccugugcgagggcaccaccgugguggucgacgagcacugcggcaaccgcgggccgagccuccggaccacgaccgugaccggcaagaucauccacgaguggugcugccgcuccugcacccugccgccccugcgguuccgcggggaggacggcugcugguacgggauggagauccggcccgugaaggagaaggaggagaaccucguccgcagcaugguguccgccggcagcggcgagguggacagcuucucccuggggcugcucugcgucagcaucaugaucgaggaggugaugcggucccgcuggagccgcaagaugcugaugacgggcacccuggccguguucuuccuccugaucauggggcagcugaccuggaacgaccucauccggcugugcaucauggucggcgccaacguguccgaccgcauggggaugggcaccacguaccuggcccucauggcgaccuucaagaugcggccgauguucgccguggggcugcuguuccgccggcucaccagccgcgagguccugcugcucaccaucgggcugucccugguggccagcgucgagcuccccaacucccuggaggagcugggcgacgggcucgccaugggcaucaugaugcugaagcugcucacggacuuccagagccaccagcuguggaccacccugcucucccugaccuucaucaagacgacccugagccucgacuacgccuggaagaccauggcgauggugcuguccaucgugagccuguucccccucugccuguccaccacgagccagaagaccaccuggcugcccguccuccugggcuccuucgggugcaagccgcugaccauguuccucaucaccgagaacaagaucuggggccgcaagagcuggccccugaacgaggggaucauggccgugggcaucguguccauccugcucagcagccugcugaagaacgacgucccccucgccgggccccugaucgccggcggcaugcugaucgcgugcuacgugaucuccgggagcuccgccgaccucagccuggagcgcgccgccgagguguccugggaggaggaggccgagcacagcggcgcgucccacaacauccuggucgaggugcaggacgacgggacgaugaagaucaaggacgaggagcgggacgacacccucaccauccugcugaaggccacccuccuggccgugagcggcgucuacccgauguccauccccgccacgcuguucgugugguacuucuggcagaagaagaagcagcgcagcggggugcucugggacacccccagcccgcccgaggucgagcgggccgugcuggacgacggcaucuaccgcauccugcagcggggccugcucgggcgcagccaggugggcgucgggguguuccaggacggcguguuccacaccauguggcacgucacccgcggggcggugcugauguaccagggcaagcgccuggagcccuccugggccagcgugaagaaggaccucaucuccuacggcgggggcuggcgguuccaggggagcuggaacacgggcgaggagguccaggugaucgccguggagcccgggaagaaccccaagaacguccagaccacccccggcaccuucaagacgcccgagggcgaggugggggccaucgcccuggacuucaagcccggcaccuccgggagccccaucgugaaccgcgagggcaagaucgucggccuguacgggaacggcguggugaccaccuccgggacguacgucagcgcgaucgcccaggccaaggccagccaggagggcccgcuccccgagaucgaggacgagguguucaagaagcggaaccugaccaucauggaccugcaccccggguccggcaagacccgccgguaccucccggccaucgugcgcgaggcgaucaagcgcaagcugcggacccugauccucgcccccacgcgcgucguggccagcgagauggccgaggcgcugaagggcaugcccauccgguaccagaccaccgccgugaaguccgagcacaccgggaaggagaucgucgaccugaugugccacgccacguucaccaugcgccuccugagccccgugcgggugccgaacuacaacaugaucaucauggacgaggcccacuucaccgaccccgccuccaucgcggcccgcggcuacaucagcacccgggucgggaugggcgaggccgccgccaucuucaugacggcgacgccgcccggguccguggaggccuucccgcagagcaacgccgugauccaggacgaggagcgcgacauccccgagcgguccuggaacagcggcuacgacuggaucaccgacuuccccggcaagaccgucugguucgugcccuccaucaagagcgggaacgacaucgccaacugccugcgcaagaacggcaagcgggugauccagcucucccgcaagacguucgacaccgaguaccagaagaccaagaacaacgacugggacuacgucgugaccacggacaucagcgagaugggggccaacuuccgggcggaccgcgugaucgacccgcggcgcugccugaagcccgucauccugaaggacggccccgagcgggugauccucgccgggcccaugccggucaccgccgccuccgcggcccagcgccggggccgcaucggccgcaaccagaacaaggagggggaccaguacaucuacaugggccagccccugaacaacgacgaggaccacgcccacuggaccgaggccaagaugcugcucgacaacaucaacacccccgaggggaucauccccgcccuguucgagccggagcgggagaaguccgcggccaucgacggcgaguaccgccugcgcggggaggcccgcaagacguucguggagcucaugcggcgcggcgaccugcccguguggcuguccuacaaggucgccagcgagggcuuccaguacuccgaccggcgcuggugcuucgacggggagcggaacaaccaggugcucgaggagaacauggacguggagaucuggaccaaggagggcgagcgcaagaagcugcggccccgcuggcuggacgcccggaccuacagcgacccccucgcgcugcgcgaguucaaggaguucgccgccgggcggcgcagcgucuccggcgaccugauccucgagaucggcaagcugccgcagcaccugacccuccgggcccagaacgcccuggacaaccuggugaugcuccacaacagcgagcagggcgggaaggcguaccgccacgccauggaggagcugcccgacaccaucgagacgcugaugcuccuggcccugaucgccgugcucaccgggggcgucacccuguucuuccuguccgggaagggccucggcaagaccagcaucgggcugcugugcgugauggcguccagcgugcuccuguggauggccuccgucgagccccacuggaucgccgccagcaucauccuggaguucuuccucauggugcugcugauccccgagccggaccggcagcgcacgccccaggacaaccagcucgccuacguggucaucggccugcuguucaugauccucaccguggcggccaacgagauggggcugcuggagaccaccaagaaggaccucggcaucgggcacguggucgccgagaaccaccaccacgccacgaugcuggacaucgaccugcaccccgccuccgcguggacccucuacgccguggccaccaccaucaucacgccgaugaugcggcacaccaucgagaacaccaccgccaacaucagccugacggccaucgcgaaccaggccgccauccugaugggccucgacaagggcuggcccaucuccaagauggacaucggggugccccugcuggcccucggcugcuacagccaggucaacccccugacccugaccgccgcggugcucaugcugguggcccacuacgccaucaucgggccgggccugcaggccaaggcgacccgcgaggcccagaagcgcacggccgccgggaucaugaagaaccccaccgucgacggcaucguggccaucgaccucgaccccguggucuacgacgcgaaguucgagaagcagcugggccagaucaugcugcucauccugugcaccucccagauccugcucaugcggaccacgugggcccugugcgagagcaucacccuggccaccgggccccucaccacgcugugggagggcuccccggggaaguucuggaacaccaccaucgccgugagcauggccaacaucuuccgcggcuccuaccuggcgggcgccgggcucgccuucagccugaugaagucccugggcgggggccggcgcgggaccggcgcccagggcgagacgcucggggagaaguggaagcggcagcugaaccagcugagcaagagcgaguucaacaccuacaagcgcuccggcaucauggagguggaccggagcgaggccaaggaggggcucaagcgcggcgagaccaccaagcacgcggucucccgggggacggccaagcugcgcugguucguggagcggaaccuggugaagcccgagggcaaggucaucgaccugggcugcgggcgcggcggguggagcuacuacugcgccggccucaagaaggugaccgaggugaagggguacaccaagggcggccccgggcacgaggagcccaucccgauggccaccuacggcuggaacaucgucaagcugcacuccgggcgggacguguucuucacgccgcccgagaagugcgacacgcugcucugcgacaucggcgagagcucccccaacccgaccaucgaggaggggcgcacccugcgggugcugaagauggucgagcccuggcuccgcggcaaccaguucugcaucaagauccugaaccccuacaugcccagcgugguggagacccuggagcagaugcagcggaagcacggcgggaugcucguccgcaacccgcugucccggaacagcacgcacgagauguacuggguguccugcggcaccgggaacaucgugagcgcggucaacaugaccucccgcaugcugcucaaccgcuucaccauggcccaccggaagcccacguacgagcgcgacguggaccugggcgccggcacccggcacguggccgucgagcccgagaucgccaaccuggacaucaucgggcagcgcaucgagaacaucaagaacgagcacaagagcaccuggcacuacgacgaggacaaccccuacaagaccugggcguaccacggcuccuacgaggugaagccgagcggguccgccagcuccauggugaacggcgucgugcggcuccugacgaagcccugggacgucauccccauggugacccagaucgccaugaccgacaccacgcccuucgggcagcagcgcguguucaaggagaaggucgacacccggaccccgcgccccaagcggggcaccgcccagaucauggaggugacggccaaguggcuguggggcuuccucagccgcaacaagaagccccggaucugcacccgcgaggaguucacccggaaggugcgcagcaacgcggccaucggggccgucuucguggacgagaaccaguggaacuccgccaaggaggccguggaggacgagcgguucugggaccugguccaccgcgagcgggagcugcacaagcagggcaagugcgcgaccugcguguacaacaugauggggaagcgcgagaagaagcucggcgaguucgggaaggccaagggcagccgggccaucugguacauguggcugggcgcccgcuuccuggaguucgaggcgcucggguucaugaacgaggaccacugguucucccgggagaacagccuguccggcguggagggggagggccugcacaagcucggguacauccugcgcgacaucagcaagaucccgggcggcaacauguacgccgacgacacggccgggugggacacccgcaucaccgaggacgaccugcagaacgaggccaagaucaccgacaucauggagcccgagcacgcccuccuggcgacguccaucuucaagcugaccuaccagaacaaggucgugcgggugcagcgccccgccaagagcggcaccgucauggacgugaucucccggcgcgaccagcgggggagcggccaggugggcaccuacgggcucaacacguucaccaacauggagguccagcugauccgccagauggaguccgagggcaucuucagccccuccgagcuggagaacagcaaccucgccgagcgggugcuggacuggcuggagaagcacgggguggagcgccucaagcggauggccaucuccggcgacgacugcgucgugaagccgaccgacgaccgcuucgccaccgcgcugacggcccugaacgacauggggaaggugcggaaggacaucccccagugggagcccagcaagggcuggaacgacuggcagcagguccccuucugcucccaccacuuccaccagcucaucaugaaggacggccgcgagaucguggugccgugccggaaccaggacgagcuggucgggcgcgcccgggugagccagggcgccggguggagccugcgcgagaccgccugccucggcaaguccuacgcgcagauguggcagcugauguacuuccaccggcgcgaccugcggcucgccgccaacgccaucugcagcgccgugcccgucaacugggugcccaccucccgcaccaccuggagcauccacgcgcaccaccaguggaugacgaccgaggacaugcuguccguguggaaccgcgucuggaucgaggagaaccccuggauggaggacaagacccacgugagcuccugggaggacgugccguaccuggggaagcgggaggaccaguggugcggcagccucaucggccugaccgcccgcgccacgugggccaccaacauccaggucgcgaucaaccaggugcggcgccugaucgggaacgagaacuaccucgacuacaugaccuccaugaagcgguucaagaacgagagcgaccccgagggcgcccugugguga

SEQ ID NO: 8948 - RNA, 9879 nt, Artificial Sequence
  derived and/or modified CDS sequence (opt1) from DENV-1__KM403632__SS-prME
agcgugaccaugcugcucaugcugcugcccaccgcccucgccuuccaccugaccacccggggcggggagccccacaugaucgugagcaagcaggagcggggcaagagccuccuguucaagaccuccgcgggggugaacaugugcacccugaucgccauggaccugggcgagcucugcgaggacacgaugaccuacaagugcccccggaucaccgaggccgagcccgacgacguggacugcuggugcaacgccaccgacaccugggugaccuacgggaccugcagccagaccggcgagcaccggcgcgacaagcgguccguggcccuggcgccccacgugggccuggggcucgagacccgcaccgagaccuggaugagcuccgagggcgccuggcggcagauccagaagguggagaccugggcccugcgccaccccggguucacggugaucgcccuguuccucgcgcacgccaucggcaccagcaucacccagaaggggaucaucuucauccugcugaugcucgugacccccuccauggccaugcggugcgucggcaucggcaaccgcgacuucguggaggggcugagcggcgccacguggguggacgucgugcuggagcacggguccugcgugaccaccauggccaagaacaagcccacccucgacaucgagcugcugaagacggaggucaccaaccccgcggugcuccggaagcugugcaucgaggccaagaucagcaacaccaccacggacucccgcugccccacccagggcgaggccacccugguggaggagcaggacgccaacuucgucugccggcgcaccuucguggaccggggcugggggaacggcugcggccucuucggcaaggggagccugcugacgugcgccaaguuccgcugcgugaccaagcucgagggcaagaucguccaguacgagaaccugaaguacuccgugaucgugaccguccacaccggcgaccagcaccagguggggaacgagacgaccgagcacggcaccaucgcgaccaucacgccccaggcccccacgagcgagauccagcugaccgacuacggggcccucacccuggacugcagcccccggaccggccuggacuucaacgagaugguccuccugacgaugaaggagaaguccuggcuggugcacaagcagugguuccucgaccugccgcugcccuggaccuccggggccagcaccagccaggagaccuggaaccgccaggaccuccuggugacguucaagaccgcccacgcgaagaagcaggaggucguggugcugggcucccaggagggcgccaugcacaccgcccucaccggggccacggagauccagaccagcggcaccaccacgaucuucgccgggcaccugaagugccggcugaagauggacaagcucacccugaagggcgucuccuacgugaugugcaccgggagcuucaagcuggagaaggagguggcggagacccagcacggcacgguccugguccaggugaaguacgagggcaccgacgcccccugcaagauccccaucuccacccaggacgagaagggggucacccagaacggccgccucaucacggccaacccgaucgugaccgacaaggagaagcccgugaacaucgagaccgagccgcccuucggggagagcuacaucgucaucggcgccggcgagaaggcgcugaagcuguccugguucaagaaggggagcuccaucggcaagauguucgaggccaccgcccgcggggcccgccgcauggccauccucggcgacacggcgugggacuucgggagcaucggcggcguguucaccuccguggggaagcugguccaccagguguucggcaccgccuacggggugcuguucagcggcgucuccuggaccaugaagaucgggaucggcauccuccugacguggcugggccucaacagccgguccaccagccuguccaugaccugcaucgccguggggauggugacccuguaccucggcgucauggugcaggccgacagcgggugcgugaucaacuggaagggccgcgagcugaagugcggguccggcaucuucgucacgaacgaggugcacaccuggaccgagcaguacaaguuccaggccgacagcccgaagcggcugagcgcggccaucggcaaggccugggaggagggggugugcggcauccgcuccgccacccggcucgagaacaucauguggaagcagaucagcaacgagcugaaccacauccugcucgagaacgacaugaaguucaccgucguggugggggacgccaacggcauccugacgcaggggaagaagaugauccgcccccagcccauggagcacaaguacuccuggaaguccuggggcaaggcgaagaucaucggcgccgacacccagaacaccaccuucaucaucgacgggcccgacacgccggagugccccgacgaccagcgggccuggaacaucugggaggucgaggacuacggcuucgggguguucaccaccaacaucuggcugaagcuccgcgacuccuacacccagaugugcgaccaccggcugaugagcgccgcgaucaaggacuccaaggccgugcacgccgacaugggcuacuggaucgagagcgagaagaacgagacguggaagcuggcccgcgccuccuucaucgaggucaagaccugcaucuggccccggagccacacccucugguccaacggcgugcuggagagcgagaugaucauccccaagaucuacgggggcccgaucucccagcacaacuaccgccccggguacuucacccagacggcgggccccuggcaccuggggaagcucgagcuggacuucaaccugugcgagggcaccaccguggucguggacgagcacugcggcaaccgggggccgagccuccgcaccacgaccgugaccggcaagaucauccacgaguggugcugccgguccugcacccugccgccccugcgcuuccgcggggaggacggcugcugguacgggauggagauccgccccgucaaggagaaggaggagaaccucgugcggagcaugguguccgccggcagcggcgaggucgacagcuucucccuggggcugcucugcgugagcaucaugaucgaggaggugaugcgcucccgcuggagccggaagaugcugaugacgggcacccuggccgucuucuuccuccugaucauggggcagcugaccuggaacgaccucauccgccugugcaucauggugggcgccaacguguccgaccggauggggaugggcaccacguaccuggcccucauggcgaccuucaagaugcgcccgauguucgccgucgggcugcuguuccggcgccucaccagccgggaggugcugcugcucaccaucgggcugucccuggucgccagcguggagcuccccaacucccuggaggagcugggcgacgggcucgccaugggcaucaugaugcugaagcugcucacggacuuccagagccaccagcuguggaccacccugcucucccugaccuucaucaagacgacccugagccucgacuacgccuggaagaccauggcgauggugcuguccaucgucagccuguucccccucugccuguccaccacgagccagaagaccaccuggcugcccgugcuccugggcuccuucgggugcaagccgcugaccauguuccucaucaccgagaacaagaucuggggccgcaagagcuggccccugaacgaggggaucauggccgugggcaucgucuccauccugcucagcagccugcugaagaacgacgugccccucgccgggccccugaucgccggcggcaugcugaucgcgugcuacgugaucuccgggagcuccgccgaccucagccuggagcgggccgccgaggucuccugggaggaggaggccgagcacagcggcgcgucccacaacauccugguggaggugcaggacgacgggacgaugaagaucaaggacgaggagcgcgacgacacccucaccauccugcugaaggccacccuccuggccgucagcggcguguacccgauguccauccccgccacgcuguucgugugguacuucuggcagaagaagaagcagcggagcgggguccucugggacacccccagcccgcccgagguggagcgcgccgugcuggacgacggcaucuaccggauccugcagcgcggccugcucgggcggagccaggucggcguggggguguuccaggacggcgucuuccacaccauguggcacgugacccgcggggcggugcugauguaccagggcaagcggcuggagcccuccugggccagcgucaagaaggaccucaucuccuacggcgggggcuggcgcuuccaggggagcuggaacacgggcgaggagguccaggugaucgccgucgagcccgggaagaaccccaagaacgugcagaccacccccggcaccuucaagacgcccgagggcgaggugggggccaucgcccuggacuucaagcccggcaccuccgggagccccaucgucaaccgggagggcaagaucgugggccuguacgggaacggcguggucaccaccuccgggacguacgugagcgcgaucgcccaggccaaggccagccaggagggcccgcuccccgagaucgaggacgagguguucaagaagcgcaaccugaccaucauggaccugcaccccggguccggcaagacccggcgcuaccucccggccaucguccgcgaggcgaucaagcggaagcugcgcacccugauccucgcccccacgcgggugguggccagcgagauggccgaggcgcugaagggcaugcccauccgcuaccagaccaccgccgucaaguccgagcacaccgggaaggagaucguggaccugaugugccacgccacguucaccaugcggcuccugagccccgugcgcgucccgaacuacaacaugaucaucauggacgaggcccacuucaccgaccccgccuccaucgcggcccggggcuacaucagcacccgcguggggaugggcgaggccgccgccaucuucaugacggcgacgccgcccggguccguggaggccuucccgcagagcaacgccgucauccaggacgaggagcgggacauccccgagcgcuccuggaacagcggcuacgacuggaucaccgacuuccccggcaagaccgugugguucgugcccuccaucaagagcgggaacgacaucgccaacugccugcggaagaacggcaagcgcgucauccagcucucccggaagacguucgacaccgaguaccagaagaccaagaacaacgacugggacuacguggugaccacggacaucagcgagaugggggccaacuuccgcgcggaccgggucaucgacccgcgccggugccugaagcccgugauccugaaggacggccccgagcgcgucauccucgccgggcccaugccggugaccgccgccuccgcggcccagcggcgcggccgcaucggccggaaccagaacaaggagggggaccaguacaucuacaugggccagccccugaacaacgacgaggaccacgcccacuggaccgaggccaagaugcugcucgacaacaucaacacccccgaggggaucauccccgcccuguucgagccggagcgcgagaaguccgcggccaucgacggcgaguaccggcugcgcggggaggcccggaagacguucguggagcucaugcgccggggcgaccugcccgucuggcuguccuacaagguggccagcgagggcuuccaguacuccgaccgccgguggugcuucgacggggagcgcaacaaccaggugcucgaggagaacauggacgucgagaucuggaccaaggagggcgagcggaagaagcugcgcccccgguggcuggacgcccgcaccuacagcgacccccucgcgcugcgggaguucaaggaguucgccgccgggcgccggagcguguccggcgaccugauccucgagaucggcaagcugccgcagcaccugacccuccgcgcccagaacgcccuggacaaccuggugaugcuccacaacagcgagcagggcgggaaggcguaccggcacgccauggaggagcugcccgacaccaucgagacgcugaugcuccuggcccugaucgccguccucaccgggggcgugacccuguucuuccuguccgggaagggccucggcaagaccagcaucgggcugcugugcgugauggcguccagcguccuccuguggauggccuccguggagccccacuggaucgccgccagcaucauccuggaguucuuccucauggugcugcugauccccgagccggaccgccagcggacgccccaggacaaccagcucgccuacgucgugaucggccugcuguucaugauccucaccguggcggccaacgagauggggcugcuggagaccaccaagaaggaccucggcaucgggcacgucguggccgagaaccaccaccacgccacgaugcuggacaucgaccugcaccccgccuccgcguggacccucuacgccguggccaccaccaucaucacgccgaugaugcgccacaccaucgagaacaccaccgccaacaucagccugacggccaucgcgaaccaggccgccauccugaugggccucgacaagggcuggcccaucuccaagauggacaucggggucccccugcuggcccucggcugcuacagccaggugaacccccugacccugaccgccgcggugcucaugcuggucgcccacuacgccaucaucgggccgggccugcaggccaaggcgacccgcgaggcccagaagcggacggccgccgggaucaugaagaaccccaccguggacggcaucguggccaucgaccucgaccccgucguguacgacgcgaaguucgagaagcagcugggccagaucaugcugcucauccugugcaccucccagauccugcucaugcgcaccacgugggcccugugcgagagcaucacccuggccaccgggccccucaccacgcugugggagggcuccccggggaaguucuggaacaccaccaucgccgugagcauggccaacaucuuccggggcuccuaccuggcgggcgccgggcucgccuucagccugaugaagucccugggcgggggccgccgggggaccggcgcccagggcgagacgcucggggagaaguggaagcgccagcugaaccagcugagcaagagcgaguucaacaccuacaagcgguccggcaucauggaggucgaccgcagcgaggccaaggaggggcucaagcggggcgagaccaccaagcacgcggugucccgcgggacggccaagcugcggugguucguggagcgcaaccuggucaagcccgagggcaaggugaucgaccugggcugcgggcggggcggguggagcuacuacugcgccggccucaagaaggugaccgaggucaagggguacaccaagggcggccccgggcacgaggagcccaucccgauggccaccuacggcuggaacaucgugaagcugcacuccgggcgcgacguguucuucacgccgcccgagaagugcgacacgcugcucugcgacaucggcgagagcucccccaacccgaccaucgaggaggggcggacccugcgcguccugaagaugguggagcccuggcuccggggcaaccaguucugcaucaagauccugaaccccuacaugcccagcguggucgagacccuggagcagaugcagcgcaagcacggcgggaugcucgugcggaacccgcugucccgcaacagcacgcacgagauguacuggguguccugcggcaccgggaacaucgucagcgcggugaacaugaccucccgcaugcugcucaaccgguucaccauggcccaccgcaagcccacguacgagcgggacguggaccugggcgccggcacccgccacgucgccguggagcccgagaucgccaaccuggacaucaucgggcagcggaucgagaacaucaagaacgagcacaagagcaccuggcacuacgacgaggacaaccccuacaagaccugggcguaccacggcuccuacgaggugaagccgagcggguccgccagcuccauggucaacggcgugguccgccuccugacgaagcccugggacgugauccccauggugacccagaucgccaugaccgacaccacgcccuucgggcagcagcgggucuucaaggagaagguggacacccgcaccccgcggcccaagcgcggcaccgcccagaucauggaggugacggccaaguggcuguggggcuuccucagccggaacaagaagccccgcaucugcacccgggaggaguucacccgcaagguccggagcaacgcggccaucggggccguguucguggacgagaaccaguggaacuccgccaaggaggccgucgaggacgagcgcuucugggaccuggugcaccgggagcgcgagcugcacaagcagggcaagugcgcgaccugcguguacaacaugauggggaagcgggagaagaagcucggcgaguucgggaaggccaagggcagccgcgccaucugguacauguggcugggcgcccgguuccuggaguucgaggcgcucggguucaugaacgaggaccacugguucucccgcgagaacagccuguccggcgucgagggggagggccugcacaagcucggguacauccugcgcgacaucagcaagaucccgggcggcaacauguacgccgacgacacggccgggugggacacccggaucaccgaggacgaccugcagaacgaggccaagaucaccgacaucauggagcccgagcacgcccuccuggcgacguccaucuucaagcugaccuaccagaacaagguggugcgcguccagcggcccgccaagagcggcaccgugauggacgugaucucccgccgggaccagcgcgggagcggccaggucggcaccuacgggcucaacacguucaccaacauggaggugcagcugauccggcagauggaguccgagggcaucuucagccccuccgagcuggagaacagcaaccucgccgagcgcgugcuggacuggcuggagaagcacggggucgagcggcucaagcgcauggccaucuccggcgacgacugcguggugaagccgaccgacgaccgguucgccaccgcgcugacggcccugaacgacauggggaagguccgcaaggacaucccccagugggagcccagcaagggcuggaacgacuggcagcagguccccuucugcucccaccacuuccaccagcucaucaugaaggacggccgggagaucguggucccgugccgcaaccaggacgagcugguggggcgggcccgcgugagccagggcgccggguggagccugcgggagaccgccugccucggcaaguccuacgcgcagauguggcagcugauguacuuccaccgccgggaccugcgccucgccgccaacgccaucugcagcgccguccccgugaacugggugcccaccucccgcaccaccuggagcauccacgcgcaccaccaguggaugacgaccgaggacaugcuguccgucuggaaccggguguggaucgaggagaaccccuggauggaggacaagacccacgugagcuccugggaggacgucccguaccuggggaagcgcgaggaccaguggugcggcagccucaucggccugaccgcccgggccacgugggccaccaacauccagguggcgaucaaccaggugcgccggcugaucgggaacgagaacuaccucgacuacaugaccuccaugaagcgcuucaagaacgagagcgaccccgagggcgcccugugguga

SEQ ID NO: 8949 - RNA, 9879 nt, Artificial Sequence
  derived and/or modified CDS sequence (opt1) from DENV-1__KM403583__SS-prME
agcgugaccaugcugcucaugcugcugcccaccgcccucgccuuccaccugaccacccggggcggggagccccacaugaucgugagcaagcaggagcggggcaagagccuccuguucaagaccuccgcgggggugaacaugugcacccugaucgccauggaccugggcgagcucugcgaggacacgaugaccuacaagugcccccggaucaccgaggccgagcccgacgacguggacugcuggugcaacgccaccgacaccugggucaccuacgggaccugcagccagaccggcgagcaccggcgcgaccggcgcuccguggcccuggcgccccacgugggccuggggcucgagacccggaccgagaccuggaugagcuccgagggcgccuggcgccagauccagcgggucgagaccugggcccugcgccaccccggguucacggugaucgcccuguuccucgcgcacgccaucggcaccagcaucacccagaaggggaucaucuucauccugcugaugcucgugacccccuccauggccaugcggugcgucggcaucggcaaccgcgacuucguggaggggcugagcggcgccacguggguggacgucgugcuggagcacggguccugcgugaccaccauggccaagaacaagcccacccucgacaucgagcugcugaagacggaggucaccaaccccgcggugcuccggaagcugugcaucgaggccaagaucagcaacaccaccacggacucccgcugccccacccagggcgaggccacccugguggaggagcaggacgccaacuucgucugccggcgcaccuucguggaccggggcugggggaacggcugcggccucuucggcaaggggagccugcugacgugcgccaaguucaagugcgugaccaagcucgagggcaagaucguccaguacgagaaccugaaguacuccgugaucgugaccguccacaccggcgaccagcaccagguggggaacgagacgaccgagcacggcaccaucgcgaccaucacgccccaggcccccacgagcgagauccagcugaccgacuacggggcccucacccuggacugcagcccccggaccggccuggacuucaacgagaugguccuccugacgaugaaggagaaguccuggcuggugcacaagcagugguuccucgaccugccgcugcccuggaccuccggggccagcaccagccaggagaccuggaaccggcaggaccuccuggugacguucaagaccgcccacgcgaagaagcaggaggucguggugcugggcucccaggagggcgccaugcacaccgcccucaccggggccacggagauccagaccagcggcaccaccacgaucuucgccgggcaccugaagugccgccugaagauggacaagcucacccugaagggcgucuccuacgugaugugcaccgggagcuucaagcuggagaaggagguggcggagacccagcacggcacgguccugguccaggugaaguacgagggcaccgacgcccccugcaagauccccaucuccacccaggacgagaagggggucacccagaacggccggcucaucacggccaacccgaucgugaccgacaaggagaagcccgugaacaucgagaccgagccgcccuucggggagagcuacaucgucaucggcgccggcgagaaggcgcugaagcuguccugguucaagaaggggagcuccaucggcaagauguucgaggccaccgcccgcggggcccgccggauggccauccucggcgacacggcgugggacuucgggagcaucggcggcguguucaccuccguggggaagcugguccaccagguguucggcaccgccuacggggugcuguucagcggcgucuccuggaccaugaagaucgggaucggcauccuccugacguggcugggccucaacagccgcuccaccagccuguccaugaccugcaucgccguggggauggugacccuguaccucggcgucauggugcaggccgacagcgggugcgugaucaacuggaagggccgggagcugaagugcggguccggcaucuucgucacgaacgaggugcacaccuggaccgagcaguacaaguuccaggccgacagcccgaagcgccugagcgcggccaucggcaaggccugggaggagggggugugcggcauccgguccgccacccgccucgagaacaucauguggaagcagaucagcaacgagcugaaccacauccugcucgagaacgacaugaaguucaccgucguggugggggacgccaacggcauccugacgcaggggaagaagaugauccggccccagcccauggagcacaaguacuccuggaaguccuggggcaaggcgaagaucaucggcgccgacacccagaacaccaccuucaucaucgacgggcccgacacgccggagugccccgacgaccagcgcgccuggaacaucugggaggucgaggacuacggcuucgggguguucaccaccaacaucuggcugaagcuccgggacuccuacacccagaugugcgaccaccgccugaugagcgccgcgaucaaggacuccaaggccgugcacgccgacaugggcuacuggaucgagagcgagaagaacgagacguggaagcuggcccgggccuccuucaucgaggucaagaccugcaucuggccccgcagccacacccucugguccaacggcgugcuggagagcgagaugaucauccccaagaucuacgggggcccgaucucccagcacaacuaccggcccggguacuucacccagacggcgggccccuggcaccuggggaagcucgagcuggacuucaaccugugcgagggcaccaccguggucguggacgagcacugcggcaaccgcgggccgagccuccggaccacgaccgugaccggcaagaucauccacgaguggugcugccgcuccugcacccugccgccccugcgguuccgcggggaggacggcugcugguacgggauggagauccggcccgucaaggagaaggaggagaaccucgugcgcagcaugguguccgccggcagcggcgaggucgacagcuucucccuggggcugcucugcgugagcaucaugaucgaggaggugaugcgcucccgguggagccgcaagaugcugaugacgggcacccuggccaucuucuuccuccugaucauggggcagcugaccuggaacgaccucauccggcugugcaucauggucggcgccaacguguccgaccgcauggggaugggcaccacguaccuggcccucauggcgaccuucaagaugcggccgauguucgccguggggcugcuguuccgccggcucaccagccgcgagguccugcugcucaccaucgggcugucccugguggccagcgucgagcuccccaacucccuggaggagcugggcgacgggcucgccaugggcaucaugaugcugaagcugcucacggacuuccagagccaccagcuguggaccacccugcucucccugaccuucaucaagacgacccugagccucgacuacgccuggaagaccauggcgauggugcuguccaucgugagccuguucccccucugccuguccaccacgagccagaagaccaccuggcugcccguccuccugggcuccuucgggugcaagccgcugaccauguuccucaucaccgagaacaagaucuggggccgcaagagcuggccccugaacgaggggaucauggccgugggcaucguguccauccugcucagcagccugcugaagaacgacgucccccucgccgggccccugaucgccggcggcaugcugaucgcgugcuacgugaucuccgggagcuccgccgaccucagccuggagcgcgccgccgagguguccugggaggaggaggccgagcacagcggcgcgucccacaacauccuggucgaggugcaggacgacgggacgaugaagaucaaggacgaggagcgggacgacacccucaccauccugcugaaggccacccuccuggccgugagcggcgucuacccgauguccauccccgccacgcuguucgugugguacuucuggcagaagaagaagcagcgcagcggggugcucugggacacccccagcccgcccgaggucgagcgggccgugcuggacgacggcaucuaccgcauccugcagcggggccugcucgggcgcagccaggugggcgucgggguguuccaggacggcguguuccacaccauguggcacgucacccgcggggcggugcugauguaccagggcaagcgccuggagcccuccugggccagcgugaagaaggaccucaucuccuacggcgggggcuggcgguuccaggggagcuggaacacgggcgaggagguccaggugaucgccguggagcccgggaagaaccccaagaacguccagaccacccccggcaccuucaagacgcccgagggcgaggugggggccaucgcccuggacuucaagcccggcaccuccgggagccccaucgugaaccgcgagggcaagaucgucggccuguacgggaacggcguggugaccaccuccgggacguacgucagcgcgaucgcccaggccaaggccagccaggagggcccgcuccccgagaucgaggacgagguguucaagaagcggaaccugaccaucauggaccugcaccccggguccggcaagacccgccgcuaccucccggccaucgugcgggaggcgaucaagcgcaagcugcggacccugauccucgcccccacgcgcgucguggccagcgagauggccgaggcgcugaagggcaugcccauccgguaccagaccaccgccgugaaguccgagcacaccgggaaggagaucgucgaccugaugugccacgccacguucaccaugcgccuccugagccccgugcgggugccgaacuacaacaugaucaucauggacgaggcccacuucaccgaccccgccuccaucgcggcccgcggcuacaucagcacccgggucgggaugggcgaggccgccgccaucuucaugacggcgacgccgcccggguccguggaggccuucccgcagagcaacgccgugauccaggacgaggagcgcgacauccccgagcgguccuggaacagcggcuacgacuggaucaccgacuuccccggcaagaccgucugguucgugcccuccaucaagagcgggaacgacaucgccaacugccugcgcaagaacggcaagcgggugauccagcucucccgcaagacguucgacaccgaguaccagaagaccaagaacaacgacugggacuacgucgugaccacggacaucagcgagaugggggccaacuuccgggcggaccgcgugaucgacccgcggcgcugccugaagcccgucauccugaaggacggccccgagcgggugauccucgccgggcccaugccggucaccgccgccuccgcggcccagcgccgcggccggaucggccgcaaccagaacaaggagggggaccaguacaucuacaugggccagccccugaacaacgacgaggaccacgcccacuggaccgaggccaagaugcugcucgacaacaucaacacccccgaggggaucauccccgcccuguucgagccggagcgggagaaguccgcggccaucgacggcgaguaccgccugcgcggggaggcccgcaagacguucguggagcucaugcggcgcggcgaccugcccguguggcuguccuacaaggucgccagcgagggcuuccaguacuccgaccggcgcuggugcuucgacggggagcggaacaaccaggugcucgaggagaacauggacguggagaucuggaccaaggagggcgagcgcaagaagcugcggccccgcuggcuggacgcccggaccuacagcgacccccucgcgcugcgcgaguucaaggaguucgccgccgggcggcgcagcgucuccggcgaccugauccucgagaucggcaagcugccgcagcaccugacccuccgggcccagaacgcccuggacaaccuggugaugcuccacaacagcgagcagggcgggaaggcguaccgccacgccauggaggagcugcccgacaccaucgagacgcugaugcuccuggcccugaucgccgugcucaccgggggcgucacccuguucuuccuguccgggaagggccucggcaagaccagcaucgggcugcugugcgugauggcguccagcgugcuccuguggauggccuccgucgagccccacuggaucgccgccagcaucauccuggaguucuuccucauggugcugcugauccccgagccggaccggcagcgcacgccccaggacaaccagcucgccuacguggucaucggccugcuguucaugauccucaccguggcggccaacgagauggggcugcuggagaccaccaagaaggaccucggcaucgggcacguggucgccgagaaccaccaccacgccacgaugcuggacaucgaccugcaccccgccuccgcguggacccucuacgccguggccaccaccaucaucacgccgaugaugcgccacaccaucgagaacaccaccgccaacaucagccugacggccaucgcgaaccaggccgccauccugaugggccucgacaagggcuggcccaucuccaagauggacaucggggugccccugcuggcccucggcugcuacagccaggucaacccccugacccugaccgccgcggugcucaugcugguggcccacuacgccaucaucgggccgggccugcaggccaaggcgacccgggaggcccagaagcgcacggccgccgggaucaugaagaaccccaccgucgacggcaucguggccaucgaccucgaccccguggucuacgacgcgaaguucgagaagcagcugggccagaucaugcugcucauccugugcaccucccagauccugcucaugcggaccacgugggcccugugcgagagcaucacccuggccaccgggccccucaccacgcugugggagggcuccccggggaaguucuggaacaccaccaucgccgugagcauggccaacaucuuccgcggcuccuaccuggcgggcgccgggcucgccuucagccugaugaagucccugggcgggggccggcgcgggaccggcgcccagggcgagacgcucggggagaaguggaagcggcagcugaaccagcugagcaagagcgaguucaacaccuacaagcgcuccggcaucauggagguggaccggagcgaggccaaggaggggcucaagcgcggcgagaccaccaagcacgcggucucccgggggacggccaagcugcgcugguucguggagcggaaccuggugaagcccgagggcaaggucaucgaccugggcugcgggcgcggcggguggagcuacuacugcgccggccucaagaaggugaccgaggugaagggguacaccaagggcggccccgggcacgaggagcccaucccgauggccaccuacggcuggaacaucgucaagcugcacuccgggcgggacguguucuucacgccgcccgagaagugcgacacgcugcucugcgacaucggcgagagcucccccaacccgaccaucgaggaggggcgcacccugcgggugcugaagauggucgagcccuggcuccgcggcaaccaguucugcaucaagauccugaaccccuacaugcccagcgugguggagacccuggagcagaugcagcggaagcacggcgggaugcucguccgcaacccgcugucccgcaacagcacgcacgagauguacuggguguccugcggcaccgggaacaucgugagcgcggucaacaugaccucccggaugcugcucaaccgcuucaccauggcccaccggaagcccacguacgagcgcgacguggaccugggcgccggcacccggcacguggccgucgagcccgagaucgccaaccuggacaucaucgggcagcgcaucgagaacaucaagaacgagcacaagagcaccuggcacuacgacgaggacaaccccuacaagaccugggcguaccacggcuccuacgaggugaagccgagcggguccgccagcuccauggugaacggcgucgugcggcuccugacgaagcccugggacgucauccccauggugacccagaucgccaugaccgacaccacgcccuucgggcagcagcgcguguucaaggagaaggucgacacccggaccccgcgccccaagcggggcaccgcccagaucauggaggugacggccaaguggcuguggggcuuccucagccgcaacaagaagccccggaucugcacccgcgaggaguucacccggaaggugcgcagcaacgcggccaucggggccgucuucguggacgagaaccaguggaacuccgccaaggaggccguggaggacgagcgguucugggaccugguccaccgcgagcgggagcugcacaagcagggcaagugcgcgaccugcguguacaacaugauggggaagcgcgagaagaagcucggcgaguucgggaaggccaagggcagccgggccaucugguacauguggcugggcgcccgcuuccuggaguucgaggcgcucggguucaugaacgaggaccacugguucucccgcgagaacagccuguccggcguggagggggagggccugcacaagcucggguacauccugcgggacaucagcaagaucccgggcggcaacauguacgccgacgacacggccgggugggacacccgcaucaccgaggacgaccugcagaacgaggccaagaucaccgacaucauggagcccgagcacgcccuccuggcgacguccaucuucaagcugaccuaccagaacaaggucgugcgggugcagcgccccgccaagagcggcaccgucauggacgugaucucccggcgcgaccagcgggggagcggccaggugggcaccuacgggcucaacacguucaccaacauggagguccagcugauccgccagauggaguccgagggcaucuucagccccuccgagcuggagaacagcaaccucgccgagcgggugcuggacuggcuggagaagcacgggguggagcgccucaagcggauggccaucuccggcgacgacugcgucgugaagccgaccgacgaccgcuucgccaccgcgcugacggcccugaacgacauggggaaggugcggaaggacaucccccagugggagcccagcaagggcuggaacgacuggcagcagguccccuucugcucccaccacuuccaccagcucaucaugaaggacggccgcgagaucguggugccgugccggaaccaggacgagcuggucgggcgcgcccgggugagccagggcgccggguggagccugcgcgagaccgccugccucggcaaguccuacgcgcagauguggcagcugauguacuuccaccggcgcgaccugcgccucgccgccaacgccaucugcagcgccgugcccgucaacugggugcccaccucccggaccaccuggagcauccacgcgcaccaccaguggaugacgaccgaggacaugcuguccguguggaaccgcgucuggaucgaggagaaccccuggauggaggacaagacccacgugagcuccugggaggacgugccguaccuggggaagcgggaggaccaguggugcggcagccucaucggccugaccgcccgcgccacgugggccaccaacauccaggucgcgaucaaccaggugcggcgccugaucgggaacgagaacuaccucgacuacaugaccuccaugaagcgguucaagaacgagagcgaccccgagggcgcccugugguga

SEQ ID NO: 8950 - RNA, 9879 nt, Artificial Sequence
  derived and/or modified CDS sequence (opt1) from DENV-1__KM403579__SS-prME
agcgugaccaugcugcucaugcugcugcccaccgcccucgccuuccaccugaccacccggggcggggagccccacaugaucgugagcaagcaggagcggggcaagagccuccuguucaagaccuccgcgggggugaacaugugcacccugaucgccauggaccugggcgagcucugcgaggacacgaugaccuacaagugcccccggaucaccgaggccgagcccgacgacguggacugcuggugcaacgccaccgacaccugggugaccuacgggaccugcagccagaccggcgagcaccggcgcgacaagcgguccguggcccuggcgccccacgugggccuggggcucgagacgcgcaccgagaccuggaugagcuccgagggcgccuggcggcagauccagaagguggagaccugggcccugcgccaccccggguucacggugaucgcccuguuccucgcgcacgccaucggcaccagcaucacccagaaggggaucaucuucauccugcugaugcucgugacccccuccauggccaugcggugcgucggcaucggcaaccgcgacuucguggaggggcugagcggcgccacguggguggacgucgugcuggagcacggguccugcgugaccaccauggccaagaacaagcccacccucgacaucgagcugcugaagacggaggucaccaaccccgcggugcuccggaagcugugcaucgaggccaagaucagcaacaccaccacggacucccgcugccccacccagggcgaggccacccugguggaggagcaggacgccaacuucgucugccggcgcaccuucguggaccggggcugggggaacggcugcggccucuucggcaaggggagccugcugacgugcgccaaguucaagugcgugaccaagcucgagggcaagaucguccaguacgagaaccugaaguacuccgugaucgugaccguccacaccggcgaccagcaccagguggggaacgagacgaccgagcacggcaccaucgcgaccaucacgccccaggcccccacgagcgagauccagcugaccgacuacggggcccucacccuggacugcagcccccggaccggccuggacuucaacgagaugguccuccugacgaugaaggagaaguccuggcuggugcacaagcagugguuccucgaccugccgcugcccuggaccuccggggccagcaccagccaggagaccuggaaccggcaggaccuccuggugacguucaagaccgcccacgcgaagaagcaggaggucguggugcugggcucccaggagggcgccaugcacaccgcccucaccggggccacggagauccagaccagcggcaccaccacgaucuucgccgggcaccugaagugccgccugaagauggacaagcucacccugaagggcgucuccuacgugaugugcaccgggagcuucaagcuggagaaggagguggcggagacccagcacggcacgguccugguccaggugaaguacgagggcaccgacgcccccugcaagauccccaucuccacccaggacgagaagggggucacccagaacggccggcucaucacggccaacccgaucgugaccgacaaggagaagcccgugaacaucgagaccgagccgcccuucggggagagcuacaucgucaucggcgccggcgagaaggcgcugaagcuguccugguucaagaaggggagcuccaucggcaagauguucgaggccaccgcccgcggggcccggcgcauggccauccucggcgacacggcgugggacuucgggagcaucggcggcguguucaccuccguggggaagcugguccaccagguguucggcaccgccuacggggugcuguucagcggcgucuccuggaccaugaagaucgggaucggcauccuccugacguggcugggccucaacagccgcuccaccagccuguccaugaccugcaucgccguggggauggugacccuguaccucggcgucauggugcaggccgacagcgggugcgugaucaacuggaagggccgggagcugaagugcggguccggcaucuucgucacgaacgaggugcacaccuggaccgagcaguacaaguuccaggccgacagcccgaagcgccugagcgcggccaucggcaaggccugggaggagggggugugcggcauccgguccgccacccgccucgagaacaucauguggaagcagaucagcaacgagcugaaccacauccugcucgagaacgacaugaaguucaccgucguggugggggacgccaacggcauccugacgcaggggaagaagaugauccggccccagcccauggagcacaaguacuccuggaaguccuggggcaaggcgaagaucaucggcgccgacauccagaacaccaccuucaucaucgacgggcccgacaccccggagugccccgacgaccagcgcgccuggaacaucugggaggucgaggacuacggcuucgggguguucacgaccaacaucuggcugaagcuccgggacuccuacacccagaugugcgaccaccgccugaugagcgccgcgaucaaggacuccaaggccgugcacgccgacaugggcuacuggaucgagagcgagaagaacgagaccuggaagcuggcccgggccuccuucaucgaggucaagacgugcaucuggccccgcagccacacccucugguccaacggcgugcuggagagcgagaugaucauccccaagaucuacgggggcccgaucucccagcacaacuaccggcccggguacuucacccagaccgcgggccccuggcaccuggggaagcucgagcuggacuucaaccugugcgagggcacgaccguggucguggacgagcacugcggcaaccgcgggccgagccuccggaccaccacggugaccggcaagaucauccacgaguggugcugccgcuccugcacccugccgccccugcgguuccgcggggaggacggcugcugguacgggauggagauccggcccgucaaggagaaggaggagaaccucgugcgcagcaugguguccgccggcagcggcgaggucgacagcuucucccuggggcugcucugcgugagcaucaugaucgaggaggugaugcggucccgcuggagccgcaagaugcugaugaccggcacgcuggccgucuucuuccuccugaucauggggcagcugaccuggaacgaccucauccggcugugcaucauggugggcgccaacguguccgaccgcauggggaugggcaccaccuaccuggcccucauggcgacguucaagaugcggccgauguucgccgucggccugcuguuccgccggcucaccagccgcgaggugcugcugcucaccaucgggcugucccuggucgccagcguggagcuccccaacucccuggaggagcugggcgacgggcucgccaugggcaucaugaugcugaagcugcucaccgacuuccagagccaccagcuguggacgacccugcucucccugaccuucaucaagaccacgcugagccucgacuacgccuggaagaccauggcgauggugcuguccaucgucagccuguucccccucugccuguccaccaccagccagaagacgaccuggcugcccgugcuccugggcuccuucgggugcaagccgcugaccauguuccucaucaccgagaacaagaucuggggccgcaagagcuggccccugaacgaggggaucauggccgugggcaucgucuccauccugcucagcagccugcugaagaacgacgugccccucgccgggccccugaucgccggcggcaugcugaucgcgugcuacgugaucuccgggagcuccgccgaccucagccuggagcgcgccgccgaggucuccugggaggaggaggccgagcacagcggcgcgucccacaacauccugguggaggugcaggacgacgggaccaugaagaucaaggacgaggagcgggacgacacgcucaccauccugcugaaggccacccuccuggccgucagcggcguguacccgauguccauccccgccacccuguucgugugguacuucuggcagaagaagaagcagcgcagcgggguccucugggacacgcccagcccgcccgagguggagcgggccgugcuggacgacggcaucuaccgcauccugcagcggggccugcucgggcgcagccaggucggcguggggguguuccaggacggcgucuuccacaccauguggcacgugacccgcggggcggugcugauguaccagggcaagcgccuggagcccuccugggccagcgucaagaaggaccucaucuccuacggcgggggcuggcgguuccaggggagcuggaacaccggcgaggagguccaggugaucgccgucgagcccgggaagaaccccaagaacgugcagacgacccccggcaccuucaagacccccgagggcgaggugggggccaucgcccuggacuucaagcccggcacguccgggagccccaucgucaaccgcgagggcaagaucgugggccuguacgggaacggcguggucaccaccuccgggaccuacgugagcgcgaucgcccaggccaaggccagccaggagggcccgcuccccgagaucgaggacgagguguucaagaagcggaaccugacgaucauggaccugcaccccggguccggcaagacccgccgguaccucccggccaucguccgcgaggcgaucaagcgcaagcugcggacccugauccucgcccccacccgcgugguggccagcgagauggccgaggcgcugaagggcaugcccauccgguaccagacgaccgccgucaaguccgagcacaccgggaaggagaucguggaccugaugugccacgccaccuucacgaugcgccuccugagccccgugcgggucccgaacuacaacaugaucaucauggacgaggcccacuucaccgaccccgccuccaucgcggcccgcggcuacaucagcacccggguggggaugggcgaggccgccgccaucuucaugaccgcgacgccgcccggguccguggaggccuucccgcagagcaacgccgucauccaggacgaggagcgcgacauccccgagcgguccuggaacagcggcuacgacuggaucaccgacuuccccggcaagaccgugugguucgugcccuccaucaagagcgggaacgacaucgccaacugccugcgcaagaacggcaagcgggucauccagcucucccgcaagaccuucgacacggaguaccagaagaccaagaacaacgacugggacuacguggugaccaccgacaucagcgagaugggggccaacuuccgggcggaccgcgucaucgacccgcggcgcugccugaagcccgugauccugaaggacggccccgagcgggucauccucgccgggcccaugccggugacggccgccuccgcggcccagcgccggggccgcaucggccgcaaccagaacaaggagggggaccaguacaucuacaugggccagccccugaacaacgacgaggaccacgcccacuggaccgaggccaagaugcugcucgacaacaucaacacccccgaggggaucauccccgcccuguucgagccggagcgggagaaguccgcggccaucgacggcgaguaccgccugcgcggggaggcccgcaagaccuucguggagcucaugcggcgcggcgaccugcccgucuggcuguccuacaagguggccagcgagggcuuccaguacuccgaccggcgcuggugcuucgacggggagcggaacaaccaggugcucgaggagaacauggacgucgagaucuggacgaaggagggcgagcgcaagaagcugcggccccgcuggcuggacgcccggaccuacagcgacccccucgcgcugcgcgaguucaaggaguucgccgccgggcggcgcagcguguccggcgaccugauccucgagaucggcaagcugccgcagcaccugacccuccgggcccagaacgcccuggacaaccuggugaugcuccacaacagcgagcagggcgggaaggcguaccgccacgccauggaggagcugcccgacaccaucgagacccugaugcuccuggcccugaucgccguccucaccggcggggugacccuguucuuccuguccgggaaggggcucggcaagaccagcaucgggcugcugugcgugauggcguccagcguccuccuguggauggccuccguggagccccacuggaucgccgccagcaucauccuggaguucuuccucauggugcugcugauccccgagccggaccggcagcgcacgccccaggacaaccagcucgccuacgucgugaucggccugcuguucaugauccucacgguggcggccaacgagauggggcugcuggagaccaccaagaaggaccucggcaucgggcacgucguggccgagaaccaccaccacgccaccaugcuggacaucgaccugcaccccgccuccgcguggacgcucuacgccguggccaccaccaucaucaccccgaugaugcggcacacgaucgagaacaccaccgccaacaucagccugaccgccaucgcgaaccaggccgccauccugaugggccucgacaagggcuggcccaucuccaagauggacaucggggucccccugcuggcccucggcugcuacagccaggugaacccccugacgcugaccgccgcggugcucaugcuggucgcccacuacgccaucaucgggccgggccugcaggccaaggcgacccgcgaggcccagaagcgcaccgccgccgggaucaugaagaaccccacgguggacggcaucguggccaucgaccucgaccccgucguguacgacgcgaaguucgagaagcagcugggccagaucaugcugcucauccugugcaccucccagauccugcucaugcggaccaccugggcccugugcgagagcaucacgcuggccaccgggccccucaccacccugugggagggcuccccggggaaguucuggaacacgaccaucgccgugagcauggccaacaucuuccgcggcuccuaccuggcgggcgccgggcucgccuucagccugaugaagucccugggcgggggccggcgcgggaccggcgcccagggcgagacccucggggagaaguggaagcggcagcugaaccagcugagcaagagcgaguucaacacguacaagcgcuccggcaucauggaggucgaccggagcgaggccaaggaggggcucaagcgcggcgagaccaccaagcacgcggugucccgggggaccgccaagcugcgcugguucguggagcggaaccuggucaagcccgagggcaaggugaucgaccugggcugcgggcgcggcggguggagcuacuacugcgccggccucaagaaggugacggaggucaagggguacaccaagggcggccccgggcacgaggagcccaucccgauggccaccuacggcuggaacaucgugaagcugcacuccgggcgggacguguucuucacgccgcccgagaagugcgacacccugcucugcgacaucggcgagagcucccccaacccgacgaucgaggaggggcgcacccugcggguccugaagaugguggagcccuggcuccgcggcaaccaguucugcaucaagauccugaaccccuacaugcccagcguggucgagacccuggagcagaugcagcggaagcacggcgggaugcucgugcgcaacccgcugucccggaacagcacccacgagauguacuggguguccugcggcacggggaacaucgucagcgcggugaacaugaccucccgcaugcugcucaaccgcuucaccauggcccaccggaagcccaccuacgagcgcgacguggaccugggcgccggcacgcggcacgucgccguggagcccgagaucgccaaccuggacaucaucgggcagcgcaucgagaacaucaagaacgagcacaagagcaccuggcacuacgacgaggacaaccccuacaagaccugggcguaccacggcuccuacgaggugaagccgagcggguccgccagcuccauggucaacggcgugguccggcuccugaccaagcccugggacgugauccccauggugacgcagaucgccaugaccgacaccacccccuucgggcagcagcgcgucuucaaggagaagguggacacgcggaccccgcgccccaagcggggcaccgcccagaucauggaggugaccgccaaguggcuguggggcuuccucagccgcaacaagaagccccggaucugcacgcgcgaggaguucacccggaagguccgcagcaacgcggccaucggggccguguucguggacgagaaccaguggaacuccgccaaggaggccgucgaggacgagcgguucugggaccuggugcaccgcgagcgggagcugcacaagcagggcaagugcgcgaccugcguguacaacaugauggggaagcgcgagaagaagcucggcgaguucgggaaggccaagggcagccgggccaucugguacauguggcugggcgcccgcuuccuggaguucgaggcgcucggguucaugaacgaggaccacugguucucccgggagaacagccuguccggcgucgagggggagggccugcacaagcucggguacauccugcgcgacaucagcaagaucccgggcggcaacauguacgccgacgacaccgccgggugggacacgcgcaucaccgaggacgaccugcagaacgaggccaagaucaccgacaucauggagcccgagcacgcccuccuggcgaccuccaucuucaagcugacguaccagaacaagguggugcggguccagcgccccgccaagagcggcaccgugauggacgugaucucccggcgcgaccagcgggggagcggccaggucggcaccuacgggcucaacaccuucacgaacauggaggugcagcugauccgccagauggaguccgagggcaucuucagccccuccgagcuggggaacagcaaccucgccgagcgggugcuggacuggcuggagaagcacggcgucgagcgccucaagcggauggccaucuccggggacgacugcguggugaagccgaccgacgaccgcuucgccaccgcgcugaccgcccugaacgacaugggcaagguccggaaggacaucccccagugggagcccagcaagggcuggaacgacuggcagcagguccccuucugcucccaccacuuccaccagcucaucaugaaggacgggcgcgagaucguggucccgugccggaaccaggacgagcuggugggccgcgcccgggugagccagggggccggcuggagccugcgcgagacggccugccucgggaaguccuacgcgcagauguggcagcugauguacuuccaccggcgcgaccugcggcucgccgccaacgccaucugcagcgccguccccgugaacugggugcccaccucccgcaccaccuggagcauccacgcgcaccaccaguggaugaccacggaggacaugcuguccgucuggaaccgcguguggaucgaggagaaccccuggauggaggacaagacccacgugagcuccugggaggacgucccguaccugggcaagcgggaggaccaguggugcggcagccucaucgggcugaccgcccgcgccaccugggccacgaacauccagguggcgaucaaccaggugcggaagcugaucggcaacgagaacuaccucgacuacaugaccuccaugaagcgcuucaagaacgagagcgaccccgagggggcccugugguga

SEQ ID NO: 8951 - RNA, 9879 nt, Artificial Sequence
  derived and/or modified CDS sequence (opt1) from DENV-1__HM469968__SS-prME
agcgugaccaugcugcucaugcugaugcccaccgcccuggccuuccaccucaccacccggggcggggagccccacaugaucgugagcaagcaggagcggggcaagagccugcuguucaagaccagcgcgggggugaacaugugcacccucaucgccauggaccugggcgagcugugcgaggacaccaugaccuacaagugcccccgcaucaccgaggccgagcccgacgacguggacugcuggugcaacgccaccgacacgugggucaccuacgggaccugcagccagaccggcgagcaccggcgcgacaagcgguccguggcccucgcgccccacgugggccuggggcuggagacgcgcaccgagaccuggaugagcuccgagggcgccuggaagcagauccagcgggucgagaccugggcccuccgccaccccggguucacggugaucgcccuguuccuggcgcacgccaucggcaccagcaucacccagaaggggaucaucuucauccuccugaugcuggugacccccuccauggccaugcggugcgucggcaucggcagccgcgacuucguggaggggcucuccggcgccacguggguggacgucgugcuggagcacgggagcugcgugaccaccauggccaaggacaagcccacccuggacaucgagcuccugaagacggaggucaccaaccccgcggugcugcggaagcucugcaucgaggccaagaucuccaacaccaccacggacagccgcugcccgacccagggcgaggccacccugguggaggagcaggacgccaacuucgucugccggcgcaccuucguggaccggggcugggggaacggcugcgggcuguucggcaaggggucccucaucacgugcgccaaguucaagugcgugaccaagcuggagggcaagaucguccaguacgagaaccugaaguacagcgugaucgugaccguccacaccggcgaccagcaccagguggggaacgaguccacggagcacggcaccaccgcgaccaucacgccccaggcccccacgaccgagauccagcucaccgacuacggggcccugacccuggacugcagcccccgcacgggccucgacuucaacgagaugguccugcugaccaugaaggagaaguccuggcucgugcacaagcagugguuccuggaccugccccuccccuggaccagcggggccagcaccucccaggagacguggaaccggcaggaccugcuggugaccuucaagaccgcccacgcgaagaagcaggaggucguggugcucggcagccaggagggcgccaugcacaccgcccugacgggggccaccgagauccagaccuccggcaccacgaccaucuucgccgggcaccugaagugccgccucaagauggacaagcugacccugaagggcaugagcuacgucaugugcaccggguccuucaagcucgagaaggagguggcggagacgcagcacggcaccgugcugguccagaucaaguacgagggcaccgacgcccccugcaagauccccuucagcacccaggacgagaagggggugacgcagaacggccggcugaucaccgccaacccgaucgugaccgacaaggagaagcccgucaacaucgaggccgagccgcccuucggggaguccuacaucgugaucggcgcgggcgagaaggcccugaagcucagcugguucaagaagggguccagcaucggcaagauguucgaggccaccgcccgcggggcccggcgcauggcgauccugggcgacacggccugggacuucggguccaucggcggcguguucaccagcgucgggaagcuggugcaccagaucuucggcaccgccuacggggugcuguucuccggcgucagcuggaccaugaagaucgggaucggcgcccugcugacguggcucggccugaacucccgcagcaccucccugagcaugaccugcaucgccguggggcucgugacccuguaccugggcgucauggugcaggcggacuccgggugcgugaucaacuggaagggccgggagcucaagugcgggagcggcaucuucgucacgaacgaggugcacaccuggaccgagcaguacaaguuccaggccgacagcccgaagcgccuguccgccgccaucggcaaggccugggaggagggggugugcggcauccggagcgcgacccgccuggagaacaucauguggaagcagaucuccaacgagcucaaccacauccugcuggagaacgacaugaaguucaccgucguggugggggacgucgccggcauccucgcccaggggaagaagaugauccggccccagcccauggaguacaaguacagcuggaaguccuggggcaaggccaagaucaucggcgcggacgugcagaacacgaccuucaucaucgacgggcccaacaccccggagugccccgacgaccagcgcgccuggaacaucugggagguggaggacuacggcuucgggaucuucaccacgaacaucuggcugaagcugcgggacagcuacacccaggucugcgaccaccgccucauguccgccgccaucaaggacagcaaggccgugcacgcggacaugggcuacuggaucgaguccgagaagaacgagaccuggaagcuggcccgggccagcuucaucgaggugaagaccugcaucuggcccaagucccacacgcuguggagcaacggcguccucgaguccgagaugaucauccccaagaucuacgggggcccgaucagccagcacaacuaccgccccggguacuucacccagaccgccggccccuggcaccuggggaagcuggagcucgacuucgaccugugcgagggcaccacggugguggucgacgagcacugcggcaaccgggggccgucccugcgcaccaccaccgugacgggcaagaucauccacgaguggugcugccggagcugcacccugccgccccuccgcuuccgcggggaggacggcugcugguacgggauggagauccgccccgugaaggagaaggaggagaaccuggucaaguccauggugagcgccggcagcggcgagguggacuccuucagccucgggcugcugugcaucuccaucaugaucgaggaggucaugcggagccgcuggucccggaagaugcucaugaccggcacccuggcgguguucuuccugcucaucauggggcagcugacguggaacgaccugauccgccucugcaucauggugggcgccaacgccagcgaccgcauggggaugggcaccaccuaccuggcccugauggccaccuucaagaugcggccgauguucgcggucggccuccuguuccgccggcugacgucccgcgaggugcuccugcugaccaucgggcucagccugguggccuccgucgagcugcccaacagccucgaggagcugggcgacgggcuggccaugggcaucaugauccucaagcugcugaccgacuuccagucccaccagcucugggccacccugcugagccucacguucaucaagaccaccuucucccugcacuacgcguggaagaccauggccauggugcugagcaucgucucccucuucccccugugccugagcacgaccucccagaagaccaccuggcuccccgugcugcugggcagccucgggugcaagccgcugacgauguuccugaucgccgagaacaagaucuggggccggaaguccuggccccucaacgaggggaucauggccgugggcaucgucagcauccugcugagcucccuccugaagaacgacgugccccuggccgggccccucaucgcgggcggcaugcugaucgccugcuacgugaucagcggguccagcgccgaccugucccucgagaaggccgccgaggucagcugggaggaggaggcggagcacuccggcgccagccacaacauccugguggaggugcaggacgacgggaccaugaagaucaaggacgaggagcgcgacgacacccugaccauccuccugaaggccacccugcucgccgucuccggcguguacccgcugagcauccccgccacgcuguucgugugguacuucuggcagaagaagaagcagcgguccgggguccucugggacacccccagcccgcccgagguggagcgcgcggugcuggacgacggcaucuaccggaucaugcagcgcggccugcuggggcggucccaggucggcguggggguguuccaggagaacgucuuccacaccauguggcacgugacccgcggcgccgugcucauguaccaggggaagcggcuggagcccagcugggccuccgucaagaaggaccugaucagcuacggcggcggguggcgccuccagggcuccuggaacacgggggaggagguccaggugaucgccgucgagcccggcaagaaccccaagaacgugcagaccgcccccgggaccuucaagacccccgagggcgaggugggcgcgaucgcccuggacuucaagcccgggacgagcggcucccccaucgucaaccgggaggggaagaucgugggccuguacggcaacgggguggucaccaccagcggcaccuacgugagcgccaucgcccaggcgaaggccucccaggaggggccgcuccccgagaucgaggacgagguguuccgcaagcggaaccugacgaucauggaccugcaccccggcagcgggaagacccgccgguaccucccggccaucguccgcgaggccaucaagcggaagcugcgcacccugauccucgcccccacccgcgugguggcguccgagauggccgaggcccugaagggcaugcccauccgguaccagacgaccgccgucaagagcgagcacaccggcaaggagaucguggaccugaugugccacgccaccuucacgaugcgccuccugucccccgugcgggucccgaacuacaacaugaucaucauggacgaggcgcacuucaccgaccccagcuccaucgccgcccgcggguacaucagcacccgggugggcaugggggaggccgccgcgaucuucaugaccgccacgccgcccggcuccguggaggccuucccgcagagcaacgccgucauccaggacgaggagcgcgacauccccgagcgguccuggaacagcggguacgaguggaucaccgacuuccccggcaagaccgugugguucgugcccuccaucaagagcggcaacgacaucgcgaacugccugcgcaagaacgggaagcgggucauccagcucucccgcaagaccuucgacacggaguaccagaagaccaagaacaacgacugggacuacguggugaccaccgacaucagcgagaugggcgccaacuuccgggccgaccgcgucaucgacccgcggcgcugccugaagcccgugauccugaaggacgggcccgagcgggugauccucgccggccccaugccggucacgguggccuccgcggcccagcgccgggggcgcaucggccggaaccacaacaaggagggcgaccaguacaucuacauggggcagccccugaacaacgacgaggaccacgcccacuggaccgaggccaagaugcugcucgacaacaucaacacccccgagggcaucauccccgcccuguucgagccggagcgcgagaaguccgcggccaucgacggggaguaccgccugcggggcgaggcccgcaagaccuucgucgagcucaugcggcgcggggaccugcccguguggcuguccuacaagguggccagcgagggcuuccaguacagcgaccggcgcuggugcuucgacggcgagcggaacaaccagguccucgaggagaacauggacguggagaucuggacgaaggagggggagcgcaagaagcugcggccccgcuggcuggacgcccggaccuacuccgacccccucgcgcugcgcgaguucaaggaguucgccgccggccggcgcagcguguccggggaccugauccucgagaucggcaagcugccgcagcaccugacccagcgggcccagaacgcgcucgacaaccuggucaugcugcacaacagcgagcagggcgggcgcgccuaccggcacgccauggaggagcuccccgacaccaucgagacgcugaugcugcucgcccugaucgccgugcugaccggcggggugacccucuucuuccuguccggccgcgggcugggcaagaccagcaucggccuccugugcgucauggcguccagcgugcugcucuggauggccuccguggagccccacuggaucgccgccagcaucauccuggaguucuuccugaugguccuccugauccccgagccggaccggcagcgcacgccccaggacaaccagcuggccuacguggugaucgggcuccuguucaugauccugacggucgcggccaacgagaugggccuccuggagaccaccaagaaggaccuggggaucggccacguggccguggagaaccaccaccacgccgccaugcucgacgucgaccugcaccccgcguccgccuggacccuguacgccguggccacgaccaucaucaccccgaugaugcggcacaccaucgagaacacgaccgccaacaucagccucaccgcgaucgccaaccaggccgccauccugauggggcuggacaagggcuggcccaucuccaagauggacaucggcgugccccuccuggcgcuggggugcuacagccaggucaacccccucacccugacggccgccgugcugaugcucguggcccacuacgccaucaucggcccggggcugcaggcgaaggccacccgcgaggcccagaagcgcaccgccgccggcaucaugaagaaccccaccgucgacgggaucguggcgaucgaccuggaccccguggucuacgacgccaaguucgagaagcagcucggccagaucaugcugcugauccucugcacgucccagauccugcugaugcggaccaccugggcccucugcgagagcaucacccuggccacgggcccccugaccacccucugggagggguccccgggcaaguucuggaacaccacgaucgccgugagcauggcgaacaucuuccgcggguccuaccuggccggcgccggccuggccuucagccucaugaagucccucgggggcgggcggcgcgggaccggggcgcagggcgagacccugggcgagaaguggaagcggcagcucaaccagcuguccaagagcgaguucaacaccuacaagcgcuccgggaucauggagguggaccggagcgaggccaaggagggccugaagcgcggggagacgaccaagcacgccgucucccggggcaccgccaagcuccgcugguucguggagcggaaccuggugaagcccgaggggaaggucaucgaccugggcugcggccgcgggggcuggagcuacuacugcgccgggcugaagaaggugaccgaggugaagggcuacacgaagggcgggcccggccacgaggagcccaucccgauggcgaccuacggguggaaccucgucaagcugcacuccggcaaggacguguucuucaucccgcccgagaagugcgacacccugcucugcgacaucggggagagcucccccaacccgaccaucgaggagggccggacgcugcgcgugcugaagauggucgagcccuggcuccgggggaaccaguucugcaucaagauccugaaccccuacaugcccagcgugguggagacccuggagcagaugcagcgcaaguacggcggcaugcucguccggaacccgcugucccgcaacagcacccacgagauguacuggguguccugcgggaccggcaacaucgugagcgccgucaacaugaccucccggaugcugcucaaccgcuucacgauggcccaccgcaagcccaccuacgagcgggacguggaccugggggccggcacccgccacguggccgucgagcccgagguggcgaaccuggacaucaucggccagcggaucgagaacaucaagcacgagcacaagagcaccuggcacuacgacgaggacaaccccuacaagacgugggccuaccacggguccuacgaggugaagccgagcggcuccgccagcagcauggucaacgggguggucaagcuccugaccaagcccugggacgugauccccauggugacccagaucgccaugaccgacacgacccccuucggccagcagcgcgucuucaaggagaagguggacacccggaccccgaaggccaagcgcgggacggcgcagaucauggaggugaccgcccgguggcuguggggcuuccucucccgcaacaagaagccccggaucugcacccgcgaggaguucacccggaagguccgcagcaacgccgccaucggcgcgguguucguggacgagaaccaguggaacuccgccaaggaggccgucgaggacgagcgguucugggaccuggugcaccgcgagcgggagcugcacaagcaggggaagugcgccacgugcguguacaacaugaugggcaagcgcgagaagaagcucggggaguucggcaaggccaaggggagccgggcgaucugguacauguggcugggcgcccgcuuccuggaguucgaggcccucggcuucaugaacgaggaccacugguucucccgggagaacagccuguccggggucgagggcgaggggcugcacaagcucggcuacauccugcgcgacaucagcaagauccccgggggcaacauguacgccgacgacaccgccggcugggacacccggaucaccgaggacgaccugcagaacgaggcgaagaucacggacaucauggagccggagcacgcccuccuggccaaggccaucuucaagcugaccuaccagaacaagguggugcgcguccagcgccccgccaagaacgggaccgugauggacgugaucucccggcgcgaccagcggggcagcgggcaggucggcaccuacggccucaacacguucaccaacauggaggcgcagcugauccgccagauggaguccgaggggaucuuccugcccagcgagcucgagacccccaaccuggccgagcgggugcuggacuggcucgagaaguacggcguggagcgccugaagcggauggccaucuccggggacgacugcgucgugaagccgaucgacgaccgcuucgccaccgcccugacggcgcucaacgacaugggcaaggugcggaaggacaucccccagugggagcccagcaagggguggaacgacuggcagcagguccccuucugcucccaccacuuccaccagcugaucaugaaggacggccgcgagaucguggugccgugccggaaccaggacgagcuggucggccgcgcccgggugagccagggggccggcuggucccuccgcgagaccgccugccugggcaagagcuacgcgcagauguggcagcugauguacuuccaccggcgcgaccuccggcuggccgccaacgccaucugcagcgccgugcccgucgacugggugcccaccucccgcaccacguggagcauccacgcgcaccaccaguggaugaccaccgaggacaugcuguccguguggaaccgggucuggaucgaggagaaccccuggauggaggacaagacccacaucagcuccugggaggacgugccguaccucggcaagcgcgaggaccaguggugcgggagccugaucggccugacggcccgcgccaccugggccaccaacauccagguggccaucaaccagguccggcgccucaucggcaacgagaacuaccuggacuacaugaccuccaugaagcgguucaagaacgagagcgaccccgagggggcgcugugguga

SEQ ID NO: 8952 - RNA, 9879 nt, Artificial Sequence
  derived and/or modified CDS sequence (opt1) from DENV-1__KC172834__SS-prME
agcgugaccaugcugcugaugcugaugcccaccgcccuggccuuccaccucaccacccggggcggggagccccacaugaucgucagcaagcaggagcggggcaagagccugcuguucaagaccuccgccggggugaacaugugcacccucaucgccauggaccugggcgagcugugcgaggacaccaugaccuacaagugcccccggaucaccgaggccgagcccgacgacguggacugcuggugcaacgccaccgacaccugggucaccuacgggaccugcagccaggccggcgagcaccggcgggacaagcgguccguggcccucgcgccccacgugggccuggggcuggagacccggacggagaccuggaugagcuccgagggcgccuggaagcagauccagcgggucgagaccugggcccuccgccaccccggguucaccgugaucgcgcuguuccuggcccacgccaucggcacgagcaucacccagaaggggaucaucuucauccuccugaugcuggugacccccuccauggccaugcggugcgucggcaucggcagccgcgacuucguggaggggcucuccggcgccaccuggguggacgucgugcuggagcacgggagcugcgugacgaccauggcgaaggacaagcccacccuggacaucgagcuccugaagaccgaggucacgaaccccgccgugcugcggaagcucugcaucgaggccaagaucuccaacaccaccaccgacagccgcugccccacgcagggcgaggccacccugguggaggagcaggacgccaacuucgucugccggcgcaccuucguggaccggggcugggggaacggcugcgggcuguucggcaaggggucccuccugaccugcgcgaaguucaagugcgugacgaagcuggagggcaagaucguccaguacgagaaccucaaguacagcgugaucgugaccguccacaccggcgaccagcaccagguggggaacgaguccaccgagcacggcacgaccgccaccaucacgccccaggcccccaccacggagauccagcugaccgacuacggggcccugacccucgacugcagcccccgcaccggccuggacuucaacgagaugguccugcucacgaugaaggagaaguccuggcuggugcacaagcagugguuccuggaccucccgcugcccuggaccagcggggccagcaccucccaggagaccuggaaccggcaggaccugcucgugacguucaagaccgcgcacgccaagaagcaggaggucguggugcugggcagccaggagggcgccaugcacaccgcccugaccggggccacggagauccagaccuccggcaccaccacgaucuucgcggggcaccucaagugccgccugaagauggacaagcugacccucaagggcaugagcuacgucaugugcaccggguccuucaagcuggagaaggagguggccgagacccagcacggcacggugcugguccagaucaaguacgagggcaccgacgcccccugcaagauccccuucagcacccaggacgagaagggggugacccagaacggccggcugaucacggccaacccgaucgugaccgacaaggagaagcccgucaacaucgaggcggagccgcccuucggggaguccuacaucgugaucggcgccggcgagaaggcccucaagcugagcugguucaagaagggguccagcaucggcaagauguucgaggccaccgcccgcggggcgcggcgcauggccauccugggcgacaccgccugggacuucggguccaucggcggcguguucacgagcgucgggaagcucgugcaccagaucuucggcaccgccuacggggugcuguucuccggcgucagcuggaccaugaagaucgggaucggcgugcugcucaccuggcugggccugaacucccgcagcacgucccucagcaugaccugcaucgccguggggcuggucacccuguaccucggcgugauggugcaggcggacuccgggugcgucaucaacuggaagggccgggagcugaagugcgggagcggcaucuucgugaccaacgaggugcacacguggaccgagcaguacaaguuccaggccgacagcccgaagcgccuguccgccgccaucggcaaggccugggaggagggggucugcggcauccggagcgcgacccgccucgagaacaucauguggaagcagaucuccaacgagcugaaccacauccugcucgagaacgacaugaaguucaccgugguggucggggacguggccggcauccuggcccaggggaagaagaugauccggccccagcccauggaguacaaguacagcuggaaguccuggggcaaggccaagaucaucggcgcggacgugcagaacagcaccuucaucaucgacgggcccaacacgccggagugccccgacgaccagcgcgccuggaacaucugggaggucgaggacuacggcuucgggaucuucaccaccaacaucuggcugaagcuccgggacuccuacacccaggugugcgaccaccgccugaugagcgccgccaucaaggacuccaaggccgugcacgcggacaugggcuacuggaucgagagcgagaagaacgagacguggaagcuggcccgggccuccuucaucgaggucaagaccugcaucuggcccaagagccacacccucugguccaacggcgugcuggagagcgagaugaucauccccaagaucuacgggggcccgaucucccagcacaacuaccgccccggguacuucacccagacggccggccccuggcaccuggggaagcucgagcuggacuucgaccugugcgagggcaccaccguggucguggacgagcacugcggcaaccgggggccgagccuccgcaccacgaccgugaccggcaagaucauccacgaguggugcugccgguccugcacccugccgccccugcgcuuccgcggggaggacggcugcugguacgggauggagauccgccccgucaaggagaaggaggagaaccucgugaaguccauggugagcgccggcuccggcgaggucgacagcuucucccuggggcugcucugcaucagcaucaugaucgaggaggugaugcggucccgcuggagccggaagaugcugaugacgggcacccuggcgguguucuuccuccugaucauggggcagcugaccuggaacgaccucauccgccugugcaucauggucggcgccaacgccuccgaccgcauggggaugggcaccacguaccuggcccucauggccaccuucaagaugcggccgauguucgcggugggccugcuguuccgccggcucaccagccgcgaggugcugcugcucaccaucgggcugucccuggucgccagcguggagcuccccaacucccuggaggagcugggcgacgggcucgccaugggcaucaugauccugaagcugcucacggacuuccagagccaccagcugugggccacccugcucucccugaccuucaucaagaccacguucagccugcacuacgcguggaagaccauggccaugguccucuccaucgugagccuguucccccugugccucuccaccaccagccagaagacgaccuggcugcccgugcugcucggcucccuggggugcaagccgcugaccauguuccucaucgccgagaacaagaucuggggccgcaagagcuggccccugaacgaggggaucauggccgucggcaucgugagcauccugcucuccagccugcugaagaacgacgugccccucgccgggccccugaucgcgggcggcaugcugaucgccugcuacgucaucuccgggagcuccgccgaccucagccuggagaaggccgccgagguguccugggaggaggaggcggagcacagcggcgccucccacaacauccugguggagguccaggacgacgggaccaugaagaucaaggacgaggagcgcgacgacacgcucaccauccugcugaaggccacccuccuggccgugagcggcguguacccgcuguccauccccgccacccucuucgucugguacuucuggcagaagaagaagcagcggagcggggugcugugggacacccccagcccgcccgagguggagcgcgcgguccuggacgacggcaucuaccggaucaugcagcgcggccugcucgggcggagccaggugggcgugggggucuuccaggagaacguguuccacacgauguggcacgugacccgcggcgccguccugauguaccaggggaagcggcuggagcccuccugggccagcgugaagaaggaccucaucuccuacggcggcggguggcgcuuccagggcagcuggaacaccggggaggaggugcaggucaucgccguggagcccggcaagaaccccaagaacgugcagaccgcccccgggacguucaagacccccgagggcgaggucggcgcgaucgcccuggacuucaagcccgggaccuccggcagccccaucgugaaccgggaggggaagaucgugggccuguacggcaacggggucgugaccacgagcggcaccuacguguccgccaucgcccaggcgaaggccagccaggaggggccgcuccccgagaucgaggacgaggucuuccgcaagcggaaccugaccaucauggaccugcaccccggcuccgggaagacccgccgguaccucccggccaucgugcgcgaggccaucaagcggaagcugcgcacgcugauccucgcccccacccgcguggucgcgagcgagauggccgaggcccugaagggcaugcccauccgguaccagaccaccgccgugaaguccgagcacacgggcaaggagaucguggaccugaugugccacgccaccuucaccaugcgccuccugagccccguccgggugccgaacuacaacaugaucaucauggacgaggcgcacuucaccgaccccuccagcaucgccgcccgcggguacaucuccacgcgggugggcaugggggaggccgccgcgaucuucaugaccgccacgccgcccggcagcauggaggccuucccgcaguccaacgccgucauccaggacgaggagcgcgacauccccgagcggagcuggaaccuggggcacgaguggaucaccgacuuccccggcaagacggugugguucgugcccuccaucaaggcgggcaacgacaucgccaacugccuccgcaagaacgggaagcgggucauccagcugagccgcaagaccuucgacaccgaguaccagaagaccaagaacaacgacugggacuacguggugacgaccgacaucuccgagaugggcgccaacuuccgggccgaccgcgucaucgacccgcggcgcugccugaagcccgugauccucaaggacgggcccgagcgggugauccuggccggccccaugccggucaccguggcgagcgccgcccagcgccgggggcgcaucggccggaaccacaacaaggagggcgaccaguacaucuacauggggcagccccugaacaacgacgaggaccacgcccacuggaccgaggccaagaugcuccuggacaacaucaacacgcccgagggcaucauccccgcgcuguucgagccggagcgcgagaaguccgccgccaucgacggggaguaccgccuccggggcgaggcccgcaagaccuucgucgagcugaugcggcgcggggaccugcccguguggcucagcuacaagguggccuccgagggcuuccaguacagcgaccggcgcuggugcuucgacggcgagcggaacaaccagguccuggaggagaacauggacguggagaucuggaccaaggagggggagcgcaagaagcugcggccccgcuggcucgacgcgcggaccuacagcgacccccuggcccugcgcgaguucaaggaguucgccgccggccggcgcuccgugagcggggaccucauccuggagaucggcaagcugccgcagcaccucacgcagcgggcgcagaacgcccuggacaaccuggucauccuccacaacuccgagcagggcgggcgcgccuaccggcacgccauggaggagcugcccgacaccaucgagacccugaugcuccuggcccugaucgcggugcucaccggcggggugacgcuguucuuccugagcggcaaggggcucggcaagaccuccaucggccugcugugcgucauggccagcuccgugcuccuguggauggccagcguggagccccacuggaucgccgccuccaucauccuggaguucuuccucaugguccugcugauccccgagccggaccgccagcggacgccccaggacaaccagcucgcguacguggugaucgggcugcuguucaugauccucaccgucgccgccaacgagaugggccugcuggagaccacgaagaaggaccucgggaucggccacguggccguggagaaccaccaccacgccgcgaugcuggacgucgaccugcaccccgccagcgccuggacccucuacgccguggccaccaccaucaucacgccgaugaugcgccacaccaucgagaacaccaccgcgaacaucucccugacggccaucgccaaccaggccgcgauccugauggggcucgacaagggcuggcccaucagcaagauggacaucggcgugccccugcuggcccucgggugcuacucccaggucaacccccugacccugaccgccgccgugcucaugcugguggcccacuacgcgaucaucggcccggggcugcaggccaaggccacccgggaggcccagaagcgcacggccgcgggcaucaugaagaaccccaccaucgacgggaucgucgccaucgaccucgaccccgugguguacgacgccaaguucgagaagcagcugggccagaucaugcugcucauccugugcaccagccagauccugcucaugcgcaccacgugggcccugugcgaguccaucacccuggccaccggcccccucaccacgcugugggaggggagcccgggcaaguucuggaacaccaccaucgcggucuccauggccaacaucuuccgggggagcuaccuggccggcgccggccucgcguucucccugaugaagucccucgggggcgggcgccgggggaccggggcccagggcgagacgcucggcgagaaguggaagcgccagcugaaccagcugagcaaguccgaguucaacaccuacaagcggagcgggaucauggagguggaccgcuccgaggccaaggagggccucaagcgcggggagaccaccaagcacgccgugagccgcggcacggccaagcugcggugguucgucgagcgcaaccuggugaagcccgaggggaaggugaucgaccugggcugcggccgcgggggcugguccuacuacugcgcggggcucaagaaggucaccgaggugaagggcuacaccaagggcggccccggccacgaggagcccaucccgauggccaccuacggguggaaccuggugaagcugcacagcggcaaggacgucuucuucgugccgcccgagaagugcgacacgcuccugugcgacaucggggaguccagccccaacccgaccaucgaggagggccgcacccugcgggugcucaagauggucgagcccuggcugcgcgggaaccaguucugcaucaagauccugaaccccuacaugcccuccgugguggagacccucgagcagaugcagcggaagcacggcggcaugcugguccgcaacccgcugagccggaacuccacgcacgagauguacugggugagcugcgggaccggcaacaucguguccgccgucaacaugaccagccgcaugcuccugaaccgguucaccauggcccaccgcaagcccaccuacgagcgcgacguggaccugggggccggcacgcggcacguggcggucgagcccgagguggccaaccucgacaucaucggccagcgcaucgagaacaucaagcacgagcacaaguccaccuggcacuacgacgaggacaaccccuacaagaccugggccuaccacgggagcuacgaggugaagccguccggcagcgccuccagcauggucaacgggguggucaagcugcugaccaagcccugggacgugauccccauggugacgcagaucgccaugaccgacaccacccccuucggccagcagcgggucuucaaggagaagguggacacgcgcaccccgaaggcgaagcgggggaccgcccagaucauggaggugaccgcccgcuggcucuggggcuuccugagccggaacaagaagccccgcaucugcacgcgggaggaguucacccgcaagguccgguccaacgccgcgaucggcgccguguucguggacgagaaccaguggaacagcgccaaggaggccgucgaggacgaccgcuucugggaccuggugcaccgggagcgcgagcuccacaagcaggggaagugcgcgaccugcguguacaacaugaugggcaagcgggagaagaagcugggggaguucggcaaggcgaaggggucccgcgccaucugguacauguggcugggcgcccgguuccucgaguucgaggcccugggcuucaugaacgaggaccacugguucagccgcgagaacucccugagcggggucgagggcgaggggcuccacaagcugggcuacauccugcgggacaucuccaagauccccgggggcaacauguacgccgacgacaccgcgggcugggacacgcgcaucaccgaggacgaccuccagaacgaggccaagaucaccgacaucauggagccggagcacgcccugcuggccaagagcaucuucaagcucaccuaccagaacaagguggugcggguccagcgccccgccaagaacgggacggugauggacgugaucucccgccgggaccagcgcggcagcgggcaggucggcaccuacggccugaacaccuucaccaacauggaggcgcagcugauccggcagauggaguccgaggggaucuucagccccaacgagcucgagacgcccaaccuggccgagcgcgugcuggacuggcucgagaaguacggcguggagcggcugaagcgcauggccaucuccggggacgacugcgucgugaagccgaucgacgaccgguucgccaccgcccugaccgcgcucaacgacaugggcaaggugcgcaaggacaucccccagugggagcccagcaagggguggaacgacuggcagcagguccccuucugcucccaccacuuccaccagcugaucaugaaggacggccgggagaucguggugccgugccgcaaccaggacgagcuggucggccgggcccgcgugagccagggggccggcugggggcuccgggagaccgccugccugggcaaguccuacgcgcagauguggcagcugauguacuuccaccgccgggaccuccgccuggccgccaacgccaucugcagcgccgugcccgucgacugggugcccacgagccggaccaccugguccauccacgcgcaccaccaguggaugaccacggaggacaugcugagcguguggaaccgcgucuggaucgaggagaaccccuggauggaggacaagacccggaucuccagcugggaggacgugccguaccucgggaagcgcgaggaccaguggugcggcucccugaucggccugaccgcccgcgccaccugggccacgaacauccagguggccaucaaccagguccggcgccucaucgggaacgagaacuacagcgacuacaugaccuccaugaagcgguucaagaacgagagcgagcccgagggcgcgcugugguga

SEQ ID NO: 8953 - RNA, 9879 nt, Artificial Sequence
  derived and/or modified CDS sequence (opt1) from DENV-1__KJ933413__SS-prME
agcgugaccaugcugcucaugcugcugcccaccgcccucgccuuccaccugaccacccgcggcggggagccccacaugaucgugagcaagcaggagcggggcaagagccuccuguucaagaccagcaccggggugaacaugugcacccugaucgcgauggaccugggcgagcucugcgaggacaccaugaccuacaagugcccccgcaucaccgagaccgagcccgacgacguggacugcuggugcaacgccaccgagaccugggugaccuacgggaccugcagccagaccggcgagcaccggcgcgacaagcgguccguggcccuggcgccccacgugggccuggggcucgagacccgcaccgagaccuggaugagcuccgagggcgccuggcggcagauccagaagguggagaccugggcgcugcgccaccccggguucaccgugaucgcccuguuccucgcccacgccaucggcaccagcaucacgcagaaggggaucaucuucauccugcugaugcucgugacccccuccauggcgaugcggugcgucggcaucggcaaccgcgacuucguggaggggcugagcggcgccaccuggguggacgucgugcuggagcacggguccugcgugaccacgauggccaaggacaagcccacccucgacaucgagcugcugaagaccgaggucaccaaccccgccgugcuccggaagcugugcaucgaggccaagaucagcaacacgaccaccgacucccgcugccccacccagggcgaggcgacgcugguggaggagcaggacaccaacuucgucugccggcgcacccucguggaccggggcugggggaacggcugcgggcuguucggcaaggggagccugaucacgugcgccaaguucaagugcgugacgaagcucgagggcaagaucguccaguacgagaaccugaaguacuccgugaucgugaccguccacaccggcgaccagcaccagguggggaacgagaccaccgagcacggcacgaccgccaccaucacgccccaggcccccacgagcgagauccagcugaccgacuacggggcccucacccuggacugcagcccccgcaccggccuggacuucaacgagaugguccuccugacgaugaaggagaaguccuggcuggugcacaagcagugguuccucgaccugccgcugcccuggaccuccggggcgagcaccagccaggagaccuggaaccggcaggaccuccuggugacguucaagaccgcccacgccaagaagcaggaggucguggugcugggcucccaggagggcgccaugcacaccgcccucaccggggcgacggagauccagaccagcggcaccaccacgaucuucgccgggcaccugaagugccgccugaagauggacaagcucacccugaagggcgucuccuacgugaugugcaccgggagcuucaagcuggagaaggagguggccgagacccagcacggcacgguccugguccaggugaaguacgagggcaccgacgcccccugcaagauccccuucaccucccaggacgagaagggggucacccagaacggccggcucaucacggccaacccgaucgugaccgacaaggagaagcccgugaacaucgaggcggagccgcccuucggggagagcuaccuggucgugggcgccggcgagaaggcccugaagcucuccugguucaagaaggggagcuccaucggcaagauguucgaggccaccgcgcgcggggcccggcgcauggccauccugggcgacaccgccugggacuucgggagcaucggcggcguguucacguccgucgggaagcugauccaccagaucuucggcaccgccuacgggguccuguucagcggcguguccuggaccaugaagaucgggaucggcauccugcugaccuggcucggccugaacagccgcuccacgagccuguccaugaccugcaucgcggucgggauggugacccucuaccugggcgugaugguccaggccgacagcgggugcgugaucaacuggaagggccgggagcugaagugcggguccggcaucuucgugaccaacgagguccacaccuggacggagcaguacaaguuccaggccgacagcccgaagcgccucagcgccgccaucggcaaggcgugggaggagggggugugcggcauccgguccgugacccgccuggagaacaucauguggaagcagaucagcaacgagcugaaccacauccuccuggagaacgacaugaaguucaccgucguggugggggacgucaacggcauccuggcccaggggaagaagaugauccggccccagcccauggagcacaaguacuccuggaaguccuggggcaaggccaaggugaucggcgccgacgugcagaacuccaccuucaucaucgacgggcccaacacgccggagugccccgacgaccagcgcgccuggaacaucugggaggucgaggacuacggcuucgggaucuucaccaccaacaucuggcucaagcugcgggacagcuacacccaggugugcgaccaccgccugauguccgcggccaucaaggacagcaaggccgugcacgccgacaugggcuacuggaucgaguccgagaagaacgagacguggaagcucacccgggcgagcuucaucgaggucaagaccugcguguggcccaagucccacacccuguggagcaacggcgugcuggaguccgagaugaucauccccaagaucuacgggggcccgaucagccagcacaacuaccgccccggguacuucacgcagaccgccggccccuggcaccucgggaagcuggagcuggacuucggccucugcgagggcaccaccgucgugguggacgagcacugcgggaaccggggcccgucccugcgcacgaccaccgucaccgggaagaucauccacgaguggugcugccggagcugcacgcugccgccccuccgcuucaagggcgaggacgggugcugguacggcauggagauccggcccgugaaggagaaggaggagaaccuggugaaguccauggucagcgccggcagcggggagguggacuccuucagccugggccuccugugcaucuccaucaugaucgaggaggugaugcgcagccgguggucccgcaagaugcugaugaccgggacccucgccgucuuccugcugcucaucaugggccagcugaccuggaacgaccugauccggcucugcaucauggugggggccaacgcgagcgacaagaugggcaugggcacgaccuaccuggcccugauggccaccuuccgcaugcgcccgauguucgccgucgggcuccuguuccggcgccugaccucccgggaggugcuccugcugacgguggggcucagccuggucgccuccguggagcugcccaacagccucgaggagcugggggacggccuggccaugggcaucaugaugcucaagcugcugaccgacuuccagucccaccagcucugggccgcccugcugagccucaccuucgugaagaccacguucucccugcacuacgccuggaagaccauggccaugauccugagcaucgucucccucuucccccugugccugagcaccaccucccagaagacgaccuggcuccccgugcugcuggggagccucggcugcaagccgcugaccauguuccugaucaccgagaaccgcaucugggggcggaaguccuggccccucaacgagggcaucauggcgguggggaucgucagcauccugcugagcucccuccugaagaacgacgugccccuggccggcccccucaucgccggcgggaugcugaucgccugcuacgugaucagcggcuccagcgcggaccugucccucgagaaggccgccgaggucagcugggaggaggaggccgagcacuccggggccagccacaacauccugguggaggugcaggacgacggcaccaugaagaucaaggacgaggagcgcgacgacacgcugaccauccuccugaaggcgacccugcucgccaucuccggggucuacccgaugagcauccccgccacccuguucgugugguacuucuggcagaagaagaagcagcgguccggcgugcugugggacacgcccagcccgcccgaggucgagcgcgccgugcuggacgacggcaucuaccggauccuccagcgcgggcugcugggcaagucccaggugggggucggcguguuccaggaggggguguuccacaccauguggcacgucacccggggcgccgugcucauguaccagggcaagcgccuggagcccagcugggcguccgugaagaaggaccugaucagcuacgggggcggguggcgguuccagggcuccuggaacaccggggaggagguccaggugaucgccguggagcccggcaagaaccccaagaacguccagacggcccccggcaccuucaagacccccgagggggaggugggcgccaucgcccucgacuucaagcccgggaccagcggcucccccaucgugaaccgcgagggcaagaucgucgggcuguacggcaacgggguggugacgaccagcggcaccuacgucagcgcgaucgcccaggccaaggccucccaggaggggccgcugcccgagaucgaggacgagguguuccggaagcgcaaccucaccaucauggaccugcaccccggcagcggcaagacgcggcgcuaccugccggccaucgugcgggaggcgaucaagcgcaagcuccggacccugguccuggcccccacccgcgugguggccuccgagauggccgaggcgcucaaggggaugcccauccgcuaccagaccacggccgucaagagcgagcacaccggcaaggagaucguggaccugaugugccacgccaccuucaccaugcggcugcucucccccgugcgcgucccgaacuacaacaugaucaucauggacgaggcccacuucacggaccccgccagcaucgcggcccggggguacaucuccacccgcgugggcaugggggaggccgccgccaucuucaugaccgcgacgccgcccggcagcauggaggccuucccgcaguccaacgccgccauccaggacgaggagcgggacauccccgagcgcagcuggaacuccggcuacgacuggaucacggacuuccccgggaagaccgugugguucguccccagcaucaaguccggcaacgacaucgccaacugccugcggaagaacgggaagcgcguggugcagcugagccggaagaccuucgacaccgaguaccagaagacgaagaacaacgacugggacuacgucgugaccaccgacaucuccgagaugggcgcgaacuuccgcgccgaccgggucaucgacccgcgccggugccucaagcccgugauccugaaggacgggcccgagcgcgugauccuggccggccccaugccggucaccguggccagcgcggcccagcggcgcggccggaucgggcgcaaccagaacaaggagggcgaccaguacaucuacauggggcagccccucaacaacgacgaggaccacgcccacuggacggaggccaagaugcugcuggacaacaucaacacccccgagggcaucauccccgcccucuucgagccggagcgggagaaguccgcggccaucgacggggaguaccgccugcgcggcgaggcccggaagaccuucguggagcugaugcgccggggcgaccuccccgucuggcugagcuacaagguggccuccgagggguuccaguacagcgaccgccgguggugcuucgacggcgagcgcaacaaccaggugcuggaggagaacauggacgucgagaucuggaccaaggagggggagcggaagaagcuccgcccccgguggcuggacgcccgcacguacagcgacccccuggcgcuccgggaguucaaggaguucgccgccggccgccgguccgugagcggcgaccugauccuggagaucgggaagcucccgcagcaccugacccagcgcgcccagaacgcccuggacaaccucgugaugcugcacaacuccgagcagggcgggaaggcguaccggcacgccauggaggagcugcccgacaccaucgagacccucaugcugcuggcccucaucgccguccugaccggcggggugacgcuguucuuccucagcggccgcggccuggggaagaccuccaucggccugcucugcgugauggcgagcuccgcccugcuguggauggccagcgucgagccccacuggaucgccgccuccaucauccucgaguucuuccugauggugcugcucauccccgagccggaccggcagcgcacgccccaggacaaccagcuggcguacguggucaucgggcuccucuucaugauccugaccguggccgccaacgagaugggccugcucgagacgaccaagaaggaccuggggaucggccacguggccgccgagagccaccaccacgcggccaugcuggacgucgaccuccaccccgccuccgccuggacccuguacgccguggcgaccacggugaucaccccgaugaugcggcacaccaucgagaacaccacggccaacaucagccugaccgccaucgccaaccaggccgcgauccucaugggccuggacaagggguggcccaucuccaagauggacaucggcgucccccugcucgcccuggggugcuacagccaggugaacccccugacccucaccgccgccgugcugaugcuggucgcgcacuacgccaucaucggcccggggcuccaggccaaggccacgcgcgaggcccagaagcggaccgcggccggcaucaugaagaaccccaccguggacggcaucguggccaucgaccuggaccccgucguguacgacgccaaguucgagaagcagcuggggcagaucaugcuccugauccugugcaccucccagauccuccugaugcgcacgaccugggcccugugcgagagcaucacccucgcgaccggcccccugacgacccugugggagggguccccgggcaaguucuggaacaccaccaucgccgugagcauggccaacaucuuccgcggcuccuaccucgccggggccggccuggcguucagccugaugaagucccucgggggcgggcggcgcggcacgggcgcccagggggagacccugggcgagaaguggaagcggcagcugaaccagcucuccaagagcgaguucaacaccuacaagcgcuccgggaucaucgaggucgaccggagcgaggccaaggagggccugaagcgcggggagaccacgaagcacgccgugucccggggcaccgcgaagcugcgcugguucguggagcggaaccuggucaagcccgagggcaaggugaucgaccucgggugcggccgcgggggcuggagcuacuacugcgccgggcugaagaaggugaccgaggucaagggcuacaccaagggcgggcccggccacgaggagcccaucccgauggccacguacggguggaaccuggugaagcuccacuccggcaaggacguguucuucacgccgcccgagaagugcgacacccugcugugcgacaucggggagagcucccccaacccgaccaucgaggagggccggacccuccgcguccugaagaugguggagcccuggcugcggggcaaccaguucugcaucaaggugcucaaccccuacaugcccagcgucguggagacgcuggagcagaugcagcgcaagcacgggggcaugcuggugcggaacccgcucucccgcaacagcacccacgagauguacugggucuccugcgggaccggcaacaucgugagcgccgugaacaugaccucccggaugcugcugaaccgcuucacgauggcccaccggaagcccaccuacgagcgcgacgucgaccucggcgcggggacccgccacguggccgucgagcccgagguggccaaccuggacaucaucggccagcggaucgagaacaucaagaacgagcacaagagcaccuggcacuacgacgaggacaaccccuacaagacgugggccuaccacggguccuacgaggugaagccgagcggcuccgccagcagcauggucaacgggguggugcgccugcucaccaagcccugggacgucauccccauggugacccagaucgcgaugaccgacacgacccccuucggccagcagcggguguucaaggagaaggucgacacccgcaccccgaaggccaagcggggcacggcccagaucauggaggugaccgcccgcuggcuguggggguuccugucccggaacaagaagccccgcaucugcacccgggaggaguucaccaagaaggugcgcagcaacgccgcgaucggcgccgucuucguggacgagaaccaguggaacuccgccaaggaggccguggaggacgagcgguucugggaccucguccaccgcgagcgggagcugcacaagcaggggaagugcgcgacgugcguguacaacaugaugggcaagcgcgagaagaagcugggggaguucggcaaggccaagggcagccgggccaucugguacauguggcucggggcccgcuuccuggaguucgaggcccugggcuucaugaacgaggaccacugguucucccgggagaacagccucuccgggguggagggcgaggggcugcacaagcugggcuacauccuccgcgacaucagcaagauccccggcgggaacauguacgcggacgacaccgccggcugggacacccggaucaccgaggacgaccugcagaacgaggccaagaucacggacaucauggagccggagcacgcccugcucgccaccuccaucuucaagcugaccuaccagaacaaggucgugcgcgugcagcggcccgcgaagaacgggaccgucauggacgugaucagccgccgcgaccagcggggcuccggccagguggggacguacggccugaacaccuucaccaacauggaggcccagcucauccgccagauggagagcgaggggaucuuccugcccuccgagcuggagacccccaaccucgccgagcggguccuggacuggcuggagaaguacggcaucgagcgccucaagcggauggccaucagcggggacgacugcguggugaagccgaucgacgaccgcuucgccacggcgcugaccgcccugaacgacaugggcaagguccggaaggacaucccccagugggagcccuccaagggcuggaacgacuggcagcagguccccuucugcagccaccacuuccaccagcucaucaugaaggacgggcgcgagaucguggucccgugccggaaccaggacgagcuggugggccgcgcccgggugucccagggggccggcuggagccugcgcgagaccgccugccucggcaagagcuacgcgcagauguggcagcugauguacuuccaccggcgcgaccugcggcucgccgccaacgccaucugcuccgcgguccccguggacugggugcccaccagccgcacgaccugguccauccacgcccaccaccaguggaugaccaccgaggacaugcugagcgucuggaaccggguguggaucgaggagaaccccuggauggaggacaagacccacguguccagcugggaggacgucccguaccugggcaagcgcgaggaccaguggugcggcucccucaucgggcugacggcccgggccaccugggccaccaacauccagguggcgaucaaccaggugcgccgccugaucggcaacgagaacuaccucgacuacaugaccagcaugaagcgguucaagaacgaguccgaccccgagggggcccugugguga

SEQ ID NO: 8954 - RNA, 9879 nt, Artificial Sequence
  derived and/or modified CDS sequence (opt1) from DENV-1__KU666942__SS-prME
agcgugaccaugcugcucaugcugaugcccaccgcccuggccuuccaccucaccacccggggcggggagccccacaugaucgugagcaagcaggagcggggcaagagccugcuguucaagaccagcgccggggugaacaugugcacccucaucgccauggaccugggcgagcugugcgaggacacgaugaccuacaagugcccccgcaucaccgaggccgagcccgacgacguggacugcuggugcaacgccaccgacaccugggugaccuacgggaccugcagccagaccggcgagcaccggcgcgacaagcgguccguggcccucgcgccccacgugggccuggggcuggagacgcgcaccgagaccuggaugagcuccgagggcgccuggaagcagauccagcggguggagaccugggcccuccgccaccccggguucacggugaucgcccuguuccuggcgcacgccaucggcaccagcaucacccagaaggggaucaucuucauccuccugaugcuggugacccccuccauggccaugcggugcgucggcaucggcagccgcgacuucguggaggggcucuccggcgccacguggguggacgucgugcuggagcacgggagcugcgugaccaccauggccaaggacaagcccacccuggacaucgagcuccugaagacggaggucaccaaccccgcgauccugcggaagcucugcaucgaggccaagaucuccaacaccaccacggacagccgcugcccgacccagggcgaggccacccugguggaggagcaggacgccaacuucgugugccggcgcaccuucgucgaccggggcugggggaacggcugcgggcuguucggcaaggggucccucaucacgugcgccaaguucaagugcgugaccaagcuggagggcaagaucgugcaguacgagaaccugaaguacagcgucaucgugaccgugcacaccggcgaccagcaccaggucgggaacgaguccacggagcacggcaccaccgcgaccaucacgccccaggcccccacgaccgagauccagcucaccgacuacggggcccugacccuggacugcagcccccgcacgggccucgacuucaacgagauggugcugcugaccaugaaggagaaguccuggcucguccacaagcagugguuccuggaccugccccuccccuggaccagcggggccagcaccucccaggagacguggaaccggcaggaccugcuggugaccuucaagaccgcccacgcgaagaagcaggagguggucgugcucggcagccaggagggcgccaugcacaccgcccugacgggggccaccgagauccagaccuccggcaccacgaccaucuucgccgggcaccugaagugccgccucaagauggacaagcugacccugaagggcaugagcuacgugaugugcaccggguccuucaagcucgagaaggaggucgcggagacgcagcacggcaccgugcuggugcagaucaaguacgagggcaccgacgcccccugcaagauccccuucagcacccaggacgagaagggggucacgcagaacggccggcugaucaccgccaacccgaucgugaccgacaaggagaagcccgugaacaucgaggccgagccgcccuucggggaguccuacaucgucaucggcgcgggcgagaaggcccugaagcucagcugguucaagaagggguccagcaucggcaagauguucgaggccaccgcccgcggggcccggcgcauggcgauccugggcgacacggccugggacuucggguccaucggcggcguguucaccagcguggggaagcugguccaccagaucuucggcaccgccuacgggguccucuucuccggcgugagcuggaccaugaagaucgggaucggcguccugcugacguggcucggccugaacucccgcagcaccucccugagcaugaccugcaucgccguggggcucgugacccuguaccugggcgucauggugcaggccgacuccgggugcgugaucaacuggaagggccgggagcucaagugcgggagcggcaucuucgucacgaacgaggugcacaccuggaccgagcaguacaaguuccaggcggacagcccgaagcgccuguccaccgccaucggcaaggccugggaggagggggugugcggcauccggagcgccacccgccuggagaacaucauguggaagcagaucuccaacgagcucaaccacauccugcuggagaacgggaugaaguucacggucguggugggcgacgucgccgggauccucgcgcagggcaagaagaugauccggccccagcccauggagcacaaguacagcuggaaguccuggggcaaggccaagaucaucggggccgacgugcagaacaccaccuucaucaucgacggccccaacaccccggagugccccgacgaccagcgcgccuggaacaucugggagguggaggacuacggguucggcaucuucacgaccaacaucuggcugaagcugcgggacagcuacacccaggucugcgaccaccgccucauguccgcggccaucaaggacagcaaggccgugcacgccgacaugggcuacuggaucgaguccgagaagaacgagaccuggaagcuggcccgggcgagcuucaucgaggugaagacgugcaucuggcccaagucccacacccuguggagcaacgggguccucgaguccgagaugaucauccccaagaucuacggcgggccgaucagccagcacaacuaccgccccggcuacuucacccagaccgccgggcccuggcaccugggcaagcuggagcucgacuucgaccugugcgagggcacgaccgugguggucgacgagcacugcgggaaccggggcccgucccugcgcaccaccacggugaccgggaagaucauccacgaguggugcugccggagcugcacccugccgccccuccgcuaccggggcgaggacgggugcugguacggcauggagauccgccccgugaaggagaaggaggagaaccuggucaaguccauggugagcgccggcagcggggagguggacuccuucagccucggccugcugugcaucuccaucaugaucgaggaggucaugcggagccgcuggucccggaagaugcucaugaccgggacgcuggccguguucuuccugcucaucaugggccagcugaccuggaacgaccugauccgccucugcaucauggugggggccaacgcgagcgaccgcaugggcaugggcaccaccuaccuggcccugauggccacguucaagaugcggccgauguucgccgucgggcuccuguuccgccggcugaccucccgcgaggugcuccugcugaccaucggccucagccugguggccuccauggagcugcccaacagccucgaggagcugggggacggccuggcgaugggcaucaugauccucaagcugcugaccgacuuccagucccaccagcucugggccacgcugcugagccucaccuucaucaagaccaccuucucccugcacuacgccuggaagacgaucgccaugguccugagcaucgugucccucuucccccugugccugagcaccaccucccagaagaccacguggcuccccguccugcuggggagccucggcugcaagccgcugaccauguuccugaucgcggagaacaagaucugggggcggaaguccuggccccucaacgagggcaucauggccguggggaucgugagcauccugcugagcucccuccugaagaacgacgucccccuggccggcccccucaucgccggcgggaugcugaucgccugcuacgugaucagcggcuccagcgcggaccugucccucgagaaggccgccgaggugagcugggaggaggaggccgagcacuccggggccagccacaacauccuggucgaggugcaggacgacggcaccaugaagaucaaggacgaggagcgcgacgacacccugaccauccuccugaaggcgacgcugcucgccguguccggggucuacccgcugagcauccccgccacccuguucgugugguacuucuggcagaagaagaagcagcgguccggcgugcucugggacacccccagcccgcccgaggucgagcgcgccgugcuggacgacggcaucuaccggaucaugcagcgcgggcugcugggccggucccaggugggggucggcguguuccaggagaacguguuccacaccauguggcacgucacgcgcggggccgugcucauguaccagggcaagcggcuggagcccagcugggcguccgugaagaaggaccugaucagcuacggcgggggcuggcgccuccagggguccuggaacaccggcgaggagguccaggugaucgccguggagcccgggaagaaccccaagaacguccagaccgcccccggcaccuucaagacgcccgagggcgaggugggggccaucgcccuggacuucaagcccggcaccagcgggucccccaucgugaaccgggagggcaagaucgucggccuguacgggaacggcguggugaccaccagcgggacguacgucagcgcgaucgcccaggccaaggccucccaggagggcccgcuccccgagaucgaggacgagguguuccgcaagcggaaccugaccaucauggaccugcaccccgggagcggcaagacccgccgguaccucccggcgaucgugcgcgaggccaucaagcggaagcugcgcacccugauccucgcccccacgcgcgucguggccuccgagauggccgaggcgcugaagggcaugcccauccgguaccagaccaccgccgucaagagcgagcacaccgggaaggagaucgucgaccugaugugccacgccacguucaccaugcgccuccugucccccgugcgggugccgaacuacaacaugaucaucauggacgaggcccacuucaccgaccccagcuccaucgccgcgcgcggcuacaucagcacccgggucgggaugggcgaggccgccgccaucuucaugacggccacgccgcccggguccguggaggcguucccgcagagcaacgccgugauccaggacgaggagcgcgacauccccgagcgguccuggaacagcggcuacgaguggaucaccgacuuccccggcaagaccgucugguucgugcccuccaucaagagcgggaacgacaucgccaacugccugcgcaagaacggcaagcgggugauccagcucucccgcaagacguucgacaccgaguaccagaagaccaagaacaacgacugggacuacgucgugaccacggacaucagcgagaugggggccaacuuccgggcggaccgcgugaucgacccgcggcgcugccugaagcccgucauccugaaggacggccccgagcgggugauccucgccgggcccaugccggugaccgucgccuccgccgcccagcgccggggccgcaucggccggaaccacaacaaggagggggaccaguacaucuacaugggccagccccugaacaacgacgaggaccacgcgcacuggaccgaggccaagaugcugcucgacaacaucaacacccccgaggggaucauccccgcccuguucgagccggagcgcgagaaguccgccgccaucgacggcgaguaccgccugcgcggggaggcgcgcaagacguucguggagcucaugcggcgcggcgaccugcccgucuggcuguccuacaagguggccagcgagggcuuccaguacagcgaccggcgcuggugcuucgacggggagcggaacaaccaggugcucgaggagaacauggacgucgagaucuggaccaaggagggcgagcgcaagaagcugcggccccgcuggcuggacgcccggaccuacuccgacccccucgcccugcgcgaguucaaggaguucgccgcggggcggcgcagcguguccggcgaccugauccucgagaucggcaagcugccgcagcaccugacccagcgggcccagaacgcccucgacaaccuggugaugcugcacaacagcgagcagggcgggcgcgccuaccggcacgcgauggaggagcuccccgacacgaucgagacccugaugcugcucgcccugaucgccguccugaccgggggcgugacccucuucuuccuguccgggaagggccugggcaagaccagcaucgggcuccugugcgugauggccuccagcgcccugcucuggauggcguccgucgagccccacuggaucgccgccagcaucauccuggaguucuuccugauggugcuccugauccccgagccggaccgccagcggacgccccaggacaaccagcuggccuacguggucaucggccuccuguucaugauccugaccguggccgcgaacgagauggggcuccuggagaccaccaagaaggaccugggcaucgggcacguggccgucgagaaccaccaccacgccgccaugcucgacguggaccugcaccccgccuccgcguggacgcuguacgccguggccaccaccaucaucaccccgaugaugcgccacacgaucgagaacaccaccgccaacaucagccucaccgccaucgcgaaccaggccgccauccugaugggccuggacaagggcuggcccaucuccaagauggacaucggggucccccuccuggcccugggcugcuacagccaggugaacccccucacgcugaccgcggccgugcugaugcucgucgcccacuacgccaucaucgggccgggccugcaggccaaggcgacccgggaggcccagaagcgcaccgccgccgggaucaugaagaaccccacgguggacggcaucguggccaucgaccuggaccccgucguguacgacgcgaaguucgagaagcagcucggccagaucaugcugcugauccucugcaccucccagauccugcugaugcgcaccaccugggcccucugcgagagcaucacgcuggccaccgggccccugaccacccucugggagggcuccccggggaaguucuggaacacgaccaucgccgugagcauggccaacaucuuccggggcuccuaccuggcgggcgccgggcuggccuucagccucaugaagucccugggcgggggccgccgggggaccggcgcccagggcgagacccugggggagaaguggaagcgccagcucaaccagcuguccaagagcgaguucaacacguacaagcgguccggcaucauggaggucgaccgcagcgaggcgaaggaggggcugaagcggggcgagaccaccaagcacgccgugucccgcgggaccgccaagcuccggugguucguggagcgcaaccuggucaagcccgagggcaaggugaucgaccugggcugcgggcggggcggguggagcuacuacugcgccggccugaagaaggugacggaggucaagggguacaccaagggcggccccgggcacgaggagcccgugccgauggccaccuacggcuggaaccucgugaagcugcacuccgggaaggacgucuucuucaucccgcccgagaagugcgacacccugcucugcgacaucggcgagagcucccccaacccgacgaucgaggaggggcgcacccugcgggugcugaagaugguggagcccuggcuccgcggcaaccaguucugcaucaagauccugaaccccuacaugcccagcgucguggagacccuggagcagaugcagcggaagcacggcgggaugcucgugcgcaacccgcugucccggaacagcacccacgagauguacugggucuccugcggcaccgggaacaucgugagcgcgaucaacaugacgucccgcaugcugcucaaccgguucaccauggcccaccgcaagcccaccuacgagcgcgacguggaccugggcgccggcacccggcacgucgccguggagcccgagguggccaaccuggacaucaucgggcagcgcaucgagaacaucaagugcgagcacaagagcacguggcacuacgacgaggacaaccccuacaagaccugggcguaccacggcuccuacgaggucaagccgagcggguccgccagcagcauggugaacggcguggucaagcuccugaccaagcccugggacgugauccccauggucacccagaucgccaugacggacaccacccccuucgggcagcagcggguguucaaggagaagguggacacccgcacgccgaaggccaagcggggcaccgcccagaucauggaggucaccgcgcgcuggcuguggggcuuccucucccggaacaagaagccccgcaucugcacccgggaggaguucacgcgcaaggugcggagcaacgccgccaucggggccguguucgucgacgagaaccaguggaacuccgcgaaggaggccguggaggacgagcgcuucugggaccuggugcaccgggagcgcgagcugcacaagcagggcaagugcgcgaccugcgucuacaacaugauggggaagcgggagaagaagcucggcgaguucgggaaggccaagggcagccgcgccaucugguacauguggcugggcgcgcgguuccuggaguucgaggcccucggguucaugaacgaggaccacugguucucccgcgagaacagccuguccggcguggagggggagggccugcacaagcucggguacauccugcgggacaucagcaagaucuccggcggcaacauguacgccgacgacaccgccgggugggacacccgcaucacggaggacgaccugcagaacgaggccaagaucaccgagaucauggagcccgagcacgcgcagcucgccaaggccaucuucaagcugaccuaccagaacaaggugguccgggugcagcgcccggccaagaacggcaccgugauggacgucaucagccgccgggaccagcgcggguccggccaggugggcacguacgggcugaacaccuucaccaacauggaggcccagcucauccggcagauggagagcgagggcaucuucucccccagcgagcuggagacccccaaccuggcggagcgcgugcucgacuggcuggagaaguacggggucgagcggcugaagcgcauggccaucuccggcgacgacugcguggugaagcccaucgacgaccgguucgccacggcccucaccgcccugaacgacauggggaagguccgcaaggacaucccgcagugggagcccagcaagggcuggaacgacuggcagcagguccccuucugcucccaccacuuccaccagcugaucaugaaggacggccgggagaucgugguccccugccgcaaccaggacgagcucguggggcgggcgcgcgugagccagggcgccggguggagccugcgggagaccgccugccugggcaaguccuacgcccagauguggcagcucauguacuuccaccgccgggaccugcgccuggcggccaacgccaucugcagcgccgucccgguggacugggugcccaccucccggacgaccuggagcauccacgcccaccaccaguggaugaccaccgaggacaugcucuccgucuggaaccgcguguggaucgaggagaaccccuggaugaaggacaagacgcacaucagcuccugggaggacgugcccuaccuggggaagcgggaggaccaguggugcggcagccugaucggccucaccgcgcgcgccaccugggccaccaacauccaggucgccaucaaccaggugcgccggcugaucgggaacgagaacuaccuggacuacaugaccuccaugaagcgcuucaagaacgagagcgacccggagggcgcccucugguga

SEQ ID NO: 8955 - RNA, 9879 nt, Artificial Sequence
  derived and/or modified CDS sequence (opt1) from DENV-1__KU666939__SS-prME
agcgugaccaugcugcucaugcugaugcccaccgcccuggccuuccaccucaccacccggggcggggagccccacaugaucgugagcaagcaggagcggggcaagagccugcuguucaagaccagcgcgggggugaacaugugcacccucaucgccauggaccugggcgagcugugcgaggacaccaugaccuacaagugcccccggaucaccgaggccgagcccgacgacguggacugcuggugcaacgccaccgacacgugggugaccuacgggaccugcagccagaccggcgagcaccggcgcgacaagcggagcguggcccucgcgccccacgugggccuggggcuggagacgcgcaccgagaccuggaugagcuccgagggcgccuggaagcagauccagcgggucgagaccugggugcuccgccaccccggguucacggugaucgcccuguuccuggcccacgcgaucggcaccagcaucacccagaaggggaucaucuucauccuccugaugcuggucacccccuccauggccaugcggugcgugggcaucggcagccgcgacuucguggaggggcucuccggcgccacgugggucgacguggugcuggagcacgggagcugcgucaccaccauggccaaggacaagcccacccuggacaucgagcuccugaagacggaggugaccaaccccgccgugcugcggaagcucugcaucgaggcgaagaucuccaacaccaccacggacagccgcugcccgacccagggcgaggccacccuggucgaggagcaggacgccaacuucgugugccggcgcaccuucguggaccggggcugggggaacggcugcgggcuguucggcaaggggucccucaucacgugcgccaaguucaagugcgucaccaagcuggagggcaagaucgugcaguacgagaaccugaaguacagcgugaucgucaccgugcacaccggcgaccagcaccaggucgggaacgaguccacggagcacggcaccaccgccaccaucacgccccaggcgcccacgaccgagauccagcucaccgacuacggggcccugacccuggacugccucccccgcacgggccuggacuucaacgagauggugcugcucaccaugaaggagaaguccuggcuggugcacaagcagugguuccuggaccucccccugcccuggaccuccggggccagcaccagccaggagacguggaaccggcaggaccugcucgucaccuucaagaccgcccacgccaagaagcaggagguggugguccugggcucccaggagggcgcgaugcacaccgcccugacgggggccaccgagauccagaccagcggcaccacgaccaucuucgccgggcaccucaagugccgccugaagauggacaagcugacccucaagggcauguccuacgugaugugcaccgggagcuucaagcuggagaaggagguggccgagacgcagcacggcaccguccuggugcagaucaaguacgagggcaccgacgcgcccugcaagauccccuucuccacccaggacgagaagggggugacgcagaacggccggcugaucaccgccaacccgaucgucaccgacaaggagaagcccgugaacaucgaggccgagccgcccuucggggagagcuacaucgugaucggcgccggcgagaaggcgcucaagcuguccugguucaagaaggggagcuccaucggcaagauguucgaggccaccgcccgcggggcccggcgcauggccauccugggcgacacggcgugggacuucgggagcaucggcggcgucuucaccuccguggggaagcucgugcaccagaucuucggcaccgccuacgggguccuguucagcggcguguccuggaccaugaagaucgggaucggcgugcugcucacguggcugggccugaacagccgcuccaccagccucuccaugaccugcaucgccgucgggcuggugacccuguaccucggcgugaugguccaggccgacagcgggugcgugaucaacuggaagggccgggagcugaagugcggguccggcaucuucgugacgaacgagguccacaccuggaccgagcaguacaaguuccaggccgacagcccgaagcgccugagcgcggccaucggcaaggccugggaggagggggugugcggcauccgguccgccacccgccucgagaacaucauguggaagcagaucagcaacgagcugaaccacauccugcucgagaacgacaugaaguucaccguggucgugggggacguggccggcauccuggcgcaggggaagaagaugauccggccccagcccauggagcacaaguacuccuggaaguccuggggcaaggccaagaucaucggcgccgacguccagaacacgaccuucaucaucgacgggcccaacaccccggagugccccgacgaccagcgcgccuggaacaucugggagguggaggacuacggcuucgggaucuucaccacgaacaucuggcugaagcuccgggacuccuacacccaggugugcgaccaccgccugaugagcgcggccaucaaggacuccaaggccguccacgccgacaugggcuacuggaucgagagcgagaagaacgagaccuggaagcuggcccgggcguccuucaucgaggugaagaccugcaucuggcccaagagccacacgcucugguccaacggcgugcuggagagcgagaugaucauccccaagaucuacgggggcccgaucucccagcacaacuaccgccccggguacuucacccagaccgccggccccuggcaccuggggaagcucgagcuggacuucgaccugugcgagggcaccacggucgugguggacgagcacugcggcaaccgggggccgagccuccgcaccaccaccgucacgggcaagaucauccacgaguggugcugccgguccugcacccugccgccccugcgcuuccgcggggaggacggcugcugguacgggauggagauccgccccgugaaggagaaggaggagaaccucgucaagagcauggucuccgccggcagcggcgagguggacagcuucucccuggggcugcucugcaucagcaucaugaucgaggaggugaugcggucccgcuggagccggaagaugcugaugaccggcacccuggccgucuucuuccuccugaucauggggcagcugacguggaacgaccucauccgccugugcaucauggugggcgccaacgcguccgaccgcauggggaugggcaccaccuaccuggcccucauggccaccuucaagaugcggccgauguucgccgugggccugcuguuccgccggcucacgagccgcgagguccugcugcucaccaucgggcugucccugguggccagcgucgagcuccccaacucccuggaggagcugggcgacgggcucgcgaugggcaucaugauccugaagcugcucaccgacuuccagagccaccagcugugggccacccugcucucccugacguucaucaagaccaccuucagccugcacuacgccuggaagaccauggccauggugcucuccaucgugagccugaucccccugugccucuccacgaccagccagaagaccaccuggcugcccguccugcucggcucccuggggugcaagccgcugacgauguuccucaucgcggagaacaagaucuggggccgcaagagcuggccccugaacgaggggaucauggccgugggcaucguguccauccugcucagcagccugcugaagaacgacgucccccucgccgggccccugaucgccggcggcaugcugaucgccugcuacgugaucuccgggagcuccgcggaccuccugcuggagaaggccgccgaggugagcugggaggaggaggccgagcacuccggcgccagccacaacauccucgucgaggugcaggacgacgggaccaugaagaucaaggacgaggagcgcgacgacacccugaccauccugcucaaggcgacccugcuggccaucuccggcguguacccgcucagcauccccgccacgcuguucgucugguacuucuggcagaagaagaagcagcgguccggggugcugugggacacccccagcccgcccgagguggagcgcgccguccuggacgacggcaucuaccggaucaugcagcgcggccuccuggggcggucccaggugggcgugggggucuuccaggagaacguguuccacaccauguggcacgugacccgcggcgccguccugauguaccaggggaagcggcucgagcccagcugggcguccgugaagaaggaccugaucagcuacggcggcggguggcgccugcagggcuccuggaacacgggggaggaggugcaggucaucgccguggagcccggcaagaaccccaagaacgugcagaccgcccccgggaccuucaagacccccgagggcgaggucggcgccaucgcccucgacuucaagcccgggacgagcggcucccccaucgugaaccgggaggggaagaucgugggccuguacggcaacggggucgugaccaccagcggcaccuacguguccgcgaucgcccaggccaaggccagccaggaggggccgcugcccgagaucgaggacgaggucuuccgcaagcggaaccucacgaucauggaccugcaccccggcagcgggaagacccgccgguaccugccggcgaucgugcgcgaggccaucaagcggaagcuccgcacccugauccuggcccccacccgcguggucgccuccgagauggccgaggcgcucaagggcaugcccauccgguaccagacgaccgccgucaagagcgagcacaccggcaaggagaucguggaccugaugugccacgccaccuucacgaugcgccugcucucccccguccgggugccgaacuacaacaugaucaucauggacgaggcccacuucaccgaccccagcuccaucgccgcgcgcggguacaucagcacccgggugggcaugggggaggccgccgccaucuucaugaccgccacgccgcccggcuccgucgaggcguucccgcagagcaacgccgugauccaggacgaggagcgcgacauccccgagcgguccuggaacagcggguacgaguggaucaccgacuuccccggcaagaccgugugguucguccccuccaucaagagcggcaacgacaucgccaacugccugcgcaagaacgggaagcgggugauccagcugucccgcaagaccuucgacacggaguaccagaagaccaagaacaacgacugggacuacguggucaccaccgacaucagcgagaugggcgccaacuuccgggcggaccgcgugaucgacccgcggcgcugccucaagcccgugauccugaaggacgggcccgagcgggucauccuggccggccccaugccggugacggucgccuccgccgcccagcgccgggggcgcaucggccggaaccacaacaaggagggcgaccaguacaucuacauggggcagccccucaacaacgacgaggaccacgcgcacuggaccgaggccaagaugcugcuggacaacaucaacacccccgagggcaucauccccgcccucuucgagccggagcgcgagaaguccgccgccaucgacggggaguaccgccugcggggcgaggcgcgcaagaccuucguggagcugaugcggcgcggggaccuccccguguggcuguccuacaaggucgccagcgagggcuuccaguacuccgaccggcgcuggugcuucgacggcgagcggaacaaccaggugcuggaggagaacauggacguggagaucuggacgaaggagggggagcgcaagaagcuccggccccgcuggcuggacgcccggaccuacagcgacccccuggcccuccgcgaguucaaggaguucgccgcgggccggcgcagcgucuccggggaccugauccuggagaucggcaagcucccgcagcaccugacccagcgggcccagaacgcccuggacaaccucgugaugcugcacaacagcgagcagggcgggcgcgccuaccggcacgcgauggaggagcugcccgacaccaucgagacgcucaugcugcuggcccucaucgccgugcugaccggcggggucacccuguucuuccucuccggccgcgggcugggcaagaccagcaucggccugcucugcgugauggccuccagcgugcugcuguggauggccuccgucgagccccacuggaucgcggccagcaucauccucgaguucuuccugauggugcugcucauccccgagccggaccggcagcgcacgccccaggacaaccagcuggccuacguggucaucgggcuccuguucaugauccugacgguggccgccaacgagaugggccugcucgagaccaccaagaaggaccuggggaucggccacguggcggucgagaaccaccaccacgccaccaugcuggacguggaccuccaccccgccuccgccuggacgcuguacgccguggcgaccaccaucaucaccccgaugaugcggcacacgaucgagaacaccaccgccaacaucagccugaccgccaucgccaaccaggccgcgauccucauggggcuggacaagggcuggcccaucuccaagauggacaucggcgucccccugcucgcccuggggugcuacagccaggugaacccccugacgcucaccgccgccgugcugaugcuggucgcgcacuacgccaucaucggcccggggcuccaggccaaggccacccgcgaggcccagaagcgcaccgcggccggcaucaugaagaaccccacgguggacgggaucguggccaucgaccuggaccccgucguguacgacgccaaguucgagaagcagcugggccagaucaugcuccugauccugugcaccucccagauccuccugaugcggaccaccugggcccugugcgagagcaucacgcucgcgaccggcccccugaccacccugugggagggguccccgggcaaguucuggaacacgaccaucgccgugagcauggccaacaucuuccgcggguccuaccucgccggcgccggccuggcguucagccugaugaagucccucgggggcgggcggcgcggcaccggggcccagggcgagacccugggcgagaaguggaagcggcagcugaaccagcucagcaagagcgaguucaacacguacaagcgcuccgggaucauggaggucgaccggagcgaggccaaggagggccugaagcgcggggagaccaccaagcacgccgugucccggggcaccgcgaagcugcgcugguucguggagcggaaccuggucaagcccgaggggaaggugaucgaccucggcugcggccgcgggggcuggagcuacuacugcgccgggcugaagaaggugacggaggucaagggcuacaccaagggcgggcccggccacgaggagcccaucccgauggccaccuacggguggaaccuggugaagcucuacuccggcaaggacguguucuucaucccgcccgagaagugcgacacccugcugugcgacaucggggagagcucccccaacccgacgaucgaggagggccggacccuccgcguccugaagaugguggagcccuggcugcgggggaaccaguucugcaucaagauccucaaccccuacaugcccagcguggucgagacccuggagcagaugcagcgcaagcacggcggcaugcuggugcggaacccgcucucccgcaacagcacccacgagauguacuggguguccugcgggaccggcaacaucgucagcgccgugaacaugacgucccggaugcugcugaaccgcuucaccauggcccaccgcaagcccaccuacgagcgggacguggaccucggggcgggcacccgccacgucgccguggagcccgagguggccaaccuggacaucaucggccagcggaucgagaacaucaagcacgagcacaagagcacguggcacuacgacgaggacaaccccuacaagaccugggccuaccacggguccuacgaggucaagccgagcggcuccgccagcuccauggugaacggggucgugaagcugcucaccaagcccugggacgugauccccauggucacccagaucgcgaugacggacaccacccccuucggccagcagcgcguguucaaggagaagguggacacccggacgccgaaggccaagcgcgggaccgcccagaucauggaggucaccgcccgguggcuguggggcuuccugagccgcaacaagaagccccggaucugcacccgcgaggaguucacgcggaaggugcgcagcaacgccgcgaucggcgccguguucaucgacgagaaccaguggaacuccgccaaggaggccgucgaggacgagcgguucugggaccucgugcaccgcgagcgggagcugcacaagcaggggaagugcgcgaccugcguguacaacaugaugggcaagcgcgagaagaagcugggggaguucggcaaggccaaggggagccgggccaucugguacauguggcucggcgcccgcuuccuggaguucgaggcccugggcuucaugaacgaggaccacugguucucccgggagaacagccucuccggggucgagggcgaggggcugcacaagcugggcuacauccuccgcgacaucagcaagauccccgggggcaacauguacgcggacgacaccgccggcugggacacccggaucacggaggacgaccugcagaacgaggccaagaucaccgacaucauggagccggagcacgcccugcucgccaaggcgaucuucaagcugaccuaccagaacaagguggugcgcguccagcgccccgccaagaacgggaccgugauggacgugaucucccggcgcgaccagcggggcagcgggcaggucggcacguacggccugaacaccuucaccaacauggaggcccagcucauccgccagauggaguccgaggggaucuucagccccuccgagcuggagacccccaaccuggccgagcgggugcucgacuggcugggcaaguacgggguggagcgccugaagcggauggccaucagcggcgacgacugcgucgugaagccgaucgacgaccgcuucgcgacggcccucaccgcccugaacgacauggggaaggugcggaaggacaucccccagugggagcccuccaagggcuggaacgacuggcagcagguccccuucugcagccaccacuuccaccagcugaucaugaaggacggccgcgagaucguggugccgugccggaaccaggacgagcucgucgggcgcgcccgggugucccagggcgccggguggagccugcgcgagaccgcgugccugggcaaguccuacgcccagauguggcagcucauguacuuccaccggcgcgaccugcggcuggccgccaacgcgaucugcagcgccgugcccgucgacugggugcccaccagccgcacgaccugguccauccacgcccaccaccaguggaugaccaccgaggacaugcucagcguguggaaccgggucuggaucgaggagaaccccuggauggaggacaagacgcacaucuccagcugggaggacgugccguaccuggggaagcgcgaggaccaguggugcggcucccugaucggccucaccgcccgcgccaccugggcgaccaacauccagguggccaucaaccagguccggcgccugaucgggaacgagaacuaccuggacuacaugaccagcaugaagcgguucaagaacgaguccgaccccgagggcgcccucugguga

SEQ ID NO: 8956 - RNA, 9879 nt, Artificial Sequence
  derived and/or modified CDS sequence (opt1) from DENV-1__KU666940__SS-prME
agcgugaccaugcugcucaugcugacccccaccgcccuggccuuccaccucaccacccggggcggggagccccacaugaucgugagcaagcaggagcggggcaagagccugcuguucaagaccagcgccggggugaacaugugcacccucaucgccauggaccugggcgagcugugcgaggacaccaugaccuacaagugcccccggaucaccgaggccgagcccgacgacguggacugcuggugcaacgccacggacaccugggugaccuacgggaccugcagccagacgggcgagcaccggcgcgacaagcgguccguggcccucgcgccccacgugggccuggggcuggagacccggaccgagaccuggaugagcuccgagggcgccuggaagcagauccagcgggucgagacgugggcccuccgccaccccggguucaccgugaucgcccuguuccuggcgcacgccaucggcaccagcaucacccagaaggggaucaucuucauccuccugaugcuggugacgcccuccauggccaugcggugcgucggcaucggcagccgcgacuucguggaggggcucuccggcgccaccuggguggacgucgugcuggagcacgggagcugcgugaccaccauggccaaggacaagcccacgcuggacaucgagcuccugaagaccgaggucaccaaccccgcggugcugcggaagcucugcaucgaggccaagaucuccaacaccacgaccgacagccgcugcccgacccagggcgaggccacccugguggaggagcaggacgccaacuucgucugccggcgcacguucguggaccggggcugggggaacggcugcgggcuguucggcaaggggucccucaucacgugcgccaaguucaagugcgugaccaagcuggagggcaagaucguccaguacgagaaccugaaguacagcgugaucgugaccguccacacgggcgaccagcaccagguggggaacgaguccaccgagcacggcaccaccgcgaccaucacgccccaggcccccaccaccgagauccagcucaccgacuacggggcccugacgcuggacugcagcccccgcaccggccucgacuucaacgagaugguccugcugaccaugaaggagaaguccuggcucgugcacaagcagugguuccuggaccugccccuccccuggaccagcggggccagcacgucccaggagaccuggaaccggcaggaccugcuggugaccuucaagaccgcccacgcgaagaagcaggaggucguggugcucggcagccaggagggcgccaugcacacggcccugaccggggccaccgagauccagaccuccggcacgaccaccaucuucgccgggcaccugaagugccgccucaagauggacaagcugacccugaagggcaugagcuacgucaugugcacgggguccuucaagcucgagaaggagguggcggagacccagcacggcaccgugcugguccagaucaaguacgagggcaccgacgcccccugcaagauccccuucagcacgcaggacgagaagggggugacccagaacggccggcugaucaccgccaacccgaucgugaccgacaaggagaagcccgucaacaucgaggccgagccgcccuucggggaguccuacaucgugaucggcgcgggcgagaaggcccugaagcucagcugguucaagaagggguccagcaucggcaagauguucgaggccacggcccgcggggcccggcgcauggcgauccugggcgacaccgccugggacuucggguccaucggcggcguguucaccagcgucgggaagcuggugcaccagaucuucggcaccgccuacggggugcuguucuccggcgucagcuggacgaugaagaucgggaucggcgugcugcugaccuggcucggccugaacucccgcagcaccucccugagcaugaccugcaucgccguggggcucgucacgcuguaccugggcgugauggugcaggccgacuccgggugcgucaucaacuggaagggccgggagcucaagugcgggagcggcaucuucgugaccaacgaggugcacaccuggaccgagcaguacaaguuccaggcggacagcccgaagcgccuguccgccgccaucggcaaggccugggaggagggggucugcggcauccggagcgccacccgccuggagaacaucauguggaagcagaucuccaacgagcucaaccacauccugcuggagaacgacaugaaguucacggugguggucggggacguggcgggcauccucgcccaggggaagaagaugauccggccccagcccauggagcacaaguacagcuggaaguccuggggcaaggccaagaucaucggcgccgacgugcagaacaccaccuucaucaucgacgggcccaacaccccggagugccccgacgaccagcgcgcguggaacaucugggaggucgaggacuacggcuucgggaucuucacgaccaacaucuggcugaagcugcgggacagcuacacccaggugugcgaccaccgccucauguccgccgccaucaaggacagcaaggccgugcacgccgacaugggcuacuggaucgaguccgagaagaacgagaccuggaagcuggcgcgggccagcuucaucgaggucaagacgugcaucuggcccaagucccacacccuguggagcaacggcgugcucgaguccgagaugaucauccccaagaucuacgggggcccgaucagccagcacaacuaccgccccggguacuucacccagaccgccggccccuggcaccuggggaagcuggagcucgacuucgaccugugcgagggcacgaccguggucguggacgagcacugcggcaaccgggggccgucccugcgcaccaccacggugaccggcaagaucauccacgaguggugcugccggagcugcacccugccgccccuccgcuaccgcggggaggacggcugcugguacgggauggagauccgccccgucaaggagaaggaggagaaccuggugaaguccauggugagcgccggcagcggcgaggucgacuccuucagccucgggcugcugugcaucuccaucaugaucgaggaggugaugcggagccgcuggucccggaagaugcucaugaccggcacgcuggccguguucuuccugcucaucauggggcagcugaccuggaacgaccugauccgccucugcaucauggucggcgcgaacgccagcgaccgcauggggaugggcaccaccuaccuggcccugauggccacguucaagaugcggccgauguucgccgugggccuccuguuccgccggcugaccucccgcgaggugcuccugcugaccaucgggcucagccuggucgcguccguggagcugcccaacagccucgaggagcugggcgacgggcuggccaugggcaucaugauccucaagcugcugaccgacuuccagucccaccagcucugggccacgcugcugagccucaccuucaucaagaccaccuucucccugcacuacgccuggaagacgaucgcgaugguccugagcaucgugucccucuucccccugugccugagcaccaccucccagaagaccacguggcuccccgugcugcugggcagccucgggugcaagccgcugaccauguuccugaucgccgagaacaagaucuggggccggaaguccuggccccucaacgaggggaucauggccgucggcaucgugagcauccugcugagcucccuccugaagaacgacgugccccuggccgggccccucaucgccggcggcaugcugaucgcgugcuacgucaucagcggguccagcgccgaccugucccucgagaaggccgccgaggugagcugggaggaggaggccgagcacuccggcgcgagccacaacauccugguggagguccaggacgacgggaccaugaagaucaaggacgaggagcgcgacgacacccugaccauccuccugaaggccacgcugcucgccguguccggcguguacccgcugagcauccccgccacccuguucgucugguacuucuggcagaagaagaagcagcgguccggggugcucugggacacccccagcccgcccgagguggagcgcgccguccuggacgacggcaucuaccggaucaugcagcgcggccugcuggggcggucccaggugggcgugggggucuuccaggagaacguguuccacaccauguggcacgugacgcgcggcgcgguccucauguaccaggggaagcggcuggagcccagcugggccuccgugaagaaggaccugaucagcuacggcggcggguggcgccuccagggcuccuggaacaccggggaggaggugcaggucaucgccguggagcccggcaagaaccccaagaacgugcagaccgcccccgggaccuucaagacgcccgagggcgaggucggcgccaucgcgcuggacuucaagcccgggaccagcggcucccccaucgugaaccgggaggggaagaucgugggccuguacggcaacggggucgugaccaccagcggcacguacgugagcgccaucgcccaggccaaggcgucccaggaggggccgcuccccgagaucgaggacgaggucuuccgcaagcggaaccugaccaucauggaccugcaccccggcagcgggaagacccgccgguaccucccggccaucgugcgcgaggccaucaagcggaagcugcgcacccugauccucgcccccacgcgcguggucgccuccgagauggcggaggcccugaagggcaugcccauccgguaccagaccaccgccgucaagagcgagcacaccggcaaggagaucguggaccugaugugccacgccacguucaccaugcgccuccugucccccguccgggugccgaacuacaacaugaucaucauggacgaggcccacuucaccgaccccagcuccaucgcggcccgcggguacaucagcacccgggugggcaugggggaggccgccgccaucuucaugacggcgacgccgcccggcuccgucgaggccuucccgcagagcaacgccgugauccaggacgaggagcgcgacauccccgagcgguccuggaacagcggguacgaguggaucaccgacuuccccggcaagaccgugugguucguccccuccaucaagagcggcaacgacaucgccaacugccugcgcaagaacgggaagcgggugauccagcucucccgcaagacguucgacaccgaguaccagaagaccaagaacaacgacugggacuacguggucaccacggacaucagcgagaugggcgcgaacuuccgggccgaccgcgugaucgacccgcggcgcugccugaagcccgugauccugaaggacgggcccgagcgggucauccucgccggccccaugccggugaccgucgccuccgccgcgcagcgccgggggcgcaucggccggaaccacaacaaggagggcgaccaguacaucuacauggggcagccccugaacaacgacgaggaccacgcccacuggaccgaggccaagaugcugcucgacaacaucaacacccccgagggcaucauccccgcccuguucgagccggagcgcgagaaguccgccgcgaucgacggggaguaccgccugcggggcgaggcccgcaagacguucguggagcucaugcggcgcggggaccugcccguguggcuguccuacaaggucgccagcgagggcuuccaguacagcgaccggcgcuggugcuucgacggcgagcggaacaaccaggugcucgaggagaacauggacguggagaucuggaccaaggagggggagcgcaagaagcugcggccccgcuggcuggacgcccggaccuacuccgacccccucgcccugcgcgaguucaaggaguucgcggccggccggcgcagcgucuccggggaccugauccucgagaucggcaagcugccgcagcaccugacccagcgggcccagaacgcccucgacaaccuggugaugcugcacaacagcgagcagggcgggcgcgcguaccggcacgccauggaggagcuccccgacacgaucgagacccugaugcugcucgcccugaucgccgugcugaccggcggggucacccucuucuuccuguccggcaaggggcugggcaagaccagcaucggccuccugugcgugauggccuccagcgugcugcucuggauggcguccgucgagccccacuggaucgccgccagcaucauccuggaguucuuccugauggugcuccugauccccgagccggaccgccagcggacgccccaggacaaccagcuggccuacguggucaucgggcuccuguucaugauccugaccguggccgcgaacgagaugggccuccuggagaccaccaagaaggaccuggggaucggccacguggccgucgagaaccaccaccacgccgccaugcucgacguggaccugcaccccgccuccgcguggacgcuguacgccguggccaccaccaucaucaccccgaugaugcgccacacgaucgagaacaccaccgccaacaucagccucaccgccaucgcgaaccaggccgccauccugauggggcuggacaagggcuggcccaucuccaagauggacaucggcgucccccuccuggcccuggggugcuacagccaggugaacccccucacgcugaccgcggccgugcugaugcucgucgcccacuacgccaucaucggcccggggcugcaggccaaggcgacccgggaggcccagaagcgcaccgccgccggcaucaugaagaaccccacgguggacgggaucguggccaucgaccuggaccccgucguguacgacgcgaaguucgagaagcagcucggccagaucaugcugcugauccucugcaccucccagauccugcugaugcgcaccaccugggcccucugcgagagcaucacgcuggccaccggcccccugaccacccucugggagggguccccgggcaaguucuggaacacgaccaucgccgugagcauggccaacaucuuccggggguccuaccuggcgggcgccggccuggccuucagccucaugaagucccucgggggcgggcgccgggggaccggggcccagggcgagacccugggcgagaaguggaagcgccagcucaaccagcuguccaagagcgaguucaacacguacaagcgguccgggaucauggaggucgaccgcagcgaggcgaaggagggccugaagcgcggggagaccaccaagcacgccgugucccgcggcaccgccaagcuccggugguucguggagcgcaaccuggucaagcccgaggggaaggugaucgaccugggcugcggccgcgggggcuggagcuacuacugcgccgggcugaagaaggugacggaggucaagggcuacaccaagggcggccccggccacgaggagcccgugccgauggccaccuacggguggaaccucgugaagcugcacuccggcaaggacgucuucuucaucccgcccgagaagugcgacacccugcucugcgacaucggggagagcucccccaacccgacgaucgaggagggccgcacccugcgggugcugaagaugguggagcccuggcuccgcgggaaccaguucugcaucaagauccugaaccccuacaugcccagcgucguggagacccuggagcagaugcagcggaagcacggcggcaugcucgugcgcaacccgcugucccggaacagcacccacgagauguacugggucuccugcgggaccggcaacaucgugagcgcgaucaacaugacgucccgcaugcugcucaaccgguucaccauggcccaccgcaagcccaccuacgagcgcgacguggaccugggggccggcacccggcacgucgccguggagcccgagguggccaaccuggacaucaucggccagcgcaucgagaacaucaagugcgagcacaagagcacguggcacuacgacgaggacaaccccuacaagaccugggcguaccacggguccuacgaggucaagccgagcggcuccgccagcagcauggugaacggggucgugaagcuccugaccaagcccugggacgugauccccauggucacccagaucgccaugacggacaccacccccuucggccagcagcggguguucaaggagaagguggacacccgcacgccgaaggccaagcgggggaccgcccagaucauggaggucaccgcgcgcuggcuguggggcuuccucucccggaacaagaagccccgcaucugcacccgggaggaguucacgcgcaaggugcggagcaacgccgccaucggcgccguguucgucgacgagaaccaguggaacuccgcgaaggaggccguggaggacgagcgcuucugggaccuggugcaccgggagcgcgagcugcacaagcaggggaagugcgcgaccugcgucuacaacaugaugggcaagcgggagaagaagcucggggaguucggcaaggccaaggggagccgcgccaucugguacauguggcugggcgcgcgguuccuggaguucgaggcccucggcuucaugaacgaggaccacugguucucccgcgagaacagccuguccgggguggagggcgaggggcugcacaagcucggcuacauccugcgggacaucagcaagaucuccgggggcaacauguacgccgacgacaccgccggcugggacacccgcaucacggaggacgaccugcagaacgaggccaagaucaccgagaucauggagcccgagcacgcgcagcucgccaaggccaucuucaagcugaccuaccagaacaaggugguccgggugcagcgcccggccaagaacgggaccgugauggacgucaucagccgccgggaccagcgcggcuccggccagguggggacguacggccugaacaccuucaccaacauggaggcccagcucauccggcagauggagagcgaggggaucuucucccccagcgagcuggagacccccaaccuggcggagcgcgugcucgacuggcuggagaaguacggcgucgagcggcugaagcgcauggccaucuccggggacgacugcguggugaagcccaucgacgaccgguucgccacggcccucaccgcccugaacgacaugggcaagguccgcaaggacaucccgcagugggagcccagcaagggguggaacgacuggcagcagguccccuucugcucccaccacuuccaccagcugaucaugaaggacggccgggagaucgugguccccugccgcaaccaggacgagcucgugggccgggcgcgcgugagccagggggccggcuggagccugcgggagaccgccugccuggggaaguccuacgcccagauguggcagcucauguacuuccaccgccgggaccugcgccuggcggccaacgccaucugcagcgccgucccgguggacugggugcccaccucccggacgaccuggagcauccacgcccaccaccaguggaugaccaccgaggacaugcucuccgucuggaaccgcguguggaucgaggagaaccccuggaugaaggacaagacgcacaucagcuccugggaggacgugcccuaccugggcaagcgggaggaccaguggugcgggagccugaucggccucaccgcgcgcgccaccugggccaccaacauccaggucgccaucaaccaggugcgccggcugaucggcaacgagaacuaccuggacuacaugaccuccaugaagcgcuucaagaacgagagcgacccggagggggcccucugguga

SEQ ID NO: 8957 - RNA, 9879 nt, Artificial Sequence
  derived and/or modified CDS sequence (opt1) from DENV-1__KU666941__SS-prME
agcgugaccaugcugcucaugcugaugcccaccgcccuggccuuccaccucaccacccggggcggggagccccacaugaucgugagcaagcaggagcggggcaagagccugcuguucaagaccagcgcgggggugaacaugugcacccucaucgccauggaccugggcgagcugugcgaggacaccaugaccuacaagugcccccgcaucaccgaggccgagcccgacgacguggacugcuggugcaacgccaccgacacgugggugaccuacgggaccugcagccagaccggcgagcaccggcgcgacaagcgguccguggcccucgcgccccacgugggccuggggcuggagacgcgcaccgagaccuggaugagcuccgagggcgccuggaagcagauccagcggguggagaccugggcccuccgccaccccggguucacggugaucgcccuguuccuggcgcacgccaucggcaccagcaucacccagaaggggaucaucuucauccuccugaugcuggugacccccuccauggccaugcggugcgucggcaucggcagccgcgacuucguggaggggcucuccggcgccacguggguggacgucgugcuggagcacgggagcugcgugaccaccauggccaaggacaagcccacccuggacaucgagcuccugaagacggaggucaccaaccccgcggugcugcggaagcucugcaucggcgccaagaucuccaacaccaccacggacagccgcugcccgacccagggcgaggccacccugguggaggagcaggacgccaacuucgucugccggcgcaccuucguggaccggggguggggcaacgggugcggccuguucgggaagggcucccucaucacgugcgccaaguucaagugcgugaccaagcuggagggcaagaucguccaguacgagaaccugaaguacagcgugaucgugaccguccacaccggggaccagcaccaggugggcaacgaguccacggagcacgggaccaccgcgaccaucacgccccaggcccccacgaccgagauccagcucaccgacuacggcgcccugacccuggacugcagcccccgcacggggcucgacuucaacgagaugguccugcugaccaugaaggagaaguccuggcucgugcacaagcagugguuccuggaccugccccuccccuggaccagcggcgccagcaccucccaggagacguggaaccggcaggaccugcuggugaccuucaagaccgcccacgcgaagaagcaggaggucguggugcucggcagccaggagggggccaugcacaccgcccugacgggcgccaccgagauccagaccuccgggaccacgaccaucuucgccggccaccugaagugccgccucaagauggacaagcugacccugaaggggaugagcuacgucaugugcaccggcuccuucaagcucgagaaggagguggcggagacgcagcacggcaccgugcugguccagaucaaguacgaggggaccgacgcccccugcaagauccccuucagcacccaggacgagaagggcgugacgcagaacgggcggcugaucaccgccaacccgaucgugaccgacaaggagaagcccgucaacaucgaggccgagccgcccuucggcgaguccuacaucgugaucggcgcgggggagaaggcccugaagcucagcugguucaagaagggcuccagcaucgggaagauguucgaggccaccgcccgcggcgcccggcgcauggcgauccugggggacacggccugggacuucggcuccaucggcgggguguucaccagcgucggcaagcuggugcaccagaucuucgggaccgccuacggcguccucuucuccggggucagcuggaccaugaagaucggcaucggcgugcugcugacguggcucgggcugaacucccgcagcaccucccugagcaugaccugcaucgccgugggccucgucacccuguaccugggggugauggugcaggccgacuccggcugcgucaucaacuggaaggggcgggagcucaagugcggcagcggcaucuucgugacgaacgaggugcacaccuggaccgagcaguacaaguuccaggcggacagcccgaagcgccuguccgccgccaucgggaaggccugggaggagggcgucugcgggauccggagcgccacccgccuggagaacaucauguggaagcagaucuccaacgagcucaaccacauccugcuggagaacgacaugaaguucaccgugguggucggcgacguggcggggauccucgcccagggcaagaagaugauccggccccagcccauggagcacaaguacagcuggaaguccuggggcaaggccaagaucaucggggccgacgugcagaacacgaccuucaucaucgacggccccaacaccccggagugccccgacgaccagcgcgcguggaacaucugggaggucgaggacuacggguucggcaucuucaccacgaacaucuggcugaagcugcgggacagcuacacccaggugugcgaccaccgccucauguccgccgccaucaaggacagcaaggccgugcacgccgacaugggcuacuggaucgaguccgagaagaacgagaccuggaagcuggcgcgggccagcuucaucgaggucaagaccugcaucuggcccaagucccacacgcuguggagcaacggggugcucgaguccgagaugaucauccccaagaucuacggcgggccgaucagccagcacaacuaccgccccggcuacuucacccagaccgccgggcccuggcaccugggcaagcuggagcucgacuucgaccugugcgagggcaccacgguggucguggacgagcacugcgggaaccggggcccgucccugcgcaccaccaccgugacggggaagaucauccacgaguggugcugccggagcugcacccugccgccccuccgcuaccggggcgaggacgggugcugguacggcauggagauccgccccgucaaggagaaggaggagaaccuggugaaguccauggugagcgccggcagcggggaggucgacuccuucagccucggccugcugugcaucuccaucaugaucgaggaggugaugcggagccgcuggucccggaagaugcucaugaccgggacccuggccguguucuuccugcucaucaugggccagcugacguggaacgaccugauccgccucugcaucauggucggggcgaacgccagcgaccgcaugggcaugggcaccaccuaccuggcccugauggccaccuucaagaugcggccgauguucgccguggggcuccuguuccgccggcugacgucccgcgaggugcuccugcugaccaucggccucagccuggucgcguccguggagcugcccaacagccucgaggagcugggggacggccuggccaugggcaucaugauccucaagcugcugaccgacuuccagucccaccagcucugggccacccugcugagccucacguucaucaagaccaccuucucccugcacuacgccuggaagaccaucgcgaugguccugagcaucgugucccucuucccccugugccugagcacgaccucccagaagaccaccuggcuccccgugcugcuggggagccucggcugcaagccgcugacgauguuccugaucgccgagaacaagaucugggggcggaaguccuggccccucaacgagggcaucauggccgucgggaucgugagcauccugcugagcucccuccugaagaacgacgugccccuggccggcccccucaucgccggcgggaugcugaucgcgugcuacgucaucagcggcuccagcgccgaccugucccucgagaaggccgccgaggugagcugggaggaggaggccgagcacuccggggcgagccacaacauccugguggagguccaggacgacggcaccaugaagaucaaggacgaggagcgcgacgacacccugaccauccuccugaaggccacccugcucgccguguccgggguguacccgcugagcauccccgccacgcuguucgucugguacuucuggcagaagaagaagcagcgguccggcgugcucugggacacccccagcccgcccgagguggagcgcgccguccuggacgacggcaucuaccggaucaugcagcgcgggcugcugggccggucccaggugggggugggcgucuuccaggagaacguguuccacaccauguggcacgugacccgcggggcgguccucauguaccagggcaagcggcuggagcccagcugggccuccgugaagaaggaccugaucagcuacggcgggggcuggcgccuccagggguccuggaacacgggcgaggaggugcaggucaucgccguggagcccgggaagaaccccaagaacgugcagaccgcccccggcaccuucaagacccccgagggcgaggucggggccaucgcgcuggacuucaagcccggcacgagcgggucccccaucgugaaccgggagggcaagaucgugggccuguacgggaacggcgucgugaccaccagcgggaccuacgugagcgccaucgcccaggccaaggcgucccaggagggcccgcuccccgagaucgaggacgaggucuuccgcaagcggaaccugacgaucauggaccugcaccccgggagcggcaagacccgccgguaccucccggccaucgugcgcgaggccaucaagcggaagcugcgcacccugauccucgcccccacccgcguggucgccuccgagauggcggaggcccugaagggcaugcccauccgguaccagacgaccgccgucaagagcgagcacaccgggaaggagaucguggaccugaugugccacgccaccuucacgaugcgccuccugucccccguccgggugccgaacuacaacaugaucaucauggacgaggcccacuucaccgaccccagcuccaucgcggcccgcggcuacaucagcacccggguggggaugggcgaggccgccgccaucuucaugaccgcgacgccgcccggguccgucgaggccuucccgcagagcaacgccgugauccaggacgaggagcgcgacauccccgagcgguccuggaacagcggcuacgaguggaucaccgacuuccccggcaagaccgugugguucguccccuccaucaagagcgggaacgacaucgccaacugccugcgcaagaacggcaagcgggugauccagcucucccgcaagaccuucgacacggaguaccagaagaccaagaacaacgacugggacuacguggucaccaccgacaucagcgagaugggggcgaacuuccgggccgaccgcgugaucgacccgcggcgcugccugaagcccgugauccugaaggacggccccgagcgggucauccucgccgggcccaugccggugacggucgccuccgccgcgcagcgccggggccgcaucggccggaaccacaacaaggagggggaccaguacaucuacaugggccagccccugaacaacgacgaggaccacgcccacuggaccgaggccaagaugcugcucgacaacaucaacacccccgaggggaucauccccgcccuguucgagccggagcgcgagaaguccgccgcgaucgacggcgaguaccgccugcgcggggaggcccgcaagaccuucguggagcucaugcggcgcggcgaccugcccguguggcuguccuacaaggucgccagcgagggcuuccaguacagcgaccggcgcuggugcuucgacggggagcggaacaaccaggugcucgaggagaacauggacguggagaucuggacgaaggagggcgagcgcaagaagcugcggccccgcuggcuggacgcccggaccuacuccgacccccucgcccugcgcgaguucaaggaguucgcggccgggcggcgcagcgucuccggcgaccugauccucgagaucggcaagcugccgcagcaccugacccagcgggcccagaacgcccucgacaaccuggugaugcugcacaacagcgagcagggcgggcgcgcguaccggcacgccauggaggagcuccccgacaccaucgagacgcugaugcugcucgcccugaucgccgugcugaccgggggcgucacccucuucuuccuguccgggaagggccugggcaagaccagcaucgggcuccugugcgugauggccuccagcgugcugcucuggauggcguccgucgagccccacuggaucgccgccagcaucauccuggaguucuuccugauggugcuccugauccccgagccggaccgccagcggacgccccaggacaaccagcuggccuacguggucaucggccuccuguucaugauccugacgguggccgcgaacgagauggggcuccuggagaccaccaagaaggaccugggcaucgggcacguggccgucgagaaccaccaccacgccgccaugcucgacguggaccugcaccccgccuccgcguggacccuguacgccguggccacgaccaucaucaccccgaugaugcgccacaccaucgagaacacgaccgccaacaucagccucaccgccaucgcgaaccaggccgccauccugaugggccuggacaagggcuggcccaucuccaagauggacaucggggucccccuccuggcccugggcugcuacagccaggugaacccccucacccugacggcggccgugcugaugcucgucgcccacuacgccaucaucgggccgggccugcaggccaaggcgacccgggaggcccagaagcgcaccgccgccgggaucaugaagaaccccaccguggacggcaucguggccaucgaccuggaccccgucguguacgacgcgaaguucgagaagcagcucggccagaucaugcugcugauccucugcacgucccagauccugcugaugcgcaccaccugggcccucugcgagagcaucacccuggccacggggccccugaccacccucugggagggcuccccggggaaguucuggaacaccacgaucgccgugagcauggccaacaucuuccggggcuccuaccuggcgggcgccgggcuggccuucagccucaugaagucccugggcgggggccgccgggggaccggcgcccagggcgagacccugggggagaaguggaagcgccagcucaaccagcuguccaagagcgaguucaacaccuacaagcgguccggcaucauggaggucgaccgcagcgaggcgaaggaggggcugaagcggggcgagacgaccaagcacgccgugucccgcgggaccgccaagcuccggugguucguggagcgcaaccuggucaagcccgagggcaaggugaucgaccugggcugcgggcggggcggguggagcuacuacugcgccggccugaagaaggugaccgaggucaagggguacacgaagggcggccccgggcacgaggagcccgugccgauggccaccuacggcuggaaccucgugaagcugcacuccgggaaggacgucuucuucaucccgcccgagaagugcgacacccugcucugcgacaucggcgagagcucccccaacccgaccaucgaggaggggcgcacgcugcgggugcugaagaugguggagcccuggcuccgcggcaaccaguucugcaucaagauccugaaccccuacaugcccagcgucguggagacccuggagcagaugcagcggaagcacggcgggaugcucgugcgcaacccgcugucccggaacagcacccacgagauguacugggucuccugcggcaccgggaacaucgugagcgcgaucaacaugaccucccgcaugcugcucaaccgguucacgauggcccaccgcaagcccaccuacgagcgcgacguggaccugggcgccggcacccggcacgucgccguggagcccgagguggccaaccuggacaucaucgggcagcgcaucgagaacaucaagugcgagcacaagagcaccuggcacuacgacgaggacaaccccuacaagacgugggcguaccacggcuccuacgaggucaagccgagcggguccgccagcagcauggugaacggcgucgugaagcuccugaccaagcccugggacgugauccccauggucacccagaucgccaugaccgacacgacccccuucgggcagcagcggguguucaaggagaagguggacacccgcaccccgaaggccaagcggggcacggcccagaucauggaggucaccgcgcgcuggcuguggggcuuccucucccggaacaagaagccccgcaucugcacccgggaggaguucacccgcaaggugcggagcaacgccgccaucggggccguguucgucgacgagaaccaguggaacuccgcgaaggaggccguggaggacgagcgcuucugggaccuggugcaccgggagcgcgagcugcacaagcagggcaagugcgccacgugcgucuacaacaugauggggaagcgggagaagaagcucggcgaguucgggaaggccaagggcagccgcgccaucugguacauguggcugggcgcgcgguuccuggaguucgaggcccucggguucaugaacgaggaccacugguucucccgcgagaacagccuguccggcguggagggggagggccugcacaagcucggguacauccugcgggacaucagcaagaucuccggcggcaacauguacgccgacgacaccgccgggugggacacccgcaucaccgaggacgaccugcagaacgaggccaagaucacggagaucauggagcccgagcacgcgcagcucgccaaggccaucuucaagcugaccuaccagaacaaggugguccgggugcagcgcccggccaagaacggcaccgugauggacgucaucagccgccgggaccagcgcggguccggccaggugggcaccuacgggcugaacacguucaccaacauggaggcccagcucauccggcagauggagagcgagggcaucuucucccccagcgagcuggagacccccaaccuggcggagcgcgugcucgacuggcuggagaaguacggggucgagcggcugaagcgcauggccaucuccggcgacgacugcguggugaagcccaucgacgaccgguucgccaccgcccucacggcccugaacgacauggggaagguccgcaaggacaucccgcagugggagcccagcaagggcuggaacgacuggcagcagguccccuucugcucccaccacuuccaccagcugaucaugaaggacggccgggagaucgugguccccugccgcaaccaggacgagcucguggggcgggcgcgcgugagccagggcgccggguggagccugcgggagaccgccugccugggcaaguccuacgcccagauguggcagcucauguacuuccaccgccgggaccugcgccuggcggccaacgccaucugcagcgccgucccgguggacugggugcccaccucccggaccacguggagcauccacgcccaccaccaguggaugaccaccgaggacaugcucuccgucuggaaccgcguguggaucgaggagaaccccuggaugaaggacaagacccacaucagcuccugggaggacgugcccuaccuggggaagcgggaggaccaguggugcggcagccugaucggccucacggcgcgcgccaccugggccaccaacauccaggucgccaucaaccaggugcgccggcugaucgggaacgagaacuaccuggacuacaugaccuccaugaagcgcuucaagaacgagagcgacccggagggcgcccucugguga

SEQ ID NO: 8958 - RNA, 9879 nt, Artificial Sequence
  derived and/or modified CDS sequence (opt1) from DENV-1__KC172835__SS-prME
agcgugaccaugcugcucaugcugaugcccaccgcccuggccuuccaccucaccacccgcggcggggagccgcacaugaucgugagcaagcaggagcggggcaagagccugcuguucaagaccagcgcgggggugaacaugugcacccucaucgccauggaccugggcgagcugugcgaggacaccaugaccuacaagugcccccgcaucaccgaggccgagcccgacgacguggacugcuggugcaacgccaccgacaccugggucaccuacgggaccugcagccagaccggcgagcaccggcgcgacaagcgguccguggcccucgcgccccacgugggccuggggcuggagacgcgcaccgagaccuggaugagcuccgagggcgccuggaagcagauccagcgggucgagaccugggcccuccgccaccccggguucacggugaucgcccuguuccuggcgcacgccaucggcaccagcaucacccagaaggggaucaucuucauccuccugaugcuggugacccccuccauggccaugcggugcgucggcaucggcagccgcgacuucguggaggggcucuccggcgccacguggguggacgucgugcuggagcacgggagcugcgugaccaccauggccaaggacaagcccacccuggacaucgagcuccugaagacggaggucaccaaccccgcggugcugcggaagcucugcaucgaggccaagaucuccaacaccaccacggacagccgcugcccgacccagggcgaggccacccugguggaggagcaggacgccaacuucgucugccggcgcaccuucguggaccggggcugggggaacggcugcgggcuguucggcaaggggucccucaucacgugcgccaaguucaagugcgugaccaagcuggagggcaagaucguccaguacgagaaccugaaguacagcgugaucgugaccguccacaccggcgaccagcaccagguggggaacgaguccacggagcacggcaccaccgcgaccaucacgccccaggcccccacgaccgagauccagcucaccgacuacggggcccugacccuggacugcagcccccgcacgggccucgacuucaacgagaugguccugcugaccaugaaggagaaguccuggcucgugcacaagcagugguuccuggaccugccgcuccccuggaccagcggggccagcaccucccaggagacguggaaccggcaggaccugcuggugaccuucaagaccgcccacgcgaagaagcaggaggucguggugcucggcagccaggagggcgccaugcacaccgcccugacgggggccaccgagauccagaccuccggcaccacgaccaucuucgccgggcaccugaagugccgccucaagauggacaagcugacccugaagggcaugagcuacgucaugugcaccggguccuucaagcucgagaaggagguggcggagacgcagcacggcaccgugcugguccagaucaaguacgagggcaccgacgcccccugcaagauccccuucagcacccaggacgagaagggggugacgcagaacggccggcugaucaccgccaacccgaucgugaccgacaaggagaagcccgucaacaucgaggccgagccgcccuucggggaguccuacaucgugaucggcgcgggcgagaaggcccugaagcucagcugguucaagaagggguccagcaucggcaagauguucgaggccaccgcccgcggggcccggcgcauggcgauccugggcgacacggccugggacuucggguccaucggcggcguguucaccagcgucgggaagcuggugcaccagaucuucggcaccgccuacggggugcuguucuccggcgucagcuggaccaugaagaucgggaucggcgugcugcugacguggcucggccugaacucccgcagcaccucccugagcaugaccugcaucgccguggggcucgucacccuguaccugggcgugauggugcaggccgacuccgggugcgucgugaacuggaagggccgggagcucaagugcgggagcggcaucuucgugacgaacgagguccacaccuggaccgagcaguacaaguuccaggcggacagcccgaagcgccuguccgccgccaucggcaaggccugggaggagggggugugcggcauccggagcgccacccgccuggagaacgugauguggaagcagaucuccaacgagcucaaccacauccugcuggagaacgacaugaaguucaccgucguggugggggacgucgcgggcauccucgcccaggggaagaagaugauccggccccagcccauggaguacaaguacagcuggaaguccuggggcaaggccaagaucaucggcgccgacgugcagaacacgaccuucaucaucgacgggcccaacaccccggagugccccgacgaccagcgcgcguggaacaucugggagguggaggacuacggcuucgggaucuucaccacgaacaucuggcugcggcugcgcgacagcuacacccaggucugcgaccaccggcucauguccgccgccaucaaggacagcaaggccgugcacgccgacaugggcuacuggaucgaguccgagaagaacgagaccuggaagcuggcgcgcgccagcuucaucgaggugaagaccugcaucuggcccaagucccacacgcuguggagcaacggcguccucgaguccgagaugaucauccccaagaucuacgggggcccgaucagccagcacaacuaccggcccggguacuucacccagaccgccggccccuggcaccuggggaagcuggagcucgacuucgaccugugcgagggcaccacggugguggucgacgagcacugcggcaaccgcgggccgucccugcggaccaccaccgugacgggcaagaccauccacgaguggugcugccgcagcugcacccugccgccccuccgguuccgcggggaggacggcugcugguacgggauggagauccggcccgugaaggagaaggaggagaaccuggucaaguccauggugagcgccggcagcggcgagguggacuccuucagccucgggcugcugugcaucuccaucaugaucgaggaggucaugcgcagccgguggucccgcaagaugcucaugaccggcacgcuggccguguucuuccugcucaucaucgggcagcugaccuggaacgaccugauccgccucagcaucauggugggcgcgaacgccuccgacaagauggggaugggcaccaccuaccuggcccugauggccacguucaagaugcggccgauguucgccgucggccuccuguuccgccggcugaccagccgcgaggugcuccugcugaccaucgggcucucccuggucgcgagcguggagcugcccaacucccucgaggagcugggcgacgggcuggccaugggcaucaugauccucaagcugcugaccgacuuccagccccaccagcucugggccacgcugcugagccucaccuucaucaagaccaccuucucccugcacuacgccuggaagacgauggcgauggugcugagcaucgucucccucuucccccugugccugagcaccaccucccagaagaccacguggcucccggugcugcugggcagccucgggugcaagccccugaccauguuccugaucaccgagaacaagaucuggggccggaaguccuggccccucaacgaggggaucauggccgugggcaucgucagcauccugcugagcucccuccugaagaacgacgugccccuggccgggccgcucaucgccggcggcaugcugaucgccugcuacgugaucagcggguccagcgcggaccugucccucgagaaggccgccgaggucagcugggaggaggaggccgagcacuccggcgccagccacaacauccugguggaggugcaggacgacgggaccaugaagaucaaggacgaggagcgcgacgacacccugacgauccuccugaaggcgacccugcucgccgucuccggcguguacccccugagcauccccgccacccuguucgugugguacuucuggcagaagaagaagcagcgguccgggguccucugggacacccccagcccgcccgagguggagcgcgccgcccuggacgacggcaucuaccggaucaugcagcgcggccugcuggggcggucccaggugggcgucgggguguuccaggagaacguguuccacacgauguggcacgucacccgcggcgcggugcucauguaccaggggaagcggcuggagcccagcugggccuccgugaagaaggaccugaucagcuacggcggcggguggcgccuccagggcuccuggaacaccggggaggagguccaggugaucgccguggagcccggcaagaacccgaagaacguccagaccgcccccgggacguucaagacccccgagggcgaggugggcgccaucgcgcuggacuucaagcccgggaccagcggcuccccgaucgugaaccgggaggggaagaucgucggccuguacggcaacgggguggugaccacgagcggcaccuacgucagcgccaucgcccaggccaaggcgucccaggaggggccccuccccgagaucgaggacgagguguuccgcaagcggaaccugaccaucauggaccugcacccgggcagcgggaagacccgccgguaccuccccgccaucgugcgcgaggccaucaagcggaagcugcgcacgcugauccucgcccccacccgcgucguggccuccgagauggcggaggcccugaagggcaugcccauccgguaccagaccaccgccgucaagagcgagcacacgggcaaggagaucgucgaccugaugugccacgccaccuucaccaugcgccuccuguccccggugcgggugcccaacuacaacaugaucaucauggacgaggcccacuucaccgaccccagcuccaucgcggcccgcggguacaucagcacgcgggucggcaugggggaggccgccgccaucuucaugaccgcgacgccgcccggcuccguggaggccuucccccagagcaacgccgugauccaggacgaggagcgcgacauccccgagcgguccuggaacagcggguacgaguggaucaccgacuuccccggcaagacggucugguucgugcccuccaucaagagcggcaacgacaucgccaacugccugcgcaagaacgggaagcgggugauccagcucucccgcaagaccuucgacaccgaguaccagaagaccaagaacaacgacugggacuacgucgugacgaccgacaucagcgagaugggcgcgaacuuccgggccgaccgcgugaucgacccccggcgcugccugaagcccgucauccugaaggacgggcccgagcgggugauccucgccggcccgaugcccgucaccguggccuccgccgcgcagcgccgggggcgcaucggccggaaccacaacaaggagggcgaccaguacaucuacauggggcagccccugaacaacgacgaggaccacgcccacuggaccgaggccaagaugcugcucgacaacaucaacacgcccgagggcaucaucccggcccuguucgagcccgagcgcgagaaguccgccgcgaucgacggggaguaccgccugcggggcgaggcccgcaagaccuucguggagcucaugcggcgcggggaccugcccgucuggcuguccuacaagguggccagcgagggcuuccaguacagcgaccggcgcuggugcuucgacggcgagcggaacaaccaggugcucgaggagaacauggacgucgagaucuggaccaaggagggggagcgcaagaagcugcggccccgcuggcuggacgcccggaccuacuccgacccgcucgcccugcgcgaguucaaggaguucgcggccggccggcgcagcguguccggggaccugauccucgagaucggcaagcugccccagcaccugacgcagcgggcccagaacgcccucgacaaccuggugaugcugcacaacagcgagcagggcgggcgcgcguaccggcacgccauggaggagcuccccgacaccaucgagacccugaugcugcucgcccugaucgccguccugaccggcggggugacccucuucuuccuguccggccgcgggcugggcaagacgagcaucggccuccugugcgugauggccuccagcguccugcucuggauggcguccguggagccccacuggaucgccgccagcaucauccuggaguucuuccugauggugcuccugaucccggagcccgaccggcagcgcacgccccaggacaaccagcuggccuacgucgugaucgggcuccuguucaugauccugaccguggccgcgaacgagaugggccuccuggagaccacgaagaaggaccuggggaucggccacgucgccgacgagaaccaccaccacgccgccaugcucgacguggaccugcacccggccuccgcguggacccuguacgccguggccaccaccaucaucacgcccaugaugcggcacaccaucgagaacaccaccgccaacaucagccucacggccaucgcgaaccaggccgccauccugauggggcuggacaagggcuggcccaucuccaagauggacaucggcgucccccuccuggcccuggggugcuacagccaggugaacccgcucacccugaccgcggccgugcugaugcucgucgcccacuacgccaucaucggccccgggcugcaggccaaggcgacccgcgaggcccagaagcgcacggccgccggcaucaugaagaaccccaccguggacgggaucguggccaucgaccuggaccccgucguguacgacgcgaaguucgagaagcagcucggccagaucaugcugcugauccucugcaccucccagauccugcugaugcggaccacgugggcccucugcgagagcaucacccuggccaccggcccgcugaccacgcucugggaggggucccccggcaaguucuggaacaccaccaucgccgugagcauggccaacaucuuccgcggguccuaccuggcgggcgccggccuggccuucagccucaugaagucccucgggggcgggcggcgcgggaccggggcccagggcgagacgcugggcgagaaguggaagcggcagcucaaccagcuguccaagagcgaguucaacaccuacaagcgcuccgggaucauggaggucgaccggagcgaggcgaaggagggccugaagcgcggggagaccaccaagcacgccgugucccggggcacggccaagcuccgcugguucguggagcggaaccuggucaagcccgaggggaaggugaucgaccugggcugcggccgcgggggcuggagcuacuacugcgccgggcugaagaaggugaccgaggucaagggcuacaccaagggcgggcccggccacgaggagccgauccccauggccaccuacggguggaaccucgugaagcugcacuccggcaaggacguguucuucaucccgcccgagaagugcgacacgcugcucugcgacaucggggagagcuccccgaaccccaccaucgaggagggccggacccugcgcguccugaagaugguggagcccuggcuccgggggaaccaguucugcaucaagauccugaaccccuacaugccgagcguggucgagacccuggagcagaugcagcgcaagcacggcggcaugcucgugcggaacccccugucccgcaacagcacccacgagauguacuggguguccugcgggacgggcaacaucgucagcgcggugaacaugaccucccggaugcugcucaaccgcuucaccauggugcaccgcaagcccaccuacgagcgggacgucgaccugggggccggcacgcgccacguggccguggagcccgaggucgccaaccuggacaucaucggccagcggaucgagaacaucaagcacgagcacaagagcaccuggcacuacgacgaggacaacccguacaagaccugggccuaccacggguccuacgaggugaagcccagcggcuccgcgagcagcauggucaacgggguggugaagcuccugaccaagcccugggacgucauccccauggugacgcagaucgccaugaccgacaccaccccguucggccagcagcgcguguucaaggagaaggucgacacgcggacccccaaggccaagcgcgggaccgcccagaucauggaggugaccgcccgguggcuguggggcuuccucucccgcaacaagaagccccggaucugcacgcgcgaggaguucacccggaaggugcgcagcaacgcggccaucggcgccgucuucaucgacgagaaccaguggaacuccgccaaggaggcgguggaggacgagcgguucugggaccuggugcaccgcgagcgggagcugcacaagcaggggaagugcgcgaccugcgucuacaacaugaugggcaagcgcgagaagaagcucggggaguucggcaaggccaaggggagccgggccaucugguacauguggcugggcgcccgcuuccuggaguucgaggcgcucggcuucaugaacgaggaccacugguucucccgggagaacagccuguccgggguggagggcgaggggcugcacaagcucggcuacauccugcgcgacaucagcaagauccccggcgggaacauguacgccgacgacaccgccgggugggacacgcggaucaccgaggacgaccugcagaacgaggccaagaucaccgacaucauggaguccgagcacgcccuccuggccaagagcaucuucaagcugaccuaccagaacaaggugguccgcgugcagcgccccgccaagaacgggacggugauggacgucaucucccggcgcgaccagcggggcagcggccaggugggcaccuacggccucaacaccuucaccaacauggaggcccagcugauccgccagauggaguccgaggggaucuucagccccuccgagcuggagacgcccaaccucgccgagcgggcccuggacuggcuggagaagcacggcguggagcgccucaagcggauggcgaucagcggggacgacugcgucgugaagccgaucgacgaccgcuucgccaccgcccugaccgcccugaacgacaugggcaaggugcggaaggacaucccccagugggagcccuccaagggguggaacgacuggcagcagguccccuucugcagccaccacuuccaccagcucaucaugaaggacggccgcgagaucguggugccgugccggaaccaggacgagcuggucggccgcgcccgggugagccagggggcgggcuggucccugcgcgagaccgccugccucggcaagagcuacgcccagauguggcagcugauguacuuccaccggcgcgaccugcggcucgccgcgaacgccaucugcuccgccgugcccgucgacugggugcccacgagccgcaccaccugguccauccacgcccaccaccaguggaugaccacggaggacaugcugagcguguggaaccgggucuggaucgaggagaaccccuggauggaggacaagacccacaucuccagcugggaggacgugccguaccugggcaagcgcgaggaccaguggugcgggucccucaucggccugaccgcccgcgcgaccugggccaccaacauccagguggccaucagccagguccggcgccugaucggcaacgagaacuaccucgacuacaugacguccaugaagcgguucaagaacgagagcgaccccgagggggcccugugguga

SEQ ID NO: 8959 - RNA, 9879 nt, Artificial Sequence
  derived and/or modified CDS sequence (opt1) from DENV-1__EU848545__SS-prME
agcgugaccaugcugcucaugcugcugcccaccgcccucgccuuccaccugaccacccgcggcggggagccgcacaugaucgugagcaagcaggagcggggcaagagccuccuguucaagaccagcgccggggugaacaugugcaccaucaucgccauggaccugggcgagcugugcgaggacaccaugaccuacaagugcccccgcaucaccaaggccgagcccgacgacguggacugcuggugcaacgccaccgacaccugggugaccuacgggaccugcagccggaccggcgagcaccgccgggacaagcgcuccguggcccucgcgccccacgugggccuggggcuggagacccgggccgagaccuggaugagcagcgagggcgccuggaagcagauccagaaggucgagaccugggcccuccgccacccgggguucaccgugaucgcgcuguuccuggcccacgccaucggcacgagcaucacccagaaggggaucaucuucauccuccugaugcuggugacccccuccauggccaugcggugcgucggcaucggcaaccgcgacuucguggaggggcucagcggcgccaccuggguggacgucgugcuggagcacggguccugcgugacgaccauggcgaaggacaagcccacccuggacaucgagcuccugaagaccgaggucacgaagcccgccgugcugcggaagcucugcaucgaggccaagaucagcaacaccaccaccgacucccgcugcccgacgcagggcgaggccacccugguggaggagcaggacgccaacuucgucugccggcgcaccuucguggaccggggcugggggaacggcugcgggcuguucggcaaggggagccucaucacgugcgcgaaguucaagugcgugacgaagcuggagggcaagaucguccaguacgagaaccugaaguacuccgugaucgugaccguccacaccggcgaccagcaccagguggggaacgagaccacggagcacggcaccaucgccaccaucacgccccaggcccccaccagcgagauccagcucacggacuacggggcccugacccuggacugcagcccccgcaccggccucgacuucaacgagaugguccugcugaccaugaaggagaaguccuggcucgugcacaagcagugguuccuggaccugccgcuccccuggacguccggggccagcacgccccaggagaccuggaaccgggaggaccugcuggugaccuucaagacggcgcacgccaagaagcaggaggucguggugcucggcagccaggagggcgccaugcacaccgcccugaccggggccaccgagauccagacguccggcaccaccaagaucuucgcggggcaccugaagugccgccucaagaugaacaagcugacccugaagggcaugagcuacgucaugugcacgggguccuucaagcucgagaaggagguggccgagacccagcacggcaccgugcugguccaggugaaguacgagggcaccgacgcccccugcaagaucccguucagcacgcaggacgagaagggggugacccagaacggccggcugaucaccgccaaccccaucgucaccgacaaggagaagcccgugaacaucgaggcggagcccccguucggggaguccuacaucguggucggcgccggcgagaaggcccugaagcucagcugguucaagaagggguccagcaucggcaagaugcuggaggccacggcccgcggggcgcggcgcauggccauccugggcgacaccgccugggacuucggguccaucggcggcguguucaccagcguggggaagcucguccaccagaucuucggcaccgccuacggggugcuguucuccggcgugagcuggacgaugaagaucgggaucggcauccugcucaccuggcugggccugaacucccgcagcgccucccucagcaugaccugcaucgcggucgggauggugacccuguaccugggcgugaugguccaggccgacuccgggugcgugaucaacuggaagggccgggagcucaagugcgggagcggcaucuucgugacgaacgagguccacaccuggaccgagcaguacaaguuccaggccgacucccccaagcgccugagcgccgccaucggcaaggcgugggaggagggggugugcggcauccggagcgccacccgccuggagaacaucauguggaagcagaucuccaacgagcucaaccacauccugcuggagaacgacaugaaguucacgguggucgugggggacgugagcggcauccucacccaggggcggaagaugaucggcccccagcccauggagcacaaguacuccuggaaguccuggggcaaggccaagaucaucggggccgacguccagaacaccaccuucaucaucgacggcccgaacacccccgagugccccgacgaccagcgcgcguggaacaucugggagguggaggacuacggguucggcaucuucacgaccaacaucuggcugaagcugcgggacuccuacacccaggugugcgacccccgccucaugagcgccgccaucaaggacuccaaggccguccacgccgacaugggcuacuggaucgagagcgagaagaacgagaccuggaagcuggcgcgggccuccuucaucgaggugaagacgugcguguggcccaagagccacacccugugguccaacgggguccucgagagcgagaugaucauccccaagaucuacggcgggcccaucucccagcacaacuaccgcccgggcuacagcacccagaccgccgggcccuggcaccugggcaagcuggagcucgacuucgaccugugcgagggcacgaccgugguggucgacgagcacugcgggaaccggggccccucccugcgcaccaccacggugaccgggaagaucauccacgaguggugcugccggagcugcacccugcccccgcugcgcuucaagggcgaggacgggugcugguacggcauggagauccggcccgugaaggacaaggaggagaaccuggucaagucccucgugagcgccggcagcggggagguggacuccuucagccugggccugcucugcaucuccaucaugaucgaggaggucaugcgcagccgguggucccgcaagaugcugaugaccgggacgcuggccguguuccuccugcugaucaugggccagcucaccuggaacgaccugauccggcugugcaucauggugggggcgaacgccagcgaccgcaugggcaugggcaccaccuaccucgcccugauggccacguucaagaugcgccccauguucgccgucgggcuccucuuccggcgccugaccucccgggaggugcugcuccugaccaucgggcugagccucgucgcguccguggagcugcccaacagccuggaggagcucggggacggccuggccaugggcaucaugauccugaagcuccugaccgacuuccagucccaccagcugugggccgcccuccugagccugacguucaucaagaccaccuucucccuccacuacgcguggaagaccguggccaugguccugagcaucgugucccuguucccgcucugccugagcacgaccucccagaagaccaccuggcugcccgugcuccuggggagccugggcugcaagccccucacgauguuccugaucgccgagaacaagaucugggggcgcaaguccuggccccugaacgagggcaucauggccgucgggaucgugagcauccuccugagcucccugcucaagaacgacgugccgcuggccggcccccugaucgcgggcgggaugcucaucgccugcuacgucaucagcggcuccagcgccgaccugucccuggagaaggccgccgagaucagcugggaggaggaggcggagcacuccggggccagccacaacauccucguggaggugcaggacgacggcaccaugaagaucaaggacgaggagcgggacgacacccugaccauccugcucaaggccacgcugcuggccgucuccgggguguaccccaucagcauccccgccacccucuucgugugguacuucuggcagaagaagaagcagcgcuccggcguccugugggacaccccguccccgcccgagguggagcgggcggugcuggacgacggcaucuaccgcauccugcagcgggggcuccugggccgcucccaggucggggugggcguguuccaggagggggucuuccacaccauguggcacgugacccggggcgccgugcugauguaccagggcaagcgccucgagcccagcugggccuccgucaagaaggaccugaucagcuacgggggcggguggcgguuccagggcuccuggaacacgggggaggagguccaggugaucgccgucgagccgggcaagaaccccaagaacgugcagaccgcccccggcaccuucaagacccccgagggggaggugggcgcgaucgcccuggacuucaagccggggacgagcggcucccccaucgucaaccgcgagggcaagaucguggggcucuacggcaacgggguggucaccaccagcggcaccuacgugagcgccaucgcccaggcgaaggccucccaggaggggccccugccggagaucgaggacgagguguuccggaagcgcaaccugacgaucauggaccuccaccccggcagcggcaagacccggcgcuaccugcccgccaucguccgggaggccaucaagcgcaagcugcggacccucauccuggcccccacccgcgugguggcguccgagauggccgaggcccugaaggggaugccgauccgcuaccagacgaccgccgucaagagcgagcacaccggccgggagaucguggaccucaugugccacgccaccuucacgaugcgccugcugucccccgugcggguccccaacuacaacaugaucaucauggacgaggcgcacuucaccgaccccgccagcaucgccgcccgcggguacaucuccacccgggugggcaugggggaggccgcggccaucuucaugaccgccacgccgcccggcagcguggaggccuucccccaguccaacgcggucauccaggacgaggagcgcgacauccccgagcggagcuggaacuccggcuacgacuggaucaccgacuucccggggaagaccgugugguucgugcccagcaucaaguccggcaacgacaucgccaacugccuccgcaagaacgggaagcgggucauccagcugagccgcaagaccuucgacacggaguaccagaagaccaagaacaacgacugggacuacguggugaccaccgacaucuccgagaugggcgccaacuuccgggccgaccgcgucaucgacccccggcgcugccugaagcccgugauccucaaggacgggccggagcgggucauccuggccggccccaugcccgugacgguggcgagcgccgcccagcgccggggccgcaucgggcggaaccagaacaaggagggcgaccaguacaucuacauggggcagccccugaacaacgacgaggaccacgcccacuggaccgaggccaagaugcuccuggacaacaucaacaccccggagggcaucauccccgcgcuguucgagcccgagcgcgggaaguccgccgccaucgacggcgaguaccgccuccggggcgaggcccgcaagaccuucgucgagcugaugcggcgcggggaccugcccguguggcucagcuacaagguggccuccgagggcuuccaguacagcgaccggaaguggugcuucgacggggagcgcaacaaccagguccuggaggagaacauggacguggagaucuggacgaaggagggcgagcggaagaagcugcgcccgcgguggcucgacgcgcgcaccuacagcgacccccaggcccugcgggaguucaaggaguucgccgccggccgccgguccgugagcggggaccugauccucgagaucggcaagcugccccagcaccugacccagcgcgcgcagaacgcccucgacaaccuggucaugcugcacaacuccgagcagggcgggaaggccuaccggcacgccauggaggagcuccccgacaccaucgagacgcugaugcugcucgcccugaucgcggugcugaccgggggcgugacccucuucuuccugagcggccgcgggcugggcaagaccuccaucgggcuccugugcgucauggccagcuccgugcugcucuggguggccagcgucgagccgcacuggaucgccgccuccaucauccuggaguucuuccugauggugcuccugauccccgagcccgaccggcagcgcacgccgcaggacaaccagcuggcguacguggucaucggccuccuguucaugauccugaccguggccgccaacgagauggggcuccuggagaccaccaagaaggaccugggcaucggccacguggccgucgagaaccaccaccacgccaccaugcucgacguggaccugcggcccgcgagcgccuggacgcuguacgccguggccaccaccaucaucacccccaugaugcgccacacgaucgagaacaccaccgccaacaucucccucaccgcgaucgccaaccaggccgccauccugauggggcuggacaagggcuggcccaucagcaagauggacaucggggucccgcuccuggcgcugggcugcuacucccaggugaacccccucacgcugaucgccgccgugcugaugcucgucgcccacuacgccaucaucgggcccggccugcaggcgaaggccacccgggaggcccagaagcgcaccgccgccggcaucaugaagaaccccaccguggacgggaucguggcgaucgaccuggacccggucguguacgacgccaaguucgagaagcagcucggccagaucaugcugcugauccucugcacgagccagauccugcugaugcgcaccaccugggcccucugcgaguccaucacccuggccacggggccccugaccacccucugggagggcagccccggcaaguucuggaacaccacgaucgccguguccauggcgaacaucuuccgggggagcuaccuggccggcgccgggcuggccuucucccucaugaagucccugggcgggggccgccggggcaccggggcgcagggcgagacccugggggagaaguggaagcgccagcucaaccagcugagcaaguccgaguucaacaccuacaagcggagcggcaucauggaggucgaccgcuccgaggccaaggaggggcugaagcggggcgagacgaccaagcacgccgugagccgcggcaccgccaagcuccggugguucguggagcgcaaccuggucaagcccgaggggaaggugaucgaccugggcugcgggcggggcgggugguccuacuacugcgccggccugaagaaggugaccgaggucaagggcuacacgaagggcgggccggggcacgaggagcccauccccauggcgaccuacggcuggaaccucgugaagcugcacagcgggaaggacguguucuucacgcccccggagaagugcgacacccugcucugcgacaucggcgaguccagccccaaccccacgaucgaggagggccgcacccugcggguccugaagaugguggagcccuggcuccgcgggaaccaguucugcaucaagauccugaacccguacaugcccuccguggucgagacccuggagcagaugcagcggaagcacggcgggaugcucgugcgcaacccccugagccggaacuccacccacgagauguacugggugagcugcggcacgggcaacaucgucuccgccgugaacaugaccagccgcaugcugcucaaccgguucaccauggcccaccgcaagcccaccuacgagcgcgacguggaccugggggccggcacccggcacgucgccguggagccggaggucgcgaaccuggacaucaucgggcagcgcaucgagaacaucaagaacgagcacaaguccacguggcacuacgacgaggacaaccccuacaagaccugggccuaccacggcagcuacgaggugaagcccuccgggagcgccuccagcauggugaacggcgucgugcggcuccugaccaagcccugggacgugaucccgauggucacccagaucgccaugacggacaccacccccuucggccagcagcgcguguucaaggagaagguggacacccggacgcccaaggccaagcgcgggaccgcgcagaucauggaggucaccgcccgguggcuguggggcuuccucagccgcaacaagaagccgcggaucugcacccgcgaggaguucacgcggaaggugcgcuccaacgccgccaucggggcgguguucgucgacgagaaccaguggaacagcgccaaggaggccguggaggacgagcgguucugggaccuggugcaccgcgagcgggagcugcacaagcagggcaagugcgcgaccugcgucuacaacaugauggggaagcgcgagaagaagcucggcgaguucggcaaggccaaggggucccgggcgaucugguacauguggcugggcgcccgcuuccuggaguucgaggcccucggguucaugaacgaggaccacugguucagccgggagaacucccugagcggcguggagggggagggccugcacaagcucggcuacauccugcgcgacaucuccaagauccccgggggcaacauguacgccgacgacaccgccgggugggacacccggaucacggaggacgaccugcagaacgaggcgaagaucaccgacaucauggagcccgagcacgcccuccuggccaccagcaucuucaagcugaccuaccagaacaaggugguccgcgugcagcgccccgccaagaacggcacggugauggacgucaucucccggcgcgaccagcggggcagcggccaggugggcaccuacgggcucaacaccuucaccaacauggaggugcagcugauccgccagauggaguccgagggcaucuucagcccguccgagcuggagacgcccaaccucgccgagcggguccuggacuggcuggagaagcacgggguggagcgccucaagcggauggcgaucagcggcgacgacugcguggucaagcccaccgacgaccgcuucgccaccgcccugaccgcccugaacgacaugggcaaggugcggaaggacaucccccagugggagccguccaagggguggaacgacuggcagcagguccccuucugcagccaccacuuccaccagcucaucaugaaggacggccgcgagaucgucgugcccugccggaaccaggacgagcugguggggcgcgcccgggucucccagggcgcgggguggagccugcgcgagacggccugccucggcaagagcuacgcccagauguggcagcugauguacuuccaccggcgcgaccugcggcucgccgcgaacgccaucugcuccgccgugcccaucgacugggugccgaccagccgcaccaccugguccauccacgcccaccaccaguggaugacgaccgaggacaugcugagcgucuggaaccggguguggaucgaggagaaccccuggauggaggacaagacccacguguccagcugggaggacguccccuaccugggcaagcgcgaggaccaguggugcgggucccucaucggccugaccgcccgcgcgacgugggccaccaacauccagguggccaucaaccaggugcggcgccugaucgggaacgagaacuaccucgacuacaugaccagcaugaagcgguucaagaacgaguccgaccuggagggcgcccugugguga

SEQ ID NO: 8960 - RNA, 9879 nt, Artificial Sequence
  derived and/or modified CDS sequence (opt1) from DENV-1__KR024708__SS-prME
agcgugaccaugcugcucaugcugcugcccaccgcccucgccuuccaccugaccacccggggcggggagccccacaugaucgugagcaagcaggagcggggcaagagccuccuguucaagaccuccgccggggugaacaugugcacccugaucgccauggaccugggcgagcucugcgaggacacgaugaccuacaagugcccccggaucaccgaggccgagcccgacgacguggacugcuggugcaacgccaccgacaccugggugaccuacgggaccugcagccagaccggcgagcaccggcgcgacaagcgguccguggcccuggcgccccacgugggccuggggcucgagacccgcaccgagaccuggaugagcuccgagggcgccuggaagcagauccagaagguggagaccugggcccugcggcaccccggguucacggugaucgcccuguuccucgcgcacgccaucggcaccagcaucacccagaaggggaucaucuucauccugcugaugcucgugacccccuccauggccaugcgcugcgucggcaucggcaaccgggacuucguggaggggcugagcggcgccacguggguggacgucgugcuggagcacggguccugcgugaccaccauggccaagaacaagcccacccucgacaucgagcugcugaagacggaggucaccaaccccgcggugcuccgcaagcugugcaucgaggccaagaucagcaacaccaccacggacucccggugccccacccagggcgaggccacccugguggaggagcaggacgccaacuucgucugccgccggaccuucguggaccgcggcugggggaacggcugcggccucuucggcaaggggagccugcugacgugcgccaaguucaagugcgugaccaagcucgagggcaagaucguccaguacgagaaccugaaguacuccgugaucgugaccguccacaccggcgaccagcaccagguggggaacgagacgaccgagcacggcaccaucgcgaccaucacgccccaggcccccacgagcgagauccagcugaccgacuacggggcccucacccuggacugcagcccccggaccggccuggacuucaacgagaugguccuccugacgaugaaggagaaguccuggcuggugcacaagcagugguuccucgaccugccgcugcccuggaccuccggggccagcaccagccaggagaccuggaaccgccaggaccuccuggugacguucaagaccgcccacgcgaagaagcaggaggucguggugcugggcucccaggagggcgccaugcacaccgcccucaccggggccacggagauccagaccagcggcaccaccacgaucuucgccgggcaccugaagugccggcugaagauggacaagcucacccugaagggcgucuccuacgugaugugcaccgggagcuucaagcuggagaaggagguggcggagacccagcacggcacgguccugguccaggugaaguacgagggcaccgacgcccccugcaagauccccaucuccacccaggacgagaagggggucacccagaacggccgccucaucacggccaacccgaucgugaccgacaaggagaagcccgugaacaucgagaccgagccgcccuucggggagagcuacaucgucaucggcgccggcgagaaggcgcugaagcuguccugguucaagaaggggagcuccaucggcaagauguucgaggccaccgcccgcggggcccgccggauggccauccucggcgacacggcgugggacuucgggagcaucggcggcguguucaccuccguggggaagcugguccaccagguguucggcaccgccuacggggugcuguucagcggcgucuccuggaccaugaagaucgggaucggcauccuccugacguggcugggccucaacagccgcuccaccagccuguccaugaccugcaucgccguggggauggugacccuguaccucggcgucauggugcaggccgacagcgggugcgugaucaacuggaagggccgcgagcugaagugcggguccggcaucuucgucacgaacgaggugcacaccuggaccgagcaguacaaguuccaggccgacagcccgaagcggcugagcgcggccaucggcaaggccugggaggagggggugugcggcauccgcuccgccacccggcucgagaacaucauguggaagcagaucagcaacgagcugaaccacauccugcucgagaacgacaugaaguucaccgucguggugggggacgccaacggcauccugacgcaggggaagaagaugauccgcccccagcccauggagcacaaguacuccuggaaguccuggggcaaggcgaagaucaucggcgccgacacccagaacaccaccuucaucaucgacgggcccgacacgccggagugccccgacgaccagcgggccuggaacaucugggaggucgaggacuacggcuucgggguguucaccaccaacaucuggcugaagcuccgcgacuccuacacccagaugugcgaccaccggcugaugagcgccgcgaucaaggacuccaaggccgugcacgccgacaugggcuacuggaucgagagcgagaagaacgagacguggaagcuggcccgcgccuccuucaucgaggucaagaccugcaucuggccccggagccacacccucugguccaacggcgugcuggagagcgagaugaucauccccaagaucuacgggggcccgaucucccagcacaacuaccgccccggguacuucacccagacggcgggccccuggcaccuggggaagcucgagcuggacuucaaccugugcgagggcaccaccguggucguggacgagcacugcggcaaccgggggccgagccuccgcaccacgaccgugaccggcaagaucauccacgaguggugcugccgguccugcacccugccgccccugcgcuuccgcggggaggacggcugcugguacgggauggagauccgccccgucaaggagaaggaggagaaccucgugcggagcaugguguccgccggcagcggcgaggucgacagcuucucccuggggcugcucugcgugagcaucaugaucgaggaggugaugcgcucccgguggagccgcaagaugcugaugacgggcacccuggccgucuucuuccuccugaucauggggcagcugaccuggaacgaccucauccgccugugcaucauggugggcgccaacguguccgaccggauggggaugggcaccacguaccuggcccucauggcgaccuucaagaugcgcccgauguucgccgucgggcugcuguuccggcgccucaccagccgggaggugcugcugcucaccaucgggcugucccuggucgccagcguggagcuccccaacucccuggaggagcugggcgacgggcucgccaugggcaucaugaugcugaagcugcucacggacuuccagagccaccagcuguggaccacccugcucucccugaccuucaucaagacgacccugagccucgacuacgccuggaagaccauggcgauggugcuguccaucgucagccuguucccccucugccuguccaccacgagccagaagaccaccuggcugcccgugcuccugggcuccuucgggugcaagccgcugaccauguuccucaucaccgagaacaagaucuggggccgcaagagcuggccccugaacgaggggaucauggccgugggcaucgucuccauccugcucagcagccugcugaagaacgacgugccccucgccgggccccugaucgccggcggcaugcugaucgcgugcuacgugaucuccgggagcuccgccgaccucagccuggagcgggccgccgaggucuccugggaggaggaggccgagcacagcggcgcgucccacaacauccugguggaggugcaggacgacgggacgaugaagaucaaggacgaggagcgcgacgacacccucaccauccugcugaaggccacccuccuggccgucagcggcguguacccgauguccauccccgccacgcuguucgugugguacuucuggcagaagaagaagcagcggagcgggguccucugggacacccccagcccgcccgagguggagcgcgccgugcuggacgacggcaucuaccggauccugcagcgcggccugcucgggcggagccaggucggcguggggguguuccaggacggcgucuuccacaccauguggcacgugacccgcggggcggugcugauguaccagggcaagcggcuggagcccuccugggccagcgucaagaaggaccucaucuccuacggcgggggcuggcgcuuccaggggagcuggaacacgggcgaggagguccaggugaucgccgucgagcccgggaagaaccccaagaacgugcagaccacccccggcaccuucaagacgcccgagggcgaggugggggccaucgcccuggacuucaagcccggcaccuccgggagccccaucgucaaccgggagggcaagaucgugggccuguacgggaacggcguggucaccaccuccgggacguacgugagcgcgaucgcccaggccaaggccagccaggagggcccgcuccccgagaucgaggacgagguguucaagaagcgcaaccugaccaucauggaccugcaccccggguccggcaagacccggcgcuaccucccggccaucguccgggaggcgaucaagcgcaagcugcgcacccugauccucgcccccacgcgggugguggccagcgagauggccgaggcgcugaagggcaugcccauccgcuaccagaccaccgccgucaaguccgagcacaccgggaaggagaucguggaccugaugugccacgccacguucaccaugcggcuccugagccccgugcgcgucccgaacuacaacaugaucaucauggacgaggcccacuucaccgaccccgccuccaucgcggcccggggcuacaucagcacccgcguggggaugggcgaggccgccgccaucuucaugacggcgacgccgcccggguccguggagagcuucccgcaguccaacgccgucauccaggacgaggagcgggacauccccgagcgcagcuggaacuccggcuacgacuggaucaccgacuuccccggcaagaccgugugguucgugcccagcaucaaguccgggaacgacaucgccaacugccugcggaagaacggcaagcgcgucauccagcucagccggaagacguucgacaccgaguaccagaagaccaagaacaacgacugggacuacguggugaccacggacaucuccgagaugggggccaacuuccgcgccgaccgggucaucgacccgcgccggugccugaagcccgugauccugaaggacggccccgagcgcgucauccucgcggggcccaugccggugaccgccgccagcgccgcgcagcggcgcggccggaucggccgcaaccagaacaaggagggggaccaguacaucuacaugggccagccccugaacaacgacgaggaccacgcccacuggaccgaggccaagaugcugcucgacaacaucaacacccccgaggggaucauccccgcccuguucgagccggagcgcgagaaguccgccgcgaucgacggcgaguaccggcugcgcggggaggcccggaagacguucguggagcucaugcgccggggcgaccugcccgucuggcugagcuacaagguggccuccgagggcuuccaguacagcgaccgccgguggugcuucgacggggagcgcaacaaccaggugcucgaggagaacauggacgucgagaucuggaccaaggagggcgagcggaagaagcugcgcccccgguggcuggacgcccgcaccuacagcgacccccucgcccugcgggaguucaaggaguucgcggccgggcgccgguccgugagcggcgaccugauccucgagaucggcaagcugccgcagcaccugacccuccgcgcccagaacgcccuggacaaccuggugaugcuccacaacuccgagcagggcgggaaggccuaccggcacgcgauggaggagcugcccgacaccaucgagacgcugaugcuccuggcccugaucgccguccucaccgggggcgugacccuguucuuccugagcgggaagggccucggcaagaccuccaucgggcugcugugcgugauggccagcuccguccuccuguggauggcgagcguggagccccacuggaucgccgccuccaucauccuggaguucuuccucauggugcugcugauccccgagccggaccgccagcggacgccccaggacaaccagcucgccuacgucgugaucggccugcuguucaugauccucaccguggccgcgaacgagauggggcugcuggagaccaccaagaaggaccucggcaucgggcacgucguggccgagaaccaccaccacgccacgaugcuggacaucgaccugcaccccgccagcgccuggacccucuacgcgguggccaccaccaucaucacgccgaugaugcgccacaccaucgagaacaccaccgccaacaucucccugacggccaucgccaaccaggcggccauccugaugggccucgacaagggcuggcccaucagcaagauggacaucggggucccccugcuggcccucggcugcuacucccaggugaacccccugacccugaccgccgccgugcucaugcuggucgcgcacuacgccaucaucgggccgggccugcaggccaaggccacccgggaggcgcagaagcgcacggccgccgggaucaugaagaaccccaccguggacggcaucguggccaucgaccucgaccccgucguguacgacgccaaguucgagaagcagcugggccagaucaugcugcucauccugugcaccagccagauccugcucaugcgcaccacgugggcgcugugcgaguccaucacccuggccaccgggccccucaccacgcugugggagggcagcccggggaaguucuggaacaccaccaucgccguguccauggccaacaucuuccggggcagcuaccuggccggcgcggggcucgccuucucccugaugaagucccugggcgggggccgccgggggaccggcgcccagggcgagacgcucggggagaaguggaagcgccagcugaaccagcugagcaaguccgaguucaacaccuacaagcggagcggcaucauggaggucgaccgcuccgaggccaaggaggggcucaagcggggcgagaccaccaagcacgccgugagccgcgggacggcgaagcugcggugguucguggagcgcaaccuggucaagcccgagggcaaggugaucgaccugggcugcgggcggggcgggugguccuacuacugcgccggccucaagaaggugaccgaggucaagggguacaccaagggcggccccgggcacgaggagcccaucccgauggccaccuacggcuggaacaucgugaagcugcacagcgggcgcgacguguucuucacgccgcccgagaagugcgacacgcugcucugcgacaucggcgaguccagccccaacccgaccaucgaggaggggcggacccugcgcguccugaagaugguggagcccuggcuccggggcaaccaguucugcaucaagauccugaaccccuacaugcccuccguggucgagacccuggagcagaugcagcgcaagcacggcgggaugcucgugcggaacccgcugagccgcaacuccacgcacgagauguacugggugagcugcggcaccgggaacaucgucuccgccgugaacaugaccagccggaugcugcucaaccgcuucaccauggcgcaccgcaagcccacguacgagcgggacguggaccugggcgccggcacccgccacgucgccguggagcccgagaucgccaaccuggacaucaucgggcagcggaucgagaacaucaagaacgagcacaaguccaccuggcacuacgacgaggacaaccccuacaagaccugggccuaccacggcagcuacgaggugaagccguccgggagcgcguccagcauggucaacggcgugguccgccuccugacgaagcccugggacgugauccccauggugacccagaucgccaugaccgacaccacgcccuucgggcagcagcgggucuucaaggagaagguggacacccgcaccccgcggcccaagcgcggcaccgcccagaucauggaggugacggccaaguggcuguggggcuuccucagccggaacaagaagccccgcaucugcacccgggaggaguucacccgcaagguccgguccaacgccgcgaucggggccguguucguggacgagaaccaguggaacagcgccaaggaggccgucgaggacgagcgcuucugggaccuggugcaccgggagcgcgagcugcacaagcagggcaagugcgcgaccugcguguacaacaugauggggaagcgggagaagaagcucggcgaguucgggaaggcgaagggcucccgcgccaucugguacauguggcugggcgcccgguuccuggaguucgaggcccucggguucaugaacgaggaccacugguucagccgcgagaacucccugagcggcgucgagggggagggccugcacaagcucggguacauccugcgggacaucuccaagaucccgggcggcaacauguacgcggacgacacggccgggugggacacccgcaucaccgaggacgaccugcagaacgaggccaagaucaccgacaucauggagcccgagcacgcccuccuggccacgagcaucuucaagcugaccuaccagaacaagguggugcgcguccagcggcccgcgaaguccggcaccgugauggacgugaucagccgccgggaccagcgcggguccggccaggucggcaccuacgggcucaacacguucaccaacauggaggugcagcugauccggcagauggagagcgagggcaucuucucccccagcgagcuggagaacuccaaccucgccgagcgcgugcuggacuggcuggagaagcacggggucgagcggcucaagcgcauggccaucagcggcgacgacugcguggugaagccgaccgacgaccgguucgccaccgcccugacggcgcugaacgacauggggaagguccgcaaggacaucccccagugggagcccuccaagggcuggaacgacuggcagcagguccccuucugcagccaccacuuccaccagcucaucaugaaggacggccgggagaucguggucccgugccgcaaccaggacgagcugguggggcgggcccgcgugagccagggcgccggguggucccugcgggagaccgccugccucggcaagagcuacgcccagauguggcagcugauguacuuccaccgccgggaccugcgccucgcggccaacgccaucugcuccgccguccccgugaacugggugcccaccagccggaccaccugguccauccacgcccaccaccaguggaugacgaccgaggacaugcugagcgucuggaaccgcguguggaucgaggagaaccccuggauggaggacaagacccacguguccagcugggaggacgucccguaccuggggaagcgcgaggaccaguggugcggcucccucaucggccugaccgcgcgggccacgugggccaccaacauccagguggccaucaaccaggugcgccggcugaucgggaacgagaacuaccucgacuacaugaccagcaugaagcgcuucaagaacgaguccgaccccgagggcgcgcugugguga

SEQ ID NO: 8961 - RNA, 9879 nt, Artificial Sequence
  derived and/or modified CDS sequence (opt1) from DENV-1__KR024705__SS-prME
agcgugaccaugcugcucaugcugcugcccaccgcccucgccuuccaccugaccacccggggcggggagccccacaugaucgugagcaagcaggagcggggcaagagccuccuguucaagaccuccgccggggugaacaugugcacccugaucgccauggaccugggcgagcucugcgaggacacgaugaccuacaagugcccccggaucaccgaggccgagcccgacgacguggacugcuggugcaacgccaccgacaccugggugaccuacgggaccugcagccagaccggcgagcaccggcgcgacaagcgguccguggcccuggcgccccacgugggccuggggcucgagacgcgcaccgagaccuggaugagcuccgagggcgccuggaagcagauccagaagguggagaccugggcccugcggcaccccggguucacggugaucgcccuguuccucgcgcacgccaucggcaccagcaucacccagaaggggaucaucuucauccugcugaugcucgugacccccuccauggccaugcgcugcgucggcaucggcaaccgggacuucguggaggggcugagcggcgccacguggguggacgucgugcuggagcacggguccugcgugaccaccauggccaagaacaagcccacccucgacaucgagcugcugaagacggaggucaccaaccccgcggugcuccgcaagcugugcaucgaggccaagaucagcaacgccaccaccgacucccggugccccacgcagggcgaggccacccugguggaggagcaggacgccaacuucgucugccgccggaccuucguggaccgcggcugggggaacggcugcggccucuucggcaaggggagccugcugaccugcgcgaaguucaagugcgugacgaagcucgagggcaagaucguccaguacgagaaccugaaguacuccgugaucgugaccguccacaccggcgaccagcaccagguggggaacgagaccacggagcacggcaccaucgccaccaucacgccccaggcccccaccagcgagauccagcugacggacuacggggcccucacccuggacugcagcccccggaccggccuggacuucaacgagaugguccuccugaccaugaaggagaaguccuggcuggugcacaagcagugguuccucgaccugccgcugcccuggacguccggggccagcaccagccaggagaccuggaaccgccaggaccuccuggugaccuucaagacggcgcacgccaagaagcaggaggucguggugcugggcucccaggagggcgccaugcacaccgcccucaccggggccaccgagauccagacgagcggcaccaccaccaucuucgcggggcaccugaagugccggcugaagauggacaagcucacgcugaagggcgucuccuacgugaugugcaccgggagcuucaagcuggagaaggagguggccgagacccagcacggcaccguccugguccaggugaaguacgagggcacggacgcccccugcaagauccccaucuccacccaggacgagaagggggucacccagaacggccgccucaucaccgccaacccgaucgugacggacaaggagaagcccgugaacaucgagaccgagccgcccuucggggagagcuacaucgucaucggcgcgggcgagaaggcccugaagcuguccugguucaagaaggggagcuccaucggcaagauguucgaggccaccgcccgcggggcccgccggauggcgauccucggcgacaccgccugggacuucgggagcaucggcggcguguucacguccguggggaagcugguccaccagguguucggcaccgccuacggggugcuguucagcggcgucuccuggaccaugaagaucgggaucggcauccuccugaccuggcugggccucaacagccgcuccacgagccuguccaugaccugcaucgccguggggauggugacccuguaccucggcgucauggugcaggccgacagcgggugcgugaucaacuggaagggccgcgagcugaagugcggguccggcaucuucgucaccaacgaggugcacacguggaccgagcaguacaaguuccaggcggacagcccgaagcggcugagcgccgccaucggcaaggccugggaggagggggugugcggcauccgcuccgccacccggcucgagaacaucauguggaagcagaucagcaacgagcugaaccacauccugcucgagaacgacaugaaguucaccgucguggugggggacgcgaacggcauccugacccaggggaagaagaugauccgcccccagcccauggagcacaaguacuccuggaaguccuggggcaaggccaagaucaucggcgccgacacgcagaacaccaccuucaucaucgacgggcccgacaccccggagugccccgacgaccagcgggccuggaacaucugggaggucgaggacuacggcuucgggguguucacgaccaacaucuggcugaagcuccgcgacuccuacacccagaugugcgaccaccggcugaugagcgcggccaucaaggacuccaaggccgugcacgccgacaugggcuacuggaucgagagcgagaagaacgagaccuggaagcuggcccgcgcguccuucaucgaggucaagacgugcaucuggccccggagccacacccucugguccaacggcgugcuggagagcgagaugaucauccccaagaucuacgggggcccgaucucccagcacaacuaccgccccggguacuucacccagaccgccggccccuggcaccuggggaagcucgagcuggacuucaaccugugcgagggcacgaccguggucguggacgagcacugcggcaaccgggggccgagccuccgcaccaccacggugaccggcaagaucauccacgaguggugcugccgguccugcacccugccgccccugcgcuuccgcggggaggacggcugcugguacgggauggagauccgccccgucaaggagaaggaggagaaccucgugcggagcaugguguccgccggcagcggcgaggucgacagcuucucccuggggcugcucugcgugagcaucaugaucgaggaggugaugcgcucccgguggagccgcaagaugcugaugaccggcacgcuggccgucuucuuccuccugaucauggggcagcugaccuggaacgaccucauccgccugugcaucauggugggcgccaacguguccgaccggauggggaugggcaccaccuaccuggcgcucauggccacguucaagaugcgcccgauguucgccgucggccugcuguuccggcgccucaccagccgggaggugcugcugcucaccaucgggcugucccuggucgccagcguggagcuccccaacucccuggaggagcugggcgacgggcucgccaugggcaucaugaugcugaagcugcucaccgacuuccagagccaccagcuguggacgacccugcucucccugaccuucaucaagaccacgcugagccucgacuacgcguggaagaccauggccauggugcuguccaucgucagccuguucccccucugccuguccaccaccagccagaagacgaccuggcugcccgugcuccugggcuccuucgggugcaagccgcugaccauguuccucaucaccgagaacaagaucuggggccgcaagagcuggccccugaacgaggggaucauggccgugggcaucgucuccauccugcucagcagccugcugaagaacgacgugccccucgccgggccccugaucgcgggcggcaugcugaucgccugcuacgugaucuccgggagcuccgccgaccucagccuggagcgggccgccgaggucuccugggaggaggaggcggagcacagcggcgccucccacaacauccugguggaggugcaggacgacgggaccaugaagaucaaggacgaggagcgcgacgacacgcucaccauccugcugaaggccacccuccuggccgucagcggcguguacccgauguccauccccgccacccuguucgugugguacuucuggcagaagaagaagcagcggagcgggguccucugggacacgcccagcccgcccgagguggagcgcgcggugcuggacgacggcaucuaccggauccugcagcgcggccugcucgggcggagccaggucggcguggggguguuccaggacggcgucuuccacaccauguggcacgugacccgcggggccgugcugauguaccagggcaagcggcuggagcccuccugggccagcgucaagaaggaccucaucuccuacggcgggggcuggcgcuuccaggggagcuggaacaccggcgaggagguccaggugaucgccgucgagcccgggaagaaccccaagaacgugcagacgacccccggcaccuucaagacccccgagggcgaggugggggccaucgcgcuggacuucaagcccggcacguccgggagccccaucgucaaccgggagggcaagaucgugggccuguacgggaacggcguggucaccaccuccgggaccuacgugagcgccaucgcccaggccaaggccagccaggagggcccgcuccccgagaucgaggacgagguguucaagaagcgcaaccugacgaucauggaccugcaccccggguccggcaagacccggcgcuaccucccggcgaucguccgggaggccaucaagcgcaagcugcgcacccugauccucgcccccacccgggugguggccagcgagauggcggaggcccugaagggcaugcccauccgcuaccagacgaccgccgucaaguccgagcacaccgggaaggagaucguggaccugaugugccacgccaccuucacgaugcggcuccugagccccgugcgcgucccgaacuacaacaugaucaucauggacgaggcccacuucaccgaccccgcguccaucgccgcccggggcuacaucagcacccgcguggggaugggcgaggccgccgcgaucuucaugaccgccacgccgcccggguccguggaggccuucccgcagagcaacgccgucauccaggacgaggagcgggacauccccgagcgcuccuggaacagcggcuacgacuggaucaccgacuuccccggcaagaccgugugguucgugcccuccaucaagagcgggaacgacaucgccaacugccugcggaagaacggcaagcgcgucauccagcucucccggaagaccuucgacacggaguaccagaagaccaagaacaacgacugggacuacguggugaccaccgacaucagcgagaugggggcgaacuuccgcgccgaccgggucaucgacccgcgccggugccugaagcccgugauccugaaggacggccccgagcgcgucauccucgccgggcccaugccggugacggccgcguccgccgcccagcggcgcggccggaucggccgcaaccagaacaaggagggggaccaguacaucuacaugggccagccccugaacaacgacgaggaccacgcccacuggaccgaggccaagaugcugcucgacaacaucaacacccccgaggggaucauccccgcgcuguucgagccggagcgcgagaaguccgccgccaucgacggcgaguaccggcugcgcggggaggcccggaagaccuucguggagcucaugcgccggggcgaccugcccgucuggcuguccuacaagguggccagcgagggcuuccaguacuccgaccgccgguggugcuucgacggggagcgcaacaaccaggugcucgaggagaacauggacgucgagaucuggacgaaggagggcgagcggaagaagcugcgcccccgguggcuggacgcgcgcaccuacagcgacccccucgcccugcgggaguucaaggaguucgccgccgggcgccggagcguguccggcgaccugauccucgagaucggcaagcugccgcagcaccugacccuccgcgcccagaacgcgcuggacaaccuggugaugcuccacaacagcgagcagggcgggaaggccuaccggcacgccauggaggagcugcccgacaccaucgagacccugaugcuccuggcccugaucgcgguccucaccggcggggugacccuguucuuccuguccgggaaggggcucggcaagaccagcaucgggcugcugugcgugauggccuccagcguccuccuguggauggccuccguggagccccacuggaucgccgccagcaucauccuggaguucuuccucauggugcugcugauccccgagccggaccgccagcggacgccccaggacaaccagcucgcguacgucgugaucggccugcuguucaugauccucacgguggccgccaacgagauggggcugcuggagaccaccaagaaggaccucggcaucgggcacgucguggccgagaaccaccaccacgccaccaugcuggacaucgaccugcaccccgcguccgccuggacgcucuacgccguggccaccaccaucaucaccccgaugaugcgccacacgaucgagaacaccaccgccaacaucagccugaccgcgaucgccaaccaggccgccauccugaugggccucgacaagggcuggcccaucuccaagauggacaucggggucccccugcuggcccucggcugcuacagccaggugaacccccugacgcugaccgcggccgugcucaugcuggucgcccacuacgccaucaucgggccgggccugcaggcgaaggccacccgggaggcccagaagcgcaccgccgccgggaucaugaagaaccccacgguggacggcaucguggcgaucgaccucgaccccgucguguacgacgccaaguucgagaagcagcugggccagaucaugcugcucauccugugcaccucccagauccugcucaugcgcaccaccugggcccugugcgagagcaucacgcuggccaccgggccccucaccacccugugggagggcuccccggggaaguucuggaacacgaccaucgccgugagcauggcgaacaucuuccggggcuccuaccuggccggcgccgggcucgccuucagccugaugaagucccugggcgggggccgccgggggaccggcgcccagggcgagacccucggggagaaguggaagcgccagcugaaccagcugagcaagagcgaguucaacacguacaagcgguccggcaucauggaggucgaccgcagcgaggcgaaggaggggcucaagcggggcgagaccaccaagcacgccgugucccgcgggaccgccaagcugcggugguucguggagcgcaaccuggucaagcccgagggcaaggugaucgaccugggcugcgggcggggcggguggagcuacuacugcgccggccucaagaaggugacggaggucaagggguacaccaagggcggccccgggcacgaggagcccaucccgauggcgaccuacggcuggaacaucgugaagcugcacuccgggcgcgacguguucuucacgccgcccgagaagugcgacacccugcucugcgacaucggcgagagcucccccaacccgacgaucgaggaggggcggacccugcgcguccugaagaugguggagcccuggcuccggggcaaccaguucugcaucaagauccugaaccccuacaugcccagcguggucgagacccuggagcagaugcagcgcaagcacggcgggaugcucgugcggaacccgcugucccgcaacagcacccacgagauguacuggguguccugcggcacggggaacaucgucagcgccgugaacaugaccucccggaugcugcucaaccgcuucaccauggcccaccgcaagcccaccuacgagcgggacguggaccugggcgccggcacgcgccacgucgccguggagcccgagaucgcgaaccuggacaucaucgggcagcggaucgagaacaucaagaacgagcacaagagcaccuggcacuacgacgaggacaaccccuacaagaccugggccuaccacggcuccuacgaggugaagccgagcggguccgccagcuccauggucaacggcgugguccgccuccugaccaagcccugggacgugauccccauggugacgcagaucgccaugaccgacaccacccccuucgggcagcagcgggucuucaaggagaagguggacacgcgcaccccgcggcccaagcgcggcaccgcccagaucauggaggugaccgcgaaguggcuguggggcuuccucagccggaacaagaagccccgcaucugcacgcgggaggaguucacccgcaagguccggagcaacgccgccaucggggccguguucguggacgagaaccaguggaacuccgccaaggaggcggucgaggacgagcgcuucugggaccuggugcaccgggagcgcgagcugcacaagcagggcaagugcgcgaccugcguguacaacaugauggggaagcgggagaagaagcucggcgaguucgggaaggccaagggcagccgcgccaucugguacauguggcugggcgcgcgguuccuggaguucgaggcccucggguucaugaacgaggaccacugguucucccgcgagaacagccuguccggcgucgagggggagggccugcacaagcucggguacauccugcgggacaucagcaagaucccgggcggcaacauguacgccgacgacaccgccgggugggacacgcgcaucaccgaggacgaccugcagaacgaggccaagaucaccgacaucauggagcccgagcacgcgcuccuggccaccuccaucuucaagcugacguaccagaacaagguggugcgcguccagcggcccgccaagagcggcaccgugauggacgugaucucccgccgggaccagcgcgggagcggccaggucggcaccuacgggcucaacaccuucacgaacauggaggugcagcugauccggcagauggaguccgagggcaucuucagccccuccgagcuggagaacagcaaccucgccgagcgcgugcuggacuggcuggagaagcacggggucgagcggcucaagcgcauggccaucuccggcgacgacugcguggugaagccgaccgacgaccgguucgcgaccgcccugaccgcccugaacgacauggggaagguccgcaaggacaucccccagugggagcccagcaagggcuggaacgacuggcagcagguccccuucugcucccaccacuuccaccagcucaucaugaaggacggccgggagaucguggucccgugccgcaaccaggacgagcugguggggcgggcccgcgugagccagggcgccggguggagccugcgggagacggcgugccucggcaaguccuacgcccagauguggcagcugauguacuuccaccgccgggaccugcgccucgccgccaacgccaucugcagcgcgguccccgugaacugggugcccaccucccggaccaccuggagcauccacgcccaccaccaguggaugaccacggaggacaugcuguccgucuggaaccgcguguggaucgaggagaaccccuggauggaggacaagacccacgugagcuccugggaggacgucccguaccuggggaagcgcgaggaccaguggugcggcagccucaucggccugaccgcccgggccaccugggcgacgaacauccagguggccaucaaccaggugcgccggcugaucgggaacgagaacuaccucgacuacaugaccuccaugaagcgcuucaagaacgagagcgaccccgagggcgcccugugguga

SEQ ID NO: 8962 - RNA, 9879 nt, Artificial Sequence
  derived and/or modified CDS sequence (opt1) from DENV-1__KR024706__SS-prME
agcgugaccaugcugcucaugcugcugcccaccgcccucgccuuccaccugaccacccgcggcggggagccccacaugaucgugagcaagcaggagcggggcaagagccuccuguucaagaccuccgcgggggugaacaugugcacccugaucgccauggaccugggcgagcucugcgaggacacgaugaccuacaagugcccccgcaucaccggggccgagcccgacgacguggacugcuggugcaacgccaccgacaccugggugaccuacgggaccugcagccagaccggcgagcaccggcgcgacaagcgguccguggcccuggcgccccacguggggcugggccucgagacccgcaccgagaccuggaugagcuccgagggggccuggcggcagauccagaaggucgagaccugggcccugcgccaccccggcuucacggugaucgccuucuuccuggcgcacgccaucgggaccagcaucacccagaagggcaucaucuucauccuccugaugcuggugacccccuccauggccaugcggugcgucggcaucgggaaccgcgacuucguggagggccucagcggggccacguggguggacgucgugcuggagcacggcuccugcgugaccaccauggccaagaacaagcccacccuggacaucgagcuccugaagacggaggucaccaaccccgcggugcugcggaagcucugcaucgaggccaagaucagcaacaccaccacggacucccgcugcccgacccagggcgaggccacccugguggaggagcaggacgccaacuucgucugccggcgcacccugguggaccggggguggggcaacgggugcggccucuucgggaagggcagccugcugacgugcgccaaguucaagugcgugaccaagcucgagggcaagaucguccaguacgagaaccugaaguacuccgugaucgugaccguccacaccggggaccagcaccaggugggcaacgagacgaccgagcacgggaccaucgcgaccaucacgccccaggcccccacgagcgagauccagcugaccgacuacggcgcccucacccuggacugcagcccccggaccgggcuggacuucaacgagaugguccuccugacgaugaaggagaaguccuggcuggugcacaagcagugguuccucgaccugccgcugcccuggaccuccggcgccagcaccagccaggagaccuggaaccggcaggaccuccuggugacguucaagaccgcccacgcgaagaagcaggaggucguggugcugggcucccaggagggggccaugcacaccgcccucaccggcgccacggagauccagaccagcgggaccaccacgaucuucgccggccaccugaagugccgccugaagauggacaagcucacccugaagggggucuccuacgugaugugcaccggcagcuucaagcuggagaaggagguggcggagacccagcacggcacgguccugguccaggugaaguacgaggggaccgacgcccccugcaagauccccaucuccacccaggacgagaagggcgucacccagaacgggcggcucaucacggccaacccgaucgugaccgacaaggagaagcccgugaacaucgagaccgagccgcccuucggcgagagcuacaucgucaucggcgccggggagaaggcgcugaagcuguccugguucaagaagggcagcuccaucgggaagauguucgaggccaccgcccgcggcgcccggcgcauggccauccucggggacacggcgugggacuucggcagcaucggcgggguguucaccuccgugggcaagcugguccaccagguguucgggaccgccuacggcgugcuguucagcggggucuccuggaccaugaagaucggcaucggcauccuccugacguggcuggggcucaacagccgcuccaccagccuguccaugaccugcaucgccgugggcauggugacccuguaccucggggucauggugcaggccgacagcggcugcgugaucaacuggaaggggcgggagcugaagugcggcuccggcaucuucgucacgaacgaggugcacaccuggaccgagcaguacaaguuccaggccgacagcccgaagcgccugagcgcggccaucgggaaggccugggaggagggcgugugcgggauccgguccgccacccgccucgagaacaucauguggaagcagaucagcaacgagcugaaccacauccugcucgagaacgacaugaaguucaccgucguggugggcgacgccaacgggauccugacgcagggcaagaagaugauccggccccagcccauggagcacaaguacuccuggaaguccuggggcaaggcgaagaucaucggggccgacacccagaacaccaccuucaucaucgacggccccgacacgccggagugccccgacgaccagcgcgccuggaacaucugggaggucgaggacuacggguucggcguguucaccaccaacaucuggcugaagcuccgggacuccuacacccagaugugcgaccaccgccugaugagcgccgcgaucaaggacuccaaggccgugcacgccgacaugggcuacuggaucgagagcgagaagaacgagacguggaagcuggcccgggccuccuucaucgaggucaagaccugcaucuggccccgcagccacacccucugguccaacggggugcuggagagcgagaugaucauccccaagaucuacggcgggccgaucucccagcacaacuaccggcccggcuacuucacccagacggcggggcccuggcaccugggcaagcucgagcuggacuucaaccugugcgagggcaccaccguggucguggacgagcacugcgggaaccgcggcccgagccuccggaccacgaccgugaccgggaagaucauccacgaguggugcugccgcuccugcacccugccgccccugcgguuccgcggcgaggacgggugcugguacggcauggagauccggcccgucaaggagaaggaggagaaccucgugcgcagcaugguguccgccggcagcggggaggucgacagcuucucccugggccugcucugcgugagcaucaugaucgaggaggugaugcggucccgcuggagccgcaagaugcugaugacggggacccuggccgucuucuuccuccugaucaugggccagcugaccuggaacgaccucauccggcugugcaucauggugggggccaacguguccgaccgcaugggcaugggcaccacguaccuggcccucauggcgaccuucaagaugcggccgauguucgccgucgggcugcuguuccgccggcucaccagccgcgaggugcugcugcucaccaucggccugucccuggucgccagcguggagcuccccaacucccuggaggagcugggggacggccucgccaugggcaucaugaugcugaagcugcucacggacuuccagagccaccagcuguggaccacccugcucucccugaccuucaucaagacgacccugagccucgacuacgccuggaagaccauggcgauggugcuguccaucgucagccuguucccccucugccuguccaccacgagccagaagaccaccuggcugcccgugcuccugggguccuucggcugcaagccgcugaccauguuccucaucaccgagaacaagaucugggggcgcaagagcuggccccugaacgagggcaucauggccguggggaucgucuccauccugcucagcagccugcugaagaacgacgugccccucgccggcccccugaucgccggcgggaugcugaucgcgugcuacgugaucuccggcagcuccgccgaccucagccuggagcgcgccgccgaggucuccugggaggaggaggccgagcacagcggggcgucccacaacauccugguggaggugcaggacgacggcacgaugaagaucaaggacgaggagcgggacgacacccucaccauccugcugaaggccacccuccuggccgucagcgggguguacccgauguccauccccgccacgcuguucgugugguacuucuggcagaagaagaagcagcgcagcggcguccucugggacacccccagcccgcccgagguggagcgggccgugcuggacgacggcaucuaccgcauccugcagcgggggcugcucggccgcagccaggucggggugggcguguuccaggacggggucuuccacaccauguggcacgugacccggggcgcggugcugauguaccagggcaagcgccuggagcccuccugggccagcgucaagaaggaccucaucuccuacgggggcggguggcgguuccagggcagcuggaacacgggggaggagguccaggugaucgccgucgagcccggcaagaaccccaagaacgugcagaccacccccggcaccuucaagacgcccgagggggaggugggcgccaucgcccuggacuucaagcccgggaccuccggcagccccaucgucaaccgcgagggcaagaucguggggcuguacggcaacgggguggucaccaccuccggcacguacgugagcgcgaucgcccaggccaaggccagccaggaggggccgcuccccgagaucgaggacgagguguucaagaagcggaaccugaccaucauggaccugcaccccggcuccggcaagacccgccgguaccucccggccaucguccgcgaggcgaucaagcgcaagcugcggacccugauccucgcccccacgcgcgugguggccagcgagauggccgaggcgcugaaggggaugcccauccgguaccagaccaccgccgucaaguccgagcacaccggcaaggagaucguggaccugaugugccacgccacguucaccaugcgccuccugagccccgugcgggucccgaacuacaacaugaucaucauggacgaggcccacuucaccgaccccgccuccaucgcggcccgcggguacaucagcacccgggugggcaugggggaggccgccgccaucuucaugacggcgacgccgcccggcuccguggaggccuucccgcagagcaacgccgucauccaggacgaggagcgcgacauccccgagcgguccuggaacagcggcuacgacuggaucaccgacuuccccgggaagaccgugugguucgugcccuccaucaagagcggcaacgacaucgccaacugccugcgcaagaacgggaagcgggucauccagcucucccgcaagacguucgacaccgaguaccagaagaccaagaacaacgacugggacuacguggugaccacggacaucagcgagaugggcgccaacuuccgggcggaccgcgucaucgacccgcggcgcugccugaagcccgugauccugaaggacgggcccgagcgggucauccucgccggccccaugccggugaccgccgccuccgcggcccagcgccggggccgcaucgggcgcaaccagaacaaggagggcgaccaguacaucuacauggggcagccccugaacaacgacgaggaccacgcccacuggaccgaggccaagaugcugcucgacaacaucaacacccccgagggcaucauccccgcccuguucgagccggagcgggagaaguccgcggccaucgacggggaguaccgccugggcggcgaggcccggaagacguucguggagcucaugaagcgcggggaccugcccgucuggcuguccuacaagguggccagcgagggcuuccaguacuccgaccggcgcuggugcuucgacggggagcggaacaaccaggugcucgaggagaacauggacgucgagaucuggaccaaggagggcgagcgcaagaagcugcggccccgcuggcuggacgcccggaccuacagcgacccccucgcgcugcgcgaguucaaggaguucgccgccggccggcgcagcguguccggggaccugauccucgagaucggcaagcugccgcagcaccugacccuccgggcccagaacgcccuggacaaccuggugaugcuccacaacagcgagcagggcgggaaggcguaccgccacgccauggaggagcugcccgacaccaucgagacgcugaugcuccuggcccugaucgccguccucaccgggggcgugacccuguucuuccuguccggcaaggggcucggcaagaccagcaucgggcugcugugcgugauggcguccagcguccuccuguggauggccuccguggagccccacuggaucgccgccagcaucauccuggaguucuuccucauggugcugcugauccccgagccggaccggcagcgcacgccccaggacaaccagcucgccuacgucgugaucggccugcuguucaugauccucaccguggcggccaacgagauggggcugcuggagaccaccaagaaggaccucggcaucggccacgucguggccgagaaccaccaccacgccacgaugcuggacaucgaccugcaccccgccuccgcguggacccucuacgccguggccaccaccaucaucacgccgaugaugcggcacaccaucgagaacaccaccgccaacaucagccugacggccaucgcgaaccaggccgccauccugauggggcucgacaagggcuggcccaucuccaagauggacaucggggucccccugcuggcccucggcugcuacagccaggugaacccccugacccugaccgccgcggugcucaugcuggucgcccacuacgccaucaucgggccgggccugcaggccaaggcgacccgcgaggcccagaagcggacggccgccggcaucaugaagaaccccaccguggacgggaucguggccaucgaccucgaccccgucguguacgacgcgaaguucgagaagcagcugggccagaucaugcugcucauccugugcaccucccagauccugcucaugcgcaccacgugggcccugugcgagagcaucacccuggccaccgggccccucaccacgcugugggagggcuccccgggcaaguucuggaacaccaccaucgccgugagcauggccaacaucuuccgcggguccuaccuggcgggcgccgggcucgccuucagccugaugaagucccugggcgggggccggcgcggcaccggggcccagggcgagacgcucggggagaaguggaagcggcagcugaaccagcugagcaagagcgaguucaacaccuacaagcgcuccggcaucauggaggucgaccggagcgaggccaaggaggggcucaagcgcggcgagaccaccaagcacgcggugucccggggcacggccaagcugcgcugguucguggagcggaaccuggucaagcccgaggggaaggugaucgaccugggcugcgggcgcggcggguggagcuacuacugcgccggccucaagaaggugaccgaggucaagggcuacaccaagggcggccccgggcacgaggagcccaucccgauggccaccuacggcuggaacaucgugaagcugcacuccgggcgggacguguucuucacgccgcccgagaagugcgacacgcugcucugcgacaucggcgagagcucccccaacccgaccaucgaggagggccgcacccugcggguccugaagaugguggagcccuggcuccgcgggaaccaguucugcaucaagauccugaaccccuacaugcccagcguggucgagacccuggagcagaugcagcggaagcacggcgggaugcucgugcgcaacccgcugucccggaacagcacgcacgagauguacuggguguccugcggcaccggcaacaucgucagcgcggugaacaugaccucccgcaugcugcucaaccgguucaccauggcccaccgcaagcccacguacgagcgcgacguggaccugggggccggcacccggcacgucgccguggagcccgagaucgccaaccuggacaucaucgggcagcgcaucgagaacaucaagaacgagcacaagagcaccuggcacuacgacgaggacaaccccuacaagaccugggcguaccacggcuccuacgaggugaagccgagcggguccgccagcuccauggucaacggcgugguccggcuccugacgaagcccugggacgugauccccauggugacccagaucgccaugaccgacaccacgcccuucggccagcagcgcgucuucaaggagaagguggacacccggaccccgcgccccaagcgggggaccgcccagaucauggaggugacggccaaguggcuguggggcuuccucagccgcaacaagaagccccggaucugcacccgcgaggaguucacccggaagguccgcagcaacgcggccaucggggccguguucguggacgagaaccaguggaacuccgccaaggaggccgucgaggacgagcgguucugggaccuggugcaccgcgagcgggagcugcacaagcagggcaagugcgcgaccugcguguacaacaugauggggaagcgcgagaagaagcucggcgaguucggcaaggccaaggggagccgggccaucugguacauguggcugggcgcccgcuuccuggaguucgaggcgcucggguucaugaacgaggaccacugguucucccgggagaacagccuguccggcgucgagggggagggccugcacaagcucggcuacauccugcgcgacaucagcaagauccccgggggcaacauguacgccgacgacacggccgggugggacacccggaucaccgaggacgaccugcagaacgaggccaagaucaccgacaucauggagcccgagcacgcccuccuggcgacguccaucuucaagcugaccuaccagaacaagguggugcgcguccagcgccccgccaagagcggcaccgugauggacgugaucucccggcgcgaccagcggggcagcgggcaggucggcaccuacgggcucaacacguucaccaacauggaggugcagcugauccgccagauggaguccgagggcaucuucagccccuccgagcuggagaacagcaaccucgccgagcgggugcuggacuggcuggagaagcacggggucgagcgccucaagcggauggccaucuccggcgacgacugcguggugaagccgaccgacgaccgcuucgccaccgcgcugacggcccugaacgacaugggcaagguccggaaggacaucccccagugggagcccagcaagggguggaacgacuggcagcucgugcccuucugcucccaccacuuccaccagcugaucaugaaggacggccgcgagaucguggucccgugccggaaccaggacgagcugguggggcgcgcccgggugagccagggcgccggguggagccuccgcgagaccgccugccugggcaaguccuacgcgcagauguggcagcugauguacuuccaccggcgcgaccuccggcuggccgccaacgccaucugcagcgccguccccgugaacugggugcccaccucccgcaccaccuggagcauccacgcgcaccaccaguggaugacgaccgaggacaugcuguccgucuggaaccggguguggaucgaggagaaccccuggauggaggacaagacccacgugagcuccugggaggacgucccguaccucggcaagcgcgaggaccaguggugcgggagccugaucggccugaccgcccgcgccacgugggccaccaacauccagguggcgaucaaccaggugcggcgccucaucgggaacgagaacuaccuggacuacaugaccuccaugaagcgguucaagaacgagagcgaccccgagggcgcccugugguga

SEQ ID NO: 8963 - RNA, 9879 nt, Artificial Sequence
  derived and/or modified CDS sequence (opt1) from DENV-1__KR024707__SS-prME
agcgugaccaugcugcucaugcugcugcccaccgcccucgccuuccaccugaccacccggggcggggagccccacaugaucgugagcaagcaggagcggggcaagagccuccuguucaagaccuccgcgggggugaacaugugcacccugaucgccauggaccugggcgagcucugcgaggacaccaugaccuacaagugcccccggaucaccgaggccgagcccgacgacguggacugcuggugcaacgccaccgacaccugggugaccuacgggaccugcagccagaccggcgagcaccggcgcgacaagcgguccguggcccuggcgccccacgugggccuggggcucgagacgcgcaccgagaccuggaugagcuccgagggcgccuggcggcagauccagaagguggagaccugggcccugcgccaccccggguucacggugaucgcccuguuccucgcgcacgccaucggcaccagcaucacccagaaggggaucaucuucauccugcugaugcucgugacccccuccauggccaugcggugcgucggcaucggcaaccgcgacuucguggaggggcugagcggcgccacguggguggacgucgugcuggagcacggguccugcgugaccaccauggccaagaacaagcccacccucgacaucgagcugcugaagacggaggucaccaaccccgcggugcuccggaagcugugcaucgaggccaagaucagcaacaccaccacggacucccgcugccccacccagggcgaggccacccugguggaggagcaggacgccaacuucgucugccggcgcaccuucguggaccggggcugggggaacggcugcggccucuucggcaaggggagccugcugacgugcgccaaguucaagugcgugaccaagcucgagggcaagaucguccaguacgagaaccugaaguacuccgugaucgugaccguccacaccggcgaccagcaccagguggggaacgagacgaccgagcacggcaccaucgcgaccaucacgccccaggcccccacgagcgagauccagcugaccgacuacggggcccucacccuggacugcagcccccggaccggccuggacuucaacgagaugguccuccugacgaugaaggagaaguccuggcuggugcacaagcagugguuccucgaccugccgcugcccuggaccuccggggccagcaccagccaggagaccuggaaccggcaggaccuccuggugacguucaagaccgcccacgcgaagaagcaggaggucguggugcugggcucccaggagggcgccaugcacaccgcccucaccggggccacggagauccagaccagcggcaccaccacgaucuucgccgggcaccugaagugccgccugaagauggacaagcucacccugaagggcgucuccuacgugaugugcaccgggagcuucaagcuggagaaggagguggcggagacccagcacggcacgguccugguccaggugaaguacgagggcaccgacgcccccugcaagauccccaucuccacccaggacgagaagggggucacccagaacggccggcucaucacggccaacccgaucgugaccgacaaggagaagcccgugaacaucgagaccgagccgcccuucggggagagcuacaucgucaucggcgccggcgagaaggcgcugaagcuguccugguucaagaaggggagcuccaucggcaagauguucgaggccaccgcccgcggggcccggcgcauggccauccucggcgacacggcgugggacuucgggagcaucggcggcguguucaccuccguggggaagcugguccaccagguguucggcaccgccuacggggugcuguucagcggcgucuccuggaccaugaagaucgggaucggcauccuccugacguggcugggccucaacagccgcuccaccagccuguccaugaccugcaucgccguggggauggugacccuguaccucggcgucauggugcaggccgacagcgggugcgugaucaacuggaagggccgggagcugaagugcggguccggcaucuucgucacgaacgaggugcacaccuggaccgagcaguacaaguuccaggccgacagcccgaagcgccugagcgcggccaucggcaaggccugggaggagggggugugcggcauccgguccgccacccgccucgagaacaucauguggaagcagaucagcaacgagcugaaccacauccugcucgagaacgacaugaaguucaccgucguggugggggacgccaacggcauccugacgcaggggaagaagaugauccggccccagcccauggagcacaaguacuccuggaaguccuggggcaaggcgaagaucaucggcgccgacacccagaacaccaccuucaucaucgacgggcccgacacgccggagugccccgacgaccagcgcgccuggaacaucugggaggucgaggacuacggcuucgggguguucaccaccaacaucuggcugaagcuccgggacuccuacacccagaugugcgaccaccgccugaugagcgccgcgaucaaggacuccaaggccgugcacgccgacaugggcuacuggaucgagagcgagaagaacgagacguggaagcuggcccgggccuccuucaucgaggucaagaccugcaucuggccccgcagccacacccucugguccaacggcgugcuggagagcgagaugaucauccccaagaucuacgggggcccgaucucccagcacaacuaccggcccggguacuucacccagacggcgggccccuggcaccuggggaagcucgagcuggacuucaaccugugcgagggcaccaccguggucguggacgagcacugcggcaaccgcgggccgagccuccggaccacgaccgugaccggcaagaucauccacgaguggugcugccgcuccugcacccugccgccccugcgguuccgcggggaggacggcugcugguacgggauggagauccggcccgucaaggagaaggaggagaaccucgugcgcagcaugguguccgccggcagcggcgaggucgacagcuucucccuggggcugcucugcgugagcaucaugaucgaggaggugaugcggucccgcuggagccgcaagaugcugaugacgggcacccuggccgucuucuuccuccugaucauggggcagcugaccuggaacgaccucauccggcugugcaucauggugggcgccaacguguccgaccgcauggggaugggcaccacguaccuggcccucauggcgaccuucaagaugcggccgauguucgccgucgggcugcuguuccgccggcucaccagccgcgaggugcugcugcucaccaucgggcugucccuggucgccagcguggagcuccccaacucccuggaggagcugggcgacgggcucgccaugggcaucaugaugcugaagcugcucacggacuuccagagccaccagcuguggaccacccugcucucccugaccuucaucaagacgacccugagccucgacuacgccuggaagaccauggcgauggugcuguccaucgucagccuguucccccucugccuguccaccacgagccagaagaccaccuggcugcccgugcuccugggcuccuucgggugcaagccgcugaccauguuccucaucaccgagaacaagaucuggggccgcaagagcuggccccugaacgaggggaucauggccgugggcaucgucuccauccugcucagcagccugcugaagaacgacgugccccucgccgggccccugaucgccggcggcaugcugaucgcgugcuacgugaucuccgggagcuccgccgaccucagccuggagcgcgccgccgaggucuccugggaggaggaggccgagcacagcggcgcgucccacaacauccugguggaggugcaggacgacgggacgaugaagaucaaggacgaggagcgggacgacacccucaccauccugcugaaggccacccuccuggccgucagcggcguguacccgauguccauccccgccacgcuguucgugugguacuucuggcagaagaagaagcagcgcagcgggguccucugggacacccccagcccgcccgagguggagcgggccgugcuggacgacggcaucuaccgcauccugcagcggggccugcucgggcgcagccaggucggcguggggguguuccaggacggcgucuuccacaccauguggcacgugacccgcggggcggugcugauguaccagggcaagcgccuggagcccuccugggccagcgucaagaaggaccucaucuccuacggcgggggcuggcgguuccaggggagcuggaacacgggcgaggagguccaggugaucgccgucgagcccgggaagaaccccaagaacgugcagaccacccccggcaccuucaagacgcccgagggcgaggugggggccaucgcccuggacuucaagcccggcaccuccgggagccccaucgucaaccgcgagggcaagaucgugggccuguacgggaacggcguggucaccaccuccgggacguacgugagcgcgaucgcccaggccaaggccagccaggagggcccgcuccccgagaucgaggacgagguguucaagaagcggaaccugaccaucauggaccugcaccccggguccggcaagacccgccgguaccucccggccaucguccgcgaggcgaucaagcgcaagcugcggacccugauccucgcccccacgcgcgugguggccagcgagauggccgaggcgcugaagggcaugcccauccgguaccagaccaccgccgucaaguccgagcacaccgggaaggagaucguggaccugaugugccacgccacguucaccaugcgccuccugagccccgugcgggucccgaacuacaacaugaucaucauggacgaggcccacuucaccgaccccgccuccaucgcggcccgcggcuacaucagcacccggguggggaugggcgaggccgccgccaucuucaugacggcgacgccgcccggguccguggaggccuucccgcagagcaacgccgucauccaggacgaggagcgcgacauccccgagcgguccuggaacagcggcuacgacuggaucaccgacuuccccggcaagaccgugugguucgugcccuccaucaagagcgggaacgacaucgccaacugccugcgcaagaacggcaagcgggucauccagcucucccgcaagacguucgacaccgaguaccagaagaccaagaacaacgacugggacuacguggugaccacggacaucagcgagaugggggccaacuuccgggcggaccgcgucaucgacccgcggcgcugccugaagcccgugauccugaaggacggccccgagcgggucauccucgccgggcccaugccggugaccgccgccuccgcggcccagcgccggggccgcaucggccgcaaccagaacaaggagggggaccaguacguguacaugggccagccccugaacaacgacgaggaccacgcccacuggaccgaggccaagaugcugcucgacaacaucaacacccccgaggggaucauccccgcccuguucgagccggagcgggagaaguccgcggccaucgacggcgaguaccgccugcgcggggaggcccgcaagacguucgucgagcucaugcggcgcggcgaccugcccguguggcuguccuacaagguggccagcgagggcuuccaguacuccgaccggcgcuggugcuucgacggggagcggaacaaccagguccucgaggagaacauggacguggagaucuggaccaaggagggcgagcgcaagaagcugcggccccgcuggcuggacgcccggaccuacagcgacccccucgcgcugcgcgaguucaaggaguucgccgccgggcggcgcagcguguccggcgaccugauccucgagaucggcaagcugccgcagcaccugacccuccgggcccagaacgcccuggacaaccuggucaugcuccacaacagcgagcagggcgggaaggcguaccgccacgccauggaggagcugcccgacaccaucgagacgcugaugcuccugacccugaucgccgugcucaccgggggcgugacccuguucuuccuguccgggaagggccucggcaagacgagcaucgggcugcugugcgucauggccuccagcgugcuccuguggauggcguccguggagccccacuggaucgccgccagcaucauccuggaguucuuccucaugguccugcugauccccgagccggaccggcagcgcacgccccaggacaaccagcucgccuacguggugaucggccugcuguucaugauccucaccgucgccgcgaacgagauggggcugcuggagaccacgaagaaggaccucggcaucgggcacgugguggccgagaaccaccaccacgccaccaugcuggacaucgaccugcaccccgccuccgccuggacccucuacgcggucgccaccacgaucaucaccccgaugaugcggcacaccaucgagaacaccacggccaacaucagccugaccgccaucgccaaccaggcggccauccugaugggccucgacaagggcuggcccaucuccaagauggacaucggggugccccugcuggcccucggcugcuacagccaggugaacccccugacccugaccgccgccguccucaugcugguggcgcacuacgccaucaucgggccgggccugcaggccaaggccacgcgcgaggcgcagaagcgcaccgccgccgggaucaugaagaaccccaccguggacggcaucgucgccaucgaccucgaccccgugguguacgacgccaaguucgagaagcagcugggccagaucaugcugcucauccugugcaccucccagauccugcucaugcggacgaccugggcgcugugcgagagcaucacccuggccaccgggccccucacgacccugugggagggcuccccggggaaguucuggaacaccaccaucgccgucagcauggccaacaucuuccgcggcuccuaccuggccggcgcggggcucgccuucagccugaugaagucccugggcgggggccggcgcgggacgggcgcccagggcgagacccucggggagaaguggaagcggcagcugaaccagcugagcaagagcgaguucaacaccuacaagcgcuccggcaucauggagguggaccggagcgaggccaaggaggggcucaagcgcggcgagaccacgaagcacgccgugucccgggggaccgcgaagcugcgcugguucgucgagcggaaccuggugaagcccgagggcaaggugaucgaccugggcugcgggcgcggcggguggagcuacuacugcgccggccucaagaaggucaccgaggugaagggguacaccaagggcggccccgggcacgaggagcccaucccgauggccaccuacggcuggaacaucgugaagcugcacuccgggcgggacgucuucuucacgccgcccgagaagugcgacacccugcucugcgacaucggcgagagcucccccaacccgaccaucgaggaggggcgcacccugcgggugcugaagaugguggagcccuggcuccgcggcaaccaguucugcaucaagauccugaaccccuacaugcccagcgucguggagacgcuggagcagaugcagcggaagcacggcgggaugcucgugcgcaacccgcugucccggaacagcacccacgagauguacugggucuccugcggcaccgggaacaucgugagcgccgugaacaugaccucccgcaugcugcucaaccgcuucacgauggcgcaccggaagcccaccuacgagcgcgacgucgaccugggcgccggcacccggcacguggccguggagcccgagaucgccaaccuggacaucaucgggcagcgcaucgagaacaucaagaacgagcacaagagcaccuggcacuacgacgaggacaaccccuacaagacgugggccuaccacggcuccuacgaggucaagccgagcggguccgcgagcuccauggugaacggcgucgugcggcuccugaccaagcccugggacgugauccccauggucacccagaucgccaugaccgacacgacccccuucgggcagcagcgcguguucaaggagaagguggacacccggaccccgcgccccaagcggggcacggcccagaucauggaggucaccgccaaguggcuguggggcuuccucagccgcaacaagaagccccggaucugcacccgcgaggaguucacccggaaggugcgcagcaacgccgcgaucggggccguguucgucgacgagaaccaguggaacuccgccaaggaggccguggaggacgagcgguucugggaccuggugcaccgcgagcgggagcugcacaagcagggcaagugcgccacgugcgucuacaacaugauggggaagcgcgagaagaagcucggcgaguucgggaaggcgaagggcagccgggccaucugguacauguggcugggcgcccgcuuccuggaguucgaggcccucggguucaugaacgaggaccacugguucucccgggagaacagccuguccggcguggagggggagggccugcacaagcucggguacauccugcgcgacaucagcaagaucccgggcggcaacauguacgcggacgacaccgccgggugggacacccgcaucaccgaggacgaccugcagaacgaggccaagaucacggacaucauggagcccgagcacgcccuccuggccaccuccaucuucaagcugaccuaccagaacaaggugguccgggugcagcgccccgccaagagcggcaccgugauggacgucaucucccggcgcgaccagcgggggagcggccaggugggcacguacgggcucaacaccuucaccaacauggaggugcagcugauccgccagauggaguccgagggcaucuucagccccuccgagcuggagaacagcaaccucgcggagcggguccuggacuggcuggagaagcacgggguggagcgccucaagcggauggccaucuccggcgacgacugcguggucaagccgaccgacgaccgcuucgccacggcccugaccgcgcugaacgacauggggaaggugcggaaggacaucccccagugggagcccagcaagggcuggaacgacuggcagcagguccccuucugcucccaccacuuccaccagcucaucaugaaggacggccgcgagaucgucgugccgugccggaaccaggacgagcugguggggcgcgcccgggucagccagggcgccggguggagccugcgcgagaccgccugccucggcaaguccuacgcccagauguggcagcugauguacuuccaccggcgcgaccugcggcucgcggccaacgccaucugcagcgccgugcccgugaacuggguccccaccucccgcaccacguggagcauccacgcccaccaccaguggaugaccaccgaggacaugcuguccguguggaaccgcguguggaucgaggagaaccccuggauggaggacaagacccacgucagcuccugggaggacgugccguaccuggggaagcgggaggaccaguggugcggcagccucaucggccugacggcgcgcgccaccugggccaccaacauccagguggccaucaaccagguccggcgccugaucgggaacgagaacuaccucgacuacaugaccuccaugaagcgguucaagaacgagagcgaccccgagggcgcgcugugguga

SEQ ID NO: 8964 - RNA, 9879 nt, Artificial Sequence
  derived and/or modified CDS sequence (opt1) from DENV-1__KC172829__SS-prME
agcgugaccaugcugcucaugcugaugcccaccgcccuggccuuccaccucaccacccgcggcggggagccgcacaugaucgugagcaagcaggagcggggcaagagccugcuguucaagaccuccgcgggggugaacaugugcacccucaucgccauggaccugggcgagcugugcgaggacaccaugaccuacaagugcccccgcaucaccgaggccgagcccgacgacguggacugcuggugcaacgccaccgacacgugggugaccuacgggaccugcagccagaccggcgagcaccggcgcgacaagcgguccguggcccucgcgccccacgugggccuggggcuggagacgcgcaccgagaccuggaugagcuccgagggcgccuggaagcagauccagcggguggagaccugggcccuccgccacccgggguucacggugaucgcccuguuccuggcgcacgccaucggcaccagcaucacccagaaggggaucaucuucauccuccugaugcuggugacccccuccauggccaugcggugcgucggcaucggcagccgcgacuucguggaggggcucuccggcgccacguggguggacgucgugcuggagcacgggagcugcgugaccaccauggccaaggacaagcccacccuggacaucgagcuccugaagacggaggucaccaaccccgcggugcugcggaagcucugcaucgaggccaagaucuccaacaccaccacggacagccgcugcccgacccagggcgaggccacccugguggaggagcaggacgccaacuucgucugccggcgcaccuucguggaccggggcugggggaacggcugcgggcuguucggcaaggggucccucaucacgugcgccaaguucaagugcgugaccaagcuggagggcaagaucguccaguacgagaaccugaaguacagcgugaucgugaccguccacaccggcgaccagcaccagguggggaacgaguccacggagcacggcaccaccgcgaccaucacgccccaggcccccacgaccgagauccagcucaccgacuacggggcccugacccuggacugcagcccccgcacgggccucgacuucaacgagaugguccugcugaccaugaaggagaaguccuggcucgugcacaagcagugguuccuggaccugccgcuccccuggaccagcggggccagcaccucccaggagacguggaaccggcaggaccugcuggugaccuucaagaccgcccacgcgaagaagcaggaggucguggugcucggcagccaggagggcgccaugcacaccgcccugacgggggccaccgagauccagaccuccggcaccacgaccaucuucgccgggcaccugaagugccgccucaagauggacaagcugacccugaagggcaugagcuacgucaugugcaccgggacguucaagcucgagaaggagguggcggagacccagcacggcaccgugcugguccagaucaaguacgagggcaccgacgcccccugcaagauccccuucuccacgcaggacgagaagggggugacccagaacggccggcugaucaccgccaacccgaucgugaccgacaaggagaagcccgucaacaucgaggccgagccgcccuucggggagagcuacaucgugaucggcgcgggcgagaaggcccugaagcucuccugguucaagaaggggagcuccaucggcaagauguucgaggccacggcccgcggggcccggcgcauggcgauccugggcgacaccgccugggacuucgggagcaucggcggcguguucaccuccgucgggaagcuggugcaccagaucuucggcaccgccuacggggugcuguucagcggcgucuccuggacgaugaagaucgggaucggcgugcugcugaccuggcucggccugaacagccgcuccaccagccuguccaugaccugcaucgccguggggcucgucacgcuguaccugggcgugauggugcaggccgacagcgggugcgucgugaacuggaagggccgggagcucaagugcggguccggcaucuucgugaccaacgagguccacaccuggaccgagcaguacaaguuccaggcggacagcccgaagcgccugagcgccgccaucggcaaggccugggaggagggggugugcggcauccgguccgccacccgccuggagaacaucauguggaagcagaucagcaacgagcucaaccacauccugcuggagaacgacaugaaguucacgguggucgugggggacguggcgggcauccucgcccaggggaagaagaugauccggccccagcccauggaguacaaguacuccuggaaguccuggggcaaggccaagaucaucggcgccgacguccagaacaccaccuucaucaucgacgggcccaacaccccggagugccccgacgaccagcgcgcguggaacaucugggagguggaggacuacggcuucgggaucuucacgaccaacaucuggcugcggcugcgcgacuccuacacccaggugugcgaccaccggcucaugagcgccgccaucaaggacuccaaggccguccacgccgacaugggcuacuggaucgagagcgagaagaacgagaccuggaagcuggcgcgcgccuccuucaucgaggugaagacgugcaucuggcccaagagccacacccugugguccaacggcgugcucgagagcgagaugaucauccccaagaucuacgggggcccgaucucccagcacaacuaccggcccggguacuucacccagaccgccggccccuggcaccuggggaagcuggagcucgacuucgaccugugcgagggcacgaccgucgugguggacgagcacugcggcaaccgcgggccgagccugcggaccaccacggucaccggcaagaucauccacgaguggugcugccgcuccugcacccugccgccccuccgguuccgcggggaggacggcugcugguacgggauggagauccggcccgugaaggagaaggaggagaaccuggucaagagcauggucuccgccggcagcggcgagguggacagcuucucccucgggcugcugugcaucagcaucaugaucgaggaggugaugcgcucccgguggagccgcaagaugcucaugaccggcacgcuggccgucuucuuccugcucaucaucgggcagcugaccuggaacgaccugauccgccucuccaucauggugggcgcgaacgccagcgacaagauggggaugggcaccaccuaccuggcccugauggccacguucaagaugcggccgauguucgccgugggccuccuguuccgccggcugaccucccgcgagguccuccugcugaccaucgggcucagccugguggcguccgucgagcugcccaacagccucgaggagcugggcgacgggcuggccaugggcaucaugauccucaagcugcugaccgacuuccagucccaccagcucugggccacgcugcugagccucaccuucaucaagaccaccuucucccugcacuacgccuggaagacgauggcgauggugcugagcaucgugucccucuucccccugugccugagcaccaccucccagaagaccacguggcuccccguccugcugggcagccucgggugcaagccgcugaccauguuccugaucaccgagaacaagaucuggggccggaaguccuggccccucaacgaggggaucauggccgugggcaucgugagcauccugcugagcucccuccugaagaacgacgucccccuggccgggccccucaucgccggcggcaugcugaucgccugcuacgugaucagcggguccagcgcggaccugucccucgagaaggccgccgaggugagcugggaggaggaggccgagcacuccggcgccagccacaacauccuggucgaggugcaggacgacgggaccaugaagaucaaggacgaggagcgcgacgacacccugacgauccuccugaaggcgacccugcucgccguguccggcgucuacccgcugagcauccccgccacccuguucgugugguacuucuggcagaagaagaagcagcgguccggggugcucugggacacccccagcccgcccgaggucgagcgcgccgugcuggacgacggcaucuaccggaucaugcagcgcggccugcuggggcggucccaggugggcgucgggguguuccaggagaacguguuccacacgauguggcacgucacccgcggcgccgugcucauguaccaggggaagcggcuggagcccagcugggcguccgugaagaaggaccugaucagcuacggcggcggguggcgccuccagggcuccuggaacaccggggaggagguccaggugaucgccguggagcccggcaagaaccccaagaacguccagaccgcccccgggacguucaagaccaccgagggcgaggugggcgccaucgcccuggacuucaagcccgggaccagcggcucccccaucgugaaccgggaggggaagaucgucggccuguacggcaacgggguggugacgaccagcggcaccuacgucagcgcgaucgcccaggccaaggccucccaggaggggccccucccggagaucgaggacgagguguuccgcaagcggaaccugaccaucauggaccugcaccccggcagcgggaagacgcgccgguaccuccccgcgaucgugcgcgaggccaucaagcggaagcugcgcacccugauccucgccccgacccgcgucguggccuccgagauggccgaggcgcugaagggcaugcccauccgguaccagaccacggccgucaagagcgagcacaccggcaaggagaucgucgaccugaugugccacgccaccuucaccaugcgccuccugucccccgugcgggugcccaacuacaacaugaucaucauggacgaggcccacuucacggacccgagcuccaucgccgcgcgcggguacaucagcacccgggucggcaugggggaggccgccgccaucuucaugaccgccacgccgcccggcuccguggaggcguucccccagagcaacgccgugauccaggacgaggagcgcgacaucccggagcgguccuggaacagcggguacgaguggaucacggacuucuccggcaagaccgucugguucgugcccagcaucaaguccggcaacgacaucgccaacugccugcgcaagaacgggaagcgggugauccagcucagccgcaagaccuucgacaccgaguaccagaagacgaagaacaacgacugggacuacgucgugaccaccgacaucuccgagaugggcgccaacuuccgggcggaccgcgugaucgacccccggcgcugccugaagcccgucauccugaaggacgggccggagcgggugauccucgccggccccaugcccgucaccguggccagcgccgcccagcgccgggggcgcaucggccggaaccacaacaaggagggcgaccaguacaucuacauggggcagccccugaacaacgacgaggaccacgcgcacuggacggaggccaagaugcugcucgacaacaucaacaccccggagggcaucauccccgcccuguucgagcccgagcgcgagaaguccgccgccaucgacggggaguaccgccugcggggcgaggcgcgcaagaccuucguggagcucaugcggcgcggggaccugcccgucuggcugagcuacaagguggccagcgagggcuuccaguacuccgaccggcgcuggugcuucgacggcgagcggaacaaccaggugcucgaggagaacauggacgucgagaucuggaccaaggagggggagcgcaagaagcugcggccgcgcuggcuggacgcccggacguacagcgacccccucgcccugcgcgaguucaaggaguucgccgcgggccggcgcuccgugagcggggaccugauccucgagaucggcaagcugccccagcaccugacccagcgggcccagaacgcccucgacaaccuggugaugcugcacaacuccgagcagggcgggcgcgccuaccggcacgcgauggaggagcuccccgacaccaucgagacccugaugcugcucgcccugaucgccguccugaccggcggggugacccucuucuuccugagcggccgcgggcugggcaagaccuccaucggccuccugugcgugauggccagcuccguccugcucuggauggccagcguggagccgcacuggaucgcggccuccaucauccuggaguucuuccugauggugcuccugauccccgagcccgaccggcagcgcacgccccaggacaaccagcuggccuacgucgugaucgggcuccuguucaugauccugaccguggccgccaacgagaugggccuccuggagacgaccaagaaggaccuggggaucggccacgucgcggacgagaaccaccaccacgccgccaugcucgacguggaccugcacccggccagcgccuggacccuguacgcgguggccaccacgaucaucacccccaugaugcggcacaccaucgagaacaccacggccaacaucucccucaccgccaucgccaaccaggcggccauccugauggggcuggacaagggcuggcccaucagcaagauggacaucggcgucccgcuccuggcccuggggugcuacucccaggugaacccccucacccugaccgccgcggugcugaugcucgucgcccacuacgccaucaucggccccgggcugcaggccaaggccacgcgcgaggcgcagaagcgcaccgccgccggcaucaugaagaaccccaccguggacgggaucguggccaucgaccuggacccggucguguacgacgccaaguucgagaagcagcucggccagaucaugcugcugauccucugcaccagccagauccugcugaugcggacgaccugggcgcucugcgaguccaucacccuggccaccggcccccugacgacccucugggaggggagccccggcaaguucuggaacaccaccaucgccguguccauggccaacaucuuccgcgggagcuaccuggccggcgcgggccuggccuucagccucaugaagucccucgggggcgggcggcgcgggacgggggcccagggcgagacccugggcgagaaguggaagcggcagcucaaccagcugagcaaguccgaguucaacaccuacaagcgcagcgggaucauggaggucgaccgguccgaggccaaggagggccugaagcgcggggagaccacgaagcacgcggugagccggggcaccgccaagcuccgcugguucguggagcggaaccuggucaagcccgaggggaaggugaucgaccugggcugcggccgcgggggcugguccuacuacugcgccgggcugaagaaggugaccgaggucaagggcuacaccaagggcgggccgggccacgaggagcccauccccauggccacguacggguggaaccucgugaagcugcacagcggcaaggacguguucuucaucccgcccgagaagugcgacacccugcucugcgacaucggggaguccagccccaaccccaccaucgaggagggccggacccugcgcguccugaagaugguggagcccuggcuccgggggaaccaguucugcaucaagauccugaaccccuacaugcccuccguggucgagacccuggagcagaugcagcgcaagcacggcggcaugcucgugcggaacccccugagccgcaacuccacgcacgagauguacugggugagcugcgggaccggcaacaucgucuccgccgugaacaugaccagccggaugcugcucaaccgcuucaccauggugcaccgcaagcccacguacgagcgggacgucgaccugggggcgggcacccgccacguggccguggagccggaggucgccaaccuggacaucaucggccagcggaucgagaacaucaagcacgagcacaaguccaccuggcacuacgacgaggacaaccccuacaagaccugggccuaccacgggagcuacgaggugaagcccuccggcagcgccagcuccauggucaacgggguggugaagcuccugacgaagcccugggacgucaucccgauggugacccagaucgcgaugaccgacaccacgcccuucggccagcagcgcguguucaaggagaaggucgacacccggacccccaaggccaagcgcgggaccgcccagaucauggaggugacggcccgguggcuguggggcuuccucagccgcaacaagaagccccggaucugcacccgcgaggaguucacccggaaggugcgcuccaacgccgcgaucggcgccgucuucguggacgagaaccaguggaacagcgccaaggaggccguggaggacgagcgguucugggaccugguccaccgcgagcgggagcugcacaagcaggggaagugcgcgaccugcguguacaacaugaugggcaagcgcgagaagaagcucggggaguucggcaaggccaaggggucccgggccaucugguacauguggcugggcgcccgcuuccuggaguucgaggcccucggcuucaugaacgaggaccacugguucagccgggagaacucccugagcgggguggagggcgaggggcugcacaagcucggcuacauccugcgcgacaucuccaagauccccgggggcaacauguacgcggacgacacggccggcugggacacccggaucaccgaggacgaccugcagaacgaggccaagaucaccgacaucauggagagcgagcacgcccuccuggccaaguccaucuucaagcugacguaccagaacaaggucgugcgcgugcagcgccccgcgaagaacgggaccgucauggacgugaucagccggcgcgaccagcggggcuccggccaggugggcaccuacggccucaacaccuucacgaacauggaggcccagcugauccgccagauggagagcgaggggaucuucucccccagcgagcuggagaccccgaaccucgccgagcgggcccuggacuggcuggagaagcacggcgucgagcgccucaagcggauggccaucuccggggacgacugcguggugaagcccaucgacgaccgcuucgcgaccgcccugaccgcccugaacgacaugggcaagguccggaaggacaucccccagugggagcccagcaagggguggaacgacuggcagcaggucccguucugcagccaccacuuccaccagcucaucaugaaggacggccgcgagaucgugguccccugccggaaccaggacgagcuggugggccgcgcccgggugucccagggggccggcuggagccugcgcgagacggcgugccucgggaaguccuacgcccagauguggcagcugauguacuuccaccggcgcgaccugcggcucgccgccaacgcgaucugcagcgccguccccguggacugggugcccaccucccgcaccaccuggagcauccacgcccaccaccaguggaugacgaccgaggacaugcuguccgucuggaaccggguguggaucgaggagaacccguggauggaggacaagacccacaucagcuccugggaggacgugcccuaccugggcaagcgcgaggaccaguggugcgggagccucaucggccugaccgcccgcgccaccugggcgacgaacauccaggucgccaucucccaggugcggcgccugaucggcaacgagaacuaccucgacuacaugaccagcaugaagcgguucaagaacgaguccgaccccgagggggcccugugguga

SEQ ID NO: 8965 - RNA, 9879 nt, Artificial Sequence
  derived and/or modified CDS sequence (opt1) from DENV-1__EU359008__SS-prME
agcgugaccaugcugcucaugcugaugcccaccgcccuggccuuccaccucaccacccggggcggggagccccacaugaucgugagcaagcaggagcggggcaagagccugcuguucaagaccuccgccggggugaacaugugcacccucaucgccauggaccugggcgagcugugcgaggacacgcucaccuacaagugcccccgcaucaccgaggccgagcccgacgacguggacugcuggugcaacgccaccgacaccugggucaccuacgggaccugcagccagaccggcgagcaccggcgcgacaagcgguccguggcccuggcgccccacgugggccuggggcucgagacgcgcaccgagaccuggaugagcuccgagggcgccuggaagcagauccagcgggucgagaccugggcccugcgccaccccggguucacggugaucgcccuguuccucgcgcacgccaucggcaccagcaucacccagaaggggaucaucuucauccugcugaugcucgugacccccuccauggccaugcggugcgucggcaucggcagccgcgacuucguggaggggcuguccggcgccacguggguggacgucgugcuggagcacgggagcugcgugaccaccauggccaaggacaagcccacccucgacaucgagcugcugaagacggaggucaccaaccccgcggugcuccggaagcugugcaucgaggccaagaucuccaacaccaccacggacagccgcugcccgacccagggcgaggccacccugguggaggagcaggacgccaacuucgucugccggcgcaccuucguggaccggggcugggggaacggcugcgggcuguucggcaaggggucccugaucacgugcgccaaguucaagugcgugaccaagcuggagggcaagaucguccaguacgagaaccucaaguacagcgugaucgugaccguccacaccggcgaccagcaccagguggggaacgaguccacggagcacggcaccaccgcgaccaucacgccccaggcccccacgaccgagauccagcugaccgacuacggggcccugacccucgacugcagcccccgcacgggccuggacuucaacgagaugguccugcucaccaugaaggagaaguccuggcuggugcacaagcagugguuccuggaccucccccugcccuggaccagcggggccagcaccacgcaggagaccuggaaccggcaggaccugcucgugaccuucaagaccgcccacgcgaagaagcaggaggucguggugcugggcucccaggagggcgccaugcacacggcccugaccggggccaccgagauccagaccagcggcacgaccaccaucuucgccgggcaccucaagugccgccugaagauggacaagcugacccucaagggcauguccuacgucaugugcacggggagcuucaagcuggagaaggagguggcggagacccagcacggcaccgugcugguccagaucaaguacgagggcaccgacgcccccugcaagauccccuuccugacgcaggacgagaagggggugacccagaacggccggcucaucaccgccaacccgaucgugaccgacaaggagaagcccgucaacaucgaggccgagccgcccuucggggaguccuacaucgugaucggcgcgggcgagaaggcccugaagcugagcugguucaagaagggguccagcaucggcaagauguucgaggccacggcccgcggggcccggcgcauggcgauccucggcgacaccgccugggacuucggguccaucggcggcguguucaccagcgucgggaagcuggugcaccagaucuucggcaccgccuacggggugcuguucuccggcgucagcuggacgaugaagaucgggaucggcgcccuccugaccuggcugggccucaacucccgcagcaccucccugagcaugaccugcaucgccguggggcuggugacgcucuaccugggcgucauggugcaggcggacuccgggugcgugaucaacuggaagggccgggagcugaagugcgggagcggcaucuucgucaccaacgaggugcacaccuggaccgagcaguacaaguuccaggccgacuccccgaagcgccucagcgccgccaucggcaaggccugggaggagggggugugcggcauccggagcgcgacccgccuggagaacaucauguggaagcagaucuccaacgagcugaaccacauccuccuggagaacgacaugaaguucacggucguggugggggacgucgccggcauccuggcccaggggaagaagaugauccggccccagcccauggagcacaaguacagcuggaaguccuggggcaaggccaagaucaucggcgcggacgugcagaacaccaccuucaucaucgacgggcccaacaccccggagugccccgacgaccagcgcgccuggaacaucugggagguggaggacuacggcuucgggaucuucacgaccaacaucuggcucaagcugcgggacagcuacacccaggucugcgaccaccgccugauguccgccgccaucaaggacagcaaggccgugcacgcggacaugggcuacuggaucgaguccgagaagaacgagaccuggaagcucgcccgggccagcuucaucgaggugaagacgugcaucuggcccaagucccacacccuguggagcaacggcguccuggaguccgagaugaucauccccaagaucuacgggggcccgaucagccagcacaacuaccgccccggguacuucacccagaccgccggccccuggcaccucgggaagcuggagcuggacuucgaccucugcgagggcacgaccgugguggucgacgagcacugcggcaaccgggggccgucccugcgcaccaccacggugaccggcaagaucauccacgaguggugcugccggagcugcacccugccgccccuccgcuuccgcggggaggacggcugcugguacgggauggagauccgccccgugaaggagaaggaggagaaccuggucaaguccauggugagcgccggcuccggcgagguggacagcuucagccuggggcuccugugcaucuccaucaugaucgaggaggucaugcggagccgcuggucccggaagaugcugaugaccggcacgcucgcgguguucuuccugcugaucaugggccaggugaccuggaacgaccucauccgccugugcaucauggucggcgccaacgccagcgaccgcauggggaugggcaccaccuaccuggcccucauggccacguucaagaugcggccgauguucgcggugggccugcuguuccgccggcucaccucccgcgaggugcugcugcucaccaucgggcugagccuggucgccuccguggagcuccccaacagccuggaggagcugggcgacgggcucgccaugggcaucaugauccugaagcugcucaccgacuuccagucccaccagcugugggccacgcugcucagccugaccuucaucaagaccaccuucucccugcacuacgcguggaagacgauggccaugguccucagcaucgugucccuguucccccugugccucagcaccaccucccagaagaccacguggcugcccgugcugcucggcagccuggggugcaagccgcugaccauguuccucaucgccgagaacaagaucuggggccggaaguccuggccccugaacgaggggaucauggccgucggcaucgugagcauccugcucuccagccugcugaagaacgacgugccccucgccgggccccugaucgcgggcggcaugcugaucgccugcuacgucaucagcggguccagcgccgaccucucccuggagaaggccgccgaggugagcugggaggaggaggcggagcacuccggcgccagccacaacauccugguggagguccaggacgacgggaccaugaagaucaaggacgaggagcgcgacgacacccucaccauccugcugaaggccacgcuccuggccguguccggcguguacccgcugagcauccccgccacccucuucgucugguacuucuggcagaagaagaagcagcgguccggggugcugugggacacccccagcccgcccgagguggagcgcgcgguccuggacgacggcaucuaccggaucaugcagcgcggccugcucgggcggucccaggugggcgugggggucuuccaggagaacguguuccacaccauguggcacgugacgcgcggcgccguccugauguaccaggggaagcggcuggagcccagcugggccuccgugaagaaggaccucaucagcuacggcggcggguggcgccugcagggcuccuggaacaccggggaggaggugcaggucaucgccguggagcccggcaagaaccccaagaacgugcagaccgcccccgggaccuucaagacgcccgagggcgaggucggcgcgaucgcccuggacuucaagcccgggaccagcggcucccccaucgugaaccgggaggggaagaucgugggccucuacggcaacggggucgugaccaccagcggcacguacguguccgccaucgcccaggcgaaggccagccaggaggggccgcugcccgagaucgaggacgaggucuuccgcaagcggaaccugaccaucauggaccuccaccccggcagcgggaagacccgccgguaccugccggccaucgugcgcgaggccaucaagcggaagcugcgcacccucauccuggcccccacgcgcguggucgcguccgagauggccgaggcccugaagggcaugcccauccgguaccagaccaccgccgucaagagcgagcacaccggcaaggagaucguggaccucaugugccacgccacguucaccaugcgccugcugucccccguccgggugccgaacuacaacaugaucaucauggacgaggcgcacuucaccgaccccagcuccaucgccgcccgcggguacaucagcacccgggugggcaugggggaggccgccgcgaucuucaugacggccacgccgcccggcuccgucgaggccuucccgcagagcaacgccgcgauccaggacgaggagcgcgacauccccgagcgguccuggaacagcggguacgaguggaucaccgacuuccccggcaagaccgugugguucgugcccuccaucaagagcggcaacgacaucgccaacugccuccgcaagaacgggaagcgggucauccagcugucccgcaagacguucgacaccgaguaccagaagaccaagaacaacgacugggacuacguggugaccacggacaucagcgagaugggcgccaacuuccgggccgaccgcgucaucgacccgcggcgcugccugaagcccgugauccucaaggacgggcccgagcgggugauccuggccggccccaugccggucaccguggcguccgccgcccagcgccgggggcgcaucggccggaaccacaacaaggagggcgaccaguacaucuacauggggcagccccugaacaacgacgaggaccacgcccacuggaccgaggccaagaugcuccuggacaacaucaacacccccgagggcaucauccccgcgcuguucgagccggagcgcgagaaguccgccgccaucgacggggaguaccgccuccggggcgaggcccgcaagacguucgucgagcugaugcggcgcggggaccugcccguguggcucuccuacaagguggccagcgagggcuuccaguacuccgaccggcgcuggugcuucgacggcgagcggaacaaccagguccuggaggagaacauggacguggagaucuggaccaaggagggggagcgcaagaagcugcggccccgcuggcucgacgcgcggaccuacagcgacccccuggcccugcgcgaguucaaggaguucgccgccggccggcgcagcguguccggggaccucauccuggagaucggcaagcugccgcagcaccucacccagcgggcgcagaacgcccuggacaaccuggucaugcuccacaacagcgagcagggcgggcgcgccuaccggcacgccauggaggagcugcccgacacgaucgagacccugaugcuccuggcccugaucgcggugcucaccggcggggugacccuguucuuccuguccggccgcgggcucggcaagaccagcaucggccugcugugcgucauggccuccagcgugcuccuguggauggccuccguggagccccacuggaucgccgccagcaucauccuggaguucuuccucaugguccugcugauccccgagccggaccggcagcgcacgccccaggacaaccagcucgcguacguggugaucgggcugcuguucaugauccucaccgucgccgccaacgagaugggccugcuggagaccaccaagaaggaccucgggaucggccacguggccguggagaaccaccaccacgccgcgaugcuggacgucgaccugcaccccgccuccgccuggacgcucuacgccguggccaccaccaucaucaccccgaugaugcggcacacgaucgagaacaccaccgcgaacaucagccugaccgccaucgccaaccaggccgcgauccugauggggcucgacaagggcuggcccaucuccaagauggacaucggcgugccccugcuggcccucgggugcuacagccaggucaacccccugacgcugaccgccgccgugcucaugcugguggcccacuacgcgaucaucggcccggggcugcaggccaaggccacccgcgaggcccagaagcgcaccgccgcgggcaucaugaagaaccccacggucgacgggaucguggccaucgaccucgaccccguggucuacgacgccaaguucgagaagcagcugggccagaucaugcugcucauccugugcaccucccagauccugcucaugcggaccaccugggcccugugcgagagcaucacgcuggccaccggcccccucaccacccugugggagggguccccgggcaaguucuggaacacgaccaucgcggugagcauggccaacaucuuccgcggguccuaccuggccggcgccggccucgcguucagccugaugaagucccucgggggcgggcggcgcgggaccggggcccagggcgagacccucggcgagaaguggaagcggcagcugaaccagcugagcaagagcgaguucaacacguacaagcgcuccgggaucauggagguggaccggagcgaggccaaggagggccucaagcgcggggagaccaccaagcacgccgucucccggggcaccgccaagcugcgcugguucguggagcggaaccuggugaagcccgaggggaaggucaucgaccugggcugcggccgcgggggcuggagcuacuacugcgcggggcucaagaaggugacggaggugaagggcuacaccaagggcgggcccggccacgaggagcccaucccgauggccaccuacggguggaaccuggucaagcugcacuccggcaaggacguguucuucaucccgcccgagaagugcgacacccuccugugcgacaucggggagagcucccccaacccgacgaucgaggagggccggacccugcgcgugcucaagauggucgagcccuggcugcgggggaaccaguucugcaucaagauccugaaccccuacaugcccagcgugguggagacccucgagcagaugcagcgcaagcacggcggcaugcugguccggaacccgcugucccgcaacagcacccacgagauguacuggguguccugcgggaccggcaacaucgugagcgccgucaacaugacgucccggaugcuccugaaccgcuucaccauggcccaccgcaagcccaccuacgagcgggacguggaccugggggccggcacccgccacguggcggucgagcccgagguggccaaccucgacaucaucggccagcggaucgagaacaucaagcacgagcacaagagcacguggcacuacgacgaggacaaccccuacaagaccugggccuaccacggguccuacgaggugaagccgagcggcuccgccagcuccauggucaacgggguggucaagcugcugaccaagcccugggacgugauccccauggugacccagaucgccaugacggacaccacccccuucggccagcagcgcgucuucaaggagaagguggacacccggacgccgaaggcgaagcgcgggaccgcccagaucauggaggugaccgcccgguggcucuggggcuuccugagccgcaacaagaagccccggaucugcacccgcgaggaguucacgcggaagguccgcagcaacgccgcgaucggcgccguguucguggacgagaaccaguggaacuccgccaaggaggccgucgaggacgagcgguucugggaccuggugcaccgcgagcgggagcuccacaagcaggggaagugcgcgaccugcguguacaacaugaugggcaagcgcgagaagaagcugggggaguucggcaaggcgaaggggagccgggccaucugguacauguggcugggcgcccgcuuccucgaguucgaggcccugggcuucaugaacgaggaccacugguucucccgggagaacagccuguccggggucgagggcgaggggcuccacaagcugggcuacauccugcgcgacaucagcaagauccccgggggcaacauguacgccgacgacaccgcgggcugggacacccggaucacggaggacgaccuccagaacgaggccaagaucaccgacaucauggagccggagcacgcccugcuggccaaggccaucuucaagcucaccuaccagaacaagguggugcgcguccagcgccccgcgaagaacgggaccgugauggacgugaucucccggcgcgaccagcggggcagcgggcaggucggcacguacggccugaacaccuucaccaacauggaggcccagcugauccgccagauggaguccgaggggaucuucagccccuccgagcucgagacccccaaccuggccgagcgggugcuggacuggcucgagaaguacggcguggagcgccugaagcggauggccaucagcggggacgacugcgucgugaagccgaucgacgaccgcuucgccacggcgcugaccgcccucaacgacaugggcaaggugcggaaggacaucccccagugggagcccuccaagggguggaacgacuggcagcagguccccuucugcagccaccacuuccaccagcugaucaugaaggacggccgcgagaucguggugccgugccggaaccaggacgagcuggucggccgcgcccgggugucccagggggccggcuggagccuccgcgagaccgcgugccuggggaaguccuacgcccagauguggcagcugauguacuuccaccggcgcgaccuccggcuggccgccaacgccaucugcagcgcggugcccgucgacugggugcccaccagccgcacgaccugguccauccacgcccaccaccaguggaugaccaccgaggacaugcugagcguguggaaccgggucuggaucgaggagaaccccuggauggaggacaagacgcacaucuccagcugggaggacgugccguaccucggcaagcgcgaggaccaguggugcgggucccugaucggccugaccgcccgcgccaccugggccaccaacauccagguggcgaucaaccagguccggcgccucaucggcaacgagaacuaccuggacuacaugaccagcaugaagcgguucaagaacgaguccgaccccgagggggcccugugguga

SEQ ID NO: 8966 - RNA, 9879 nt, Artificial Sequence
  derived and/or modified CDS sequence (opt1) from DENV-1__AY835999__SS-prME
agcgugaccaugcugcugaugcugaugcccaccgcccuggccuuccaccucaccacccggggcggggagccccacaugaucgugagcaagcaggagcggggcaagagccugcuguucaagaccagcgcgggggugaacaugugcacccucaucgccauggaccugggcgagcugugcgaggacaccaugaccuacaagugcccccggaucaccgaggccgagcccgacgacguggacugcuggugcaacgccaccgacaccugggucaccuacgggaccugcagccagaccggcgagcaccggcgcgacaagcgguccguggcccucgcgccccacgugggccuggggcuggagacgcggaccgagaccuggaugagcuccgagggcgccuggaagcagauccagcgggucgagaccugggcccuccgccaccccggguucacggugaucgcccuguuccuggcgcacgccaucggcaccagcaucacccagaaggggaucaucuucauccuccugaugcuggugacccccuccauggccaugcggugcgucggcaucggcagccgcgacuucguggaggggcucuccggcgccacguggguggacgucgugcuggagcacgggagcugcgugaccaccauggccaaggacaagcccacccuggacaucgagcuccugaagacggaggucaccaaccccgcggugcugcggaagcucugcaucgaggccaagaucuccaacaccaccacggacagccgcugcccgacccagggcgaggccacccugguggaggagcaggacgccaacuucgucugccggcgcaccuucguggaccggggcugggggaacggcugcgggcuguucggcaaggggucccuccugacgugcgccaaguucaagugcgugaccaagcuggagggcaagaucguccaguacgagaaccucaaguacagcgugaucgugaccguccacaccggcgaccagcaccagguggggaacgaguccacggagcacggcaccaccgcgaccaucacgccccaggcccccacgaccgagauccagcugaccgacuacggggcccugacccucgacugcagcccccgcacgggccuggacuucaacgagaugguccugcucaccaugaaggagaaguccuggcuggugcacaagcagugguuccuggaccucccccugcccuggaccagcggggccagcaccucccaggagacguggaaccggcaggaccugcucgugaccuucaagaccgcccacgcgaagaagcaggaggucguggugcugggcagccaggagggcgccaugcacaccgcccugacgggggccaccgagauccagaccuccggcaccacgaccaucuucgccgggcaccucaagugccgccugaagauggacaagcugacccucaagggcaugagcuacgucaugugcaccggguccuucaagcuggagaaggagguggcggagacgcagcacggcaccgugcugguccagaucaaguacgagggcaccgacgcccccugcaagauccccuuccugacccaggacgagaagggggugacgcagaacggccggcucaucaccgccaacccgaucgugaccgacaaggagaagcccgucaacaucgaggccgagccgcccuucggggagagcuacaucgugaucggcgcgggcgagaaggcccugaagcuguccugguucaagaaggggagcuccaucggcaagauguucgaggccaccgcccgcggggcccggcgcauggcgauccucggcgacacggccugggacuucgggagcgugggcggcgucuucaccuccguggggaagcuggugcaccagaucuucggcaccgccuacgggguccuguucagcggcguguccuggaccaugaagcucgggaucggcgugcugcugacguggcucggccugaacagccgcuccaccagccuguccaugaccugcaucgccgucgggcucgugacccuguaccugggcgugaugguccaggccgacagcgggugcgugaucaacuggaagggccgggagcucaagugcggguccggcaucuucgugacgaacgagguccacaccuggaccgagcaguacaaguuccaggcggacagcccgaagcgccugagcgccgccaucggcaaggccugggaggagggggugugcggcauccgguccgccacccgccuggagaacaucauguggaagcagaucagcaacgagcucaaccacauccugcuggagaacgacaugaaguucaccguggucgugggggacguggcgggcauccucguccaggggaagaagaugauccggccccagcccauggaguacaaguacuccuggaaguccuggggcaaggccaagaucaucggcgccgacgugcagaacuccacguucaucaucgacgggcccaacaccccggagugccccgacgaccagcgcgccuggaacaucugggagguggaggacuacggcuucgggaucuucaccaccaacaucuggcugaagcugcgggacagcuacacgcaggucugcgaccaccgccucauguccgcggccaucaaggacagcaaggccgugcacgccgacaugggcuacuggaucgaguccgagaagaacgagaccuggaagcuggcccgggcgagcuucaucgaggugaagaccugcaucuggcccaagucccacacccuguggagcaacggcguccucgaguccgagaugaucauccccaagaucuacgggggcccgaucagccagcacaacuaccgccccggguacuucacgcagaccgccggccccuggcaccuggggaagcuggagcucgacuucgaccugugcgagggcaccaccgugguggucgacgagcacugcggcaaccgggggccgucccugcgcacgaccaccgugaccggcaagaucauccacgaguggugcugccggagcugcacgcugccgccccuccgcuuccgcggggagaacggcugcugguacgggauggagauccgccccgugaaggagaaggaggagaaccuggucaaguccauggugagcgccggcagcggcgagguggacuccuucagccucgggcugcugugcaucuccaucaugaucgaggaggucaugcggagccgcuggucccggaagaugcucaugaccggcauccuggccguguucuuccugcucaucauggggcagcugaccuggaacgaccugauccgccucugcaucauggugggcgccaacgcgagcgaccgcauggggaugggcaccacguaccuggcccugauggccaccuucaagaugcggccgauguucgccgucggccuccuguuccgccggcugaccucccgcgaggugcuccugcugaccaucgggcucagccuggucgccuccguggagcugcccaacagccucgaggagcugggcgacgggcuggcgaugggcaucaugauccucaagcugcugacggacuuccagucccaccagcucugggccacccugcugagccucaccuucaucaagaccacguucucccugcacuacgccuggaagaccauggccauggugcugagcaucgucucccucuucccccugugccugagcaccaccucccagaagacgaccuggcuccccgugcugcugggcagccucgggugcaagccgcugaccauguuccugaucgcggagaacaagaucuggggccggaaguccuggccccucaacgaggggaucauggccgugggcaucgucagcauccugcugagcucccuccugaagaacgacgugccccuggccgggccccucaucgccggcggcaugcugaucgccugcuacgugaucagcggguccagcgcggaccugucccucgagaaggccgccgaggucagcugggaggaggaggccgagcacuccggcgccagccacaacauccugguggaggugcaggacgacgggaccaugaagaucaaggacgaggagcgcgacgacacgcugaccauccuccugaaggcgacccugcucgccgucuccggcguguacccgcugagcauccccgccacccuguucgugugguacuucuggcagaagaagaagcagcgguccgggguccugugggacacccccagcccgcccgagguggagcgcgccgugcucgacgacggcaucuaccggaucaugcagcgcggccugcuggggcggucccaggucggcguggggguguuccaggagaacgucuuccacacgauguggcacgugacccgcggcgccgugcucauguaccaggggaagcggcuggagcccagcugggcguccgucaagaaggaccugaucagcuacggcggcggguggcgccuccagggcuccuggaacaccggggaggagguccaggugaucgccgucgagcccggcaagaaccccaagaacgugcagaccgcccccgggacguucaagacccccgagggcgaggugggcgccaucgcccuggacuucaagcccgggaccagcggcucccccaucgucaaccgggaggggaagaucgugggccuguacggcaacgggguggucaccacgagcggcaccuacgugagcgcgaucgcccagaccaaggccucccaggaggggccgcuccccgagaucgaggacgagguguuccgcaagcggaaccugaccaucauggaccugcaccccggcagcgggaagacgcgccgguaccucccggccaucguccgcgaggcgaucaagcggaagcugcgcacccugauccucgcccccacccgcgugguggccuccgagauggccgaggcccugaagggcaugcccauccgguaccagaccacggcggucaagagcgagcacaccggcaaggagaucguggaccugaugugccacgccaccuucaccaugcgccuccugucccccgugcgggucccgaacuacaacaugaucaucauggacgaggcccacuucacggaccccagcuccaucgccgcccgcggguacaucagcacccgggugggcaugggggaggcggccgccaucuucaugaccgccacgccgcccggcuccauggaggccuucccgcagagcaacgcggugauccaggacgaggagcgcgacauccccgagcgguccuggaacagcggguacgaguggaucacggacuuccccggcaagaccgucugguucgugcccuccaucaaggccggcaacgacaucgccaacugccugcgcaagaacgggaagcgggugauccagcucagccgcaagaccuucgacaccgaguaccagaagacgaagaacaacgacugggacuacgucgugaccaccgacaucuccgagaugggcgccaacuuccgggcggaccgcgugaucgacccgcggcgcugccugaagcccgucauccugaaggacgggcccgagcgggugauccucgccggccccaugccggucaccguggccagcgccgcccagcgccgggggcgcaucggccggaaccacaacaaggagggcgaccaguacaucuacauggggcagccccugaacaacgacgaggaccacgcgcacuggacggaggccaagaugcugcucgacaacaucaacacccccgagggcaucauccccgcccuguucgagccggagcgcgagaaguccgccgccaucgacggggaguaccgccugcggggcgaggcgcgcaagaccuucguggagcucaugcggcgcggggaccugcccgucuggcugagcuacaagguggccuccgagggcuuccaguacagcgaccggcgcuggugcuucgacggcgagcggaacaaccaggugcucgaggagaacauggacgucgagaucuggaccaaggagggggagcgcaagaagcugcggccccgcuggcuggacgcccggacguacagcgacccccucgcccugcgcgaguucaaggaguucgccgcgggccggcgcuccgugagcggggaccugauccucgagaucggcaagcugccgcagcaccugacccagcgggcccagaacgcccucgacaaccuggugaugcugcacaacuccgagcagggcgggcgcgccuaccggcacgcgauggaggagcuccccgacaccaucgagacccugaugcugcucgcccugaucgccguccugacgggcggggugacccucuucuuccugagcggcaaggggcugggcaagaccuccaucggccuccugugcgugauggccagcuccguccugcucuggauggccagcguggagccccacuggaucgcggccuccaucauccuggaguucuuccugauggugcuccugauccccgagccggaccgccagcggacgccccaggacaaccagcuggccuacgucgugaucgggcuccuguucaugauccugaccguggccgccaacgagaugggccuccuggagacgaccaagaaggaccuggggaucggccacgucgcgguggagaaccaccaccacgccgccaugcucgacguggaccugcaccccgccagcgccuggacccuguacgcggucgccaccacgaucaucaccccgaugaugcgccacaccaucgagaacaccacggccaacaucucccucaccgccaucgccaaccaggcggccauccugauggggcuggacaagggcuggcccaucagcaagauggacaucggcgugccccuccuggcccuggggugcuacucccaggugaacccccucacccugaccgccgcgcugcucaugcuggucgcccacuacgccaucaucggcccggggcugcaggccaaggccacgcgggaggcgcagaagcgcaccgccgccggcaucaugaagaaccccaccaucgacgggaucguggccaucgaccucgaccccguggucuacgacgccaaguucgagaagcagcugggccagaucaugcugcucauccugugcaccagccagauccugcucaugcgcacgaccugggcgcugugcgaguccaucacccuggccaccggcccccucacgacccugugggaggggagcccgggcaaguucuggaacaccaccaucgccguguccauggccaacaucuuccgggggagcuaccuggccggcgcgggccucgccuucucccugaugaagucccucgggggcgggcgccgggggacgggggcccagggcgagacccucggcgagaaguggaagcgccagcugaaccagcugagcaaguccgaguucaacaccuacaagcggagcgggaucauggagguggaccgcuccgaggccaaggagggccugaagcgcggggagaccacgaagcacgcggucagccgcggcaccgccaagcuccggugguucguggagcgcaaccuggugaagcccgaggggaaggucaucgaccugggcugcggccgcggcgggugguccuacuacugcgccgggcucaagaaggugaccgaggugaagggguacaccaagggcggccccggccacgaggagcccaucccgauggccacguacggguggaaccuggucaagcugcacagcggcaaggacguguucuucaucccgcccgagaagugcgacacccuccugugcgacaucggggaguccagccccaacccgaccaucgaggagggccgcacccugcgggugcucaagauggucgagcccuggcugcgcgggaaccaguucugcaucaagauccugaaccccuacaugcccuccgugguggagacgcucgagcagaugcagcggaagcacggcggcaugcugguccgcaacccgcugagccggaacuccacccacgagauguacugggugagcugcgggaccggcaacaucguguccgccgucaacaugaccagccgcaugcuccugaaccgguucaccauggcgcaccgcaagcccacguacgagcgcgacguggaccugggggccggcacccggcacguggccgucgagcccgagguggccaaccucgacaucaucggccagcgcaucgagaacaucaagcacgagcacaaguccaccuggcacuacgacgaggacaaccccuacaagaccugggccuaccacgggagcuacgaggugaagccguccggcagcgcguccagcauggucaacgggguggucaagcugcugacgaagcccugggacgugauccccauggugacccagaucgccaugaccgacaccacgcccuucggccagcagcgggucuucaaggagaagguggacacccgcaccccgaaggccaagcgggggaccgcccagaucauggaggugacggcccgcuggcucuggggcuuccugagccggaacaagaagccccgcaucugcacccgggaggaguucacccgcaagguccgguccaacgcggccaucggcgccguguucguggacgagaaccaguggaacagcgccaaggaggcggucgaggacgaccgcuucugggaccuggugcaccgggagcgcgagcuccacaagcaggggaagugcgcgaccugcguguacaacaugaugggcaagcgggagaagaagcugggggaguucggcaaggccaaggggucccgcgccaucugguacauguggcugggcgcccgguuccucgaguucgaggcgcugggcuucaugaacgaggaccacugguucagccgcgagaacucccugagcggggucgagggcgaggggcuccacaagcugggcuacauccugcgggacaucuccaagauccccgggggcaacauguacgccgacgacacggccggcugggacacccgcaucaccgaggacgaccuccagaacgaggccaagaucaccgacaucauggagccggagcacgcccagcuggccaagagcaucuucaagcugacguaccagaacaagguggugcggguccagcgccccgccaagaacgggaccgugauggacgugaucucccgccgggaccagcgcggcagcgggcaggucggcaccuacggccucaacaccuucacgaacauggaggcccagcugauccggcagauggaguccgaggggaucuucagccccaacgagcuggagacccccaaccucgccgagcgcgugcuggacuggcuggagaaguacggcguggagcggcucaagcgcauggccaucuccggggacgacugcgucgugaagccgaucgacgaccgguucgcgaccgcccugaccgcccugaacgacaugggcaaggugcgcaaggacaucccccagugggagcccagcaagggguggaacgacuggcagcagguccccuucugcucccaccacuuccaccagcucaucaugaaggacggccgggagaucguggugccgugccgcaaccaggacgagcuggucggccgggcccgcgugagccagggggccggcuggucccugcgggagacggcgugccucggcaagagcuacgcccagauguggcagcugauguacuuccaccgccgggaccugcgccucgccgccaacgcgaucugcagcgccgugcccgucgacugggugcccaccucccggaccaccuggagcauccacgcccaccaccaguggaugacgaccgaggacaugcuguccguguggaaccgcgucuggaucgaggagaaccccuggauggaggacaagacccggaucagcuccugggaggacgugccguaccugggcaagcgcgaggaccaguggugcgggagccucaucggccugaccgcccgcgccacgugggcgaccaacauccagguggccaucaaccagguccggcgccugaucggcaacgagaacuacuccgacuacaugaccagcaugaagcgguucaagaacgaguccgagcccgagggggcccucugguga

SEQ ID NO: 8967 - RNA, 9879 nt, Artificial Sequence
  derived and/or modified CDS sequence (opt1) from DENV-1__KP686070__SS-prME
agcgugaccaugcugcucaugcugcugcccaccgcccucgccuuccaccugaccacccggggcggggagccccacaugaucgugagcaagcaggagcggggcaagagccuccuguucaagaccagcgcgggggugaacaugugcacccugaucgccauggaccugggcgagcucugcgaggacacgaugaccuacaagugcccccggaucaccgaggccgagcccgacgacguggacugcuggugcaacgccaccgacaccugggugaccuacgggaccugcagccagaccggcgagcaccggcgcgacaagcgguccguggcccuggcgccccacgugggccuggggcucgagacccgcaccgagaccuggaugagcuccgagggcgccuggcggcagauccagaagguggagaccugggcccugcgccaccccggguucacggugaucgcccuguuccucgcgcacgccaucggcaccagcaucacccagaaggggaucaucuucauccugcugaugcucgugacccccuccauggccaugcggugcgucggcaucggcaaccgcgacuucguggaggggcugagcggcgccacguggguggacgucgugcuggagcacggguccugcgugaccaccauggccaagaacaagcccacccucgacaucgagcugcugaagacggaggucaccaaccccgcggugcuccggaagcugugcaucgaggccaagaucagcaacaccaccacggacucccgcugccccacccagggcgaggccacccugguggaggagcaggacgccaacuucgucugccggcgcaccuucguggaccggggcugggggaacggcugcggccucuucggcaaggggagccugcugacgugcgccaaguucaagugcgugaccaagcucgagggcaagaucguccaguacgagaaccugaaguacuccgugaucgugaccguccacaccggcgaccagcaccagguggggaacgagacgaccgagcacggcaccaucgcgaccaucacgccccaggcccccacgagcgagauccagcugaccgacuacggggcccucacccuggacugcagcccccggaccggccuggacuucaacgagaugguccuccugacgaugaaggagaaguccuggcuggugcacaagcagugguuccucgaccugccgcugcccuggaccuccggggccagcaccagccaggagaccuggaaccggcaggaccuccuggugacguucaagaccgcccacgcgaagaagcaggaggucguggugcugggcucccaggagggcgccaugcacaccgcccucaccggggccacggagauccagaccagcggcaccaccacgaucuucgccgggcaccugaagugccgccugaagauggacaagcucacccugaagggcgucuccuacgugaugugcaccgggagcuucaagcuggagaaggagguggcggagacccagcacggcacgguccugguccaggugaaguacgagggcaccgacgcccccugcaagauccccaucuccacccaggacgagaagggggucacccagaacggccggcucaucacggccaacccgaucgugaccgacaaggagaagcccgugaacaucgagaccgagccgcccuucggggagagcuacaucgucaucggcgccggcgagaaggcgcugaagcuguccugguucaagaaggggagcuccaucggcaagauguucgaggccaccgcccgcggggcccggcgcauggccauccucggcgacacggcgugggacuucgggagcaucggcggcguguucaccuccguggggaagcugguccaccagguguucggcaccgccuacggggugcuguucagcggcgucuccuggaccaugaagaucgggaucggcauccuccugacguggcugggccucaacagccgcuccaccagccuguccaugaccugcaucgccguggggauggugacccuguaccucggcgucauggugcaggccgacagcgggugcgugaucaacuggaagggccgggagcugaagugcggguccggcaucuucgucacgaacgaggugcacaccuggaccgagcaguacaaguuccaggccgacagcccgaagcgccugagcgcggccaucggcaaggccugggaggagggggugugcggcauccgguccgccacccgccucgagaacaucauguggaagcagaucagcaacgagcugaaccacauccugcucgagaacgacaugaaguucaccgucguggugggggacgccaacggcauccugacgcaggggaagaagaugauccggccccagcccauggagcacaaguacuccuggaaguccuggggcaaggcgaagaucaucggcgccgacacccagaacaccaccuucaucaucgacgggcccgacacgccggagugccccgacgaccagcgcgccuggaacaucugggaggucgaggacuacggcuucgggguguucaccaccaacaucuggcugaagcuccgggacuccuacacccagaugugcgaccaccgccugaugagcgccgcgaucaaggacuccaaggccgugcacgccgacaugggcuacuggaucgagagcgagaagaacgagacguggaagcuggcccgggccuccuucaucgaggucaagaccugcaucuggccccgcagccacacccucugguccaacggcgugcuggagagcgagaugaucauccccaagaucuacgggggcccgaucucccagcacaacuaccggcccggguacuucacccagacggcgggccccuggcaccuggggaagcucgagcuggacuucaaccugugcgagggcaccaccguggucguggacgagcacugcggcaaccgcgggccgagccuccggaccacgaccgugaccggcaagaucauccacgaguggugcugccgcuccugcacccugccgccccugcgguuccgcggggaggacggcugcugguacgggauggagauccggcccgucaaggagaaggaggagaaccucgugcgcagcaugguguccgccggcagcggcgaggucgacagcuucucccuggggcugcucugcgugagcaucaugaucgaggaggugaugcggucccgcuggagccgcaagaugcugaugacgggcacccuggccgucuucuuccuccugaucauggggcagcugaccuggaacgaccucauccggcugugcaucauggugggcgccaacguguccgaccgcauggggaugggcaccacguaccuggcccucauggcgaccuucaagaugcggccgauguucgccgucgggcugcuguuccgccggcucaccagccgcgaggugcugcugcucaccaucgggcugucccuggucgccagcguggagcuccccaacucccuggaggagcugggcgacgggcucgccaugggcaucaugaugcugaagcugcucacggacuuccagagccaccagcuguggaccacccugcucucccugaccuucaucaagacgacccugagccucgacuacgccuggaagaccauggcgauggugcuguccaucgucagccuguucccccucugccuguccaccacgagccagaagaccaccuggcugcccgugcuccugggcuccuucgggugcaagccgcugaccauguuccucaucaccgagaacaagaucuggggccgcaagagcuggccccugaacgaggggaucauggccgugggcaucgucuccauccugcucagcagccugcugaagaacgacgugccccucgccgggccccugaucgccggcggcaugcugaucgcgugcuacgugaucuccgggagcuccgccgaccucagccuggagcgcgccgccgaggucuccugggaggaggaggccgagcacagcggcgcgucccacaacauccugguggaggugcaggacgacgggacgaugaagaucaaggacgaggagcgggacgacacccucaccauccugcugaaggccacccuccuggccgucagcggcguguacccgauguccauccccgccacgcuguucgugugguacuucuggcagaagaagaagcagcgcagcgggguccucugggacacccccagcccgcccgagguggagcgggccgugcuggacgacggcaucuaccgcauccugcagcggggccugcucgggcgcagccaggucggcguggggguguuccaggacggcgucuuccacaccauguggcacgugacccgcggggcggugcugauguaccagggcaagcgccuggagcccuccugggccagcgucaagaaggaccucaucuccuacggcgggggcuggcgguuccaggggagcuggaacacgggcgaggagguccaggugaucgccgucgagcccgggaagaaccccaagaacgugcagaccacccccggcaccuucaagacgcccgagggcgaggugggggccaucgcccuggacuucaagcccggcaccuccgggagccccaucgucaaccgcgagggcaagaucgugggccuguacgggaacggcguggucaccaccuccgggacguacgugagcgcgaucgcccaggccaaggccagccaggagggcccgcuccccgagaucgaggacgagguguucaagaagcggaaccugaccaucauggaccugcaccccggguccggcaagacccgccgguaccucccggccaucguccgcgaggcgaucaagcgcaagcugcggacccugauccucgcccccacgcgcgugguggccagcgagauggccgaggcgcugaagggcaugcccauccgguaccagaccaccgccgucaaguccgagcacaccgggaaggagaucguggaccugaugugccacgccacguucaccaugcgccuccugagccccgugcgggucccgaacuacaacaugaucaucauggacgaggcccacuucaccgaccccgccuccaucgcggcccgcggcuacaucagcacccggguggggaugggcgaggccgccgccaucuucaugacggcgacgccgcccggguccguggaggccuucccgcagagcaacgccgucauccaggacgaggagcgcgacauccccgagcgguccuggaacagcggcuacgacuggaucaccgacuuccccggcaagaccgugugguucgugcccuccaucaagagcgggaacgacaucgccaacugccugcgcaagaacggcaagcgggucauccagcucucccgcaagacguucgacaccgaguaccagaagaccaagaacaacgacugggacuacguggugaccacggacaucagcgagaugggggccaacuuccgggcggaccgcgucaucgacccgcggcgcugccugaagcccgugauccugaaggacggccccgagcgggucauccucgccgggcccaugccggugaccgccgccuccgcggcccagcgccggggccgcaucggccgcaaccagaacaaggagggggaccaguacaucuacaugggccagccccugaacaacgacgaggaccacgcccacuggaccgaggccaagaugcugcucgacaacaucaacacccccgaggggaucauccccgcccuguucgagccggagcgggagaaguccgcggccaucgacggcgaguaccgccugcgcggggaggcccgcaagacguucguggagcucaugcggcgcggcgaccugcccgucuggcuguccuacaagguggccagcgagggcuuccaguacuccgaccggcgcuggugcuucgacggggagcggaacaaccaggugcucgaggagaacauggacgucgagaucuggaccaaggagggcgagcgcaagaagcugcggccccgcuggcuggacgcccggaccuacagcgacccccucgcgcugcgcgaguucaaggaguucgccgccgggcggcgcagcguguccggcgaccugauccucgagaucggcaagcugccgcagcaccugacccuccgggcccagaacgcccuggacaaccuggugaugcuccacaacagcgagcagggcgggaaggcguaccgccacgccauggaggagcugcccgacaccaucgagacgcugaugcuccuggcccugaucgccguccucaccgggggcgugacccuguucuuccuguccgggaagggccucggcaagaccagcaucgggcugcugugcgugauggcguccagcguccuccuguggauggccuccguggagccccacuggaucgccgccagcaucauccuggaguucuuccucauggugcugcugauccccgagccggaccggcagcgcacgccccaggacaaccagcucgccuacgucgugaucggccugcuguucaugauccucaccguggcggccaacgagauggggcugcuggagaccaccaagaaggaccucggcaucgggcacgucguggccgagaaccaccaccacgccacgaugcuggacaucgaccugcaccccgccuccgcguggacccucuacgccguggccaccaccaucaucacgccgaugaugcggcacaccaucgagaacaccaccgccaacaucagccugacggccaucgcgaaccaggccgccauccugaugggccucgacaagggcuggcccaucuccaagauggacaucggggucccccugcuggcccucggcugcuacagccaggugaacccccugacccugaccgccgcgguguccaugcucgucgcccacuacgccaucaucgggccgggccugcaggccaaggcgacccgcgaggcccagaagcgcacggccgccgggaucaugaagaaccccaccguggacggcaucguggccaucgaccuggaccccgucguguacgacgcgaaguucgagaagcagcucggccagaucaugcugcugauccucugcaccagccagauccugcugaugcggaccacgugggcccucugcgaguccaucacccuggccaccgggccccugaccacgcucugggagggcagcccggggaaguucuggaacaccaccaucgccguguccauggccaacaucuuccgcggcagcuaccuggcgggcgccgggcuggccuucucccucaugaagucccugggcgggggccggcgcgggaccggcgcccagggcgagacgcugggggagaaguggaagcggcagcucaaccagcugagcaaguccgaguucaacaccuacaagcgcagcggcaucauggaggucgaccgguccgaggccaaggaggggcugaagcgcggcgagaccaccaagcacgcggugagccgggggacggccaagcuccgcugguucguggagcggaaccuggucaagcccgagggcaaggugaucgaccugggcugcgggcgcggcgggugguccuacuacugcgccggccugaagaaggugaccgaggucaagggguacaccaagggcggccccgggcacgaggagcccaucccgauggccaccuacggcuggaacaucgugaagcuccacagcgggcgggacguguucuucacgccgcccgagaagugcgacacgcugcugugcgacaucggcgaguccagccccaacccgaccaucgaggaggggcgcacccuccggguccugaagaugguggagcccuggcugcgcggcaaccaguucugcaucaagauccucaaccccuacaugcccuccguggucgagacccuggagcagaugcagcggaagcacggcgggaugcuggugcgcaacccgcucagccggaacuccacgcacgagauguacugggugagcugcggcaccgggaacaucgucuccgcggugaacaugaccagccgcaugcugcugaaccgcuucaccauggcccaccggaagcccacguacgagcgcgacguggaccucggcgccggcacccggcacgucgccguggagcccgagaucgccaaccuggacaucaucgggcagcgcaucgagaacaucaagaacgagcacaaguccaccuggcacuacgacgaggacaaccccuacaagaccugggcguaccacggcagcuacgaggugaagccguccgggagcgccuccagcauggucaacggcgugguccggcugcucacgaagcccugggacgugauccccauggugacccagaucgccaugaccgacaccacgcccuucgggcagcagcgcgucuucaaggagaagguggacacccggaccccgcgccccaagcggggcaccgcccagaucauggaggugacggccaaguggcuguggggcuuccugagccgcaacaagaagccccggaucugcacccgcgaggaguucacccggaagguccgcuccaacgcggccaucggggccguguucguggacgagaaccaguggaacagcgccaaggaggccgucgaggacgagcgguucugggaccucgugcaccgcgagcgggagcugcacaagcagggcaagugcgcgaccugcguguacaacaugauggggaagcgcgagaagaagcugggcgaguucgggaaggccaagggcucccgggccaucugguacauguggcucggcgcccgcuuccuggaguucgaggcgcugggguucaugaacgaggaccacugguucagccgggagaacucccucagcggcgucgagggggagggccugcacaagcugggguacauccuccgcgacaucuccaagaucccgggcggcaacauguacgccgacgacacggccgggugggacacccgcaucaccgaggacgaccugcagaacgaggccaagaucaccgacaucauggagcccgagcacgcccugcucgcgacgagcaucuucaagcugaccuaccagaacaagguggugcggguccagcgccccgccaaguccggcaccgugauggacgugaucagccggcgcgaccagcggggguccggccaggucggcaccuacgggcugaacacguucaccaacauggaggugcagcucauccgccagauggagagcgagggcaucuucucccccagcgagcuggagaacuccaaccuggccgagcgggugcucgacuggcuggagaagcacggggucgagcgccugaagcggauggccaucagcggcgacgacugcguggugaagccgaccgacgaccgcuucgccaccgcgcucacggcccugaacgacauggggaagguccggaaggacaucccccagugggagcccuccaagggcuggaacgacuggcagcagguccccuucugcagccaccacuuccaccagcugaucaugaaggacggccgcgagaucguggucccgugccggaaccaggacgagcucguggggcgcgcccgggugagccagggcgccggguggucccugcgcgagaccgccugccugggcaagagcuacgcgcagauguggcagcucauguacuuccaccggcgcgaccugcggcuggccgccaacgccaucugcuccgccguccccgugaacugggugcccaccagccgcaccaccugguccauccacgcgcaccaccaguggaugacgaccgaggacaugcucagcgucuggaaccgcguguggaucgaggagaaccccuggauggaggacaagacccacguguccagcugggaggacgucccguaccuggggaagcgggaggaccaguggugcggcucccugaucggccucaccgcccgcgccacgugggccaccaacauccagguggcgaucaaccaggugcggcgccugaucgggaacgagaacuaccuggacuacaugaccagcaugaagcgguucaagaacgaguccgaccccgagggcgcccucugguga

SEQ ID NO: 8968 - RNA, 9876 nt, Artificial Sequence
  derived and/or modified CDS sequence (opt1) from DENV-1__KF672760__SS-prME
agcgugaccaugcugcucaugcugcugcccaccgcccucgccuuccaccugaccacccgcggcggggagccccacaugaucgugagcaagcaggagcggggcaagagccuccuguucaagaccagcgcgggggugaacaugugcacccugaucgccauggaccugggcgagcucugcgaggacaccaugaccuacaagugcccccgcaucaccgaggccgagcccgacgacguggacugcuggugcaacgccaccgacaccugggucaccuacgggaccugcagccagaccggcgagcaccggcgcgagaagcgguccguggcccuggcgccccacgugggccuggggcucgagacccgcaccgagaccuggaugagcuccgagggcgccuggaagcagauccagcgggucgagaccugggcccugcgccaccccggguucacggugaucgccuucuuccuggcgcacgccaucggcaccagcaucacccagaaggggaucaucuucauccuccugaugcuggugacccccuccauggccaugcggugcgucggcaucggcaaccgcgacuucguggaggggcucagcggcgccacguggguggacgucgugcuggagcacggguccugcgugaccaccauggccaagaacaagcccacccuggacaucgagcuccugaagacggaggucaccaaccccgcggugcugcggaagcucugcaucgaggccaagaucagcaacaccaccacggacucccgcugcccgacccagggcgaggccacccugguggaggagcaggacgccaacuucgucugccggcgcaccuucguggaccggggcugggggaacggcugcgggcuguucggcaaggggagccuccugacgugcgccaaguucaagugcgugaccaagcuggagggcaagaucguccaguacgagaaccucaaguacuccgugaucgugaccguccacaccggcgaccagcaccagguggggaacgagacgaccgagcacggcaccaucgcgaccaucacgccccaggcccccacgagcgagauccagcugaccgacuacggggcccugacccucgacugcagcccccggaccggccuggacuucaacgagaugguccugcucacgaugaaggagaaguccuggcuggugcacaagcagugguuccuggaccucccgcugcccuggaccuccggggccagcaccagccaggagaccuggaaccggcaggaccugcucgugacguucaagaccgcccacgcgaagaagcaggaggucguggugcugggcucccaggagggcgccaugcacaccgcccugaccggggccacggagauccagaccagcggcaccaccacgaucuucgccgggcaccucaagugccgccugaagauggacaagcugacccucaagggcauguccuacgucaugugcaccgggagcuucaagcuggagaaggagguggcggagacccagcacggcacggugcugguccaggugaaguacgagggcaccgacgcccccugcaagauccccuucuccacccaggacgagaagggggugacccagaacggccggcugaucacggccaacccgaucgucaccgacaaggagaagcccgugaacaucgagaccgagccgcccuucggggagagcuacaucguggucggcgccggcgagaaggcgcucaagcuguccugguucaagcgcgggagcuccaucggcaagauguucgaggccaccgcccgcggggcgcgccgcauggccauccugggcgacacggcgugggacuucgggagcaucggcggcguguucaccuccguggggaagcucguccaccagguguucggcaccgccuacggggugcuguucagcggcgucuccuggaccaugaagaucgggaucggcauccugcucacguggcugggccugaacagccgguccaccagccucuccaugaccugcaucgccguggggauggugacccuguaccugggcgucauggugcaggccgacagcgggugcgugaucaacuggaagggccgcgagcucaagugcggguccggcaucuucgucacgaacgaggugcacaccuggaccgagcaguacaaguuccaggccgacagcccgaagcggcugagcgcggccaucggcaaggccugggaggagggggugugcggcauccgcuccgccacccggcuggagaacaucauguggaagcagaucagcaacgagcucaaccacauccugcuggagaacgacaugaaguucaccgucguggugggggacgccaacggcauccucgcgcaggggaagaagaugauccgcccccagcccauggagcacaaguacuccuggaaguccuggggcaaggccaagaucaucggcgccgacauccagaacacgaccuucaucaucgacgggcccgacaccccggagugccccgacggccagcgggccuggaacaucugggaggucgaggacuacggguucggcguguucaccacgaacaucuggcugaagcugcgcgacuccuacacccagaugugcgaccaccggcucaugagcgcggccaucaaggacuccaaggccgugcacgccgacaugggcuacuggaucgagagcgagaagaacgagaccuggaagcuggcccgcgcguccuucaucgaggucaagaccugcacguggcccaagagccacacccugugguccaacggggugcucgagagcgagaugaucauccccaagaucuucggcgggccgaucucccagcacaacuaccggcccggcuacuucacccagaccgccgggcccuggcaccugggcaagcuggagcucgacuucgaccugugcgagggcacgaccguggucguggacgagcacugcgggaaccgcggcccgagccugcggaccaccacggugaccgggaagaucauccacgaguggugcugccgcuccugcacccugccgccccugcgguuccgcggcgaggacgggugcugguacggcauggagauccggcccgucaaggagaaggaggagaaccuggugcgcagcaugguguccgccggcagcggggaggucgacagcuucucccucggcauccugugcgugagcaugaugaucgaggaggugaugcggucccgcuggagccgcaagaugcugaugaccgggacgcucgccgucuuccugcugcucaucaugggccagcugaccuggaacgaccugauccggcucugcaucauggugggggccaacgcguccgaccgcaugggcaugggcaccaccuaccuggcccugauggccacguucaagaugcggccgauguucgccguggggcuccuguuccgccggcugaccagccgcgagguccuccugcugaccaucggccucucccugguggccugcgucgagcugcccaacagccucgaggagcugggggacggccuggcgaugggcaucaugaugcucaagcugcugaccgaguuccagccccaccagcucuggacgacccugcugucccucaccuucgugaagaccacgcugagccuggacuacgccuggaagaccaccgccauggugcucuccaucgucagccuguucccccugugccucuccaccacgagccagaagaccaccuggcugccggugcugcucggguccuucggcugcaagccccugaccauguuccugaucaccgagaacaagaucugggggcgcaagagcuggccccucaacgagggcaucauggccaucgggaucguguccauccugcugagcucccuccugaagaacgacgucccccuggcgggcccgcucaucgccggcgggaugcugaucgccugcuacgugaucagcggcagcuccgccgaccugagccucgagaaggccgcggagguguccugggagcaggaggccgagcacagcggggccucccacaacauccuggucgaggugcaggacgacggcacgaugaagaucaaggacgaggagcgcgacgacacccugaccauccuccugaaggccacccugcucgccgugagcggggucuaccccauguccauccccgcgacgcuguucgugugguacuucuggcagaagaagaagcagcggagcggcgugcugugggacacccccuccccgcccgaggucgagcgcgccgugcucgacgacggcaucuaccggauccugcagcgcgggcugcugggccggagccaggugggggucggcguguuccaggacgggguguuccacaccauguggcacgucacccgcggcgccgugcucauguaccagggcaagcggcuggagcccuccugggccagcgugaagaaggaccugaucuccuacgggggcggguggcgcuuccagggcagcuggaacacgggggaggagguccaggugaucgccguggagcccggcaagaacccgaagaacguccagaccacccccggcaccuucaagacgcccgagggggaggugggcgcgaucgcccucgacuucaagcccgggaccuccggcagcccgaucgugaaccgggagggcaagaucgucgggcuguacggcaacgggguggugaccaccuccggcacguacgucagcgccaucgcccaggccaaggcgucccaggaggggccccugcccgagaucgaggacgagguguucaagaagcgcaaccucaccaucauggaccugcacccgggcagcggcaagacccggcgcuaccugcccgccaucgugcgggaggccaucaagcgcaagcuccgcacccugauccuggcccccacgcgggucguggcgagcgagauggccgaggcccucaaggggaugcccauccgcuaccagaccaccgccgugaaguccgagcacaccggccgggagaucgucgaccugaugugccacgccacguucaccaugcgccugcucagcccggugcgggugcccaacuacaacaugaucaucauggacgaggcgcacuucaccgaccccgccuccaucgccgcccgcggguacaucagcacccgggucggcaugggggaggccgcggccaucuucaugacggccacgccgcccggcuccguggaggccuucccccagagcaacgccgugauccaggacgaggagcgcgacauccccgagcgguccuggaacagcggcuacgacuggaucaccgacuuccccgggaagaccgucugguucgugcccuccaucaagagcggcaacgacaucgcgaacugccugcgcaagaacgggaagcgggugauccagcugucccgcaagacguucgacaccgaguaccagaagaccaagaacaacgacugggacuacgucgugaccacggacaucagcgagaugggcgccaacuuccgggccgaccgcgugaucgacccccggcgcugccucaagcccgucauccugaaggacgggcccgagcgggugauccuggccggcccgaugcccgucaccguggcguccgccgcccagcgccggggccgcaucgggcgcaaccagaacaaggagggcgaccaguacguguacauggggcagccccucaacaacgacgaggaccacgcccacuggaccgaggccaagaugcugcuggacaacaucaacacccccgagggcaucaucccggcccucuucgagcccgagcgggagaaguccgccgccaucgacggggaguaccgccugcggggcgaggcccgcaagacguucgucgagcugaugcggcgcggcgaccuccccguguggcuguccuacaagguggccagcgagggguuccaguacuccgaccggcgcuggugcuucgacggcgagcggaacaaccagguccuggaggagaacauggacguggagaucuggaccaaggagggggagcgcaagaagcuccggccccgcuggcuggacgcgcggaccuacagcgacccgcuggcccuccgcgaguucaaggaguucgccgccggccggcgcuccgugagcggcgaccugauccuggagaucgggaagcucccccagcaccugacccugcgggcccagaacgcgcucgacaaccuggucaugcugcacaacagcgagcagggcgggaaggccuaccgccacgccauggaggagcuccccgacaccaucgagacgcugaugcugcucgcccugaucgcggugcugaccggcggggugacccucuucuuccuguccggcaagggccuggggaagaccagcaucggccuccugugcgucacggccuccagcgcccugcucuggauggccuccguggagccccacuggaucgccgcgagcaucauccuggaguucuuccugauggugcuccugaucccggagcccgaccggcagcgcacgccccaggacaaccagcuggccuacgucgugaucgggcuccuguucaugauccugaccguggccgccaacgagaugggccuccuggagaccacgaagaaggaccuggggaucggcuacgucgccgcggagaaccaccagcacgccaccaugcucgacguggaccugcacccggccuccgccuggacccuguacgccguggcgaccacggucaucacccccaugaugcggcacaccaucgagaacaccacggccaacaucagccucaccgccaucgccaaccaggccgcgauccugaugggccuggacaagggguggcccaucuccaagauggacaucggcgugccccuccuggcccuggggugcuacagccaggugaacccgcucacccugaccgccgccguccugaugcucguggcgcacuacgccaucaucggccccgggcugcaggccaaggccacgcgcgaggcccagaagcgcaccgcggccggcaucaugaagaaccccaccguggacggcaucgucgccaucgaccuggaccccgugguguacgacgccaaguucgagaagcagcucgggcagaucaugcugcugauccucugcaccucccagauccugcugaugcggacgaccugggcccucugcgagagcaucacccuggcgaccggcccgcugacgacccucugggaggggucccccggcaaguucuggaacaccaccaucgccgucagcauggccaacaucuuccgcggcuccuaccuggccggggccggccuggcguucagccucaugaagucccucgggggcgggcggcgcggcacgggcgcccagggggagacccugggcgagaaguggaagcggcagcucaaccagcugagcaaguccgaguucaacaccuacaagcgcagcgggaucauggagguggaccggagcgaggccaaggagggccugaagcgcggggagaccacgaagcacgccgugucccggggcaccgcgaagcuccgcugguucgucgagcggaaccuggugaagcccgagggcaaggugaucgaccuggggugcggccgcgggggcuggagcuacuacugcgccgggcugaagaaggucaccgaggugaagggcuacaccaagggcgggcccggccacgaggagccgauccccauggccaccuacggguggaaccucgugaagcugcacuccggcaaggacgucuucuucaugccgcccgagaagugcgacacgcugcucugcgacaucggggagagcuccccgaaccccaccaucgaggagggccggacccugcgcgugcugaagaugguggagcccuggcuccggggcaaccaguucugcaucaagauccugaaccccuacaugccgagcgucguggagacccuggagcgcaugcagcggaagcacgggggcaugcucgugcgcaacccccugucccggaacagcacgcacgagauguacugggucuccugcgggaccggcaacaucgugagcgccgugaacaugaccucccgcaugcugcucaaccgcuucaccauggcccaccggaagcccacguacgagcgcgacgucgaccugggcgcggggacccggcacguggccguggagcccgaggucgccaaccuggacaucaucggccagcgcaucgagaacaucaagaacgagcacaagagcaccuggcacuacgacgaggacaacccguacaagaccugggccuaccacggguccuacgaggugaagcccagcggcuccgccagcuccauggucaacgggguggugcggcuccugacgaagcccugggacgucauccccauggugacccagaucgcgaugaccgacaccacgccguucggccagcagcgcguguucaaggagaaggucgacacccggacgccccgggccaagcggggcaccacgcagaucauggaggugaccgccaaguggcuguggggguuccucagccgcaacaagaagccccggaucugcacccgcgaggaguucacccggaaggugcgcuccaacgccgccaucggcgcggucuucguggacgagaaccaguggaacagcgccaaggaggccguggaggacgagcgguucugggaccugguccaccgcgagcgggagcugcacaagcaggggaagugcgccacgugcguguacaacaugaugggcaagcgcgagaagaagcucggggaguucggcaaggcgaagggcagccgggccaucugguacauguggcugggggcccgcuuccuggaguucgaggcccucggcuucaugaacgaggaccacugguucucccgggagaacagccuguccgggguggagggcgaggggcugcacaagcucggcuacauccugcgcgacaucagcaagaucccgggcgggaacauguacgccgacgacaccgcgggcugggacacccgcaucaccgaggacgaccugcagaacgaggccaagaucacggacaucauggagcccgagcacgcccuccuggccaccuccaucuucaagcugaccuaccagaacaaggucgugcgggugcagcgccccgccaagaacgggaccgucauggacgugaucagccggcgcgaccagcggggcuccggccagguggggacguacggccucaacaccuucaccaacauggagguccagcugauccgccagauggagagcgaggggaucuuccugcccuccgagcucgagaccccgaaccuggcggagcgggcccuggacuggcucgagaagcacggcgccgagcgccugaagcggauggccaucagcggggacgacugcguggugaagcccaucgacgaccgcuucgccacggcgcugaccgcccucaacgacaugggcaagguccggaaggacaucccccagugggagcccuccaagggcuggaacgacuggcagcaggucccguucugcagccaccacuuccaccagcugaucaugaaggacgggcgcgagaucgugguccccugccggaaccaggacgagcuggugggccgcgcccgggugucccagggggccggcuggagccuccgcgagaccgccugccuggggaaguccuacgcgcagauguggcagcugauguacuuccaccggcgcgaccuccggcuggccgccaacgccaucugcagcgcgguccccguggacugggugcccgccucccgcaccaccuggagcauccacgcccaccaccaguggaugacgaccgaggacaugcugagcgucuggaaccgcguguggaucgaggagaacccguggauggaggacaagacccacguguccagcugggaggagguccccuaccucggcaagcgggaggaccaguggugcggcucccugaucgggcugaccgcccgcgccacgugggcgaccaacauccagguggccaucaaccaggugcggcgccucaucggcaacgagaacuaccuggacuacaugaccagcaugaagcgguucaagaacgaguccgaccccgagggggcccugugg

SEQ ID NO: 8969 - RNA, 9876 nt, Artificial Sequence
  derived and/or modified CDS sequence (opt1) from DENV-1__KF672759__SS-prME
agcgugaccaugcugcucaugcugcugcccaccgcccucgccuuccaccugaccacccggggcggggagccccacaugaucgugagcaagcaggagcggggcaagagccuccucuucaagaccuccgugggggugaacaugugcacccugaucgcgauggaccugggcgagcucugcgaggacaccaugaccuacaagugcccccgcaucaccgaggccgagcccgacgacguggacugcuggugcaacgccaccgacaccugggugaccuacgggaccugcagccagaccggcgagcaccggcgcgacaagcgguccguggcccuggcgccccacgucggccuggggcucgagacgcgcaccgagaccuggaugagcuccgagggcgccuggaagcagauccagaagguggagaccugggcccugcggcaccccggguucacggugaucgcccuguuccucgcccacgcgaucggcaccagcaucacccagaaggggaucaucuucauccugcugaugcucgugacccccuccauggccaugcgcugcgugggcaucggcaaccgggacuucguggaggggcugagcggcgccacgugggucgacguggugcuggagcacggguccugcgucaccaccauggccaagaacaagcccacccucgacaucgagcugcugaagacggaggugaccaaccccgccgugcuccgcaagcugugcaucgaggcgaagaucagcaacaccaccacggacucccggugccccacccagggcgaggccacccuggucgaggagcaggacgccaacuucgugugccgccggaccuucguggaccgcggcugggggaacggcugcggccucuucggcaaggggagccugcugacgugcgccaaguucaagugcgucaccaagcucgagggcaagaucgugcaguacgagaaccugaaguacuccgugaucgucaccgugcacaccggcgaccagcaccaggucgggaacgagacgaccgagcacggcaccaucgccaccaucacgccccaggcgcccacgagcgagauccagcugaccgacuacggggcccucacccuggacugcagcccccggaccggccuggacuucaacgagauggugcuccugacgaugaaggagaaguccuggcuggugcacaagcagugguuccucgaccugccgcugcccuggaccuccggggccagcaccagccaggagaccuggaaccgccaggaccuccuggucacguucaagaccgcccacgccaagaagcaggagguggugguccugggcucccaggagggcgcgaugcacaccgcccucaccggggccacggagauccagaccagcggcaccaccacgaucuucgccgggcaccugaagugccggcugaagauggacaagcucacccugaagggcauguccuacgugaugugcaccgggagcuucaagcuggagaaggagguggccgagacccagcacggcacgguccugguccaggugaaguacgagggcaccgacgcgcccugcaagauccccuuccucacccaggacgagaagggggucacccagaacggccgccugaucacggccaacccgaucgugaccgacaaggagaagcccgugaacaucgagaccgagccgcccuucggggaguccuacaucgucgugggcgccggcgagaaggcccugaagcucagcugguucaagaagggguccagcaucggcaagauguucgaggcgaccgcccgcggggcccgccggauggccauccugggcgacacggccugggacuucggguccaucggcggccuguucaccagcguggggaagcucauccaccaggucuucggcaccgcguacggggugcuguucuccggcgugagcuggaccaugaagaucgggaucggcauccugcucacguggcugggccugaacucccgcagcaccucccucagcaugaccugcaucgccgucgggauggugacccuguaccugggcgugaugguccaggccgacuccgggugcgugaucaacuggaagggccgcgagcucaagugcgggagcggcaucuucgugacgaacgagguccacaccuggaccgagcaguacaaguuccaggccgacuccccgaagcggcugagcgccgcgaucggcaaggccugggaggagggggugugcggcauccgcagcgccacccggcuggagaacaucauguggaagcagaucuccaacgagcucaacuacauccugcuggagaacgacaugaaguucaccguggucgugggggacgugaacggcauccucgcccaggggaagaagaugauccgcccccagcccauggagcacaaguacagcuggaaguccuggggcaaggccaagaucaucggcgcggacauccagaacacgaccuucaucaucgacgggcccgacaccccggagugccccgacgaccagcgggccuggaacaucugggaggucgaggacuacggcuucgggaucuucaccacgaacaucuggcugaagcugcgcgacagccacacccagaugugcgaccaccggcucauguccgccgccaucaaggacagcaaggcggugcacgccgacaugggcuacuggaucgaguccgagaagaacgagaccuggaagcuggcccgcgccagcuucaucgaggugaagaccugcaucuggcccaagucccacacgcuguggagcaacggcguccucgaguccgagauggugauccccaagaucuacgggggcccgaucagccagcacaacuaccggcccggguacuucacccagaccgccggccccuggcaccuggggaagcuggagcucgacuucgaccugugcgagggcaccacgguggucguggacgagcacugcggcuaccgcgggccgucccugcggaccaccaccgugacgggcaagaucauccacgaguggugcugccgcagcugcacccugccgccccugcgguuccgcggggaggacggcugcugguacgggauggagauccggcccgucaaggagaaggaggagaaccuggugcgcuccauggugagcgcgggcuccggcgaggucgacagcuucagccucgggauccugugcguguccauccugaucgaggaggugaugcggagccgcuggucccggaagaugcucaugaccggcacccuggccgucuuccugcuccugaucauggggcagcugacguggaacgaccucauccgccugugcaucauggugggcgccaacgccagcgaccgcauggggaugggcaccaccuaccuggcccucauggcgaccuucaagaugcggccgauguucgccgugggccugcuguuccgccggcucacgugccgcgagguccugcugcucaccguggggcugucccuggucgccagcguggagcuccccaacucccuggaggagcugggcgacgggcucgccaugggcaucaugaugcugaagcugcucaccgacuuccagccccaccagcuguggaccacgcugcucagccugaccuucauccggaccucccugagccucgacuacgccuggaagaccauggcgauggcccuguccaucgugagccuguucccccucugccuguccacgaccagccagaagaccaccuggcugccgguccuccugggcuccuucgggugcaagccccugacgauguuccucaucaccgagaacaagaucuggggccgcaagagcuggcccaucaacgaggggaucauggccgugggcaucguguccauccugcugagcucccuccugaagaacgacgucccccuggccgggccgcucaucgcgggcggcaugcugaucgccugcuacgugaucagcgggagcuccgccgaccugagccucgagaaggccgccgagguguccugggaggaggaggcggagcacagcggcaccucccacaacauccuggucgaggugcaggacgacgggaccaugaagaucaaggacgaggagcgggacgacacccugacgauccuccugaaggccacccugcucgccgugagcggcgucuaccccauguccauccccgccacccuguucgugugguacuucuggcagaagaagaagcagcgcagcggggugcugugggacacccccuccccgcccaaggucgagcgggccgugcuggacgacggcaucuaccgcauccuccagcggggccugcuggggcgcagccaggugggcgucgggguguuccaggacggcguguuccacacgauguggcacgucacccgcggggcggugcucauguaccagggcaagcgccuggagcccuccugggccagcgugaagaaggaccugaucuccuacggcgggggcuggcgguuccaggggagcuggaacaccggcgaggagguccaggugaucgccguggagcccgggaagaacccgaagaacguccagaccacgcccggcaccuucaagacccccgagggcgaggugggggccaucgcccucgacuucaagcccggcaccuccgggagcccgaucgugaaccgcgagggcaagaucgucggccuguacgggaacggcguggugacgaccuccgggaccuacgucagcgcgaucgcccaggccaaggccacccaggagggcccccugcccgagaucgaggacgagguguucaagaagcggaaccucacgaucauggaccugcacccgggguccggcaagacccgccgguaccugcccgccaucgugcgcgaggcgaucaagcggaagcuccgcacccugauccuggcccccacccgcgucguggccagcgagauggccgaggcgcucaagggcaugcccauccgguaccagacgaccgccgucaagagcgagcacaccgggcgcgagaucgucgaccugaugugccacgccaccuucacgaugcggcugcucuccccggugcgcgugcccaacuacaacaugaucaucauggacgaggcccacuucaccgaccccgccagcaucgcggcccggggcuacaucuccacccgcgucgggaugggcgaggccgccgccaucuucaugaccgcgacgcccccggggagcguggaggccuucccccaguccaacgccgugauccaggacgaggagcgggacauccccgagcgcagcuggaacuccggcuacgacuggaucaccgacuuccccggcaagaccgucugguucgugccgagcaucaaguccgggaacgacaucgccaacugccugcggaagaacggcaagcgcgugauccagcugagccggaagaccuucgacacggaguaccagaagaccaagaacaacgacugggacuacgucgugaccaccgacaucuccgagaugggggccaacuuccgcgcggaccgggugaucgacccccgccggugccucaagcccgucauccugaaggagggccccgagcgcgugauccuggccgggccgaugcccgucacgguggccagcgccgcgcagcggcgcggccggaucggccgcaaccagaacaaggagggggaccaguacaucuacaugggccagccccucaacaacgacgaggaccacgcccacuggaccgaggccaagaugcugcuggacaacaucaacacccccgaggggaucaucccggcccucuucgagcccgagcgcgagaaguccgccgcgaucgacggcgaguaccggcugcgcggggaggcccggaagaccuucguggagcugaugcgccggggcgaccuccccgucuggcugagcuacaagguggccuccgagggcuuccaguacagcgaccgccgguggugcuucgacggggagcgcaacaaccaggugcuggaggagaacauggacgucgagaucuggacgaaggagggcgagcggaagaagcuccgcccccgguggcuggacgcccgcaccuacuccgacccgcuggcccuccgggaguucaaggaguucgcggccgggcgccggagcguguccggcgaccugauccuggagaucggcaagcucccccagcaccugacccugcgcgcccagaacgcccucgacaaccuggugaugcugcacaacagcgagcagggcgggaaggccuaccggcacgcgauggaggagcuccccgacaccaucgagacccugaugcugcucgcccugaucgccguccugaccggcggggugacccucuucuuccugagcgggaaggggcugggcaagaccuccaucgggcuccugugcgugauggccagcuccgcgcugcucuggauggccagcgucgagccccacuggaucgccgccuccaucauccuggaguucuuccugauggugcuccugaucccggagcccgaccgccagcggacgccccaggacaaccagcuggccuacguggucaucggccuccuguucaugauccugacgguggcggccaacgagauggggcuccuggagaccaccaagaaggaccugggcaucgggcacguggccgucgagaaccaccaccacgccaccaugcucgacguggaccugcgcccggccagcgcguggacgcuguacgccguggccaccaccgucaucacccccaugaugcggcacacgaucgagaacaccaccgccaacaucucccucaccgccaucgcgaaccaggccgccauccugaugggccuggacaagggcuggcccaucagcaagauggacaucggggugccccuccuggcccugggcugcuacucccaggugaacccgcucacgcugaccgccgcgguccugaugcucguggcccacuacgccaucaucgggcccggccugcaggccaaggcgacccgcgaggcccagaagcgcaccgccgccgggaucaugaagaaccccacgguggacggcaucgucaccaucgaccuggaccccgugguguacgacgccaaguucgagaagcagcucggccagaucaugcugcugauccucugcaccagccagauccugcugaugcggaccacgugggcgcucugcgaguccaucacccuggccaccgggccgcugaccacgcucugggagggcagccccgggaaguucuggaacaccaccaucgccgucuccauggccaacaucuuccgcggcagcuaccuggccggcgcggggcuggccuucucccucaugaagucccugggcgggggccggcgcgggaccggcgcccagggcgagacgcugggggagaaguggaagcggcagcucaaccagcuguccaagagcgaguucaacaccuacaagaaguccggcaucauggagguggaccgcagcgaggccaaggaggggcugaagcggggcgagaccaccaagcacgccgugagccgcgggacggcgaagcugcggugguucgucgagcgcaaccucgugaagcccgagggcaaggugaucgaccugggcugcgggcggggcgggugguccuacuacugcgccggccugaagaaggucaccgaggugaagggguacaccaagggcggccccgggcacgaggagccgauccccauggccaccuacggcuggaaccucgugaagcugcacagcgggaaggacgucuucuucacgccgcccgagaagugcgacacgcugcucugcgacaucggcgaguccagcccgaaccccaccaucgaggaggggcgcacccugcgggugcugaagaugguggagcccuggcuccgcggcaaccaguucugcaucaagauccugaaccccuacaugccguccgucguggagacccuggagcagaugcagcggaagcacggcgggaugcucgugcgcaacccccugagccggaacuccacgcacgagauguacugggucagcugcggcaccgggaacaucguguccgccgugaacaugaccagccgcaugcugcucaaccgguucaccauggcgcaccgcaagcccacguacgagcgcgacgucgaccugggcgccggcacccggcacguggccguggagcccgaggucgccaaccuggacaucaucgggcagcgcaucgagaacaucaagaacgagcacaaguccaccuggcacuacgacgaggacaacccguacaagaccugggccuaccacggcagcuacgaggugaagcccuccgggagcgcguccagcauggucaacggcguggugcggcuccugacgaagcccugggacgucauccccauggugacccagaucgccaugaccgacaccacgccguucgggcagcagcgcguguucaaggagaaggucgacacccggacgccccgggccaagcggggcaccgcccagaucauggaggugacggccaaguggcuguggggcuuccucucccgcaacaagaagccccggaucugcacccgcgaggaguucacccggaaggugcgcagcaacgcggccaucggggccgucuucguggacgagaaccaguggaacuccgccaaggaggccguggaggacgagcgguucugggaccugguccaccgcgagcgggagcugcacaagcagggcaagugcgcgaccugcguguacaacaugauggggaagcgcgagaagaagcucggcgaguucgggaaggccaagggcagccgggccaucugguacauguggcugggcgcccgcuuccuggaguucgaggcgcucggguucaugaacgaggaccacugguucagccgggagaacucccugagcggcguggagggggagggccugcacaagcucggguacauccugcgcgacaucuccaagaucccgggcggcaacauguacgccgacgacacggccgggugggacacccggaucaccgaggacgaccugcagaacgaggccaagaucaccgacaucauggagcccgagcacgcccuccuggcgacgagcaucuucaagcugaccuaccagaacaaggucgugcgcgugcagcgccccgccaaguccggcaccgucauggacgugaucagccggcgcgaccagcggggguccggccaggugggcaccuacgggcucaacacguucaccaacauggagguccagcugauccgccagauggagagcgagggcaucuucucccccagcgagcuggagaccccgaaccucgccaagaaggugcuggacuggcuggagaagcacggggccgagcggcucaagcgcauggccaucuccggcgacgacugcguggucaagcccaucgacgaccgguucgcgaccgcccugacggcccugaacgacauggggaaggugcgcaaggacaucccccagugggagcccagcaagggcuggaacgacuggcagcaggucccguucugcucccaccacuuccaccagcucaucaugaaggacggccgggagaucgucgugcccugccgcaaccaggacgagcugguggggcgggcccgcgucagccagggcgccggguggucccugcgggagaccgcgugccucggcaagagcuacgcccagauguggcagcugauguacuuccaccgccgggaccugcgccucgccgccaacgccaucugcuccgcggugcccguggacuggguccccaccagccggaccaccuggagcauccacgcccaccaccaguggaugacgaccgaggacaugcuguccguguggaaccgcguguggaucgaggagaacccguggauggaggacaagacccacgucagcuccugggaggaggugcccuaccuggggaagcgggaggaccaguggugcggcagccucaucggccugaccgcccgcgccacgugggcgaccaacauccagguggccaucaaccagguccgccggcugaucgggaacgagaacuaccucgacuacaugaccuccaugaagcgcuucaagaacgagagcgaccccgagggcgcccugugg

SEQ ID NO: 8970 - RNA, 9876 nt, Artificial Sequence
  derived and/or modified CDS sequence (opt1) from DENV-1__KF672761__SS-prME
agcgugaccaugcuguucaugcugcugcccaccgcccuggccuuccaccucaccacccgcggcggggagccccacaugaucgugagcaagcaggagcggggcaagagccugcuguucaagaccagcgcgggggugaacaugugcacccucaucgccauggaccugggcgagcugugcgaggacaccaugaccuacaagugcccccgcaucaccgaggccgagcccgacgacguggacugcuggugcaacgccaccgacaccugggucaccuacgggaccugcagccagaccggcggccaccggcgcgacaagcgguccguggcccucgcgccccacguggggcugggccuggagacccgcaccgagaccuggaugagcuccgagggggccuggaagcagauccagaaggucgagaccugggcccuccggcaccccggcuucacggugaucgcccuguuccuggcgcacgccaucgggaccagcaucacccagaagggcaucaucuucauccuccugaugcuggugacccccuccauggccaugcgcugcgucggcaucgggaaccgggacuucguggagggccucagcggggccacguggguggacgucgugcuggagcacggcuccugcgugaccaccauggccaagaacaagcccacccuggacaucgagcuccugaagacggaggucaccaaccccgcggugcugcgcaagcucugcaucgaggccaagaucagcaacaccaccacggacucccggugcccgacccagggcgaggccacccugguggaggagcaggacgccaacuucgucugccgccggaccuucguggaccgcggguggggcaacgggugcggccuguucgggaagggcagccuccugacgugcgccaaguucaagugcgugaccaagcuggagggcaagaucguccaguacgagaaccucaaguacuccgugaucgugaccguccacaccggggaccagcaccaggugggcaacgagacgaccgagcacgggaccaucgcgaccaucacgccccaggcccccacgagcgagauccagcugaccgacuacggcgcccugacccucgacugcagcccccggaccgggcuggacuucaacgagaugguccugcucacgaugaaggagaaguccuggcuggugcacaagcagugguuccuggaccucccgcugcccuggaccuccggcgccagcaccagccaggagaccuggaaccgccaggaccugcucgugacguucaagaccgcccacgcgaagaagcaggaggucguggugcugggcucccaggagggggccaugcacaccgcccugaccggcgccacggagauccagaccagcgggaccaccacgaucuucgccggccaccucaagugccggcugaagauggacaagcugacccucaaggggaccuccuacgucaugugcaccggcagcuucaagcuggagaaggagguggcggagacgcagcacggcaccgugcugguccaggugaaguacgaggggaccgacgcccccugcaagauccccuucuccacccaggacgagaagggcgugacgcagaacgggcgccugaucaccgccaacccgaucgucaccgacaaggagaagcccgugaacaucgagaccgagccgcccuucggcgagagcuacaucguggucggcgccggggagaaggcgcucaagcuguccugguucaagaagggcagcuccaucgggaagauguucgaggccacggcccggggcgcccgccggauggccauccugggggacaccgcgugggacuucggcagcaucggcgggguguucaccuccgugggcaagcucguccaccagguguucgggaccgccuacggcgugcuguucagcggggucuccuggacgaugaagaucggcaucggcauccugcucaccuggcuggggcugaacagccgcuccaccagccucuccaugaccugcaucgccgugggcauggugacgcuguaccugggggucauggugcaggccgacagcggcugcgugaucaacuggaaggggcgcgagcucaagugcggcuccggcaucuucgucaccaacgaggugcacaccuggaccgagcaguacaaguuccaggccgacagcccgaagcggcugagcgcggccaucgggaaggccugggaggagggcgugugcgggauccgcuccgccacccggcuggagaacaucauguggaagcagaucagcaacgagcucaaccacauccugcuggagaacgacaugaaguucacggucguggugggcgacgccaacgggauccucgcgcagggcaagaagaugauccgcccccagcccauggagcacaaguacuccuggaaguccuggggcaaggccaagaucaucggggccgacauccagaacaccaccuucaucaucgacggccccgacaccccggagugccccgacgagcagcgggccuggaacaucugggaggucgaggacuacggguucggcaucuucacgaccaacaucuggcugaagcugcgcgacuccuacacccagaugugcgaccaccggcucaugagcgcggccaucaaggacuccaaggccgugcacgccgacaugggcuacuggaucgagagcgagaagaacgagaccuggaagcuggcccgcgcguccuucaucgaggugaagacgugcaucuggcccaagagccacacccugugguccaacgggguccucgagagcgagaugaucauccccaagaucuacggcgggccgaucucccagcacaacuaccggcccggcuacuucacccagaccgccgggcccuggcaccugggcaagcuggagcucgacuucgaccugugcgagggcacgaccgugguggucgacgagcacugcgggaaccgcggcccgagccugcggaccaccacggugaccgggaagaucauccacgaguggugcugccgcuccugcacccugccgccccuccgguuccgcggcgaggacgggugcugguacggcauggagauccggcccgugaaggagaaggaggagaaccugguccgcagcaugguguccgccggcagcggggagguggacagcuucucccucggcauccugugcgucagcaucaugaucgaggaggugaugcggucccgcuggagccggaagaugcugaugaccgggacgcucgccguguuccugcugcucaucaugggccagcugaccuggaacgaccugauccgccucugcaucauggucggggccaacgcguccgacaagaugggcaugggcaccaccuaccuggcccugauggccacguucaagaugcgcccgauguucgccguggggcuccuguuccggcgccugaccagccgggaggugcuccugcugaccaucggccucucccuggucgccagcguggagcugcccaacucccucgaggagcugggggacggccuggcgaugggcaucaugaugcucaagcugcugaccgaguuccagccccaccagcucuggacgacccugcugagccucaccuucaucaagaccacgcugucccuggacuacgccuggaagaccaccgccaugguccucagcaucgugucccuguucccccugugccucagcaccacgucccagaagaccaccuggcugccggugcugcucgggagcuucggcugcaagccccugaccauguuccugaucaccgagaacaagaucugggggcgcaaguccuggccccucaacgagggcaucauggccaucgggaucgucagcauccugcuguccagccuccugaagaacgacgugccccuggcgggcccgcucaucgccggcgggaugcugaucgccugcuacgugaucagcggcuccagcgccgaccugucccucgagaaggccgcggaggucagcugggaggaggaggccgagcacuccgggacgagccacaacauccugguggaggugcaggacgacggcaccaugaagaucaaggacgaggagcgggacgacacccugaccauccuccugaaggccacgcugcucgccgucuccgggguguaccccaugagcauccccgccacccuguucgugugguacuucuggcagaagaagaagcagcgcuccggcguccugugggacacccccagcccgcccgagguggagcgggcggugcucgacgacggcaucuaccgcauccugcagcgggggcugcugggccgcucccaggucggggugggcguguuccaggacggggucuuccacaccauguggcacgugacgcggggcgccgugcucauguaccagggcaagcgccuggagcccagcugggccuccgucaagaaggaccugaucagcuacgggggcggguggcgguuccagggcuccuggaacaccggggaggagguccaggugaucgccgucgagcccggcaagaacccgaagaacgugcagaccacccccggcacguucaagacccccgagggggaggugggcgccaucgcgcucgacuucaagcccgggaccagcggcuccccgaucgucaaccgcgagggcaagaucguggggcuguacggcaacgggguggucaccacgagcggcaccuacguguccgccaucgcccaggccaaggccagccaggaggggccccugcccgagaucgaggacgagguguucaagaagcggaaccucaccaucauggaccugcacccgggcagcggcaagacccgccgguaccugcccgcgaucguccgcgaggccaucaagcggaagcuccgcacgcugauccuggcccccacccgggugguggccuccgagauggcggaggcccucaaggggaugcccauccgcuaccagaccaccgccgucaagagcgagcacacgggccgcgagaucguggaccugaugugccacgccaccuucaccaugcggcugcucuccccggugcgcguccccaacuacaacaugaucaucauggacgaggcccacuucaccgaccccgcgagcaucgccgcccggggguacaucuccacgcgcgugggcaugggggaggccgccgcgaucuucaugaccgccacgccgcccggcagcguggaggccuucccccaguccaacgccgucauccaggacgaggagcgggacauccccgagcgcagcuggaacuccggcuacgacuggaucaccgacuuccccgggaagacggugugguucgugcccagcaucaaguccggcaacgacaucgccaacugccugcggaagaacgggaagcgcgucauccagcugagccggaagaccuucgacaccgaguaccagaagaccaagaacaacgacugggacuacguggugacgaccgacaucuccgagaugggcgcgaacuuccgcgccgaccgggucaucgacccccgccggugccucaagcccgugauccugaaggacgggcccgagcgcgugauccuggccggcccgaugcccgucaccguggccagcgcggcccagcggcgcggccggaucgggcgcaaccagaacaaggagggcgaccaguacgucuacauggggcagccccucaacaacgacgaggaccacgcccacuggaccgaggccaagaugcugcuggacaacaucaacacgcccgagggcaucaucccggcccucuucgagcccgagcgggagaaguccgcggccaucgacggggaguaccgccugcgcggcgaggcccggaagaccuucguggagcugaugcgccggggcgaccuccccguguggcugagcuacaaggucgccuccgagggguuccaguacagcgaccgccgguggugcuucgacggcgagcgcaacaaccaggugcuggaggagaacauggacguggagaucuggaccaaggagggggagcggaagaagcuccgcccccgguggcuggacgcccgcaccuacuccgacccgcuggcgcuccgggaguucaaggaguucgccgccggccgccggagcgucagcggcgaccugauccuggagaucgggaagcucccccagcaccugacccugcgcgcccagaacgcccucgacaaccuggugaugcugcacaacuccgagcagggcgggaaggcguaccggcacgccauggaggagcuccccgacacgaucgagacccugaugcugcucgcccugaucgccgugcugaccggcggggucacccucuucuuccugagcggcaagggccuggggaagacguccaucggccuccugugcgugaccgcgagcuccgcccugcucuggauggccagcguggagccccacuggaucgccgccuccaucauccuggaguucuuccugaugguccuccugaucccggagcccgaccgccagcggacgccccaggacaaccagcuggcguacguggugaucgggcuccuguucaugauccugaccgucgccgccaacgagaugggccuccuggagacgaccaagaaggaccuggggaucggccacguggccgccgagaaccaccagcacgcgaccaugcucgacguggaccugcgcccggccagcgccuggacccuguacgccgucgccacgaccgugaucacccccaugaugcggcacaccaucgagaacacgaccgcgaacaucucccucaccgccaucgccaaccaggccgccauccugaugggccuggacaagggguggcccaucagcaagauggacaucggcgugccccuccuggcgcuggggugcuacucccaggucaacccgcucacccugacggccgccgugcugaugcucguggcccacuacgcgaucaucggccccgggcugcaggccaaggccacccgcgaggcccagaagcggaccgccgcgggcaucaugaagaaccccaccgucgacggcaucguggccaucgaccuggaccccguggucuacgacgccaaguucgagaagcagcucgggcagaucaugcugcugauccucugcacgagccagauccugcugaugcgcaccaccugggcccucugcgaguccaucacccuggccacgggcccgcugaccacccucugggaggggagccccggcaaguucuggaacaccacgaucgcgguguccauggccaacaucuuccgcggcagcuaccuggccggggccggccuggccuucucccucaugaagucccucgggggcgggcggcgcgggaccggcgcgcagggggagacccugggcgagaaguggaagcggcagcucaaccagcuguccaagagcgaguucaacaccuacaagcgcagcgggaucauggagguggaccgguccgaggccaaggagggccugaagcgcggggagacgaccaagcacgccgucagccggggcaccgccaagcuccgcugguucguggagcggaaccuggugaagcccgagggcaaggucaucgaccuggggugcggccgcgggggcugguccuacuacugcgcggggcugaagaaggugaccgaggugaagggcuacaccaagggcgggcccggccacgaggagccgauccccauggccacguacggguggaaccucgucaagcugcacagcggcaaggacguguucuucaugccgcccgagaagugcgacacccugcucugcgacaucggggaguccagcccgaaccccaccaucgaggagggccggacccugcgcgugcugaagauggucgagcccuggcuccggggcaaccaguucugcaucaagauccugaaccccuacaugccguccgugguggagacgcuggagcagaugcagcgcaagcacgggggcaugcucguccggaacccccugagccgcaacuccacccacgagauguacugggugagcugcgggaccggcaacaucguguccgccgucaacaugaccagccggaugcugcucaaccgcuucacgauggcccaccggaagcccaccuacgagcgcgacguggaccugggcgccgggacccgccacguggcggucgagcccgagguggccaaccuggacaucaucggccagcggaucgagaacaucaagaacgagcacaaguccaccuggcacuacgacgaggacaacccguacaagacgugggccuaccacgggagcuacgaggugaagcccuccggcagcgccuccagcauggucaacggggugguccgccuccugaccaagcccugggacgugauccccauggugacccagaucgccaugaccgacacgaccccguucggccagcagcgggucuucaaggagaagguggacacccgcacgccccgggcgaagcgcggcacggcccagaucauggaggugaccgccaaguggcuguggggguuccucucccggaacaagaagccccgcaucugcacccgggaggaguucacccgcaagguccggagcaacgccgccaucggcgcgguguucguggacgagaaccaguggaacagcgccaaggaggccgucgaggacgagcgcuucugggaccuggugcaccgggagcgcgagcugcacaagcaggggaagugcgccacgugcguguacaacaugaugggcaagcgggagaagaagcucggggaguucggcaaggcgaagggcucccgcgccaucugguacauguggcugggggcccgguuccuggaguucgaggcccucggcuucaugaacgaggaccacugguucagccgcgagaacucccugagcggggucgagggcgaggggcugcacaagcucggcuacauccugcgggacaucuccaagaucccgggcgggaacauguacgccgacgacaccgcgggcugggacacccgcaucaccgaggacgaccugcagaacgaggccaagaucacggacaucauggagcccgagcacgcccuccuggccaccagcaucuucaagcugaccuaccagaacaagguggugcggguccagcgccccgccaagaacgggaccgugauggacgugaucucccgccgggaccagcgcggcagcggccaggucgggacguacggccucaacaccuucaccaacauggaggugcagcugauccggcagauggaguccgaggggaucuuccugcccagcgagcucgagaccccgaaccuggcggagcgcgugcuggacuggcucgagaagcacggcgccgagcggcugaagcgcauggccaucuccggggacgacugcgucgugaagcccaucgacgaccgguucgccacggcccugaucgcgcucaacgacaugggcaaggugcgcaaggacaucccccagugggagcccagcaagggcuggaacgacuggcagcaggucccguucugcucccaccacuuccaccagcugaucaugaaggacgggcgggagaucguggugcccugccgcaaccaggacgagcuggucggccgggcccgcgugagccagggggccggcuggucccuccgggagaccgccugccugggcaagagcuacgcccagauguggcagcugauguacuuccaccgccgggaccuccgccuggcggccaacgccaucugcuccgccgugcccgucgacugggugcccaccagccggaccaccuggagcauccacgcgcaccaccaguggaugacgaccgaggacaugcuguccguguggaaccgcgucuggaucgaggagaacccguggauggaggacaagacccacgugagcuccugggaggaggugcccuaccucggcaagcgggaggaccaguggugcggcagccugaucgggcugaccgcccgcgccacgugggccaccaacauccaggucgccaucaaccaggugcgccggcucaucggcaacgagaacuaccuggacuacaugaccuccaugaagcgcuucaagaacgagagcgaccccgagggggcgcugugg

SEQ ID NO: 8971 - RNA, 9876 nt, Artificial Sequence
  derived and/or modified CDS sequence (opt1) from DENV-1__KF672762__SS-prME
agcgugaccaugcugcucaugcugcugcccaccgcccucgccuuccaccugaccacccggggcggggagccccacaugaucgugagcaagcaggagcggggcaagagccuccuguucaagaccagcgccggggugaacaugugcacccugaucgccauggaccugggcgagcucugcgaggacaccaugaccuacaagugcccccggaucaccgaggccgagcccgacgacguggacugcuggugcaacgccaccgacaccugggugaccuacgggaccugcagccagaccggcgagcaccggcgcgacaagcgguccguggcccuggcgccccacgugggccuggggcucgagacgcgcaccgagaccuggaugagcuccgagggcgccuggaagcagauccagaaggucgagaccugggcccugcggcaccccggguucacggugaucgcccuguuccucgcgcacgccaucggcaccagcaucacccagaaggggaucaucuucauccugcugaugcucgugacccccuccauggccaugcgcugcgucggcaucggcaaccgggacuucguggaggggcugagcggcgccacguggguggacgucgugcuggagcacggguccugcgugaccaccauggccaagaacaagcccacccucgacaucgagcugcugaagacggaggucaccaaccccgcggugcuccgcaagcugugcaucgaggccaagaucagcaacaccaccacggacucccggugcccgacccagggcgaggccacccugguggaggagcaggacgccaacuucgucugccgccggaccuucguggaccgcggcugggggaacggcugcggccuguucggcaaggggagccugcugacgugcgccaaguucaagugcgugaccaagcucgagggcaagaucguccaguacgagaaccugaaguacuccgugaucgugaccguccacaccggcgaccagcaccagguggggaacgagacgaccgagcacggcaccaucgcgaccaucacgccccaggcccccacgagcgagauccagcugaccgacuacggggcccucacccuggacugcagcccccggaccggccuggacuucaacgagaugguccuccugacgaugaaggagaaguccuggcuggugcacaagcagugguuccucgaccugccgcugcccuggaccuccggggccagcaccagccaggagaccuggaaccgccaggaccuccuggugacguucaagaccgcccacgcgaagaagcaggaggucguggugcugggcucccaggagggcgccaugcacaccgcccucaccggggccacggagauccagaccagcggcaccaccacgaucuucgccgggcaccugaagugccggcugaagauggacaagcucacccugaagggcaccuccuacgucaugugcaccgggagcuucaagcuggagaaggagguggcggagacgcagcacggcaccgugcugguccaggugaaguacgagggcaucgacgcccccugcaagauccccuucuccacccaggacgagaagggggugacccagaacggccgccucaucacggccaacccgaucgucaccgacaaggagaagcccgugaacaucgagaccgagccgcccuucggggagagcuacaucguggucggcgccggcgagaaggcgcugaagcuguccugguucaagaaggggagcuccaucggcaagauguucgaggccaccgcccgcggggcccgccggauggccauccucggcgacacggcgugggacuucgggagcaucggcggcguguucaccuccguggggaagcugguccaccaggugcugggcaccgccuacgggguccuguucagcggcgucuccuggaccaugaagaucgggaucggcauccugcugacguggcucggccugaacagccgcuccaccagccuguccaugaccugcaucgccguggggauggugacccucuaccugggcgucauggugcaggccgacagcgggugcgugaucaacuggaagggccgcgagcugaagugcggguccggcaucuucgucacgaacgaggugcacaccuggaccgagcaguacaaguuccaggccgacagcccgaagcggcucagcgcggccaucggcaaggccugggaggagggggugugcggcauccgcuccgccacccggcuggagaacaucauguggaagcagaucagcaacgagcugaaccacauccuccuggagaacgacaugaaguucaccgucguggugggggacgccaacggcauccuggcgcaggggaagaagaugauccgcccccagcccauggagcacaaguacuccuggaaguccuggggcaaggccaagaucaucggcgccgacauccagaacacgaccuucaucaucgacgggcccgacaccccggagugccccgacgagcagcgggccuggaacaucugggaggucgaggacuacggcuucgggaucuucaccacgaacaucuggcucaagcugcgcgacuccuacacccagaugugcgaccaccggcugaugagcgcggccaucaaggacuccaaggccgugcacgccgacaugggcuacuggaucgagagcgagaagaacgagaccuggaagcucgcccgcgcguccuucaucgaggugaagaccugcaucuggcccaagagccacacgcugugguccaacggcguccuggagagcgagaugaucauccccaagaucuacgggggcccgaucucccagcacaacuaccggcccggguacuucacccagaccgccggccccuggcaccucgggaagcuggagcuggacuucgaccucugcgagggcaccacggugguggucgacgagcacugcggcaaccgcgggccgagccugcggaccaccaccgugacgggcaagaucauccacgaguggugcugccgcuccugcacccugccgccccuccgguuccgcggggaggacggcugcugguacgggauggagauccggcccgugaaggagaaggaggagaaccugguccgcagcaugguguccgccggcagcggcgagguggacagcuucucccuggggauccucugcgucagcaucaugaucgaggaggugaugcggucccgcuggagccggaagaugcugaugaccggcacccuggccguguuccuccugcugaucauggggcagcucacguggaacgaccugauccgccugugcaucauggucggcgccaacgcguccgacaagauggggaugggcaccaccuaccucgcccugauggccaccuucaagaugcgcccgauguucgccguggggcuccucuuccggcgccugacgagccgggaggugcugcuccugaccaucgggcugucccucgucgccagcguggagcugcccaacucccuggaggagcucggcgacgggcuggcgaugggcaucaugaugcugaagcuccugaccgaguuccagccccaccagcuguggaccacgcuccugagccugaccuucaucaagaccacccucucccuggacuacgccuggaagacgaccgccaugguccugagcaucgugucccucuucccccugugccugagcaccaccucccagaagacgaccuggcucccggugcugcugggcagcuucgggugcaagccccucaccauguuccugaucaccgagaacaagaucuggggccgcaaguccuggccccugaacgaggggaucauggccaucggcaucgucagcauccuccuguccagccugcucaagaacgacgugccccuggcggggccgcugaucgccggcggcaugcucaucgccugcuacgugaucagcggguccagcgccgaccugucccuggagaaggccgcggaggucagcugggaggaggaggccgagcacuccggcaccagccacaacauccucguggaggugcaggacgacgggacgaugaagaucaaggacgaggagcgggacgacacccugaccauccugcucaaggccacccugcuggccgucuccggcguguaccccaugagcauccccgccacccucuucgugugguacuucuggcagaagaagaagcagcgcuccgggguccugugggacacccccagcccgcccgagguggagcgggcggugcuggacgacggcaucuaccgcauccugcagcggggccuccuggggcgcucccaggucggcguggggguguuccaggacggcgucuuccacaccauguggcacgugacccgcggggccgugcugauguaccagggcaagcgccucgagcccagcugggccuccgucaagaaggaccugaucagcuacggcgggggcuggcgguuccagggguccuggaacacgggcgaggagguccaggugaucgccgucgagcccgggaagaacccgaagaacgugcagaccacccccggcaccuucaagacgcccgagggcgaggugggggccaucgcgcuggacuucaagcccggcaccagcggguccccgaucgucaaccgcgagggcaagaucgugggccucuacgggaacggcguggucaccaccagcgggacguacguguccgccaucgcccaggccaaggccagccaggagggcccccugcccgagaucgaggacgagguguucaagaagcggaaccugaccaucauggaccuccacccggggagcggcaagacccgccgguaccugcccgcgaucguccgcgaggccaucaagcggaagcugcgcacccucauccuggcccccacgcgggugguggccuccgagauggcggaggcccugaagggcaugcccauccgcuaccagaccaccgccgucaagagcgagcacaccgggcgcgagaucguggaccucaugugccacgccacguucaccaugcggcugcuguccccggugcgcguccccaacuacaacaugaucaucauggacgaggcccacuucaccgaccccgcgagcaucgccgcccggggcuacaucuccacccgcguggggaugggcgaggccgccgcgaucuucaugacggccacgccgcccgggagcguggaggccuucccccaguccaacgccgucauccaggacgaggagcgggacauccccgagcgcagcuggaacuccggcuacgacuggaucaccgacuuccccggccggaccgugugguucgugcccagcaucaaguccgggaacgacaucgccaacugccuccgcaagaacggcaagcgggucauccagcugagccgcaagacguucgacaccgaguaccagaagaccaagaacaacgacugggacuacguggugaccacggacaucuccgagaugggggcgaacuuccgggccgaccgcgucaucgacccccggcgcugccugaagcccgugauccucaaggacggccccgagcgggugauccuggccgggccgaugcccgucaccguggccagcgcggcccagcgccggggccgcaucggccggaaccagaacaaggagggggaccaguacgucuacaugggccagccccugaacaacgacgaggaccacgcccacuggaccgaggccaagaugcuccuggacaacaucaacacccccgaggggaucaucccggcccuguucgagcccgagcgcgagaaguccgcggccaucgacggcgaguaccgccuccgcggggaggcccgcaagacguucguggagcugaugcggcgcggcgaccugcccguguggcucagcuacaaggucgccuccgagggcuuccaguacagcgaccggcgcuggugcuucgacggggagcggaacaaccaggugcuggaggagaacauggacguggagaucuggaccaaggagggcgagcgcaagaagcugcggccccgcuggcucgacgcccggaccuacuccgacccgcuggcgcugcgcgaguucaaggaguucgccgccgggcggcgcagcgucagcggcgaccucauccuggagaucggcaagcugccccagcaccucacccugcgggcccagaacgcccuggacaaccucgugaugcugcacaacuccgagcagggcgggaaggcguaccgccacgccauggaggagcugcccgacaccaucgagacgcucaugcugcuggcccucaucgccgugcugaccgggggcgucacccuguucuuccucagcgggaagggccugggcaagaccuccaucgggcugcucugcgugacggcgagcuccgcccugcuguggauggccagcguggagccccacuggaucgccgccuccaucauccucgaguucuuccugaugguccugcucaucccggagcccgaccggcagcgcacgccccaggacaaccagcuggcguacguggugaucggccuccucuucaugauccugaccgucgccgccaacgagauggggcugcucgagaccacgaagaaggaccugggcaucgggcacguggccgccgagaaccaccagcacgcgaccaugcuggacguggaccuccggccggccagcgccuggacccuguacgccgucgccaccacggugaucacccccaugaugcgccacaccaucgagaacaccacggcgaacaucucccugaccgccaucgccaaccaggccgccauccucaugggccuggacaagggcuggcccaucagcaagauggacaucggggugccccugcucgcgcugggcugcuacucccaggucaacccgcugacccucaccgccgccgugcugaugcugguggcccacuacgcgaucaucgggcccggccuccaggccaaggccacgcgggaggcccagaagcgcaccgccgcggggaucaugaagaaccccaccgucgacggcaucguggccaucgaccuggaccccguggucuacgacgccaaguucgagaagcagcugggccagaucaugcuccugauccugugcaccagccagauccuccugaugcgcacgaccugggcccugugcgaguccaucacccucgccaccgggccgcugacgacccugugggagggcagccccgggaaguucuggaacaccaccaucgcgguguccauggccaacaucuuccggggcagcuaccucgccggcgccgggcuggccuucucccugaugaagucccucggcgggggccgccgggggacgggcgcgcagggcgagacccugggggagaaguggaagcgccagcugaaccagcucuccaagagcgaguucaacaccuacaagcggagcggcaucauggagguggaccgcuccgaggccaaggaggggcugaagcggggcgagaccacgaagcacgccgucagccgcgggaccgccaagcugcggugguucguggagcgcaaccuggugaagcccgagggcaaggucaucgaccucggcugcgggcggggcgggugguccuacuacugcgcgggccugaagaaggugaccgaggugaagggguacaccaagggcggccccgggcacgaggagccgauccccauggccaccuacggcuggaaccuggucaagcuccacagcgggaaggacguguucuucaugccgcccgagaagugcgacacgcugcugugcgacaucggcgaguccagcccgaaccccaccaucgaggaggggcgcacccuccgggugcugaagauggucgagcccuggcugcgcggcaaccaguucugcaucaagauccucaaccccuacaugccguccgugguggagacccuggagcagaugcagcggaagcacggcgggaugcugguccgcaacccccucagccggaacuccacgcacgagauguacugggugagcugcggcaccgggaacaucguguccgccgucaacaugaccagccgcaugcugcugaaccgguucaccauggcccaccgcaagcccacguacgagcgcgacguggaccucggcgccggcacccggcacguggcggucgagcccgagguggccaaccuggacaucaucgggcagcgcaucgagaacaucaagaacgagcacaaguccaccuggcacuacgacgaggacaacccguacaagaccugggccuaccacggcagcuacgaggugaagcccuccgggagcgccuccagcauggucaacggcgugguccggcugcucacgaagcccugggacgugauccccauggugacccagaucgccaugaccgacaccacgccguucgggcagcagcgcgucuucaaggagaagguggacacccggacgccccgggcgaagcggggcaccgcccagaucauggaggugacggccaaguggcuguggggcuuccugucccgcaacaagaagccccggaucugcacccgcgaggaguucacccggaagguccgcagcaacgccgccaucggggcgguguucguggacgagaaccaguggaacagcgccaaggaggccgucgaggacgagcgguucugggaccucgugcaccgcgagcgggagcugcacaagcagggcaagugcgcgaccugcguguacaacaugauggggaagcgcgagaagaagcugggcgaguucgggaaggcgaagggcucccgggccaucugguacauguggcucggcgcccgcuuccuggaguucgaggcccugggguucaugaacgaggaccacugguucagccgggagaacucccucagcggcgucgagggggagggccugcacaagcugggguacauccuccgcgacaucuccaagaucccgggcggcaacauguacgccgacgacacggcggggugggacacccggaucaccgaggacgaccugcagaacgaggccaagaucaccgacaucauggagcccgagcacgcccugcucgccacgagcaucuucaagcugaccuaccagaacaagguggugcgcguccagcgccccgccaagaacggcaccgugauggacgugaucucccggcgcgaccagcgggggagcggccaggucggcaccuacgggcugaacacguucaccaacauggaggugcagcucauccgccagauggaguccgagggcaucuuccugcccagcgagcuggagaccccgaaccucgcggagcgggugcuggacuggcuggagaagcacggggccgagcgccucaagcggauggccaucuccggcgacgacugcgucgugaagcccaucgacgaccgcuucgccaccgcccugaucgcgcugaacgacauggggaaggugcggaaggacaucccccagugggagcccagcaagggcuggaacgacuggcagcaggucccguucugcucccaccacuuccaccagcucaucaugaaggacggccgcgagaucguggugcccugccggaaccaggacgagcuggucgggcgcgcccgggugagccagggcgccggguggucccugcgcgagacggccugccucggcaagagcuacgcccagauguggcagcugauguacuuccaccggcgcgaccugcggcucgcggccaacgccaucugcuccgccgugcccaucgacuggguccccaccagccgcaccaccuggagcauccacgcgcaccaccaguggaugaccacggaggacaugcuguccguguggaaccggguguggaucgaggagaacccguggauggaggacaaggcccacgucagcuccugggaggaggugcccuaccuggggaagcgcgaggaccaguggugcggcagccucaucggccugaccgcccgcgccaccugggccaccaacauccagguggcgaucaaccagguccggcgccugaucgggaacgagaacuaccucgacuacaugacguccaugaagcgguucaagaacgagagcgaccccgagggcgcccugugg

SEQ ID NO: 8972 - RNA, 9879 nt, Artificial Sequence
  derived and/or modified CDS sequence (opt1) from DENV-1__JF459993__SS-prME
agcgugaccaugcuguucaugcuccugcccaccagccuggccuuccaccucaccacccggggcggggagccccacaugaucgugagcaagcaggagcggggcaagucccugcuguucaagaccagcgccggggugaacaugugcacccucaucgccauggaccugggcgagcugugcgaggacaccaugaccuacaagugcccccgcaucaccgagaccgagcccgacgacguggacugcuggugcaacgccacggagaccugggugaccuacgggaccugcucccagacgggcgagcaccggcgcgacaagcggagcguggcccucgcgccccacgugggccuggggcuggagacccgcaccgagaccuggauguccagcgagggcgccuggaagcagauccagaagguggagacgugggcgcucgggcaccccggcuucaccgugaucgcccuguuccuggcccacgccaucgggaccuccaucacccagaagggcaucaucuucauccuccugaugcuggugacgcccagcauggcgaugcggugcgucggcaucgggaaccgcgacuucguggagggccucuccggggccaccuggguggacgucgugcuggagcacggcagcugcgugaccaccauggccaaggacaagcccacgcuggacaucgagcuccugaagaccgaggucaccaaccccgccauccugcggaagcucugcaucgaggccaagaucuccaacaccacgaccgacagccgcugcccgacccagggcgaggcgacccugguggaggagcaggacacgaacuucgugugccggcgcaccuucgucgaccggggguggggcaacgggugcggccuguucgggaagggcucccucaucacgugcgccaaguucaagugcgugaccaagcuggagggcaagaucgugcaguacgagaaccugaaguacagcgucaucgugacggugcacaccggggaccagcaccaggucggcaacgagaccaccgagcacgggaccacggccaccaucacgccccaggcccccaccuccgagauccagcucacggacuacggcgcccugacccuggacugcagcccccgcaccgggcucgacuucaacgagauggugcugcugaccaugaaggagaaguccuggcucguccacaagcagugguuccuggaccugccccuccccuggacgagcggcgcgagcaccucccaggagaccuggaaccggcaggaccugcuggugaccuucaagacggcccacgccaagaagcaggagguggucgugcucggcagccaggagggggccaugcacaccgcccugaccggcgcgaccgagauccagacguccgggaccaccaccaucuucgccggccaccugaagugccgccucaagauggacaagcugacgcugaagggggugagcuacgucaugugcaccggcuccuucaagcucgagaaggagguggccgagacccagcacggcaccgugcugguccaggugaaguacgaggggacggacgcccccugcaagauccccuucagcucccaggacgagaagggcgugauccagaacgggcggcugaucaccgccaacccgaucgucaccgacaaggagaagcccgugaacaucgaggcggagccgcccuucggcgagagcuacaucguggucggcgccggggagaaggcccugaagcucuccugguucaagaagggcagcuccaucgggaagauguucgaggccaccgcgcgcggcgcccggcgcauggccauccugggggacacggccugggacuucggcagcaucggcgggguguucaccuccgugggcaagcugguccaccagaucuucgggaccgccuacggcguccuguucagcgggguguccuggaccaugaagaucggcaucggcauccugcugacguggcucgggcugaacagccgguccaccagccuguccaugaccugcaucgcggucggcauggugacccucuaccugggggugaugguccaggccgacagcggcugcgugaucaacuggaaggggcgcgagcugaagugcggcagcggcaucuucgugacgaacgagguccacaccuggaccgagcaguacaaguuccaggccgacuccccgaagcgccucagcgccgccaucgggaaggcgugggaggagggcgugugcgggauccgguccgccacccgccuggagaacaucauguggaagcagaucagcaacgagcugaaccacauccuccuggagaacgacaugaaguucaccguggucgugggcgacguggccgggauccuggcccagggcaagaagaugauccggccccagcccauggaguacaaguacuccuggaaguccuggggcaaggccaagaucaucggggcggacguccagaacgccacguucaucaucgacggccccaacaccccggagugccccgacgaccagcgcgccuggaacaucugggagguggaggacuacggguucggcaucuucaccaccaacaucuggcucaagcugcgggacuccuacacccaggugugcgaccaccgccugaugagcgccgcgaucaaggacuccaaggccguccacgccgacaugggcuacuggaucgagagcgagaagaacgagaccuggaagcucgcccgggccuccuucaucgaggugaagaccugcguguggcccaagagccacacccugugguccaacgggguccuggagagcgagaugaucauccccaagaucuacggcgggccgaucucccagcacaaccaccgccccggcuacuucacgcagaccgcggggcccuggcaccucggcaagcuggagcuggacuucgaccucugcgagggcaccaccgugguggucgacgagcacugcgggaaccggggcccgagccugcgcacgaccaccgugaccgggaagaucauccacgaguggugcugccgguccugcacgcugccgccccuccgcuuccggggcgaggacgggugcugguacggcauggagauccgccccgugaaggagaaggaggagaaccuggucaagagcauggugagcgccggcuccggggagguggacagcuucucccugggccuccugugcaucagcaucaugaucgaggaggucaugcggucccgcuggagccggaagaugcugaugaccgggacccucgccguguucuuccugcugaucaugggccagcucaccuggaacgaccugauccgccugugcaucauggugggggccaacgccuccgaccggaugggcaugggcacgaccuaccucgcgcugauggccaccuucaagaugcgcccgauguucgccgucgggcuccucuuccgccggcugaccagccgcgaggugcugcuccugacgaucggccugucccucgucgccagcguggagcugcccaacucccuggaggagcucggggacggccuggccaugggcaucaugauccugaagcuccugaccgacuuccagagccaccagcugugggcgacccuccugucccugaccuucaucaagacgaccuucagccuccacuacgccuggaagaccauggccauggugcuguccaucgucagccuguucccccucugccuguccaccacgagccagaagaccaccuggcugcccgugcuccuggggucccugggcugcaagccgcucaccauguuccugaucgccgagaacaagaucugggggcgcaagagcuggccccugaacgagggcaucauggcgguggggaucgucagcauccuccuguccagccugcucaagaacgacgugccccuggccggcccccugaucgccggcgggaugcucaucgccugcuacgugaucuccggcagcuccgccgaccugagccuggagaaggcggccgaggucuccugggaggaggaggccgagcacagcggggccucccacaacauccucguggaggugcaggacgacggcacgaugaagaucaaggacgaggagcgcgacgacacccugaccauccugcucaaggccacccugcuggcggucagcgggguguacccgcucuccauccccgccacccuguucgugugguacuucuggcagaagaagaagcagcggagcggcguccugugggacacgcccagcccgcccgagguggagcgcgccgugcucgacgacggcaucuaccggaucaugcagcgcgggcugcugggccggagccaggucggggugggcguguuccaggagaacgucuuccacaccauguggcacgugacccgcggggccgugcugauguaccagggcaagcggcucgagcccuccugggccagcgucaagaaggaccugaucuccuacggcgggggcuggcgccugcaggggagcuggaacaccggcgaggagguccaggugaucgcggucgagcccgggaagaaccccaagaacgugcagacggcccccggcaccuucaagacccccgagggcgaggugggggccaucgcccucgacuucaagcccggcaccuccgggagccccaucgucaaccgggagggcaagaucgugggccuguacgggaacggcguggucacgaccagcgggaccuacguguccgccaucgcgcaggccaaggccagccaggagggcccgcugcccgagaucgaggacgagguguuccgcaagcggaaccucaccaucauggaccugcaccccggguccggcaagacgcgccgguaccugccggccaucguccgcgaggcgaucaagcggaagcuccgcacccugauccuggcccccacccgggugguggccagcgagauggccgaggcccucaagggcaugcccauccgcuaccagaccacggcggucaaguccgagcacaccgggaaggagaucguggaccugaugugccacgccaccuucaccaugcgccugcucagccccgugcgggucccgaacuacaacaugaucaucauggacgaggcccacuucacggaccccuccagcaucgccgcccgcggcuacaucuccacccggguggggaugggcgaggcggccgccaucuucaugaccgccacgccgcccgggagcguggaggccuucccgcaguccaacgcggucauccaggacgaggagcgcgacauccccgagcggagcuggaacuccggcuacgaguggaucacggacuuccccggcaagaccgugugguucgugcccagcaucaaguccgggaacgacaucgccaacugccugcgcaagaacggcaagcgggucauccagcugagccgcaagaccuucgacaccgaguaccagaagacgaagaacaacgacugggacuacguggugaccaccgacaucuccgagaugggggccaacuuccgggccgaccgcgucaucgacccgcggcgcugccucaagcccgugauccugaaggacggccccgagcgggucauccuggcggggcccaugccggugaccguggccagcgccgcccagcgccggggccgcaucggccggaaccacaacaaggagggggaccaguacaucuacaugggccagccccucaacaacgacgaggaccacgcccacuggacggaggcgaagaugcugcuggacaacaucaacacccccgaggggaucauccccgcccucuucgagccggagcgcgagaaguccgccgccaucgacggcgaguaccggcugcgcggggaggcccgcaagaccuucgucgagcugaugcggcgcggcgaccuccccguguggcugagcuacaagguggcgagcgagggcuuccaguacuccgaccggcgcuggugcuucgacggggagcggaacaaccagguccuggaggagaacauggacguggagaucuggaccaaggagggcgagcgcaagaagcuccggccccgcuggcuggacgcccggacguacagcgacccccuggcccuccgcgaguucaaggaguucgccgccgggcggcgcuccgugagcggcgaccugauccuggagaucggcaagcucccgcagcaccugacccagcgggcgcagaacgcccuggacaaccucgucaugcugcacaacuccgagcagggcgggcgcgccuaccggcacgcccuggaggagcuccccgacaccaucgagacccugaugcugcucgcgcugaucgccgugcugaccgggggcgugacccucuucuuccugagcgggcgcggccugggcaagaccuccaucgggcuccugugcgucauggccagcuccgcccugcucuggauggccagcguggagccccacuggaucgcggccuccaucauccuggaguucuuccugauggugcuccugauccccgagccggaccggcagcgcacgccccaggacaaccagcuggccuacgucgugaucggccuccuguucaugauccugaccguggccgccaacgagauggggcuccuggagacgaccaagaaggaccugggcaucgggcacgucgcgguggagaaccaccaccacgccagcaugcucgacguggaccugcaccccgccuccgccuggacccuguacgccgucgcgaccacgaucaucaccccgaugaugcggcacaccaucgagaacaccacggccaacaucagccucaccgccaucgccaaccaggccgcgauccugaugggccuggacaagggcuggcccaucuccaagauggacaucggggugccccuccuggcccugggcugcuacagccaggugaacccccucacccugaccgccgccguccugaugcucguggcgcacuacgccaucaucgggccgggccugcaggccaaggccacgcgcgaggcccagaagcggaccgcggccgggaucaugaagaaccccaccguggacggcaucgucgccaucgaccuggaccccgugguguacgacgccaaguucgagaagcagcucggccagaucaugcugcugauccucugcaccucccagauccugcugaugcgcacgaccugggcccucugcgagagcaucacccuggcgaccgggccccugacgacccucugggagggcuccccggggaaguucuggaacaccaccaucgccgucagcauggccaacaucuuccgcggcagcuaccuggccggcgccgggcuggcguucucccucaugaagucccugggcgggggccggcgcgggacgggcgcccagggcgagacccugggggagaaguggaagcggcagcucaaccagcuguccaagagcgaguucaacaccuacaagcgcuccggcaucauggagguggaccggagcgaggccaaggaggggcugaagcgcggcgagaccacgaagcacgccgugucccgggggaccgcgaagcuccgcugguucgucgagcggaaccuggugaagcccgagggcaaggugaucgaccugggcugcgggcgcggcggguggagcuacuacugcgccggccugaagaaggucaccgaggugaagggguacaccaagggcggccccgggcacgaggagcccaucccgauggccacguacggcuggaaccucgugaagcugcacuccgggaaggacgucuucuucaucccgcccgagaagugcgacacccugcucugcgacaucggcgagagcucccccaacccgaccaucgaggaggggcggacccugcgcgugcugaagaugguggagcccuggcuccggggcaaccaguucugcaucaagauccugaaccccuacaugcccagcgucguggagacgcuggagcagaugcagcgcaagcacggcgggaugcucgugcggaacccgcugucccgcaacagcacccacgagauguacugggucuccugcggcaccgggaacaucgugagcgccgugaacaugaccucccggaugcugcucaaccgcuucaccauggcccaccggaagcccacguacgagcgcgacgucgaccugggcgcgggcacccgccacguggccguggagcccgaggucgccaaccuggacaucaucgggcagcggaucgagaacaucaagcacgagcacaagagcaccuggcacuacgacgaggacaaccccuacaagaccugggccuaccacggcuccuacgaggugaagccgagcgggagcgccuccagcauggucaacggcguggugaagcuccugacgaagcccugggacgucauccccauggugacccagaucgcgaugaccgacaccacgcccuucgggcagcagcgcguguucaaggagaaggucgacacccggaccccgaaggccaagcgcggcaccgcccagaucauggaggugacggcccgguggcuguggggcuuccucucccgcaacaagaagccccggaucugcacccgcgaggaguucacccggaaggugcgcagcaacgccgcgaucggggccgucuucguggacgagaaccaguggaacuccgccaaggaggccguggaggacgagcgguucugggaccugguccaccgcgagcgggagcugcacaagcagggcaagugcgcgaccugcguguacaacaugauggggaagcgcgagaagaagcucggcgaguucgggaaggccaagggcagccgggccaucugguacauguggcugggcgcccgcuuccuggaguucgaggcccucggguucaugaacgaggaccacugguucucccgggagaacagccuguccggcguggagggggagggccugcacaagcucggguacauccugcgcgacaucagcaagauccccggcggcaacauguacgcggacgacacggccgggugggacacccggaucaccgaggacgaccugcagaacgaggccaagaucaccgacaucauggagccggagcacgcccuccuggccaaguccaucuucaagcugacguaccagaacaaggucgugcgcgugcagcggcccgcgaagaacggcaccgucauggacgugaucagccgccgcgaccagcggggguccggccaggugggcaccuacgggcucaacaccuucacgaacauggaggcccagcugauccgccagauggagagcgaggagaucuucucccccagcgagcuggagacccccaaccucgccgagcggguccuggacuggcuggagaaguacggcguggagcgccucaagcggauggccaucuccggggacgacugcguggucaagccgaucgacgaccgcuucgccaccgcgcugaccgcccugaacgacaugggcaaggugcggaaggacaucccccagugggagcccagcaagggguggaacgacuggcagcagguccccuucugcagccaccacuuccaccagcucaucaugaaggacggccgcgaggucguggugccgugccggaaccaggacgagcuggucggccgcgcccgggugucccagggggccggcuggagccugcgcgagacggccugccucgggaaguccuacgcgcagauguggcagcugauguacuuccaccggcgcgaccugcggcucgccgccaacgccaucugcagcgcggugcccgucgacugggugcccaccucccgcaccaccuggagcauccacgcccaccaccaguggaugacgaccgaggacaugcuguccguguggaaccgggucuggaucgaggagaaccccuggauggaggacaagacccacgugagcuccugggaggacgugccguaccugggcaagcgcgaggaccaguggugcgggagccucaucggccugaccgcccgggccacgugggccaccaacauccaggucgcgaucaaccaggugcgccgccugaucggcaacgagaacuaccucgacuacaugaccuccaugaagcgguucaagaacgagagcgaccccgagggggcccugugguga

SEQ ID NO: 8973 - RNA, 9876 nt, Artificial Sequence
  derived and/or modified CDS sequence (opt1) from DENV-1__KF672763__SS-prME
agcgugaccaugcugcucaugcugcugcccaccgcccucgccuuccaccugaccacccggggcggggagccccacaugaucgugagcaagcaggagcggggcaagagccuccuguucaagaccagcgcgggggugaacaugugcacccugaucgccauggaccugggcgagcucugcgaggacaccaugaccuacaagugcccccggaucaccgaggccgagcccgacgacguggacugcuggugcaacgccaccgacaccugggugaccuacgggaccugcagccagaccggcgagcaccggcgggacaagcgguccguggcccuggcgccccacgugggccuggggcucgagacccggaccgagaccuggaugagcuccgagggcgccuggaagcagauccagaaggucgagaccugggcccugcggcaccccggguucacggugaucgcccuguuccucgcgcacgccaucggcaccagcaucacccagaaggggaucaucuucauccugcugaugcucgugacccccuccauggccaugcgcugcgucggcaucggcaaccgggacuucguggaggggcugagcggcgccacguggguggacgucgugcuggagcacggguccugcgugaccaccauggccaagaacaagcccacccucgacaucgagcugcugaagacggaggucaccaaccccgcggugcuccgcaagcugugcaucgaggccaagaucagcaacaccaccacggacucccggugcccgacccagggcgaggccacccugguggaggagcaggacgccaacuucgucugccgccggaccuucguggaccgcggcugggggaacggcugcggccucuucggcaaggggagccugcugacgugcgccaaguucaagugcgugaccaagcucgagggcaagaucguccaguacgagaaccugaaguacuccgugaucgugaccguccacaccggcgaccagcaccagguggggaacgagacgaccgagcacggcaccaucgcgaccaucacgccccaggcccccacgagcgagauccagcugaccgacuacggggcccucacccuggacugcagcccccggaccggccuggacuucaacgagaugguccuccugacgaugaaggagaaguccuggcuggugcacaagcagugguuccucgaccugccgcugcccuggaccuccggggccagcaccagccaggagaccuggaaccgccaggaccuccuggugacguucaagaccgcccacgcgaagaagcaggaggucguggugcugggcucccaggagggcgccaugcacaccgcccucaccggggccacggagauccagaccagcggcaccaccacgaucuucgccgggcaccugaagugccggcugaagauggacaagcucacccugaagggcaccuccuacgucaugugcaccgggagcuucaagcuggagaaggagguggcggagacgcagcacggcaccgugcugguccaggugaaguacgagggcaccgacgcccccugcaagauccccuucuccacccaggacgagaagggggugacgcagaacggccgccucaucaccgccaacccgaucgucaccgacaaggagaagcccgugaacaucgagaccgagccgcccuucggggagagcuacaucguggucggcgugggcgagaaggcccugaagcuguccugguucaagaaggggagcuccaucggcaagauguucgaggcgacggcccgcggggcccgccggauggccauccucggcgacaccgccugggacuucgggagcaucggcggcguguucaccuccgucgggaagcuggugcaccagguguucggcaccgcguacgggguccuguucagcggcguguccuggacgaugaagaucgggaucggcauccuccugaccuggcugggccucaacagccgcuccaccagccuguccaugaccugcaucgccguggggauggucacgcuguaccucggcgugauggugcaggccgacagcgggugcgucaucaacuggaagggccgcgagcugaagugcggguccggcaucuucgugaccaacgaggugcacaccuggaccgagcaguacaaguuccaggccgacagcccgaagcggcugagcgccgcgaucggccgcgccugggaggagggggucugcggcauccgguccgccacccgccucgagaacaucauguggaagcagaucagcaacgagcugaaccacauccugcucgagaacgacaucaaguucacggugguggucgggaacgccgacggcauccuggcccaggggaagaagaugauccggccccagcccauggagcacaaguacuccuggaaguccuggggcaaggcgaagaucaucggcgccgacauccagaacaccaccuucaucaucgacgggcccgacaccccggagugccccgacgagcagcgcgccuggaacaucugggagguggaggacuacggcuucgggaucuucacgaccaacaucuggcugaagcuccgggacuccuacacccagaugugcgaccaccgccugaugagcgccgcgaucaaggacuccaaggccgugcacgccgacaugggcuacuggaucgagagcgagaagaacgagaccuggaagcuggcccgggccuccuucaucgaggucaagacgugcaucuggcccaagagccacacccucugguccaacggcgugcuggagagcgagaugaucauccccaagauguacgggggcccgaucucccagcacaacuaccgccccggguacuucacccagaccgcgggccccuggcaccuggggaagcucgagcuggacuucgaccugugcgagggcacgaccguggucguggacgagcacugcggcagccgggggccgucccuccgcaccaccacggugaccggcaagaucauccacgaguggugcugccggagcugcacccugccgccccugcgcuuccgcggggaggacggcugcugguacgggauggagauccgccccgucaaggagaaggaggagaaccucgugcgguccauggugagcgccggcagcggcgaggucgacuccuucagccuggggauccugugcguguccaucaugaucgaggaggugaugcgcagccgguggucccgcaagaugcucaugaccggcacgcuggccgucuuccugcuccugaucauggggcagcugaccuggaacgaccucauccgccugugcaucauggugggcgccaacgccagcgacaagauggggaugggcaccaccuaccuggcgcucauggccacguucaagaugcggccgauguucgccguggggcugcuguuccgccggcucaccucccgcgagguccugcugcucaccaucgggcugagccugauggccuccguggagcuccccaacagccuggaggagcugggcgacgggcucgccaugggcaucaugaugcugaagcugcucaccgaguuccagccccaccagcuguggacgacccugcucucccugaccuucaucaagaccacgcugagccucgacuacgcguggaagaccaccgccaugguccuguccaucgugagccuguucccccucugccuguccaccacgagccagaagaccaccuggcugccggugcuccugggcuccuucgggugcaagccccugaccauguuccucaucaccgagaacgagaucuggggccgcaagagcuggccccugaacgaggggaucauggccaucggcaucgucuccauccugcucagcagccugcugaagaacgacgugccccucgccgggccgcugaucgcgggcggcaugcugaucgccugcuacgugaucuccgggagcuccgccgaccucagccuggagaaggccgccgaggucuccugggaggaggaggcggagcacagcggcacgucccacaacauccugguggaggugcaggacgacgggaccaugaagaucaaggacgaggagcgcgacgacacccucaccauccugcugaaggccacgcuccuggccgucagcggcguguaccccauguccauccccgccacccuguucgugugguacuucuggcagaagaagaagcagcggagcgggguccucugggacacccccuccccgcccgagguggagcgcgccgugcuggacgacggcaucuaccggauccugcagcgcggccugcucgggcggagccaggucggcguggggguguuccaggacggcgucuuccacaccauguggcacgugacgcgcggggcggugcugauguaccagggcaagcggcuggagcccuccugggccagcgucaagaaggaccucaucuccuacggcgggggcuggcgcuuccaggggagcuggaacaccggcgaggagguccaggugaucgccgucgagcccgggaagaacccgaagaacgugcagaccacccccggcacguucaagacccccgagggcgaggugggggccaucgcccuggacuucaagcccggcaccuccgggagcccgaucgucaaccgggagggcaagaucgugggccuguacgggaacggcguggucaccacguccgggaccuacgugagcgcgaucgcccaggccaaggccagccaggagggcccccuccccgagaucgaggacgagguguucaagaagcgcaaccugaccaucauggaccugcacccgggguccggcaagacccggcgcuaccuccccgccaucguccgggaggcgaucaagcgcaagcugcggacgcugauccucgcccccacccgcgugguggccagcgagauggccgaggcgcugaagggcaugcccauccgcuaccagaccaccgccgucaaguccgagcacacggggcgggagaucguggaccugaugugccacgccaccuucaccaugcgccuccugagcccggugcggguccccaacuacaacaugaucaucauggacgaggcccacuucaccgaccccgccuccaucgcggcccgcggcuacaucagcacgcggguggggaugggcgaggccgccgccaucuucaugaccgcgacgccgcccggguccguggaggccuucccccagagcaacgccgucauccaggacgaggagcgcgacauccccgagcgguccuggaacagcggcuacgacuggaucaccgacuuccccggcaagacggugugguucgugcccuccaucaagagcgggaacgacaucgccaacugccugcgcaagaacggcaagcgggucauccagcucucccgcaagaccuucgacaccgaguaccagaagaccaagaacaacgacugggacuacguggugacgaccgacaucagcgagaugggggccaacuuccgggcggaccgcgucaucgacccccggcgcugccugaagcccgugauccugaaggacggccccgagcgggugauccucgccgggccgaugcccgucaccguggccuccgccgcgcagcgccggggccgcaucggccggaaccagaacaaggagggggaccaguacgucuacaugggccagccccugaacaacgacgaggaccacgcccacuggaccgaggccaagaugcugcucgacaacaucaacacgcccgaggggaucaucccggcccuguucgagcccgagcgcgagaaguccgccgcgaucgacggcgaguaccgccugcgcggggaggcccgcaagaccuucguggagcucaugcggcgcggcgaccugcccguguggcuguccuacaaggucgccagcgagggcuuccaguacuccgaccggcgcuggugcuucgacggggagcggaacaaccaggugcucgaggagaacauggacguggagaucuggaccaaggagggcgagcgcaagaagcugcggccccgcuggcuggacgcccggaccuacagcgacccgcucgcccugcgcgaguucaaggaguucgcggccgggcggcgcagcgucuccggcgaccugauccucgagaucggcaagcugccccagcaccugacccuccgggcccagaacgcccuggacaaccuggugaugcuccacaacagcgagcagggcgggaaggccuaccgccacgcgauggaggagcugcccgacacgaucgagacccugaugcuccuggcccugaucgccgugcucaccgggggcgucacccuguucuuccuguccgggaagggccucggcaagacgagcaucgggcugcugugcgugaccgccuccagcgcgcuccuguggauggccuccguggagccccacuggaucgccgccagcaucauccuggaguucuuccucaugguccugcugaucccggagcccgaccggcagcgcacgccccaggacaaccagcucgccuacguggugaucggccugcuguucaugauccucaccgucgcggccaacgagauggggcugcuggagacgaccaagaaggaccucggcaucgggcacguggccgccgagaaccaccagcacgccaccaugcuggacguggaccugcacccggcguccgccuggacccucuacgccgucgccacgaccgugaucacccccaugaugcggcacaccaucgagaacacgaccgccaacaucagccugaccgcgaucgccaaccaggccgccauccugaugggccucgacaagggcuggcccaucuccaagauggaccugggggugccccugcucgcccugggcugcuacagccaggucaacccgcugacccucacggcggccgugcugaugcugguggcccacuacgccaucaucgggcccggccuccaggcgaaggccacccgcgaggcccagaagcggaccgccgccgggaucaugaagaaccccaccaucgacggcaucgucgcgaucgaccuggaccccgugguguacgacgccaaguucgagaagcagcugggccagaucaugcuccugauccugugcacgucccagauccuccugaugcgcaccaccugggcccugugcgagagcaucacccucgccacggggccgcugaccacccugugggagggcucccccgggaaguucuggaacaccacgaucgccgucagcauggcgaacaucuuccgcggcuccuaccucgccggcgccgggcuggccuucagccugaugaagucccucggcgggggccggcgcgggaccggcgcccagggcgagacccugggggagaaguggaagcggcagcugaaccagcucagcaagagcgaguucaacaccuacaagcgcuccggcaucauggagguggaccggagcgaggcgaaggaggggcugaagcgcggcgagacgaccaagcacgccgugucccgggggaccgccaagcugcgcugguucgucgagcggaaccuggugaagcccgagggcaaggugaucgaccucggcugcgggcgcggcggguggagcuacuacugcgccggccugaagaaggucaccgaggugaagggguacaccaagggcggccccgggcacgaggagccgauccccauggcgacguacggcuggaaccuggugaagcuccacuccgggaaggacgucuucuucaugccgcccgagaagugcgacacccugcugugcgacaucggcgagagcuccccgaaccccaccaucgaggaggggcggacccuccgcgugcugaagaugguggagcccuggcugcggggcaaccaguucugcaucaagauccucaaccccuacaugccgagcgucguggagacgcuggagcagaugcagcgcaagcacggcgggaugcuggugcggaacccccucucccgcaacagcacccacgagauguacugggucuccugcggcaccgggaacaucgugagcgccgugaacaugaccucccggaugcugcugaaccgcuucacgauggcccaccggaagcccaccuacgagcgcgacgucgaccucggcgccggcacccgccacguggccguggagcccgaggucgcgaaccuggacaucaucgggcagcggaucgagaacaucaagaacgagcacaagagcaccuggcacuacgacgaggacaacccguacaagacgugggccuaccacggcuccuacgaggugaagcccagcggguccgccagcuccauggugaacggcgucgugcgccugcucaccaagcccugggacgucauccccauggugacccagaucgccaugaccgacacgaccccguucgggcagcagcggguguucaaggagaaggucgacacccgcacgccccgggccaagcgcggcacggcgcagaucauggaggugaccgccaaguggcuguggggcuuccugagccggaacaagaagccccgcaucugcacccgggaggaguucacccgcaaggugcggagcaacgccgccaucggggccgucuucguggacgagaaccaguggaacuccgcgaaggaggccguggaggacgagcgcuucugggaccucguccaccgggagcgcgagcugcacaagcagggcaagugcgccacgugcguguacaacaugauggggaagcgggagaagaagcugggcgaguucgggaaggccaagggcagccgcgcgaucugguacauguggcucggcgcccgguuccuggaguucgaggcccugggguucaugaacgaggaccacugguucucccgcgagaacagccucuccggcguggagggggagggccugcacaagcugggguacauccuccgggacaucagcaagaucccgggcggcaacauguacgccgacgacaccgccgggugggacacccgcaucaccgaggacgaccugcggaacgaggcgaagaucacggacaucauggagcccgagcacgcccugcucgccaccuccaucuucaagcugaccuaccagaacaaggucgugcgcgugcagcgccccgccaagaacggcaccgucauggacgugaucagccggcgcgaccagcggggguccggccaggugggcacguacgggcugaacaccuucaccaacauggagguccagcucauccgccagauggagagcgagggcaucuucuuccccuccgagcuggagagcccgaaccuggccgagcgggugcucgacuggcuggagaagcacggggcggagcgccugaagcggauggccaucuccggcgacgacugcguggucaagcccaucgacgaccgcuucgccaccgcccucaucgcccugaacgacauggggaaggugcggaaggacaucccccagugggagcccagcaagggcuggaacgacuggcagcaggucccguucugcucccaccacuuccaccagcugaucaugaaggacggccgcgagaucgucgugcccugccggaaccaggacgagcucguggggcgcgcgcgggucagccagggcgccggguggucccugcgcgagacggccugccugggcaagagcuacgcccagauguggcagcucauguacuuccaccggcgcgaccugcggcuggccgcgaacgccaucugcagcgccgugcccguggacuggguccccaccucccgcaccaccuggagcauccacgcccaccaccaguggaugaccacggaggacaugcucuccguguggaaccggguguggaucgaggagaacccguggauggaggacaagacccacgucagcuccugggaggaggugcccuaccuggggaagcgcgaggaccaguggugcggcagccugaucggccucaccgcgcgcgccaccugggccacgaacauccagguggccaucaaccagguccggcgccugaucgggaacgagaacuaccuggacuacaugaccuccaugaagcgguucaagaacgagagcgaccccgagggcgcccucugg

SEQ ID NO: 8974 - RNA, 9876 nt, Artificial Sequence
  derived and/or modified CDS sequence (opt1) from DENV-1__KF672764__SS-prME
agcgugaccaugcugcucaugcugcugcccaccgcccucgccuuccaccugaccacccggggcggggagccccacaugaucgugagcaagcaggagcggggcaagagccuccuguucaagaccagcgcgggggugaacaugugcacccugaucgccauggaccugggcgagcucugcgaggacaccaugaccuacaagugcccccggaucaccgaggccgagcccgacgacguggacugcuggugcaacgccaccgacaccugggucaccuacgggaccugcagccagaccggcgagcaccggcgcgacaagcgguccguggcccuggcgccccacgugggccuggggcucgagacccgcaccgagaccuggaugagcuccgagggcgccuggaagcagauccagaaggucgagaccugggcccugcggcaccccggguucacggugaucgcccuguuccucgcgcacgccaucggcaccagcaucacccagaaggggaucaucuucauccugcugaugcucgugacccccuccauggccaugcgcugcgucggcaucggcaaccgggacuucguggaggggcugagcggcgccacguggguggacgucgugcuggagcacggguccugcgugaccaccauggccaagaacaagcccacccucgacaucgagcugcugaagacggaggucaccaaccccgcggugcuccgcaagcugugcaucgaggccaagaucagcaacaccaccacggacucccggugcccgacccagggcgaggccacccugguggaggagcaggacgccaacuucgucugccgccggaccuucguggaccgcggcugggggaacggcugcggccucuucggcaaggggagccugcugacgugcgccaaguucaagugcgugaccaagcucgagggcaagaucguccaguacgagaaccugaaguacuccgugaucgugaccguccacaccggcgaccagcaccagguggggaacgagacgaccgagcacggcaccaucgcgaccaucacgccccaggcccccacgagcgagauccagcugaccgacuacggggcccucacccuggacugcagcccccggaccggccuggacuucaacgagaugguccuccugacgaugaaggagaaguccuggcuggugcacaagcagugguuccucgaccugccgcugcccuggaccuccggggccagcaccagccaggagaccuggaaccgccaggaccuccuggugacguucaagaccgcccacgcgaagaagcaggaggucguggugcugggcucccaggagggcgccaugcacaccgcccucaccggggccacggagauccagaccagcggcaccaccacgaucuucgccgggcaccugaagugccggcugaagauggacaagcucacccugaagggcaccuccuacgucaugugcaccgggagcuucaagcuggagaaggagguggcggagacgcagcacggcaccgugcugguccaggugaaguacgagggcaccgacgcccccugcaagauccccuucuccacccaggacgagaagggggugacgcagaacggccgccucaucaccgccaacccgaucgucaccgacaaggagaagcccgugaacaucgagaccgagccgcccuucggggagagcuacaucguggucggcgccggcgagaaggcgcugaagcuguccugguucaagaaggggagcuccaucggcaagauguucgaggccacggcccgcggggcccgccggauggccauccucggcgacaccgcgugggacuucgggagcaucggcggcguguucaccuccguggggaagcugguccaccagguguucggcaccgccuacggggugcuguucagcggcgucuccuggacgaugaagaucgggaucggcauccuccugaccuggcugggccucaacagccgcuccaccagccuguccaugaccugcaucgccguggggauggugacgcuguaccucggcgucauggugcaggccgacagcgggugcgugaucaacuggaagggccgcgagcugaagugcggguccggcaucuucgucaccaacgaggugcacaccuggaccgagcaguacaaguuccaggccgacagcccgaagcggcugagcgcggccaucggccgcgccugggaggagggggugugcggcauccgguccgccacccgccucgagaacaucauguggaagcagaucagcaacgagcugaaccacauccugcucgagaacgacaucaaguucacggucgugguggggaacgccaacggcauccugacccaggggaagaagaugauccggccccagcccauggagcacaaguacuccuggaaguccuggggcaaggcgaagaucaucggcgccgacauccagaacaccaccuucaucaucgacgggcccgacacgccggagugccccgacgagcagcgcgccuggaacaucugggaggucgaggacuacggcuucgggaucuucaccaccaacaucuggcugaagcuccgggacuccuacacccagaugugcgaccaccgccugaugagcgccgcgaucaaggacuccaaggccgugcacgccgacaugggcuacuggaucgagagcgagaagaacgagacguggaagcuggcccgggccuccuucaucgaggugaagaccugcaucuggcccaagagccacacccucugguccaacggcguccuggagagcgagaugaucauccccaagauguacgggggcccgaucucccagcacaacuaccgccccggguacuucacccagacggcgggccccuggcaccuggggaagcucgagcuggacuucgaccugugcgagggcaccaccgugguggucgacgagcacugcggcagccgggggccgucccuccgcaccacgaccgugaccggcaagaucauccacgaguggugcugccggagcugcacccugccgccccugcgcuuccgcggggaggacggcugcugguacgggauggagauccgccccgugaaggagaaggaggagaaccucgucaaguccauggugagcgccggcagcggcgagguggacuccuucagccuggggauccugugcgucuccaucaugaucgaggaggugaugcggagccgcuggucccggaagaugcucaugacgggcacccuggccguguuccugcuccugaucauggggcagcugaccuggaacgaccucauccgccugugcaucauggucggcgccaacgccagcgacaagauggggaugggcaccacguaccuggcgcucauggccaccuucaagaugcgcccgauguucgccguggggcugcuguuccggcgccucaccucccgggaggugcugcugcucaccaucgggcugagccuggucgccuccguggagcuccccaacagccuggaggagcugggcgacgggcucgccaugggcaucaugaugcugaagcugcucacggaguuccagccccaccagcuguggaccacccugcucucccugaccuucaucaagacgacccugagccucgacuacgcguggaagaccaccgccaugguccuguccaucgugagccuguucccccucugccuguccacgaccagccagaagaccaccuggcugccggugcuccugggcuccuucgggugcaagccccugaccauguuccucaucacggagaacaagaucuggggccgcaagagcuggccccugaacgaggggaucauggccaucggcaucgucuccauccugcucagcagccugcugaagaacgacgugccccucgccgggccgcugaucgcgggcggcaugcugaucgccugcuacgugaucuccgggagcuccgccgaccucagccuggagaaggccgccgaggucuccugggaggaggaggcggagcacagcggcaccucccacaacauccugguggaggugcaggacgacgggaccaugaagaucaaggacgaggagcgggacgacacccucacgauccugcugaaggccacccuccuggccgucagcggcguguaccccauguccauccccgccacccuguucgugugguacuucuggcagaagaagaagcagcgcagcgggguccucugggacacccccuccccgcccgagguggagcgggccgugcuggacgacggcaucuaccgcauccugcagcggggccugcucgggcgcagccaggucggcguggggguguuccaggacggcgucuuccacacgauguggcacgugacccgcggggccgugcugauguaccagggcaagcgccuggagcccuccugggccagcgucaagaaggaccucaucuccuacggcgggggcuggcgguuccaggggagcuggaacaccggcgaggagguccaggugaucgccgucgagcccgggaagaacccgaagaacgugcagaccacgcccggcaccuucaagacccccgagggcgaggugggggccaucgcccuggacuucaagcccggcaccuccgggagcccgaucgucaaccgcgagggcaagaucgugggccuguacgggaacggcguggucacgaccuccgggaccuacgugagcgcgaucgcccaggccaaggccagccaggagggcccccuccccgagaucgaggacgagguguucaagaagcggaaccugaccaucauggaccugcacccgggguccggcaagacgcgccgguaccuccccgccaucguccgcgaggcgaucaagcggaagcugcgcacccugauccucgcccccacccgggugguggccagcgagauggccgaggcgcugaagggcaugcccauccgcuaccagaccacggccgucaaguccgagcacaccgggcgcgagaucguggaccugaugugccacgccaccuucaccaugcggcuccugagcccggugcgcguccccaacuacaacaugaucaucauggacgaggcccacuucacggaccccgccuccaucgcggcccggggcuacaucagcacccgcguggggaugggcgaggccgccgccaucuucaugaccgcgacgccgcccggguccguggaggccuucccccagagcaacgccgucauccaggacgaggagcgggacauccccgagcgcuccuggaacagcggcuacgacuggaucacggacuuccccggcaagaccgugugguucgugcccuccaucaagagcgggaacgacaucgccaacugccugcggaagaacggcaagcgcgucauccagcucucccggaagaccuucgacaccgaguaccagaagacgaagaacaacgacugggacuacguggugaccaccgacaucagcgagaugggggccaacuuccgcgcggaccgggucaucgacccccgccggugccugaagcccgugauccugaaggacggccccgagcgcgugauccucgccgggccgaugcccgucaccguggccuccgccgcgcagcggcgcggccggaucggccgcaaccagaacaaggagggggaccaguacgucuacaugggccagccccugaacaacgacgaggaccacgcccacuggacggaggccaagaugcugcucgacaacaucaacacccccgaggggaucaucccggcccuguucgagcccgagcgggagaaguccgccgcgaucgacggcgaguaccgccugcgcggggaggcccggaagaccuucguggagcucaugcgccggggcgaccugcccguguggcuguccuacaaggucgccagcgagggcuuccaguacuccgaccgccgguggugcuucgacggggagcgcaacaaccaggugcucgaggagaacauggacguggagaucuggaccaaggagggcgagcggaagaagcugcgcccccgguggcuggacgcccgcaccuacagcgacccgcucgcccugcgggaguucaaggaguucgcggccgggcgccggagcgucuccggcgaccugauccucgagaucggcaagcugccccagcaccugacgcuccgcgcccagaacgcccuggacaaccuggugaugcuccacaacagcgagcagggcgggaaggccuaccggcacgcgauggaggagcugcccgacaccaucgagacccugaugcuccuggcccugaucgccgugcucaccgggggcgucacgcuguucuuccuguccgggaagggccucggcaagaccagcaucgggcugcugugcgugaccgccuccagcgcgcuccuguggauggccuccguggagccccacuggaucgccgccagcaucauccuggaguucuuccucaugguccugcugaucccggagcccgaccgccagcggacgccccaggacaaccagcucgccuacguggugaucggccugcuguucaugauccucacggucgcggccaacgagauggggcugcuggagaccaccaagaaggaccucggcaucgggcacguggccgccgagaaccaccagcacgccaccaugcuggacguggaccugcacccggcguccgccuggacgcucuacgccgucgccaccaccgugaucacccccaugaugcgccacacgaucgagaacaccaccgccaacaucagccugaccgcgaucgccaaccaggccgccauccugaugggccucgacaagggcuggcccaucuccaagauggaccugggggugccccugcucgcccugggcugcuacagccaggucaacccgcugacgcucaccgcggccgugcugaugcugguggcccacuacgccaucaucgggcccggccuccaggcgaaggccacccgggaggcccagaagcgcaccgccgccgggaucaugaagaaccccacggucgacggcaucguggcgaucgaccuggaccccguggucuacgacgccaaguucgagaagcagcugggccagaucaugcuccugauccugugcaccucccagauccuccugaugcggaccaccugggcccugugcgagagcaucacgcucgccaccgggccgcugaccacccugugggagggcucccccgggaaguucuggaacacgaccaucgccgugagcauggcgaacaucuuccgcggcuccuaccucgccggcgccgggcuggccuucagccugaugaagucccucggcgggggccgccgggggaccggcgcccagggcgagacccugggggagaaguggaagcgccagcugaaccagcucagcaagagcgaguucaacacguacaagcgguccggcaucauggagguggaccgcaccgaggcgaaggaggggcugaagcggggcgagaccaccaagcacgccgucagccgcgggaccgccaagcugcggugguucguggagcgcaaccuggugaagcccgagggcaaggucaucgaccucggcugcgggcggggcgggugguccuacuacugcgccggccugaagaaggugacggaggugaagggguacaccaagggcggccccgggcacgaggagccgauccccauggcgaccuacggcuggaaccuggucaagcuccacagcgggaaggacguguucuucaugccgcccgagaagugcgacacccugcugugcgacaucggcgaguccagcccgaaccccacgaucgaggaggggcgcacccuccgggugcugaagauggucgagcccuggcugcgcggcaaccaguucugcaucaagauccucaaccccuacaugccguccgugguggagacccuggagcagaugcagcggaagcacggcgggaugcugguccgcaacccccucagccggaacuccacccacgagauguacugggugagcugcggcacggggaacaucguguccgccgucaacaugaccagccgcaugcugcugaaccgguucaccauggcccaccgcaagcccaccuacgagcgggacguggaccucggcgccggcacgcgccacguggccgucgagcccgagguggcgaaccuggacaucaucgggcagcgcaucgagaacaucaagaacgagcacaaguccaccuggcacuacgacgaggacaacccguacaagaccugggccuaccacggcagcuacgaggugaagcccuccgggagcgccuccagcauggucaacggcgugguccggcugcucaccaagcccugggacgugauccccauggugacgcagaucgccaugaccgacaccaccccguucgggcagcagcgcgucuucaaggagaagguggacacgcggacgccccgggccaagcggggcaccgcgcagaucauggaggugaccgccaaguggcuguggggcuuccugucccgcaacaagaagccccggaucugcacgcgcgaggaguucacccggaagguccgcagcaacgccgccaucggggccguguucguggacgagaaccaguggaacagcgcgaaggaggccgucgaggacgagcgguucugggaccucgugcaccgcgagcgggagcugcacaagcagggcaagugcgcgaccugcguguacaacaugauggggaagcgcgagaagaagcugggcgaguucgggaaggccaagggcucccgggcgaucugguacauguggcucggcgcccgcuuccuggaguucgaggcccugggguucaugaacgaggaccacugguucagccgggagaacucccucagcggcgucgagggggagggccugcacaagcugggguacauccuccgcgacaucuccaagaucccgggcggcaacauguacgccgacgacaccgccgggugggacacgcggaucaccgaggacgaccugcagaacgaggcgaagaucaccgacaucauggagcccgagcacgcccugcucgccaccagcaucuucaagcugacguaccagaacaagguggugcgcguccagcggcccgccaagaacggcaccgugauggacgugaucucccgccgcgaccagcgggggagcggccaggucggcaccuacgggcugaacaccuucacgaacauggaggugcagcucauccgccagauggaguccgagggcaucuucuuccccagcgagcuggaguccccgaaccuggccgagcgggugcucgacuggcuggagaagcacggggcggagcgccugaagcggauggccaucagcggcgacgacugcgucgugaagcccaucgacgaccgcuucgccaccgcccucaucgcccugaacgacauggggaaggugcggaaggacaucccccagugggagcccuccaagggcuggaacgacuggcagcaggucccguucugcagccaccacuuccaccagcugaucaugaaggacggccgcgagaucguggugcccugccggaaccaggacgagcucgucgggcgcgcgcgggugucccagggcgccggguggagccugcgcgagaccgccugccugggcaaguccuacgcccagauguggcagcucauguacuuccaccggcgcgaccugcggcuggccgcgaacgccaucugcagcgccgugcccgucgacugggugcccaccagccgcaccacgugguccauccacgcccaccaccaguggaugaccaccgaggacaugcucagcguguggaaccgggucuggaucgaggagaacccguggauggaggacaagacccacguguccagcugggaggaggugcccuaccuggggaagcgcgaggaccaguggugcggcucccugaucggccucacggcgcgggccaccugggccaccaacauccaggucgccaucaaccaggugcgccgccugaucgggaacgagaacuaccuggacuacaugaccagcaugaagcgguucaagaacgaguccgaccccgagggcgcccucugg

SEQ ID NO: 8975 - RNA, 9879 nt, Artificial Sequence
  derived and/or modified CDS sequence (opt1) from DENV-1__EU863650__SS-prME
agcgugaccaugcugcucaugcugcugcccaccgugcucaccuuccaccugaccacccgcggcggggagccccacaugaucgugagcaagcaggagcggggcaagagccuccuguucaagaccuccgccggggugaacaugugcacgcugaucgccauggaccugggcgagcucugcgacgacaccaugaccuacaagugcccccgcaucaccgagacggagcccgacgacguggacugcuggugcaacgccaccgagaccugggugaccuacgggacgugcagccagaccggcgagcaccggcgcgacaagcgguccguggcccuggcgccccacgucggccuggggcucgagacccgcaccgagacguggaugagcuccgagggcgccuggcggcagauccagaagguggagaccugggcccugcgccaccccggguucaccgugaucgcgcuguuccucgcccacgccaucggcaccagcaucacgcagaaggggaucaucuucauccugcugaugcucgucacccccuccauggccaugcggugcgugggcaucggcaaccgcgacuucguggaggggcugagcggcgcgaccugggucgacguggugcuggagcacggguccugcgucaccacgauggccaaggacaagcccacccucgacaucgagcugcugaagaccgaggugaccaaccccgccgugcuccggaagcugugcaucgaggccaagaucagcaacacgaccaccgacucccgcugcccgacccagggcgaggccacgcuggucgaggagcaggacaccaacuucgugugccggcgcaccuucguggaccggggcugggggaacggcugcggccuguucggcaaggggagccugaucacgugcgcgaaguucaagugcgucacgaagcuggagggcaagaucgugcaguacgagaaccucaaguacuccgugaucgucaccgugcacaccggcgaccagcaccaggucgggaacgagaccaccgagcacggcacgaucgccaccaucacgccccaggcccccaccagcgagauccagcugacggacuacggggcccugacccucgacugcagcccccggaccggccuggacuucaacgagauggugcugcucaccaugaaggagaaguccuggcuggugcacaagcagugguuccuggaccucccgcugcccuggacguccggggccagcaccagccaggagaccuggaaccggcaggaccugcucgucaccuucaagacggcgcacgccaagaagcaggagguggugguccugggcucccaggagggcgccaugcacaccgcccugaccggggccaccgagauccagacgagcggcaccaccaccaucuucgcggggcaccucaagugccgccugaagauggacaagcugacgcucaagggcaucuccuacgugaugugcaccgggcuguucaagcuggagaaggagguggccgagacccagcacggcaccguccugguccaggugaaguacgagggcacggacgcccccugcaagauccccuucagcucccaggacgagaagggggccacccagaacggccggcucgucaccgccaacccgaucgugaccgacaaggagaagcccgugaacaucgaggcggagccgcccuucggggagagcuacaucgucgugggcgccggcgagaaggcccugaagcuguccugguucaagaaggggagcuccaucggcaagauguucgaggccacggcgcgcggggcccggcgcauggccauccucggcgacaccgccugggacuucgggagcaucggcggcguguucaccuccgucgggaagcuggugcaccagaucuucggcaccgccuacggggugcuguucagcggcgucuccuggacgaugaagaucgggaucggcauccuccugaccuggcugggccucaacagccgcuccaccagccuguccaugaccugcaucgcgguggggauggugacgcuguaccucggcgucauggugcaggccgacagcgggugcgugaucaacuggaagggccgggagcugaagugcggguccggcaucuucgucaccaacgaggugcacaccuggaccgagcaguacaaguuccaggccgacagcccgaagcgccugagcgccgccaucggcaaggcgugggaggagggggugugcggcauccgguccgccacccgccucgagaacaucauguggaagcagaucagcaacgagcugaaccacauccugcucgagaacgacaugaaguucacggucguggugggggacgucuccggcauccuggcccaggggaagaagaccauccggccccagcccauggagcacaaguacagcuggaaguccuggggcaaggccaagaucaucggcgccgacgugcagaacaccaccuucaucaucgacgggcccaacacgccggagugccccgacgaccagcgcgcguggaacaucugggagguggaggacuacggcuucgggaucuucaccaccaacaucuggcugaagcuccgggacagcuacacccaggucugcgaccaccgccugauguccgccgccaucaaggacagcaaggccgugcacgcggacaugggcuacuggaucgaguccgagaagaacgagacguggaagcuggcccgggccagcuucaucgaggugaagaccugcgucuggcccaagucccacacccucuggagccacggcgugcuggaguccgagaugaucauccccaagaucuacgggggcccgaucagccagcacaacuaccgccccggguacuucacccagacggccggccccuggcaccuggggaagcucgagcuggacuucgaccugugcgagggcaccaccguggucguggacgagcacugcggcaaccgggggccgucccuccgcaccacgaccgugaccggcaagaucauccacgaguggugcugccggagcugcacccugccgccccugcgcuucaagggggaggacggcugcugguacgggauggagauccggcccgucaaggagaaggaggagaaccucgugaaguccauggugagcgccggcagcggcgaggucgacuccuucagccuggggcugcucugcaucuccaucaugaucgaggaggugaugcgcagccgguggucccgcaagaugcugaugacgggcacccugguggucuuccuccugcugacccucgggcagcugaccuggaacgaccugauccggcucugcaucauggugggcgcgaacgccagcgacaacauggggaugggcacgaccuaccuggcccugauggccaccuuccgcaugcgcccgauguucgccgucgggcuccuguuccggcgccugaccucccgggaggugcuccugcugacgguggggcucagccuggucgccuccguggagcugcccaacagccucgacgagcugggcgacgggcuggccaugggcaucaugauccucaagcugcugaccgacuuccagucccaccagcucugggccacccugcugagccucaccuucgugaagacgacccugucccugcacuacgccuggaagaccauggccaugauccucagcaucgucucccugcugccccucugccugagcaccacgucccagaagaccaccuggcugcccgugcuccugggcagccuggggugcaagccgcucaccauguuccugaucaccgagaacaagaucuggggccgcaaguccuggccccugaacgaggggaucauggcggugggcaucgucagcauccuccugagcucccugcucaagaacgacgugccccuggccgggccccugaucgccggcggcaugcucaucgccugcuacgugaucagcggguccagcgcggaccugucccuggagaaggccgccaaggucagcugggaggaggaggccgagcacuccggcgccagccacaacauccucguggagauccaggacgacgggacgaugaagaucaaggacgaggagcgggacgacaccaucaccauccugcugaaggcgacccuccuggccaucuccggcguguacccgaugagcauccccgccacgcuguucgucuggcacuucuggcagaagaagaagcagcgcuccggggugcugugggacacccccagcccgcccgagguggagaaggccguccucgacgacggcaucuaccggauccugcagcgcggccugcucgggcggucccaggugggcgugggggucuuccaggagggcguguuccacaccauguggcacgugacccgcggggccguccugauguaccagggcaagcggcuggagcccagcugggcguccgugaagaaggaccucaucagcuacggcgggggcuggcgcuuccagggguccuggaacacgggcgaggaggugcaggucaucgccguggagcccgggaagaaccccaagaacgugcagaccgcccccggcaccuucaagaccagcgagggcgaggucggggccaucgcccuggacuucaagcccggcacguccgggagccccaucgugaaccgggagggcaagaucgugggccuguacgggaacggcgucgugaccaccagcgggaccuacguguccgcgaucgcccaggccaaggccagccaggagggcccccucccggagaucgaggacgaggucuuccgcaagcggaaccugacgaucauggaccugcaccccggguccggcaagacccgccgguaccuccccgccaucgugcgcgaggcgaucaagcggaagcugcgcacccuggugcucgccccgacccgggucguggccagcgagauggccgaggcgcugaagggcaugcccauccgcuaccagacgaccgccgugaaguccgagcacaccgggaaggagaucgucgaccugaugugccacgccaccuucacgaugcgccuccugagccccgugcgggugcccaacuacaacaugaucaucauggacgaggcccacuucaccgacccggccuccaucgcggcccgcggcuacaucagcacccgggucgggaugggcgaggccgccgccaucuucaugaccgcgacgccgcccggguccguggaggccuucccccagagcaacgccgugauccaggacgaggagaaggacaucccggagcgcuccuggaacagcggcuacgacuggaucaccgacuuccccggcaagaccgucugguucgugcccuccaucaagagcgggaacgacaucgccaacugccugcggaagaacggcaagcgcgugauccagcucucccggaagaccuucgacacggaguaccagaagaccaagaacaacgacugggacuacgucgugaccaccgacaucagcgagaugggggccaacuuccgcgcggaccgggucaucgacccccgccggugccugaagccggugauccugaaggacggccccgagcgcgugauccucgccgggcccaugcccgucacgguggccuccgccgcgcagcggcgcggccggaucggccgcaaccagaacaaggagggggaccaguacaucuacaugggccagccgcugaacaacgacgaggaccacgcccacuggaccgaggccaagaugcugcucgacaacaucaacacccccgaggggaucauccccgcccuguucgagcccgagcgggagaaguccgccgcgaucgacggcgaguaccgccugcgcggggaggcccgcaagaccuucguggagcucaugcgccggggcgaccugccggucuggcuguccuacaagguggccagcgagggcuuccaguacagcgaccgccgguggugcuucgacggggagcgcaacaaccaggugcucgaggagaacauggacgucgagaucuggacgaaggagggcgagcggaagaagcugcgcccccgguggcuggacgcccgcaccuacuccgacccccucgcccugcgggaguucaaggaguucgcggccgggcgccggagcguguccggcgaccugauccucgagaucggcaagcugccccagcaccugacccagcgcgcccagaaggcccucgacaaccuggugaugcugcacaacagcgagcagggcgggaaggccuaccggcacgcgauggaggagcucccggacaccaucgagaccaucaugcugcuggcccucaucgccguccugaccggcggggugacccuguucuuccucuccgggcgcgggcugggcaagaccagcaucgggcugcucugcgugaccuccagcuccgcccugcuguggauggcgagcgucgagccccacuggaucgccgccuccaucauccucgaguucuuccugauggugcugcucauccccgagcccgaccggcagcgcacgccgcaggacaaccagcuggccuacguggucaucggccuccucuucaugauccugaccguggccgcgaccgagauggggcugcucgagaccacgaagaaggaccugggcaucgggcacgccgccgccgagaaccaccaccacgccgcgaugcuggacguggaccuccaccccgccagcgccuggacccuguacgccgucgccaccaccaucaucacgcccaugaugcggcacaccaucgagaacaccaccgcgaacaucucccugacggccaucgccaaccaggccgccauccucaugggccuggacaagggcuggccgaucagcaagauggacaucggggugccccugcucgcgcugggcugcuacucccaggugaacccccugacccucaccgccgccguccugaugcugguggcccacuacgcgaucaucgggcccggccuccaggccaaggccacccgcgaggcccagaagcggacggccgcggggaucaugaagaacccgaccguggacggcaucgucgccaucgaccuggaccccgugguguacgacgccaaguucgagaagcagcugggccagaucaugcuccugauccugugcaccagccagauccuccugaugcgcaccacgugggcccugugcgaguccaucacccucgccaccgggccccugaccacgcugugggagggcagccccgggaaguucuggaacaccaccaucgcggucuccauggccaacaucuuccggggcagcuaccucgccggcgccgggcuggccuucagccugaugaagucccucggcgggggccgccgcgggaccggcgcgcagggcgagacgcugggggagaaguggaagcggcagcugaaccagcucagcaaguccgaguucaagaccuacaagcgcagcggcaucaucgagguggaccgguccgaggccaaggaggggcugaagcgcggcgagaccaccaagcacgccgugagccgggggacggccaagcugcgcugguucgucgagcggaaccuggugaagccggagggcaaggugaucgaccucggcugcgggcgcggcgggugguccuacuacugcgcgggccugaagaaggucaccgaggugaaggggagcaccaagggcggccccgggcacgaggagcccauccccauggccaccuacggcuggaaccuggugaagcuccacuccgggaaggacgucuucuucaucccgcccgagaagugcgacacccugcugugcgacaucggcgagagcucccccaaccccacgaucgaggaggggcggacccuccgcgugcugaagaugguggagccguggcugcggggcaaccaguucugcaucaagauccucaaccccuacaugcccagcgucguggagacccuggagcagaugcagcgcaagcacggcgggaugcuggugcggaacccccucucccgcaacagcacccacgagauguacugggucuccugcggcacggggaacaucgugagcgccgugaacaugaccucccggaugcugcugaaccgcuucaccauggcccaccggaagccgaccuacgagcgcgacgucgaccucggcgccggcacgcggcacguggcgguggagcccgaggucgccaaccuggacaucaucgggcagcgcaucgagaacaucaagaacgagcacaagagcaccuggcacuacgacgaggacaaccccuacaagaccugggccuaccacggcuccuacgaggugaagcccagcgggagcgccuccagcauggucaacggcguggugcgccugcucaccaagccgugggacgucauccccauggugacgcagaucgccaugaccgacaccacccccuucgggcagcagcggguguucaaggagaaggucgacacgcgcacccccaaggcgaagcggggcaccgcccagaucauggaggugaccgccaaguggcuguggggcuuccugucccgcaacaagaagccgcggaucugcacgcgcgaggaguucacccggaaggugcgcagcaacgccgccaucggggcggucuucguggacgagaaccaguggaacucccccaaggaggccguggaggacgagcgguucugggaccucguccaccgcgagcgggagcugcacaagcagggcaagugcgcgaccugcguguacaacaugauggggaagcgcgagaagaagcugggcgaguucgggaaggccaagggcagccgggcgaucugguacauguggcucggcgcccgcuuccuggaguucgaggcccugggguucaugaacgaggaccacugguucucccgggagaacagccucuccggcguggagggggagggccugcacaagcugggguacauccuccgcgacaucagcaagauccccggcggcaacauguacgccgacgacaccgccgggugggacacgcggaucaccgaggacgaccugcagaacgaggcgaagaucaccgacaucauggagccggagcacgcccugcucgccaccuccaucuucaagcugacguaccagaacaaggucgugcgcgugcagcggcccgccaagaacggcaccgucauggacgugaucagccgccgggaccagcgcggguccggccaggugggcaccuacgggcugaacaccuucacgaacauggaggcccagcucauccgccagauggagagcgagggcaucuuccugcccuccgagcuggagcccccgaaccucgcggggcggguccccgacuggcuggagaagcacggcaccgagcgccugcggcgcauggccaucagcggggacgacugcguggugaagcccaucgacgaccgguucgccaccgcccucaccgcccugaacgacaugggcaagguccgcaaggacaucccccagugggagccguccaagggcuggaacgacuggcagcagguccccuucugcagccaccacuuccaccagcugaucaugaaggacgggcgggagaucgugguccccugccgcaaccaggacgagcucgugggccgggcgcgcgugagccagggggccggcuggucccugcgggagacggccugccugggcaagagcuacgcccagauguggcagcucauguacuuccaccgccgggaccugcgccuggccgcgaacgccaucugcuccgccguccccguggacugggugccgaccagccggaccaccugguccauccacgcccaccaccaguggaugaccacggaggacaugcucagcgucuggaaccgcguguggaucgaggagaaccccuggauggaggacaagacccacguguccagcugggaggacguccccuaccugggcaagcgggaggaccaguggugcggcucccugaucgggcucaccgcgcgcgccaccugggccacgaacauccagguggccaucaaccaggugcggcgccugaucggcaacgagaacuaccuggacuacaugaccagcaugaagcgcuucaagaacgaguccgaccccgagggggcccucugguga

SEQ ID NO: 8976 - RNA, 9879 nt, Artificial Sequence
  derived and/or modified CDS sequence (opt1) from DENV-1__KU365900__SS-prME
agcgugaccaugcugcucaugcugaugcccaccgcccuggccuuccaccucaccacccggggcggggagccccacaugaucgucagcaagcaggagcggggcaagagccugcuguucaagaccuccgccggggugaacaugugcacccucaucgccauggaccugggcgagcugugcgaggacacgaugaccuacaagugcccccggaucaccgaggccgagcccgacgacguggacugcuggugcaacgccaccgacacgugggucaccuacgggaccugcagccagaccggcgagcaccggcgggacaagcgguccguggcccucgcgccccacgugggccuggggcuggagacgcggaccgagaccuggaugagcuccgagggcgccuggaagcagauccagcgggucgagaccugggcccuccgccaccccggguucacggugaucgcccuguuccuggcgcacgccaucggcaccagcaucacccagaaggggaucaucuucauccuccugaugcuggugacccccuccauggccaugcggugcgucggcaucggcagccgcgacuucguggaggggcucuccggcgccacguggguggacgucgugcuggagcacgggagcugcgugaccaccauggccaaggacaagcccacccuggacaucgagcuccugaagacggaggucaccaaccccgcggugcugcggaagcucugcaucgaggccaagaucuccaacaccaccacggacagccgcugcccgacccagggcgaggccacccugguggaggagcaggacgccaacuucgucugccggcgcaccuucguggaccggggcugggggaacggcugcgggcuguucggcaaggggucccucaucacgugcgccaaguucaagugcgugaccaagcuggagggcaagaucguccaguacgagaaccugaaguacagcgugaucgugaccguccacaccggcgaccagcaccagguggggaacgaguccacggagcacggcaccaccgcgaccaucacgccccaggcccccacgaccgagauccagcucaccgacuacggggcccugacccuggacugcagcccccgcacgggccucgacuucaacgagaugguccugcugaccaugaaggagaaguccuggcucgugcacaagcagugguuccuggaccugccccuccccuggaccagcggggccagcaccucccaggagacguggaaccggcaggaccugcuggugaccuucaagaccgcccacgcgaagaagcaggaggucguggugcucggcagccaggagggcgccaugcacaccgcccugacgggggccaccgagauccagaccuccggcaccacgaccaucuucgccgggcaccugaagugccgccucaagauggacaagcugacccugaagggcaugagcuacgucaugugcaccggguccuucaagcucgagaaggagguggcggagacgcagcacggcaccgugcugguccagaucaaguacgagggcaccgacgcccccugcaagauccccuucagcacccaggacgagaagggggugacgcagaacggccggcugaucaccgccaacccgaucgugaccgacaaggagaagcccgucaacaucgaggccgagccgcccuucggggaguccuacaucgugaucggcgcgggcgagaaggcccugaagcucagcugguucaagaagggguccagcaucggcaagauguucgaggccaccgcccgcggggcccggcgcauggcgauccugggcgacacggccugggacuucggguccaucggcggcguguucaccagcgucgggaagcuggugcaccagaucuucggcaccgccuacggggugcuguucuccggcgucagcuggaccaugaagaucgggaucggcgugcugcugacguggcucggccugaacucccgcagcaccucccugagcaugaccugcaucgccguggggcucgucacccuguaccugggcgugauggugcaggccgacuccgggugcgucaucaacuggaagggccgggagcucaagugcgggagcggcaucuucgugacgaacgaggugcacaccuggaccgagcaguacaaguuccaggcggacagcccgaagcgccuguccgccgccaucggcaaggccugggaggagggggucugcggcauccggagcgccacccgccuggagaacaucauguggaagcagaucuccaacgagcucaaccacauccugcuggagaacgacaugaaguucaccgugguggucggggacguggcgggcauccucgcccaggggaagaagaugauccggccccagcccauggagcacaaguacagcuggaaguccuggggcaaggccaagaucaucggcgccgacgugcagaacacgaccuucaucaucgacgggcccaacaccccggagugccccgacgaccagcgcgcguggaacaucugggaggucgaggacuacggcuucgggaucuucaccacgaacaucuggcugaagcugcgggacagcuacacccaggugugcgaccaccgccucauguccgccgccaucaaggacagcaaggccgugcacgccgacaugggcuacuggaucgaguccgagaagaacgagaccuggaagcuggcgcgggccagcuucaucgaggucaagaccugcaucuggcccaagucccacacgcuguggagcaacggcgugcucgaguccgagaugaucauccccaagaucuacgggggcccgaucagccagcacaacuaccgccccggguacuucacccagaccgccggccccuggcaccuggggaagcuggagcucgacuucgaccugugcgagggcaccacgguggucguggacgagcacugcggcaaccgggggccgucccugcgcaccaccaccgugacgggcaagaucauccacgaguggugcugccggagcugcacccugccgccccuccgcuuccgcggggaggacggcugcugguacgggauggagauccgccccgucaaggagaaggaggagaaccuggugaaguccauggugagcgccggcccgggcgaggucgacagcuucucccucgggcugcugugcaucagcaucaugaucgaggaggugaugcggucccgcuggagccggaagaugcucaugaccggcacccuggccguguucuuccugcucaucauggggcagcugacguggaacgaccugauccgccucugcaucauggucggcgcgaacgccuccgaccgcauggggaugggcaccaccuaccuggcccugauggccaccuucaagaugcggcccauguucgccgugggccuccugcugcgccggcucacgagccgcgaggugcugcugcucaccaucgggcugucccuggucgcgagcguggagcuccccaacucccuggaggagcugggcgacgggcucgccaugggcaucaugauccugaagcugcucaccgacuuccagagccaccagcugugggccacccugcucucccugacguucaucaagaccaccuucagccugcacuacgccuggaagaccauggcgaugguccucuccaucgugagccuguucccccugugccucuccacgaccagccagaagaccaccuggcugccggugcugcucggcucccuggggugcaagccccugacgauguuccucaucgccgagaacaagaucuggggccgcaagagcuggccccugaacgaggggaucauggccgucggcaucguguccauccugcucagcagccugcugaagaacgacgugccccucgccgggccgcugaucgccggcggcaugcugaucgcgugcuacgucaucuccgggagcuccgccgaccucagccuggagaaggccgccgagguguccugggaggaggaggccgagcacagcggcgcgucccacaacauccugguggagguccaggacgacgggaccaugaagaucaaggacgaggagcgcgacgacacccucaccauccugcugaaggccacccuccuggccgugagcggcguguacccccuguccauccccgccacccucuucgucugguacuucuggcagaagaagaagcagcggagcggggugcugugggacacccccuccccgcccgagguggagcgcgccguccuggacgacggcaucuaccggaucaugcagcgcggccugcucgggcggagccaggugggcgugggggucuuccaggagaacguguuccacaccauguggcacgugacccgcggcgcgguccugauguaccaggggaagcggcuggagcccuccugggccagcgugaagaaggaccucaucuccuacggcggcggguggcgccugcagggcagcuggaacacgggggaggaggugcaggucaucgccguggagcccggcaagaacccgaagaacgugcagaccgcccccgggaccuucaagacccccgagggcgaggucggcgccaucgcgcuggacuucaagcccgggacguccggcagcccgaucgugaaccgggaggggaagaucgugggccucuacggcaacggggucgugaccaccuccggcaccuacgugagcgccaucgcccaggccaaggcgagccaggaggggccccugcccgagaucgaggacgaggucuuccgcaagcggaaccugacgaucauggaccuccacccgggcuccgggaagacccgccgguaccugcccgccaucgugcgcgaggccaucaagcggaagcugcgcacccucauccuggcccccacccgcguggucgccagcgagauggcggaggcccugaagggcaugcccauccgguaccagacgaccgccgugaaguccgagcacaccggcaaggagaucguggaccucaugugccacgccaccuucacgaugcgccugcugagcccgguccgggugcccaacuacaacaugaucaucauggacgaggcccacuucaccgaccccuccagcaucgcggcccgcggguacaucuccacccgggugggcaugggggaggccgccgccaucuucaugaccgcgacgcccccgggcagcgucgaggccuucccccaguccaacgccgugauccaggacgaggagcgcgacauccccgagcggagcuggaacuccggguacgaguggaucaccgacuuccccggcaagaccgugugguucgucccgagcaucaaguccggcaacgacaucgccaacugccuccgcaagaacgggaagcgggugauccagcugagccgcaagaccuucgacacggaguaccagaagaccaagaacaacgacugggacuacguggucaccaccgacaucuccgagaugggcgcgaacuuccgggccgaccgcgugaucgacccccggcgcugccugaagcccgugauccucaaggacgggcccgagcgggucauccuggccggcccgaugcccgugacggucgccagcgccgcgcagcgccgggggcgcaucggccggaaccacaacaaggagggcgaccaguacaucuacauggggcagccccugaacaacgacgaggaccacgcccacuggaccgaggccaagaugcuccuggacaacaucaacacccccgagggcaucaucccggcccuguucgagcccgagcgcgagaaguccgccgcgaucgacggggaguaccgccuccggggcgaggcccgcaagaccuucguggagcugaugcggcgcggggaccugcccguguggcucagcuacaaggucgccuccgagggcuuccaguacagcgaccggaaguggugcuucgacggcgagcgcaacaaccaggugcuggaggagaacauggacguggagaucuggacgaaggagggggagcggaagaagcugcgcccccgguggcucgacgcccgcaccuacagcgacccgcuggcccugcgggaguucaaggaguucgcggccggccgccgguccgucagcggggaccucauccuggagaucggcaagcugccccagcaccucacccagcgcgcccagaacgcccuggacaaccuggugaugcuccacaacuccgagcagggcgggcgggcguaccgccacgccauggaggagcugcccgacaccaucgagacgcugaugcuccuggcccugaucgccgugcucaccggcggggucacccuguucuuccugagcggccgggggcucggcaagaccuccaucggccugcugugcgugauggccagcuccgugcuccuguggauggcgagcgucgagccccacuggaucgccgccuccaucauccuggaguucuuccucauggugcugcugaucccggagcccgaccgccagcggacgccccaggacaaccagcucgccuacguggucaucgggcugcuguucaugauccucacgguggccgcgaacgagaugggccugcuggagaccaccaagaaggaccucgggaucggccacguggccgucgagaaccaccaccacgccaccaugcuggacguggaccugcacccggccagcgccuggacgcucuacgcgguggccaccaccaucaucacccccaugaugcgccacacgaucgagaacaccaccgccaacaucucccugaccgccaucgccaaccaggcggccauccugauggggcucgacaagggcuggcccaucagcaagauggacaucggcgucccccugcuggcccucgggugcuacucccaggugaacccgcugacgcugaccgccgcggugcucaugcuggucgcccacuacgccaucaucggccccgggcugcaggccaaggccacccgggaggcgcagaagcgcaccgccgccggcaucaugaagaaccccacgguggacgggaucguggccaucgaccucgaccccgucguguacgacgccaaguucgagaagcagcugggccagaucaugcugcucauccugugcaccagccagauccugcucaugcgcaccaccugggcgcugugcgaguccaucacgcuggccaccggcccgcucaccacccugugggaggggagccccggcaaguucuggaacacgaccaucgccguguccauggccaacaucuuccgggggagcuaccuggccggcgcgggccucgccuucucccugaugaagucccucgggggcgggcgccgggggaccggggcccagggcgagacccucggcgagaaguggaagcgccagcugaaccagcugagcaaguccgaguucaacacguacaagcggagcgggaucauggaggucgaccgcuccgaggccaaggagggccucaagcgcggggagaccaccaagcacgcggugagccgcggcaccgccaagcugcggugguucguggagcgcaaccuggucaagcccgaggggaaggugaucgaccugggcugcggccgcgggggcugguccuacuacugcgccgggcucaagaaggugacggaggucaagggcuacaccaagggcggccccggccacgaggagccgauccccauggccaccuacggguggaaccuggugaagcuguacagcggcaaggacguguucuucaucccgcccgagaagugcgacacccuccugugcgacaucggggaguccagcccgaaccccacgaucgaggagggccgcacccugcggguccucaagaugguggagcccuggcugcgcgggaaccaguucugcaucaagauccugaaccccuacaugccguccguggucgagacccucgagcagaugcagcggaagcacggcggcaugcuggugcgcaacccccugagccggaacuccacccacgagauguacugggugagcugcgggaccggcaacaucgucuccgccgugaacaugacgagccgcaugcuccugaaccgguucaccauggcgcaccgcaagcccaccuacgagaaggacguggaccugggggccggcacccgccacgucgccguggagcccgagguggccaaccucgacaucaucggccagcggaucgagaacaucaagcacgagcacaaguccacguggcacuacgacgaggacaacccguacaagaccugggccuaccacgggagcuacgaggucaagcccuccggcagcgcguccagcauggugaacggggucgugaagcugcugaccaagcccugggacgugauccccauggucacccagaucgccaugacggacaccaccccguucggccagcagcgcguguucaaggagaagguggacacccggacgcccaaggccaagcgcgggaccgcccagaucauggaggucaccgcccgguggcucuggggcuuccugagccgcaacaagaagccccggaucugcacccgcgaggaguucacgcggaaggugcgcuccaacgcggccaucggcgccguguucaucgacgagaaccaguggaacagcgccaaggaggcggucgaggacgagcgguucugggaccuggugcaccgcgagcgggagcuccacaagcaggggaagugcgcgaccugcguguacaacaugaugggcaagcgcgagaagaagcugggggaguucggcaaggccaaggggucccgggccaucugguacauguggcugggcgcccgcuuccucgaguucgaggcgcugggcuucaugaacgaggaccacugguucagccgggagaacucccugagcggggucgagggcgaggggcuccacaagcugggcuacauccugcgcgacaucuccaagaucagcgggggcaacauguacgccgacgacaccgccggcugggacacccggaucacggaggacgaccuccagaacgaggccaagaucaccgacaucauggagccggagcacgcccugcuggcgaaggccaucuucaagcucaccuaccagaacaagguggugcgcguccagcggcccgccaagaacgggaccgugauggacgugaucucccgccgcgaccagcggggcagcgggcaggucggcacguacggccugaacaccuucaccaacauggaggcccagcugauccgccagauggaguccgaggggaucuucagccccuccgagcucgagacccccaaccuggccgagcgggugcuggacuggcucggcaaguacgggguggagcgccugaagcggauggcgaucagcggcgacgacugcgucgugaagccgaucgacgaccgcuucgccacggcccugaccgcccucaacgacauggggaaggugcggaaggacaucccccagugggagcccuccaagggcuggaacgacuggcagcagguccccuucugcagccaccacuuccaccagcugaucaugaaggacggccgcgagaucguggugccgugccggaaccaggacgagcuggucgggcgcgcccgggugucccagggcgcgggguggagccuccgcgagaccgccugccugggcaagagcuacgcccagauguggcagcugauguacuuccaccggcgcgaccuccggcuggccgcgaacgccaucugcuccgccgugcccgucgacugggugcccaccagccgcacgaccugguccauccacgcccaccaccaguggaugaccaccgaggacaugcugagcguguggaaccgggucuggaucgaggagaaccccuggauggaggacaagacgcacaucuccagcugggaggacgugccguaccucgggaagcgcgaggaccaguggugcggcucccugaucggccugaccgcccgggcgaccugggccaccaacauccagguggccaucaaccagguccgccgccucaucgggaacgagaacuaccuggacuacaugaccagcaugaagcgguucaagaacgaguccgaccccgagggcgcccugugguga

SEQ ID NO: 8977 - RNA, 9879 nt, Artificial Sequence
  derived and/or modified CDS sequence (opt1) from DENV-1__FJ176779__SS-prME
agcgugaccaugcugcucaugcugaugcccaccgcgcuggccuuccaccucaccacccggggcggggagccccacaugaucgugagcaagcaggagcggggcaagagccugcuguucaagaccuccgcgggggugaacaugugcacccucguggccauggaccugggcgagcugugcgaggacacgaugaccuacaagugcccccggaucaccgaggccgagcccgacgacguggacugcuggugcaacgccaccgacaccugggugaccuacgggaccugcagccagaccggcgagcaccggcgcgacaagcgguccguggcccucgcgccccacgucggccuggggcuggagacgcggaccgagaccuggaugagcuccgagggcgccuggaagcagauccagcggguggagaccugggcccuccgccaccccggguucacggugaucgcccuguuccuggcgcacgccaucggcaccagcaucacccagaaggggaucaucuucauccuccugaugcuggucacccccuccauggccaugcggugcgugggcaucggcagccgcgacuucguggaggggcucuccggcgccacgugggucgacguggugcuggagcacgggagcugcgucaccaccauggccaaggacaagcccacccuggacaucgagcuccugaagacggaggugaccaaccccgcggugcugcggaagcucugcaucgaggccaagaucuccaacaccaccacggacagccgcugccccacccagggcgaggccacccuggucgaggagcaggacgccaacuucgugugccggcgcaccuucguggaccggggcugggggaacggcugcgggcuguucggcaaggggucccuccugacgugcgccaaguucaagugcgucaccaagcuggagggcaagaucgugcaguacgagaaccucaaguacagcgugaucgucaccgugcacaccggcgaccagcaccaggucgggaacgaguccacggagcacggcaccaccgcgaccaucacgccccaggcccccacgaccgagauccagcugaccgacuacggggcccugacccucgacugcagcccccgcacgggccuggacuucaacgagauggugcugcucaccaugaaggagaaguccuggcuggugcacaagcagugguuccuggaccucccgcugcccuggaccagcggggccagcaccucccaggagacguggaaccggcaggaccugcucgucaccuucaagaccgcccacgcgaagaagcaggagguggugguccugggcagccaggagggcgccaugcacaccgcccugacgggggccaccgagauccagaccuccggcaccacgaccaucuucgccgggcaccucaagugccgccugaagauggacaagcugacccucaagggcaugagcuacgugaugugcaccggguccuucaagcuggagaaggagguggcggagacgcagcacggcaccguccuggugcagaucaaguacgagggcaccgacgcccccugcaagauccccuucagcacccaggacgagaagggggugacgcagaacggccggcugaucaccgccaacccgaucgucaccgacaaggagaagcccgugaacaucgaggccgagccgcccuucggggaguccuacaucgugaucggcgucggcgagaaggcgcucaagcugagcugguucaagaagggguccagcaucggcaagauguucgaggccaccgcccgcggggcccggcgcauggccauccugggcgacacggcgugggacuucggguccaucggcggcguguucaccagcguggggaagcucguccaccagaucuucggcaccgccuacggggugcuguucuccggcgugagcuggaccaugaagaucgggaucggcguccugcucacguggcugggccugaacucccgcagcaccucccucagcaugaccugcaucgccguggggcuggugacccuguaccucggcgucauggugcaggccgacuccgggugcgugaucaacuggaagggccgggagcugaagugcgggagcggcaucuucgucacgaacgaggugcacaccuggaccgagcaguacaaguuccaggccgacagcccgaagcgccuguccgcggccaucggcaaggccugggaggagggggugugcggcauccggagcgccacccgccucgagaacaucauguggaagcagaucuccaacgagcugaaccacauccugcucgagaacgacaugaaguucaccgucguggugggggacgucgccggcauccuggcgcaggggaagaagaugauccggccccagcccauggagcacaaguacagcuggaagaacuggggcaaggccaagaucaucggcgccgacgugcagaacuccacguucaucaucgacgggcccaacaccccggagugcagcgacgaccagcgcgccuggaacaucugggagguggaggacuacggcuucgggaucuucaccaccaacaucuggcugaagcuccgggacuccuacacgcaggucugcgaccaccgccugaugagcgcggccaucaaggacuccaaggccgugcacgccgacaugggcuacuggaucgagagcgagaagaacgagaccuggaagcuggcccgggcguccuucaucgaggugaagaccugcaucuggcccaagagccacacccucugguccaacggcguccuggagagcgagaugaucauccccaagaucuacgggggccccaucucccagcacaacuaccgcccgggguacuucacgcagaccgccggccccuggcaccuggggaagcucgagcuggacuucgaccugugcgagggcaccaccgugguggucgacgagcacugcggcaaccgggggcccagccuccgcacgaccaccgugaccggcaagaucauccacgaguggugcugccgguccugcacgcugccgccccugcgcuuccgcggggaggacggcugcugguacgggauggagauccgccccgugaaggagaaggaggagaaccucgucaagagcauggugagcgccggcuccggcgagguggacagcuucucccuggggcugcucugcaucagcaucaugaucgaggaggucaugcggucccgcuggagccggaagaugcugaugaccggcacccuggccguguucuuccuccugaucauggggcagcugaccuggaacgaccucauccgccugugcaucauggugggcgccaacgcguccgaccgcauggggaugggcacgaccuaccuggcccucauggccaccuucaagaugcggcccauguucgccgucggccugcuguuccgccggcucaccagccgcgaggugcugcugcucacgaucgggcugucccuggucgccagcguggagcucccgaacucccuggaggagcugggcgacgggcucgcgaugggcaucaugauccugaagcugcucaccgacuuccagagccaccagcugugggccacccugcucuccaugaccuucaucaagacgaccuucagccugcacuacgccuggaagaccauggccauggugcuguccaucgucagccucuucccccugugccuguccaccacgagccagaagaccaccuggcuccccgugcugcugggcucccucgggugcaagccccugaccauguuccugaucgcggagaacaagaucuggggccgcaagagcuggccgcucaacgaggggaucauggccgugggcaucgucagcauccugcuguccagccuccugaagaacgacgugccccuggccgggccccucaucgccggcggcaugcugaucgccugcuacgugaucuccgggagcuccgcggaccugagccucgagaaggccgccgaggucuccugggaggaggaggccgagcacagcggcgccucccacaacauccugguggaggugcaggacgacgggacgaugaagaucaaggacgaggagcgggacgacacccugaccauccuccugaaggcgacccugcucgccgucagcggcguguacccccuguccaucccggccacccuguucgugugguacuucuggcagaagaagaagcagcggagcgggguccucugggacacgcccagcccgcccaagguggagcgcgccgugcuggacgacggcaucuaccggaucaugcagcgcggccugcuggggcggagccaggucggcguggggguguuccaggagaacgucuuccacaccauguggcacgugacccgcggcgccgugcucauguaccaggggaagcggcuggagccguccugggcgagcgucaagaaggaccugaucuccuacggcggcggguggcgccuccagggcagcuggaacaccggggaggagguccaggugaucgccgucgagcccggcaagaaccccaagaacgugcagacggcccccgggaccuucaagaccccggagggcgaggugggcgccaucgcccuggacuucaagcccgggaccuccggcagccccaucgucaaccgggaggggaagaucgugggccuguacggcaacgggguggucacgaccagcggcaccuacguguccgcgaucgcccaggccaaggccagccaggaggggccccucccggagaucgaggacgagguguuccgcaagcggaaccugaccaucauggaccugcaccccggcuccgggaagacgcgccgguaccuccccgcgaucguccgcgaggccaucaagcggaagaugcgcacccugauccuggccccgacccgcgugguggccagcgagauggccgaggcgcucaagggcaugcccauccgguaccagaccacggccgucaaguccgagcacaccggcaaggagaucguggaccugaugugccacgccaccuucaccaugcgccugcucagccccgugcggguccccaacuacaacaugaucaucauggacgaggcccacuucacggacccguccagcaucgccgcgcgcggguacaucuccacccgggugggcaugggggaggccgccgccaucuucaugaccgccacgccgcccggcagcguggaggcguucccccaguccaacgccgucauccaggacgaggagcgcgacaucccggagcggagcuggaacuccggguacgaguggaucacggaguuccccggcaagaccgugugguucgugcccagcaucaaggccggcaacgacaucgccaacugccugcgcaagaacgggaagcgggucauccagcugucccgcaagaccuucgacaccgaguaccagaagacgaagaacaacgacugggacuacguggugaccaccgacaucagcgagaugggcgcgaacuuccgggccgaccgcgucaucgacccccggcgcugccucaagccggugauccugaaggacgggcccgagcgggucauccuggccggccccaugcccgugaccguggccuccgccgcgcagcgccgggggcgcaucggccggaaccacaacaaggagggcgaccaguacaucuacauggggcagccgcucaacaacgacgaggaccacgcccacuggacggaggccaagaugcugcuggacaacaucaacacccccgagggcaucauccccgcccucuucgagcccgagcgcgagaaguccgccgcgaucgacggggaguaccgccugcggggcgaggcccgcaagaccuucgucgagcugaugcggcgcggggaccucccgguguggcuguccuacaagguggccagcgagggcuuccaguacagcgaccggcgcuggugcuucgacggcgagcggaacaaccagguccuggaggagaacauggacguggagaucuggaccaaggagggggagcgcaagaagcuccggccccgcuggcuggacgcccggacguacuccgacccccuggcccuccgcgaguucaaggaguucgcggccggccggcgcagcguguccggggaccugauccuggagaucggcaagcucccccagcaccugacccagcgggcccagaacgcccuggacaaccucgucaugcugcacaacagcgagcagggcgggcgcgcguaccggcacgccauggaggagcugccggacaccaucgagacccucaugcugcuggcccucaucgccgugcugacgggcggggugacccuguucuuccucuccggcaaggggcugggcaagaccagcaucggccugcucugcgucauggccuccagcgugcugcuguggauggcguccguggagccccacuggaucgccgccagcaucauccucgaguucuuccugaugguccugcucauccccgagcccgaccgccagcggaccccgcaggacaaccagcuggccuacguggugaucgggcuccuguucaugauccugaccgucgccgcgaacgagaugggccugcucgagacgaccaagaaggaccuggggaucggccacguggccguggagaaccaccaccacgccgccaugcuggacgucgaccuccaccccgccuccgcguggacccuguacgccguggccaccacgaucaucacccccaugaugcgccacaccaucgagaacaccacggccaacaucagccugaccgccaucgcgaaccaggccgccauccucauggggcuggacaagggcuggccgaucuccaagauggacaucggcgugccccugcucgcccuggggugcuacagccaggucaacccccugacccucaccgcggccgugcugaugcugguggcccacuacgccaucaucggccccgggcuccaggccaaggcgacgcgggaggcccagaagcgcaccgccgccggcaucaugaagaacccgaccaucgacgggaucgucgccaucgaccuggaccccgugguguacgacgcgaaguucgagaagcagcugggccagaucaugcuccugauccugugcaccucccagauccuccugaugcgcacgaccugggcccugugcgagagcaucacccucgccaccggcccccugacgacccugugggaggggucccccggcaaguucuggaacaccaccaucgccgucagcauggccaacaucuuccggggguccuaccucgcgggcgccggccuggccuucagccugaugaagucccucgggggcgggcgccggggcacgggggcccagggcgagacccugggcgagaaguggaagcgccagcugaaccagcucuccaagagcgaguucaacaccuacaagcgguccgggaucauggagguggaccgcagcgaggcgaaggagggccugaagcgcggggagaccacgaagcacgccgugucccgcggcaccgccaagcugcggugguucgucgagcgcaaccucgugaagccggaggggaaggugaucgaccugggcugcggccgcggcggguggagcuacuacugcgccgggcugaagaaggucaccgaggugaagggguacaccaagggcggccccggccacgaggagcccauccccauggccacguacggguggaaccuggugaagcuccacuccggcaaggacgucuucuucaucccgcccgagaagugcgacacccugcugugcgacaucggggagagcucccccaaccccaccaucgaggagggccgcacccuccgggugcugaagaugguggagccguggcugcgcgggaaccaguucugcaucaagauccucaaccccuacaugcccagcgucguggagacgcuggagcagaugcagcggaagcacggcggcaugcuggugcgcaacccccucucccggaacagcacccacgagauguacugggucuccugcgggaccggcaacaucgugagcgcggugaacaugaccucccgcaugcugcugaaccgguucaccauggcccaccgcaagccgacguacgagcgcgacgucgaccucggggccggcacccggcacguggccguggagcccgaggucaccaaccuggacaucaucggccagcgcaucgagaacaucaaguacgagcacaagagcaccuggcacuacgacgaggacaaccccuacaagacgugggccuaccacggguccuacgaggugaagcccagcggcuccgcgagcagcauggucaacgggguggugaagcugcucaccaagccgugggacgucauccccauggugacccagaucgccaugaccgacacgacccccuucggccagcagcggguguucaaggagaaggucgacacccgcacccccaaggccaagcgggggacggcccagaucauggaggugaccgcccgcuggcugugguccuuccugagccggaacaagaagccgcgcaucugcacccgggaggaguucacccgcaaggugcgguccaacgcggccaucggcgccgucuucguggacgagaaccaguggaacagcgccaaggaggcgguggaggacgaccgcuucugggaccucguccaccgggagcgcgagcugcacaagcagggcaagugcgccacgugcguguacaacaugauggggaagcgggagaagaagcugggcgaguucgggaaggccaagggcucccgcgccaucugguacauguggcucggggcccgguuccuggaguucgaggcgcugggcuucaugaacgaggaccacugguucagccgcgagaacucccucagcggcguggagggggagggccugcacaagcugggguacauccuccgggacaucuccaagauccccggcgggaacauguacgccgacgacaccgccggcugggacacccgcaucaccgaggacgaccugcagaacgaggccaagaucacggacaucauggagcccgagcacgcccugcucgccaagagcaucuucaagcugaccuaccagaacaaggucgugcgggugcagcgcccggccaagaacggcaccgucauggacgugaucucccgccgggaccagcgcgggagcggccagguggggaccuacggccugaacacguucaccaacauggaggcccagcucauccggcagauggaguccgagggcaucuucagccccaacgagcuggagacccccaaccuggccgagcgcguccucgacuggcuggagaaguacgggguggagcggcugaagcgcauggccaucuccggcgacgacugcguggucaagcccaucgacgaccgguucgcgaccgcccucacggcccugaacgacauggggaaggugcgcaaggacaucccgcagugggagcccagcaagggcuggaacgacuggcagcagguccccuucugcucccaccacuuccaccagcugaucaugaaggacgggcgggagaucgucgugcccugccgcaaccaggacgagcucgugggccgggcccgcgucagccagggcgccggguggagccugcgggagaccgcgugccugggcaaguccuacgcccagauguggcagcucauguacuuccaccgccgggaccugcgccuggccgccaacgcgaucugcagcgccgugccgguggacuggguccccaccucccggaccacguggagcauccacgcccaccaccaguggaugaccaccgaggacaugcucuccguguggaaccgcguguggaucgaggagaaccccuggauggaggacaagacccggaucagcuccugggaggacguccccuaccuggggaagcgcgaggaccaguggugcggcagccugaucgggcucacggcccgcgccaccugggcgaccaacauccagguggccaucaaccaggugcggcgccugaucggcaacgagaacuacuccgacuacaugaccagcaugaagcgguucaagaacgaguccgagccggagggcgcccugugguga

SEQ ID NO: 8978 - RNA, 9879 nt, Artificial Sequence
  derived and/or modified CDS sequence (opt1) from DENV-1__FJ176780__SS-prME
agcgugaccaugcugcucaugcugaugcccaccgcccuggccuuccaccucaccacccggggcggggagccccacaugaucgugagcaagcaggagcggggcaagagccugcuguucaagaccagcgccggggugaacaugugcacccucaucgccauggaccugggcgagcugugcgaggacacgaugaccuacaagugcccccggaucaccgaggccgagcccgacgacguggacugcuggugcaacgccaccgacaccugggugaccuacgggaccugcagccagaccggcgagcaccggcgggacaagcgguccguggcccucgcgccccacgugggccuggggcuggagacgcgcaccgagaccuggaugagcuccgagggcgccuggaagcagauccagcgggucgagaccugggcccuccggcaccccggguucacggugaucgcccuguuccuggcgcacgccaucggcaccagcaucacccagaaggggaucaucuucauccuccugaugcuggugacccccuccauggccaugcggugcgucggcaucggcagccgcgacuucguggaggggcucuccggcgccacguggguggacgucgugcuggagcacgggagcugcgugaccaccauggccaaggacaagcccacccuggacaucgagcuccugaagacggaggucaccaaccccgcggugcugcggaagcucugcaucgaggccaagaucuccaacaccaccacggacagccgcugcccgacccagggcgaggccacccugguggaggagcaggacgccaacuucgucugccggcgcaccuucguggaccggggcugggggaacggcugcgggcuguucggcaaggggucccucaucacgugcgccaaguucaagugcgugaccaagcuggagggcaagaucguccaguacgagaaccugaaguacagcgugaucgugaccguccacaccggcgaccagcaccagguggggaacgaguccacggagcacggcaccaccgcgaccaucacgccccaggcccccacgaccgagauccagcucaccgacuacggggcccugacccuggacugcagcccccgcacgggccucgacuucaacgagaugguccugcugaccaugaaggagaaguccuggcucgugcacaagcagugguuccuggaccugccccuccccuggaccagcggggccagcaccucccaggagacguggaaccggcaggaccugcuggugaccuucaagaccgcccacgcgaagaagcaggaggucguggugcucggcagccaggagggcgccaugcacaccgcccugacgggggccaccgagauccagaccuccggcaccacgaccaucuucgccgggcaccugaagugccgccucaagauggacaagcugacccugaagggcaugagcuacgucaugugcaccggguccuucaagcucgagaaggagguggcggagacgcagcacggcaccgugcugguccagaucaaguacgagggcaccgacgcccccugcaagauccccuucagcacccaggacgagaagggggugacgcagaacggccggcugaucaccgccaacccgaucgugaccgacaaggagaagcccgucaacaucgaggccgagccgcccuucggggaguccuacaucgugaucggcgcgggcgagaaggcccugaagcucagcugguucaagaagggguccagcaucggcaagauguucgaggccaccgcccgcggggcccggcgcauggcgauccugggcgacacggccugggacuucggguccaucggcggcguguucaccagcgucgggaagcuggugcaccagaucuucggcaccgccuacggggugcuguucuccggcgucagcuggaccaugaagaucgggaucggcgugcugcugacguggcucggccugaacucccgcagcaccucccugagcaugaccugcaucgccguggggcucgucacccuguaccugggcgugauggugcaggccgacuccgggugcgucaucaacuggaagggccgggagcucaagugcgggagcggcaucuucgugacgaacgaggugcacaccuggaccgagcaguacaaguuccaggcggacagcccgaagcgccuguccgccgccaucggcaaggccugggaggagggggucugcggcauccggagcgccacccgccuggagaacaucauguggaagcagaucuccaacgagcucaaccacauccugcuggagaacgacaugaaguucaccgugguggucggggacguggcgggcauccucgcccaggggaagaagaugauccggccccagcccauggaguacaaguacagcuggaaguccuggggcaaggccaagaucaucggcgccgacgugcagaacacgaccuucaucaucgacgggcccaacaccccggagugccccgacgaccagcgcgcguggaacaucugggaggucgaggacuacggcuucgggaucuucaccacgaacaucuggcugaagcugcgggacagcuacacccaggugugcgaccaccgccucauguccgccgccaucaaggacagcaaggccgugcacgccgacaugggcuacuggaucgaguccgagaagaacgagaccuggaagcuggcgcgggccagcuucaucgaggucaagaccugcaucuggcccaagucccacacgcuguggagcaacggcgugcucgaguccgagaugaucauccccaagaucuacgggggcccgaucagccagcacaacuaccgccccggguacuucacccagaccgccggccccuggcaccuggggaagcuggagcucgacuucgaccugugcgagggcaccacgguggucguggacgagcacugcggcaaccgggggccgucccugcgcaccaccaccgugacgggcaagaucauccacgaguggugcugccggagcugcacccugccgccccuccgcuuccgcggggaggacggcugcugguacgggauggagauccgccccgucaaggagaaggaggagaaccuggugaaguccauggugagcgccggcagcggcgaggucgacuccuucagccucgggcugcugugcaucuccaucaugaucgaggaggugaugcggagccgcuggucccggaagaugcucaugaccggcacccuggccguguucuuccugcucaucauggggcagcugacguggaacgaccugauccgccucugcaucauggucggcgcgaacgccagcgaccgcauggggaugggcaccaccuaccuggcccugauggccaccuucaagaugcggccgauguucgccgugggccuccuguuccgccggcugacgucccgcgaggugcuccugcugaccaucgggcucagccuggucgcguccguggagcugcccaccagccucgaggagcugggcgacgggcuggccaugggcaucaugauccucaagcugcugaccgacuuccagucccaccagcucugggccacgcugcugagccucaccuucgucaagaccaccuucucccugcacuacgccuggaagacgauggcgauggugcugagcaucgugucccucuucccccugugccugagcaccaccucccagaagaccacguggcuccccguccugcugggcagccucgggugcaagccgcugaccauguuccugaucgccgagaacaagaucuggggccggcgcuccuggccccucaacgaggggaucauggccgugggcaucgugagcauccugcugagcucccuccugaagaacgacgucccccuggccgggccccucaucgccggcggcaugcugaucgcgugcuacgugaucagcggguccagcgccgaccugucccucgagaaggccgccgaggugagcugggaggaggaggccgagcacuccggcgcgagccacaacauccuggucgaggugcaggacgacgggaccaugaagaucaaggacgaggagcgggacgacacccugaccauccuccugaaggccacgcugcucgccguguccggcgucuacccgcugagcauccccgccacccuguucgugugguacuucuggcagaagaagaagcagcgcuccggggugcucugggacacccccagcccgcccgaggucgagcgggccgugcuggacgacggcaucuaccgcaucaugcagcggggccugcuggggcgcucccaggugggcgucgggguguuccaggagaacguguuccacaccauguggcacgucacgcggggcgcggugcucauguaccaggggaagcgccuggagcccagcugggccuccgugaagaaggaccugaucagcuacggcggcggguggcggcuccagggcuccuggaacaccggggaggagguccaggugaucgccguggagcccggcaagaaccccaagaacguccagaccgcccccgggaccuucaagacgcccgagggcgaggugggcgccaucgcgcuggacuucaagcccgggaccagcggcucccccaucgugaaccgcgaggggaagaucgucggccuguacggcaacgggguggugaccaccagcggcacguacgucagcgccaucgcccaggccaaggcgucccaggaggggccgcuccccgagaucgaggacgagguguuccggaagcgcaaccugaccaucauggaccugcaccccggcagcgggaagacccggcgcuaccucccggccaucgugcgggaggccaucaagcgcaagcugcgcacccugauccucgcccccacgcgggucguggccuccgagauggcggaggcccugaagggcaugcccauccgcuaccagaccaccgccgucaagagcgagcacaccggcaaggagaucgucgaccugaugugccacgccacguucaccaugcggcuccugucccccgugcgcgugccgaacuacaacaugaucaucauggacgaggcccacuucaccgaccccagcuccaucgcggcccggggguacaucagcacccgcgucggcaugggggaggccgccgccaucuucaugacggcgacgccgcccggcuccguggaggccuucccgcagagcaacgccgugauccaggacgaggagcgggacauccccgagcgcuccuggaacagcggguacgaguggaucaccgacuuccccggcaagaccgucugguucgugcccuccaucaagagcggcaacgacaucgccaacugccugcggaagaacgggaagcgcgugauccagcucucccggaagacguucgacaccgaguaccagaagaccaagaacaacgacugggacuacgucgugaccacggacaucagcgagaugggcgcgaacuuccgcgccgaccgggugaucgacccgcgccggugccugaagcccgucauccugaaggacgggcccgagcgcgugauccucgccggccccaugccggucaccguggccuccgccgcgcagcggcgcgggcggaucggccgcaaccacaacaaggagggcgaccaguacaucuacauggggcagccccugaacaacgacgaggaccacgcccacuggaccgaggccaagaugcugcucgacaacaucaacacccccgagggcaucauccccgcccuguucgagccggagcgcgagaaguccgccgcgaucgacggggaguaccggcugcgcggcgaggcccggaagacguucguggagcucaugcgccgcggggaccugcccgucuggcuguccuacaagguggccagcgagggcuaccaguacagcgaccgccgguggugcuucgacggcgagcgcaacaaccaggugcucgaggagaacauggacgucgagaucuggaccaaggagggggagcggaagaagcugcgcccccgguggcuggacgcccgcaccuacuccgacccccucgcccugcgggaguucaaggaguucgcggccggccgccggagcguguccggggaccugauccucgagaucggcaagcugccgcagcaccugacccagcgcgcccagaacgcccucgacaaccuggugaugcugcacaacagcgagcagggcgggcgggcguaccgccacgccauggaggagcuccccgacacgaucgagacccugaugcugcucgcccugaucgccguccugaccggcggggugacccucuucuuccuguccggccgggggcugggcaagaccagcaucggccuccugugcgugauggccuccagcguccugcucuggauggcguccguggagccccacuggaucgccgccagcaucauccuggaguucuuccugauggugcuccugauccccgagccggaccgccagcggacgccccaggacaaccagcuggccuacgucgugaucgggcuccuguucaugauccugaccguggccgcgaacgagaugggccuccuggagaccaccaagaaggaccuggggaucggccacgucgccguggagaaccaccaccacgccgccaugcucgacguggaccugcaccccgccuccgcguggacgcuguacgccgucgccaccaccaucaucaccccgaugaugcgccacacgaucgagaacaccaccgccaacaucagccucaccgccaucgcgaaccaggccgccauccugauggggcuggacaagggcuggcccaucuccaagauggacaucggcgugccccuccuggcccuggggugcuacagccaggugaacccccucacgcugaccgcggccguccugaugcucguggcccacuacgccaucaucggcccggggcugcaggccaaggcgacccgcgaggcccagaagcggaccgccgccggcaucaugaagaaccccacgguggacgggaucgucgccaucgaccuggaccccgugguguacgacgcgaaguucgagaagcagcucggccagaucaugcugcugauccucugcaccucccagauccugcugaugcgcaccaccugggcccucugcgagagcaucacgcuggccaccggcccccugaccacccucugggagggguccccgggcaaguucuggaacacgaccaucgccgucagcauggccaacaucuuccggggguccuaccuggcgggcgccggccuggccuucagccucaugaagucccucgggggcgggcgccgggggaccggggcccagggcgagacccugggcgagaaguggaagcgccagcucaaccagcuguccaagagcgaguucaacacguacaagcgguccgggaucauggagguggaccgcagcgaggcgaaggagggccugaagcgcggggagaccaccaagcacgccgugucccgcggcaccgccaagcuccggugguucgucgagcgcaaccuggugaagcccgaggggaaggugaucgaccugggcugcggccgcgggggcuggagcuacuacugcgccgggcugaagaaggucacggaggugaagggcuacaccaagggcggccccggccacgaggagcccaucccgauggccaccuacggguggaaccucgugaagcugcacuccggcaaggacgucuucuucaucccgcccgagaagugcgacacccugcucugcgacaucggggagagcucccccaacccgacgaucgaggagggccgcacccugcgggugcugaagaugguggagcccuggcuccgcgggaaccaguucugcaucaagauccugaaccccuacaugcccagcgucguggagacccuggagcagaugcagcggaagcacggcggcaugcucgugcgcaacccgcugucccggaacagcacccacgagauguacugggucuccugcgggaccggcaacaucgugagcgcggugaacaugacgucccgcaugcugcucaaccgcuucaccauggcccaccggaagcccaccuacgagcgcgacgucgaccugggggccggcacccggcacguggccguggagcccgaggucacgaaccuggacaucaucggccagcgcaucgagaacaucaagcacgagcacaagagcaccuggcacuacgacgaggacaaccccuacaagaccugggccuaccacggguccuacgaggugaagccgagcggcuccgcgagcagcauggucaacgggguggugaagcuccugaccaagcccugggacgucauccccauggugacgcagaucgccaugaccgacaccacccccuucggccagcagcggguguucaaggagaaggucgacacgcgcaccccgaaggccaagcgggggaccgcccagaucauggaggugaccgccaaguggcuguggggcuuccucucccgcaacaagaagccccggaucugcacgcgcgaggaguucacccggaaggugcgcagcaacgcggccaucggcgccgucuucguggacgagaaccaguggaacuccgccaaggaggcgguggaggacgagcgguucugggaccugguccaccgcgagcgggagcugcacaagcaggggaagugcgcgaccugcguguacaacaugaugggcaagcgcgagaagaagcucggggaguucggcaaggccaaggggagccgggccaucugguacauguggcugggcgcccgcuuccuggaguucgaggcgcucggcuucaugaacgaggaccacugguucucccgggagaacagccuguccgggguggagggcgaggggcugcacaagcucggcuacauccugcgcgacaucagcaagauccccgggggcaacauguacgccgacgacaccgccggcugggacacgcggaucaccgaggacgaccugcagaacgaggcccgcaucaccgacaucauggagccggagcacgcccuccuggcgaaguccaucuucaagcugaccuaccagaacaaggucgugcgcgugcagcggcccgccaagaacgggacggucauggacgugaucagccgccgggaccagcgcggcuccggccagguggggaccuacggccucaacaccuucaccaacauggaggcccagcugauccggcagauggagagcgaggggaucuucucccccagcgagcuggagacgcccaaccucgccgagcgcguccuggacuggcuggagaaguacggcguggagcggcucaagcgcauggccaucuccggggacgacugcguggucaagccgaucgacgaccgguucgcgaccgcccugaccgcccugaacgacaugggcaaggugcgcaaggacaucccccagugggagcccagcaagggguggaacgacuggcagcagguccccuucugcucccaccacuuccaccagcucaucaugaaggacggccgggagaucgucgugccgugccgcaaccaggacgagcuggugggccgggcccgcgucagccagggggccggcuggagccugcgggagaccgcgugccucgggaaguccuacgcccagauguggcagcugauguacuuccaccgccgggaccugcgccucgccgccaacgcgaucugcagcgccgugcccguggacuggauccccacgucccggaccaccuggagcauccacgcccaccaccaguggaugaccacggaggacaugcuguccgucuggaaccgcguguggaucgaggagaaccccuggauggaggacaagacccacaucagcuccuggggcgacgugccguaccuggggaagcgcgaggaccaguggugcggcagccucaucggccugaccgcccgggccaccugggcgaccaacauccaggucgccaucuaccaggugcgccggcugaucgggaacgagaacuaccucgacuacaugacguccaugaagcgcuucaagaacgagagcgaccccgagggcgcccugugguga

SEQ ID NO: 8979 - RNA, 9879 nt, Artificial Sequence
  derived and/or modified CDS sequence (opt1) from DENV-1__JN205310__SS-prME
agcgugaccgugcuguucaugcuccugcccaccgcccuggccuuccaccucaccacccugggcggggagccccacaugaucgugagcaagcaggagcgcggcaagagccuccuguucaagaccuccgcgggggugaacaugugcacccugaucgccauggaccugggcgagcucugcgaggacaccaugaccuacaagugcccccggaucaccgagaccgagcccgacgacguggacugcuggugcaacgccaccgagaccugggugaccuacgggaccugcagccagaccggcgagcaccgccgggacaagcgcuccguggcccuggcgccccacgucggccuggggcucgagacccggaccgagaccuggaugagcuccgagggcgccuggaagcagauccagaagguggagacgugggcccugcgccaccccggguucaccgugaucgcccuguuccucgcccacgcgaucggcaccagcaucacccagaaggggaucaucuucauccugcugaugcucgugacgcccuccauggccaugcggugcgugggcaucggcaaccgcgacuucguggaggggcccagcggcgccaccugggucgacguggugcuggagcacggguccugcgucaccaccauggccaagaacaagcccacgcuggacaucgagcuccugaagaccgaggugaccaacccggccauccugcggaagcucugcaucgaggcgaagaucagcaacaccacgaccgacucccgcugccccacccagggcgaggccacccugguggaggagcaggacacgaacuucgucugccggcgcaccuucguggaccggggcugggggaacggcugcgggcuguucggcaaggggagccucaucacgugcgccaaguucaagugcgugaccaagcuggagggcaagaucguccaguacgagaaccugaaguacuccgugaucgugacgguccacaccggcgaccagcaccagguggggaacgagaccaccgagcacggcaccacggccaucaucacgccccaggcccccaccagcgagauccagcucaccgacuacggggcgcugacgccggacugcagcccccgcaccggccuggacuucaacgagaugguccuccugaccaugaaggagaaguccuggcuggugcacaagcagugguuccucgaccugccccugcccuggaccuccggggccagcacgagccaggagaccuggaaccggcaggaccuccuggugaccuucaagaccgcccacgccaagaagcaggaggucguggugcugggcucccaggagggcgccaugcacacggcgcucaccggggccaccgagauccagaccagcggcacgaccaccaucuucgccgggcaccugaagugccgccugaagauggacaagcucacccugaagggcgucuccuacgugaugugcacggggagcuucaagcuggagaaggagguggccgagacccagcacggcaccguccucguccaggugaaguacgagggcaccgacgccccgugcaagauccccuccagcucccaggacgagaagggggucauccagaacggccggcugaucacggcgaaccccaucgugaccgacaaggagaagcccgugaacaucgaggccgagccgcccuucggggagagcuacaucgucgugggcgccggcgagaaggcccugaagcuguccugguucaagaaggggagcuccaucggcaagauguucgaggcgaccgcccgcggggcccggcgcauggccauccucggcgacaccgccugggacuucgggagcaucggcggcguguucacguccgucgggaagcuggugcaccagaucuucggcaccgcguacggggugcuguucagcggcgucuccuggaccaugaagaucgggaucggcauccuccugaccuggcugggccucaacagccgguccacgagccuguccaugaccugcaucgccguggggauggugacccuguaccucggcgucauggugcaggccgacagcgggugcgugaucaacuggaagggccgcgagcugaagugcgggagcggcaucuucgucaccaacgaggugcacacguggaccgagcaguacaaguuccaggccgacucccccaagcgccugagcgccgcgaucggcaaggccugggaggagggggugugcggcauccgguccgccacccgccucgagaacaucauguggaagcagaucagcaacgagcugaaccacauccugcucgagaacgacaugaaguucaccgucguggugggggacgucuccggcauccuggcccaggggaagaagaugauccggccccagccgauggagcacaaguacagcuggaaguccuggggcaaggccaagaucaucggcgcggacgugcagaacaccacguucaucaucgacgggcccaacacccccgagugccccgacaaccagcgcgccuggaacaucugggagguggaggacuacggcuucgggaucuucaccaccaacaucuggcugaagcuccgggacagcuucacgcaggucugcgaccaccgccugauguccgccgccaucaaggacagcaaggcggugcacgccgacaugggcuacuggaucgaguccgagaagaaggagaccuggaagcuggcccgggccagcuucaucgaggugaagaccugcaucuggccgaagucccacacccucuggagcaacggcguccuggaguccgagaugaucauccccaagaucuacgggggccccgugagccagcacaacuaccgcccgggguacuucacgcagaccgccggccccuggcaccuggggaagcucgagcuggacuucgaccugugcgagggcaccaccguggucguggacgagaacugcggcaaccgggggcccucccuccgcacgaccaccgugaccggcaagacgacccacgagcggugcugccgcagcugcacccugcccccgcugcgguucaagcgcgaggacgggugcugguacggcauggagauccggcccgucaaggagaaggaggagaaccucgugaaguccaugguguccgcggggagcggcgaggucgacuccuucagccugggccugcucugcaucuccaucaugaucgaggaggugaugcgcagccgguggucccgcaagaugcugaugaccgggacgcuggccguguuccuccugcugaccaugggccagagcaccuggaacgaccucauccggcugugcaccauggucggggccaacgccuccgacaugaugggcauggggacgaccuaccuggcccucauggcgaccuuccgcaugcgccccauguucgccgugggccugcuguuccggcgccucaccagccgggagauccugcugcucacggucggccugucccugguggccagcguggagcuccccaacucccuggaggagcugggggacggccucgccauggggaucaugaugcugaagcugcucaccgacuuccagccgcaccagcugugggccacccugcucagccugaccuucgucaagacgacccugucccuccacuacgcguggaagaccauggccaugauccugagcaucgugucccugcucccccugugccugagcaccacgucccagaagaccaccuggcuccccgugcugcugggcagccucggcugcaagccccugaccauguuccugaucaccgagaacaagaucugggggcgccggagcuggccgcucaacgagggcaucauggccaucgggaucgucuccauccugcugagcagcccccugaagaacgacgugccccuggccggcccccugaucgccggcgggaugcucaucgccugcuacgugaucagcggguccagcgccgaccugucccuggagaaggccgccgaggucagcugggaggacgaggcggagcacuccggggccagccacaacauccucguggaggugcaggacgacggcacgaugaagaucaaggacgaggagcgcgacgacacccugaccauccugcucaaggccacccugcuggucaucuccgggguguacccgaugagcauccccgccacccucuucgugugguacuucuggcagaagaagaagcagcgguccggcguccugugggacacccccuccccgcccgagguggagcgcgccgugcuggacaacgggaucuaccggauccuccagcgcggccugcugggccggucccaggucggggugggcguguuccaggagggggucuuccacaccauguggcacgugacccgcggcgcggugcugauguaccaggggaagcggcucgagcccagcugggccuccgucaagaaggaccugaucagcuacggcggcggguggcgcuuccagggcuccuggaacacgggggaggagguccaggugaucgccgucgagcccggcaagaaccccaagaacgugcagaccacccccgggaccuucaagacgcccgagggcgaggugggcgccaucgcccuggacuucaagcccgggaccagcggcagcaccaucgucaaccgggaggggaagaucgugggccucuacggcaacgggguggucaccacguccggcaccuacgugagcgcgaucgcccaggccaaggccucccaggaggggccgcugcccgagaucgaggacgagguguuccgcaagcggaaccugaccaucauggaccuccaccccggcagcgggaagacccgccgguaccugcccgccaucguccgcgaggcgaucaagcggaagcugcgcacgcucgugcuggccccgacccgcguggucgccuccgagauggccgaggcgcugaagggcaugcccauccgguaccagaccaccgccgucaagagcgagcacacgggcaaggagaucguggaccucaugugccacgccaccuucaccaugcgccugcugucccccguccgggugcccaacuacaacaugaucaucauggacgaggcccacuucaccgacccggccagcaucgcggcccgcggguacaucuccacgcgggugggcaugggggaggccgccgccaucuucaugaccgcgacgccgcccggcagcgucgaggccuucccccaguccaacgccgugauccaggacgaggagcgcgacaucccggagcggagcuggaacuccggguacgaguggaucaccgacuuccccggcaagacggugugguucguccccagcaucaaguccggcaacgacaucgccaacugccuccgcaagaacgggaagcggguggugcagcugagccgcaagaccuucgacaccgaguaccagaagaccaagaacaacgacugggacuacgucgugacgaccgacaucuccgagaugggcgccaacuuccgggcggaccgcgucaucgacccccggcgcugccugaagccggugauccucaaggacgggcccgagcgggugauccuggccggccccaugcccgucaccguggccagcgccgcgcagcgccgggggcgcaucggccggaacccgaacaaggagggcgaccaguacguguacauggggcagccccugaacaacgacgaggaccacgcccacuggaccgaggccaagaugcuccuggacaacaucaacacgcccgagggcaucauccccgcccuguucgagccggagcgcgagaaguccgccgcgaucgacggggaguaccgccuccggggcgaggcccgcaagaccuucgucgagcugaugcggcgcggggaccugcccguguggcucagcuacaagguggccagcgagggcuuccaguacuccgaccggcgcuggugcuucgacggcgagcggaacaaccagguccuggaggagaacauggacguggagaucuggaccaaggagggggagcgcaagaagcugcggccccgcuggcucgacgcccggaccuacagcgacccccuggcccugcgcgaguucaaggaguucgcggccggccggcgcuccgugagcggggaccucauccuggagaucggcaagcugccgcagcaccucacccugaaggcccagaacgcccuggacaaccucgucaugcugcacaacuccgagcagggcgggaaggccuaccggcacgcgauggaggagcugcccgacacgaucgagacccucaugcugcuggcccucaucgccgugcugaccggcggggugacccuguucuuccucagcggccgcgggcugggcaagacguccaucggccugcucugcgucauggccagcuccgugcugcuguggauggcgagcguggagccccacuggaucgccgccuccaucauccucgaguucuuccugaugguccugcucaucccggagcccgaccggcagcgcacgccccaggacaaccagcuggccuacguggugaucgggcuccucuucaugauccugaccgucgccgcgaacgagaugggccugcucgagaccacgaagaaggaccuggggaucggccacgccgccgccgagaaccaccaccacgccgcgaugcuggacguggaccuccaccccgccagcgccuggacccuguacgccguggccaccaccaucaucacgccgaugaugcggcacaccaucgagaacaccaccgcgaacaucucccugacggccaucgccaaccacgccgccauccucauggggcuggacaagggcuggcccaucagcaagauggacaucggcgucccccugcucgcgcuggggugcuacucccaggugaacccccugacccucaccgccgccgugcugaugcuggucgcccacuacgcgaucaucggcccggggcuccaggccaaggccacccgcgaggcccagaagcggacggccgcgggcaucaugaagaaccccaccguggacgggaucguggccaucgaccuggaccccgucguguacgacgccaagaucgagaagcagcugggccagaucaugcuccugauccugugcaccagccagauccuccugaugcgcaccacgugggcccugugcgaguccaucacccucgccaccggcccccugaccacgcugugggaggggagcccgggcaaguucuggaacaccaccaucgcgguguccauggccaacaucuuccgcgggagcuaccucgccggcgccggccuggccuucagccugaugaagucccucgggggcgggcggcgcggcaccggggcgcagggcgagacgcugggcgagaaguggaagcggcagcugaaccagcucagcaaguccgaguucaacaucuacaagcgcagcgggaucaucgaggucgaccgguccgaggccaaggagggccugaagcgcggggagaccaccaagcacgccgugagccggggcaccgccaagcugcgcugguucguggagcggaaccucgucaagcccgaggggaaggugaucgaccugggcugcggccgcgggggcugguccuacuacugcgcggggcugaagaaggugacggaggucaagggcuacaccaagggcgggcccggccacgaggagcccaucccgauggccaccuacggguggaaccuggugaagcuccacagcggcaaggacguguucuucacgccgcccgagaagugcgacacccugcugugcgacaucggggaguccagccccaacccgacgaucgaggagggccggacccuccgcguccugaagaugguggagcccuggcugcgggggaaccaguucugcaucaagauccucaaccccuacaugcccuccguggucgagacccuggagcagaugcagcgcaagcacggcggcaugcuggugcggaacccgcucagccgcaacuccacccacgagauguacugggugagcugcgggacgggcaacaucgucuccgccgugaacaugaccagccggaugcugcugaaccgcuucaccauggcccaccggaagcccaccuacgagcgcgacguggaccucggggccggcacgcgccacgucgcgguggagcccgaggucgccaaccuggacaucaucggccagcggaucgagaacaucaagaacgagcacaaguccaccuggcacuacgacgaggacaaccccuacaagaccugggccuaccacgggagcuacgaggugaagccguccggcagcgccagcuccauggugaacggggucgugcgccugcucaccaagcccugggacgugauccccauggucacgcagaucgccaugaccgacaccaccccguucggccagcagcggguguucaaggagaagguggacacgcgcacccccaaggcgaagcgggggaccgcccagaucauggaggucaccgcccgcuggcuguggggcuuccugagccggaacaagaagccccgcaucugcacgcgggaggaguucacccgcaaggugcgguccaacgccgccaucggcgcgguguucgucgacgagaaccaguggaacagcgccaaggaggccguggaggacgagcgcuucugggaccucgugcaccgggagcgcgagcugcacaagcaggggaagugcgcgaccugcgucuacaacaugaugggccggcgcgagaagaagcugggggaguucggcaaggcgaaggggucccgggccaucugguacauguggcucggcgcccgcuuccuggaguucgaggcccugggcuucaugaacgaggaccacugguucagccgggagaacucccucagcgggguggagggcgaggggcaccacaagcugggcuacauccugcgcgacaucuccaagauccccgggggcaacauguacgccgacgacaccgcgggcugggacacgcggaucaccgaggacgaccuccagaacgaggccaagaucaccgacaucauggagccggagcacgcccugcuggccaccagcaucuucaagcucacguaccagaacaaggugguccgcgugcagcgccccgccaagaacgggaccgugauggacgucaucucccggcgcgaccagcggggcagcggccaggugggcaccuacggccugaacaccuucacgaacauggaggcgcagcugauccgccagauggaguccgaggggaucuucagccccuccgagcucgagacccccaaccuggccgagcggguguucgacuggcuggagaagcacggcaucgagcgccucaagcggauggccaucagcggggacgacugcgucgugaagccgaucgacgaccgcuucgccaccgcccugaccgcgcugaacgacaugggcaaggugcggaaggacaucccccagugggagccgcccaagggguggaacgacuggcagcaggucccguucugcucccaccacuuccaccagcucaucaugaaggacggccgcgagaucguggugcccugccggaaccaggacgagcuggucggccgcgcccgggugagccagggggccggcuggagccugcgcgagacggccugccucgggaaguccuacgcccagauguggcagcugauguacuuccaccggcgcgaccugcggcucgcggccaacgccaucugcagcgccgugcccgucgacugggugcccaccucccgcaccaccuggagcauccacgcgcaccaccaguggaugaccacggaggacaugcuguccguguggaaccgggucuggaucgaggagaacccguggauggaggacaagacccacgugagcuccugggaggacgugcccuaccugggcaagcgcgaggaccaguggugcgggagccucaucggccugaccgcccgcgccaccugggccacgaacauccaggucgccaucaaccaggugcggcgccugaucggcaacgagaacuaccucgacuacaugaccuccaugaagcgguucaagaacgagagcgaccccgagggggcgcugugguga

SEQ ID NO: 8980 - RNA, 9879 nt, Artificial Sequence
  derived and/or modified CDS sequence (opt1) from DENV-1__HQ332182__SS-prME
agcgugaccaugcugcucaugcugcugcccaccgcccucgccuuccaccugaccacccgcggcggggagccccacaugaucgugagcaagcaggagcggggcaagagccuccuguucaagaccagcgccggggugaacaugugcacccugaucgccauggaccugggcgagcucugcgaggacaccaugaccuacaagugcccccgcaucaccgaggccgagcccgacgacguggacugcuggugcaacgccaccgacaccugggugaccuacgggaccugcagccagaccggcgagcaccggcgcgacaagcgguccguggcccuggcgccccacgugggccuggggcucgagacgcgcaccgagaccuggaugagcuccgagggcgccuggaagcagauccagcgggucgagaccugggcccugcgccaccccggguucacggugaucgcccuguuccucgcgcacgccaucggcaccagcaucacccagaaggggaucaucuucauccugcugaugcucgugacccccuccauggccaugcggugcgucggcaucggcaaccgcgacuucguggaggggcugagcggcgccacguggguggacgucgugcuggagcacggguccugcgugaccaccauggccaagaacaagcccacccucgacaucgagcugcugaagacggaggucaccaaccccgcggugcuccggaagcugugcaucgaggccaagaucagcaacaccaccacggacucccgcugcccgacccagggcgaggccacccugguggaggagcaggacgccaacuucgucugccggcgcaccuucguggaccggggcugggggaacggcugcggccucuucggcaaggggagccugcugacgugcgccaaguucaagugcgugaccaagcucgagggcaagaucguccaguacgagaaccugaaguacuccgugaucgugaccguccacaccggcgaccagcaccagguggggaacgagacgaccgagcacggcaccaucgcgaccaucacgccccaggcccccacgagcgagauccagcugaccgacuacggggcccucacccuggacugcagcccccggaccggccuggacuucaacgagaugguccuccugacgaugaaggagaaguccuggcuggugcacaagcagugguuccucgaccugccgcugcccuggaccuccggggccagcaccagccaggagaccuggaaccggcaggaccuccuggugacguucaagaccgcccacgcgaagaagcaggaggucguggugcugggcucccaggagggcgccaugcacaccgcccucaccggggccacggagauccagaccagcggcaccaccacgaucuucgccgggcaccugaagugccgccugaagauggacaagcucacccugaagggcaccuccuacgucaugugcaccgggagcuucaagcuggagaaggagguggcggagacgcagcacggcaccgugcugguccaggugaaguacgagggcaccgacgcccccugcaagauccccuucuccacccaggacgagaagggggugacgcagaacggccggcucaucaccgccaacccgaucgucaccgacaaggagaagcccgugaacaucgagaccgagccgcccuucggggagagcuacaucguggucggcgccggcgagaaggcgcugaagcuguccugguucaagaaggggagcuccaucggcaagauguucgaggccacggcccgcggggcccggcgcauggccauccucggcgacaccgcgugggacuucgggagcaucggcggcguguucaccuccguggggaagcugguccaccagguguucggcaccgccuacggggugcuguucagcggcgucuccuggacgaugaagaucgggaucggcauccuccugaccuggcugggccucaacagccgcuccaccagccuguccaugaccugcaucgccguggggauggugacgcuguaccucggcgucauggugcaggccgacagcgggugcgugaucaacuggaagggccgggagcugaagugcggguccggcaucuucgucaccaacgaggugcacaccuggaccgagcaguacaaguuccaggccgacagcccgaagcgccugagcgcggccaucggcaaggccugggaggagggggugugcggcauccgguccgccacccgccucgagaacaucauguggaagcagaucagcaacgagcugaaccacauccugcucgagaacgacaugaaguucacggucguggugggggacgccaacggcauccuggcgcaggggaagaagaugauccggccccagcccauggagcacaaguacuccuggaaguccuggggcaaggccaagaucaucggcgccgacauccagaacaccaccuucaucaucgacgggcccgacaccccggagugccccgacgaccagcgcgccuggaacaucugggaggucgaggacuacggcuucgggaucuucacgaccaacaucuggcugaagcuccgggacuccuacacccagaugugcgaccaccgccugaugagcgcggccaucaaggacuccaaggccgugcacgccgacaugggcuacuggaucgagagcgagaagaacgagaccuggaagcuggcccgggcguccuucaucgaggugaagacgugcaccuggcccaagagccacacccucugguccaacggcguccuggagagcgagaugaucauccccaagaucuacgggggcccgaucucccagcacaacuaccgccccggguacuucacccagacggccggccccuggcaccuggggaagcucgagcuggacuucgaccugugcgagggcaccaccgugguggucgacgagcacugcggcaaccgggggccgagccuccgcaccacgaccgugaccggcaagaucauccacgaguggugcugccgguccugcacccugccgccccugcgcuuccgcggggaggacggcugcugguacgggauggagauccgccccgugaaggagaaggaggagaaccucguccggagcaugguguccgccggcagcggcgagguggacagcuucucccuggggauccugugcgucagcaucaugaucgaggaggugaugcgcucccgguggagccgcaagaugcucaugacgggcacccuggccguguuccugcuccugaucauggggcagcugaccuggaacgaccucauccgccugugcaucauggucggcgccaacgcguccgaccggauggggaugggcaccacguaccuggcccucauggccaccuucaagaugcgcccgauguucgccguggggcugcuguuccggcgccucaccagccgggaggugcugcugcucaccaucgggcugucccuggucgccagcguggagcuccccaacucccuggaggagcugggcgacgggcucgcgaugggcaucaugaugcugaagcugcucacggaguuccagccccaccagcuguggaccacccugcucagccugaccuucaucaagacgacccugucccucgacuacgccuggaagaccaccgccauggcccugagcaucgucucccuguucccccucugccugagcacgaccucccagaagaccaccuggcugccggugcuccugggcagcuucgggugcaagccccugaccauguuccucaucacggagaacaagaucuggggccgcaaguccuggcccaucaacgaggggaucauggcgaucggcaucgugagcauccugcuguccagccuccugaagaacgacgucccccuggccgggccgcucaucgccggcggcaugcugaucgccugcuacgugaucagcggguccagcgccgaccugucccucgagaaggcggccgaggugagcugggagcaggaggccgagcacuccggcaccagccacaacauccuggucgaggugcaggacgacgggaccaugcggaucaaggacgaggagaaggacgacacccugacgauccuccugaaggccacccugcucgccguguccggcgucuaccccaugagcauccccgcgacccuguucgugugguacuucuggcagaagaagaagcagcgcuccggggugcugugggacacccccagcccgcccgaggucgagcgggccgugcucgacgacggcaucuaccgcauccugcagcggggccugcuggggcgcucccaggugggcgucgggguguuccaggacggcguguuccacacgauguggcacgucacccgcggggcggugcucauguaccagggcaagcgccuggagcccagcugggccuccgugaagaaggaccugaucagcuacggcgggggcuggcgguuccagggguccuggaacaccggcgaggagguccaggugaucgccguggagcccgggaagaacccgaagaacguccagaccacgcccggcaccuucaagacccccgagggcgaggugggggcgaucgcccucgacuucaagcccggcaccagcggguccccgaucgugaaccgcgagggcaagaucgucggccuguacgggaacggcguggugacgaccagcgggaccuacgucuccgccaucgcccaggccaaggcgagccaggagggcccccugcccgagaucgaggacgagguguucaagaagcggaaccucaccaucauggaccugcacccggggagcggcaagacgcgccgguaccugcccgccaucgugcgcgaggccaucaagcggaagcuccgcacccugauccuggcccccacccgcgucguggcguccgagauggccgaggcccucaagggcaugcccauccgguaccagaccacggccgucaagagcgagcacaccgggcgcgagaucgucgaccugaugugccacgccaccuucaccaugcggcugcucuccccggugcgcgugcccaacuacaacaugaucaucauggacgaggcgcacuucacggaccccgccagcaucgccgcccggggcuacaucuccacccgcgucgggaugggcgaggccgcggccaucuucaugaccgccacgccgcccgggagcguggaggccuucccccaguccaacgccgugauccaggacgaggagcgggacauccccgagcgcagcuggaacuccggcuacgacuggaucacggacuuccccggcaagaccgucugguucgugcccagcaucaaguccgggaacgacaucgcgaacugccugcggaagaacggcaagcgcgugauccagcugagccggaagaccuucgacaccgaguaccagaagacgaagaacaacgacugggacuacgucgugaccaccgacaucuccgagaugggggccaacuuccgcgccgaccgggugaucgacccccgccggugccucaagcccgucauccugaaggacggccccgagcgcgugauccuggccgggccgaugcccgugaccgucgcgagcgccgcccagcggcgcggccggaucggccgcaaccagaacaaggagggggaccaguacguguacaugggccagccccucaacaacgacgaggaccacgcccacuggacggaggccaagaugcugcuggacaacaucaacacccccgaggggaucaucccggcccucuucgagcccgagcgcgagaaguccgccgccaucgacggcgaguaccggcugcgcggggaggcccggaagaccuucgucgagcugaugcgccggggcgaccuccccguguggcugagcuacaagguggccuccgagggcuuccaguacagcgaccgccgguggugcuucgacggggagcgcaacaaccagguccuggaggagaacauggacguggagaucuggaccaaggagggcgagcggaagaagcuccgcccccgguggcuggacgcgcgcaccuacuccgacccgcuggcccuccgggaguucaaggaguucgccgccgggcgccggagcgugagcggcgaccugauccuggagaucggcaagcucccccagcaccugacgcugcgcgcccagaacgcgcucgacaaccuggucaugcugcacaacuccgagcagggcgggaaggccuaccggcacgccauggaggagcuccccgacaccaucgagacccugaugcugcucgcccugaucgcggugcugaccgggggcgugacccucuucuuccugagcgggaagggccugggcaagaccuccaucgggcuccugugcgucaccgccagcuccgugcugcucuggauggccagcguggagccccacuggaucgccgccuccaucauccuggaguucuuccugaugguccuccugaucccggagcccgaccgccagcggacgccccaggacaaccagcuggcguacguggugaucggccuccuguucaugauccugacggucgccgccaacgagauggggcuccuggagaccaccaagcgcgaccugggcaucgggcacguggccgccgagaaccaccagcacgcgaccaugcucgacguggaccugcggccggccagcgccuggacgcuguacgccgucgccaccaccgugaucacccccaugaugcgccacacgaucgagaacaccaccgcgaacaucucccucaccgccaucgccaaccaggccgccauccugaugggccuggacaagggcuggcccaucagcaagauggacaucggggugccccuccuggcgcugggcugcuacucccaggucaacccgcucacgcugaccgccgccgugcugaugcucguggcccacuacgcgaucaucgggcccggccugcaggccaaggccacccgcgaggcccagaagcggaccgccgcggggaucaugaagaaccccacggucgacggcaucguggccaucgaccuggaccccguggucuacgacgccaaguucgagaagcagcucggccagaucaugcugcugauccucugcgccagccaggugcugcugaugcgcaccaccugggcccucugcgaguccaucacccuggcgacggggccgcugaccacccucugggagggcagccccgggaaguucuggaacaccacgaucgccguguccauggccaacaucuuccggggcagcuaccuggccggcgccgggcuggcguucucccucaugaagucccugggcgggggccgccgggggaccggcgcccagggcgagacccugggggagaaguggaagcgccagcucaaccagcuguccaagagcgaguucaacaccuacaagcggagcggcaucauggaggucgaccgcuccgaggccaaggaggggcugaagcggggcgagacgaccaagcacgccgugagccgcgggaccgcgaagcuccggugguucguggagcgcaaccuggucaagcccgagggcaaggugaucgaccugggcugcgggcggggcgggugguccuacuacugcgccggccugaagaaggugaccgaggucaagggguacaccaagggcggccccgggcacgaggagccgauccccauggccacguacggcuggaaccucgugaagcugcacagcgggaaggacguguucuucaugccgcccgagaagugcgacacccugcucugcgacaucggcgaguccagcccgaaccccaccaucgaggaggggcgcacccugcggguccugaagaugguggagcccuggcuccgcggcaaccaguucugcaucaagauccugaaccccuacaugccguccguggucgagacgcuggagcagaugcagcggaagcacggcgggaugcucgugcgcaacccccugagccggaacuccacccacgagauguacugggugagcugcggcaccgggaacaucgucuccgccgugaacaugaccagccgcaugcugcucaaccgcuucacgauggcccaccggaagcccaccuacgagcgcgacguggaccugggcgcgggcacccggcacgucgccguggagcccgagguggccaaccuggacaucaucgggcagcgcaucgagaacaucaagaacgagcacaaguccaccuggcacuacgacgaggacaacccguacaagacgugggccuaccacggcagcuacgaggucaagcccuccgggagcgccuccagcauggugaacggcgucgugcggcuccugaccaagcccugggacgugauccccauggucacccagaucgcgaugaccgacacgaccccguucgggcagcagcgcguguucaaggagaagguggacacccggacgccccgggccaagcggggcacgacccagaucauggaggucaccgccaaguggcuguggggcuuccucucccgcaacaagaagccccggaucugcacccgcgaggaguucacgcggaaggugcgcagcaacgccgccgugggggcggucuucguggacgagaaccaguggaacagcgccaaggaggccguggaggacgagcgguucugggaccugguccaccgcgagcgggagcugcacaagcagggcaagugcgcgaccugcguguacaacaugauggggaagcgcgagaagaagcucggcgaguucgggaaggcgaagggcucccgggccaucugguacauguggcugggcgcccgcuuccuggaguucgaggcccucggguucaugaacgaggaccacugguucagccgggagaacucccugagcggcguggagggggagggccugcacaagcucggguacauccugcgcgacaucuccaagaucccgggcggcaacauguacgccgacgacaccgcggggugggacacccgcaucacggaggacgaccugcagaacgaggccaagaucaccgacaucauggagcccgagcacgcccuccuggccaccagcaucuucaagcugaccuaccagaacaaggucgugcgggugcagcgccccgccaagaacggcacggucauggacgugaucucccggcgcgaccagcgggggagcggccaggugggcaccuacgggcucaacaccuucaccaacauggagguccagcugauccgccagauggaguccgagggcaucuuccugcccagcgagcucgagacgccgaaccuggcggagcgggugcuggacuggcucgagaagcacggggccgagcgccugaagcggauggccaucuccggcgacgacugcguggucaagcccaucgacgaccgcuucgccaccgcccugaccgcgcucaacgacauggggaaggugcggaaggacaucccccagugggagcccagcaagggcuggaacgacuggcagcaggucccguucugcucccaccacuuccaccagcugaucaugaaggacggccgcgagaucgucgugcccugccggaaccaggacgagcugguggggcgcgcccgggucagccagggcgccggguggucccuccgcgagaccgccugccugggcaagagcuacgcccagauguggcagcugauguacuuccaccggcgcgaccuccggcuggcggccaacgccaucugcuccgccgugcccguggacuggguccccaccagccgcacgaccuggagcauccacgcgcaccaccaguggaugaccaccgaggacaugcuguccguguggaaccgcguguggaucgaggagaacccguggauggaggacaagacgcacgucagcuccugggaggaggugcccuaccucgggaagcgggaggaccaguggugcggcagccugaucggccugaccgcccgcgccaccugggccaccaacauccagguggccaucaaccagguccggcgccucaucgggaacgagaacuaccuggacuacaugacguccaugaagcgguucaagaacgagagcgaccccgagggcgcgcugugguga

SEQ ID NO: 8981 - RNA, 9879 nt, Artificial Sequence
  derived and/or modified CDS sequence (opt1) from DENV-1__HQ332181__SS-prME
agcgugaccaugcugcucaugcugcugcccaccgcccucgccuuccaccugaccacccggggcggggagccccacaugaucgugagcaagcaggagcggggcaagagccuccuguucaagaccagcgcgggggugaacaugugcacccugaucgccauggaccugggcgagcucugcgaggacaccaugaccuacaagugcccccgcaucaccgaggccgagcccgacgacguggacugcuggugcaacgccaccgacaccugggugaccuacgggaccugcagccagaccggcgagcaccggcgcgagaagcgguccguggcccuggcgccccacgugggccuggggcucgagacccgcaccgagaccuggaugagcuccgagggcgccuggaagcagauccagcgggucgagaccugggcccugcgccaccccggguucacggugaucgccuucuuccuggcgcacgccaucggcaccagcaucacccagaaggggaucaucuucauccuccugaugcuggugacccccuccauggccaugcggugcgucggcaucggcaaccgcgacuucguggaggggcucagcggcgccacguggguggacgucgugcuggagcacggguccugcgugaccaccauggccaagaacaagcccacccuggacaucgagcuccugaagacggaggucaccaaccccgcggugcugcggaagcucugcaucgaggccaagaucagcaacaccaccacggacucccgcugcccgacccagggcgaggccacccugguggaggagcaggacgccaacuucgucugccggcgcaccuucguggaccggggcugggggaacggcugcgggcuguucggcaaggggagccuccugacgugcgccaaguucaagugcgugaccaagcuggagggcaagaucguccaguacgagaaccucaaguacuccgugaucgugaccguccacaccggcgaccagcaccagguggggaacgagacgaccgagcacggcaccaucgcgaccaucacgccccaggcccccacgagcgagauccagcugaccgacuacggggcccugacccucgacugcagcccccggaccggccuggacuucaacgagaugguccugcucacgaugaaggagaaguccuggcuggugcacaagcagugguuccuggaccucccgcugcccuggaccuccggggccagcaccagccaggagaccuggaaccggcaggaccugcucgugacguucaagaccgcccacgcgaagaagcaggaggucguggugcugggcucccaggagggcgccaugcacaccgcccugaccggggccacggagauccagaccagcggcaccaccacgaucuucgccgggcaccucaagugccgccugaagauggacaagcugacccucaagggcauguccuacgucaugugcaccgggagcuucaagcuggagaaggagguggcggagacccagcacggcacggugcugguccaggugaaguacgagggcaccgacgcccccugcaagauccccuucuccacccaggacgagaagggggugacccagaacggccggcugaucacggccaacccgaucgucaccgacaaggagaagcccgugaacaucgagaccgagccgcccuucggggagagcuacaucguggucggcgccggcgagaaggcgcucaagcuguccugguucaagcgcgggagcuccaucggcaagauguucgaggccaccgcccgcggggcgcgccgcauggccauccugggcgacacggcgugggacuucgggagcaucggcggcguguucaccuccguggggaagcucguccaccagguguucggcaccgccuacggggugcuguucagcggcgucuccuggaccaugaagaucgggaucggcauccugcucacguggcugggccugaacagccgguccaccagccucuccaugaccugcaucgccguggggauggugacccuguaccugggcgucauggugcaggccgacagcgggugcgugaucaacuggaagggccgcgagcucaagugcggguccggcaucuucgucacgaacgaggugcacaccuggaccgagcaguacaaguuccaggccgacagcccgaagcggcugagcgcggccaucggcaaggccugggaggagggggugugcggcauccgcuccgccacccggcuggagaacaucauguggaagcagaucagcaacgagcucaaccacauccugcuggagaacgacaugaaguucaccgucguggugggggacgccaacggcauccucguccaggggaagaagaugauccgcccccagcccauggagcacaaguacuccuggaaguccuggggcaaggcgaagaucaucggcgccgacauccagaacacgaccuucaucaucgacgggcccgacaccccggagugccccgacggccagcgggccuggaacaucugggagguggaggacuacggguucggcguguucaccacgaacaucuggcugaagcugcgcgacuccuacacccagaugugcgaccaccggcucaugagcgccgcgaucaaggacuccaaggccguccacgccgacaugggcuacuggaucgagagcgagaagaacgagaccuggaagcuggcccgcgccuccuucaucgaggugaagaccugcacguggcccaagagccacacccugugguccaacggggugcucgagagcgagaugaucauccccaagaucuacggcgggccgaucucccagcacaacuaccggcccggcuacuucacccagaccgcggggcccuggcaccugggcaagcuggagcucgacuucgaccugugcgagggcacgaccgucgugguggacgagcacugcgggaaccgcggcccgagccugcggaccaccacggucaccgggaagaucauccacgaguggugcugccgcuccugcacccugccgccccugcgguuccgcggcgaggacgggugcugguacggcauggagauccggcccgugaaggagaaggaggagaaccuggugcgcagcauggucuccgccggcaccggggagguggacagcuucagccucggcauccugugcguguccaucaugaucgaggaggucaugcggagccgcuggucccgcaagaugcugaugacggggacccucgccguguuccugcugcucaucaugggccagcugaccuggaacgaccugauccggcucugcaucauggugggggccaacgccagcgaccgcaugggcaugggcaccacguaccuggcgcugauggccaccuucaagaugcggccgauguucgccgucgggcuccuguuccgccggcugaccucccgcgaggugcuccugcugaccaucggccucagccuggucgccuccguggagcugcccaacagccucgaggagcugggggacggccuggccaugggcaucaugaugcucaagcugcugacggaguuccagccccaccagcucuggaccacccugcugucccucaccuucgugaagacggcgcugagccuggacuacgccuggaagaccaccgccaugguccucuccaucgugagccuguucccccugugccucuccaccacgagccagaagaccaccuggcugccggugcugcucggguccuucggcugcaagccccugaccauguuccugaucaccgagaacaagaucugggggcgcaagagcuggccccucaacgagggcaucauggccaucgggaucgucuccauccugcugagcucccuccugaagaacgacgugccccuggcgggcccgcucaucgccggcgggaugcugaucgccugcuacgugaucagcggcagcuccgccgaccugagccucgagaaggccgcggaggucuccugggagcaggaggccgagcacagcggggccucccacaacauccugguggaggugcaggacgacggcacgaugaagaucaaggacgaggagcgcgacgacacccugaccauccuccugaaggccacccugcucgccgucagcgggguguaccccauguccauccccgcgacgcuguucgugugguacuucuggcagaagaagaagcagcggagcggcguccugugggacacccccuccccgcccgagguggagcgcgccgugcucgacaacggcaucuaccggauccugcagcgcgggcugcugggccggagccaggucggggugggcguguuccaggacggggucuuccacaccauguggcacgugacccgcggcgccgugcucauguaccagggcaagcggcuggagcccuccugggccagcgucaagaaggaccugaucuccuacgggggcggguggcgcuuccagggcagcuggaacacgggggaggagguccaggugaucgccgucgagcccggcaagaacccgaagaacgugcagaccacccccggcaccuucaagacgcccgagggggaggugggcgcgaucgcccucgacuucaagcccgggaccuccggcagcccgaucgucaaccgggagggcaagaucguggggcuguacggcaacgggguggucaccaccuccggcacguacgugagcgccaucgcccaggccaaggcgucccaggaggggccccugcccgagaucgaggacgagguguucaagaagcgcaaccucaccaucauggaccugcacccgggcagcggcaagacccggcgcuaccugcccgccaucguccgggaggccaucaagcgcaagcuccgcacccugauccuggcccccacgcgggugguggcgagcgagauggccgaggcccucaaggggaugcccauccgcuaccagaccaccgccgucaaguccgagcacaccggccgggagaucguggaccugaugugccacgccacguucaccaugcgccugcucagcccggugcggguccccaacuacaacaugaucaucauggacgaggcgcacuucaccgaccccgccuccaucgccgcccgcggguacaucagcacccgggugggcaugggggaggccgcggccaucuucaugacggccacgccgcccggcuccguggaggccuucccccagagcaacgccgucauccaggacgaggagcgcgacauccccgagcgguccuggaacagcggcuacgacuggaucaccgacuuccccgggaagaccgugugguucgugcccuccaucaagagcggcaacgacaucgcgaacugccugcgcaagaacgggaagcgggucauccagcugucccgcaagacguucgacaccgaguaccagaagaccaagaacaacgacugggacuacguggugaccacggacaucagcgagaugggcgccaacuuccgggccgaccgcgucaucgacccccggcgcugccucaagcccgugauccugaaggacgggcccgagcgggucauccuggccggcccgaugcccgugaccguggcguccgccgcccagcgccggggccgcaucgggcgcaaccagaacaaggagggcgaccaguacgucuacauggggcagccccucaacaacgacgaggaccacgcccacuggaccgaggccaagaugcugcuggacaacaucaacacccccgagggcaucaucccggcccucuucgagcccgagcgggagaaguccgccgccaucgacggggaguaccgccugcggggcgaggcccgcaagacguucguggagcugaugcggcgcggcgaccuccccguguggcuguccuacaaggucgccagcgagggguuccaguacuccgaccggcgcuggugcuucgacggcgagcggaacaaccaggugcuggaggagaacauggacguggagaucuggaccaaggagggggagcgcaagaagcuccggccccgcuggcuggacgcgcggaccuacagcgacccgcuggcccuccgcgaguucaaggaguucgccgccggccggcgcuccgucagcggcgaccugauccuggagaucgggaagcucccccagcaccugacccugcgggcccagaacgcgcucgacaaccuggugaugcugcacaacagcgagcagggcgggaaggccuaccgccacgccauggaggagcuccccgacaccaucgagacgcugaugcugcucgcccugaucgcggugcugaccggcggggucacccucuucuuccuguccggcaagggccuggggaagaccagcaucggccuccugugcgugacggccuccagcgcccugcucuggauggccuccguggagccccacuggaucgccgcgagcaucauccuggaguucuuccugaugguccuccugaucccggagcccgaccggcagcgcacgccccaggacaaccagcuggccuacguggugaucgggcuccuguucaugauccugaccgucgccgccaacgagaugggccuccuggagaccacgaagaaggaccuggggaucggcuacguggccgcggagaaccaccagcacgccaccaugcucgacguggaccugcacccggccuccgccuggacccuguacgccgucgcgaccacggugaucacccccaugaugcggcacaccaucgagaacaccacggccaacaucagccucaccgccaucgccaaccaggccgcgauccugaugggccuggacaagggguggcccaucuccaagauggacaucggcgugccccuccuggcccuggggugcuacagccaggucaacccgcucacccugaccgccgccgugcugaugcucguggcgcacuacgccaucaucggccccgggcugcaggccaaggccacgcgcgaggcccagaagcgcaccgcggccggcaucaugaagaaccccaccgucgacggcaucguggccaucgaccuggaccccguggucuacgacgccaaguucgagaagcagcucgggcagaucaugcugcugauccucugcaccucccagauccugcugaugcggacgaccugggcccucugcgagagcaucacccuggcgaccggcccgcugacgacccucugggaggggucccccggcaaguucuggaacaccaccaucgccgugagcauggccaacaucuuccgcggcuccuaccuggccggggccggccuggcguucagccucaugaagucccucgggggcgggcggcgcggcacgggcgcccagggggagacccugggcgagaaguggaagcggcagcucaaccagcugagcaaguccgaguucaacaccuacaagcgcagcgggaucauggagguggaccggagcgaggccaaggagggccugaagcgcggggagaccacgaagcacgccgucucccggggcaccgcgaagcuccgcugguucguggagcggaaccuggugaagcccgagggcaaggucaucgaccuggggugcggccgcgggggcuggagcuacuacugcgccgggcugaagaaggugaccgaggugaagggcuacaccaagggcgggcccggccacgaggagccgauccccauggccaccuacggguggaaccucgucaagcugcacuccggcaaggacguguucuucaugccgcccgagaagugcgacacgcugcucugcgacaucggggagagcuccccgaaccccaccaucgaggagggccggacccugcgcgugcugaagauggucgagcccuggcuccggggcaaccaguucugcaucaagauccugaaccccuacaugccgagcgugguggagacccuggagcagaugcagcgcaagcacgggggcaugcucguccggaacccccugucccgcaacagcacgcacgagauguacuggguguccugcgggaccggcaacaucgugagcgccgucaacaugaccucccggaugcugcucaaccgcuucaccauggcccaccgcaagcccacguacgagcgggacguggaccugggcgcggggacccgccacguggccgucgagcccgagguggccaaccuggacaucaucggccagcggaucgagaacaucaagaacgagcacaagagcaccuggcacuacgacgaggacaacccguacaagaccugggccuaccacggguccuacgaggucaagcccagcggcuccgccagcuccauggugaacggggugguccgccuccugacgaagcccugggacgugauccccauggugacccagaucgcgaugaccgacaccacgccguucggccagcagcgggucuucaaggagaagguggacacccgcacgccccgggccaagcgcggcaccacgcagaucauggaggugaccgccaaguggcuguggggguuccucagccggaacaagaagccccgcaucugcacccgggaggaguucacccgcaagguccgguccaacgccgccaucggcgcgguguucguggacgagaaccaguggaacagcgccaaggaggccgucgaggacgagcgcuucugggaccuggugcaccgggagcgcgagcugcacaagcaggggaagugcgccacgugcguguacaacaugaugggcaagcgggagaagaagcucggggaguucggcaaggcgaagggcagccgcgccaucugguacauguggcugggggcccgguuccuggaguucgaggcccucggcuucaugaacgaggaccacugguucucccgcgagaacagccuguccggggucgagggcgaggggcugcacaagcucggcuacauccugcgggacaucagcaagaucccgggcgggaacauguacgccgacgacaccgcgggcugggacacccgcaucaccgaggacgaccugcagaacgaggccaagaucacggacaucauggagcccgagcacgcccuccuggccaccuccaucuucaagcugaccuaccagaacaagguggugcgcguccagcggcccgccaagaacgggaccgugauggacgugaucagccgccgggaccagcgcggcuccggccaggucgggacguacggccucaacaccuucaccaacauggaggugcagcugauccggcagauggagagcgaggggaucuuccugcccuccgagcucgagaccccgaaccuggcggagcgcgcccuggacuggcucgagaagcacggcgccgagcggcugaagcgcauggccaucagcggggacgacugcguggucaagcccaucgacgaccgguucgccacggcgcugaccgcccucaacgacaugggcaaggugcgcaaggacaucccccagugggagcccuccaagggcuggaacgacuggcagcaggucccguucugcagccaccacuuccaccagcugaucaugaaggacgggcgggagaucgucgugcccugccgcaaccaggacgagcuggugggccgggcccgcgucucccagggggccggcuggagccuccgggagaccgccugccuggggaaguccuacgcgcagauguggcagcugauguacuuccaccgccgggaccuccgccuggccgccaacgccaucugcagcgcggugcccguggacuggguccccaccucccggaccacguggagcauccacgcccaccaccaguggaugaccaccgaggacaugcugagcguguggaaccgcguguggaucgaggagaacccguggauggaggacaagacccacgucuccagcugggaggaggugcccuaccucggcaagcgcgaggaccaguggugcggcucccugaucgggcugacggcccgggccaccugggccaccaacauccagguggcgaucaaccagguccgccggcucaucggcaacgagaacuaccuggacuacaugaccagcaugaagcgcuucaagaacgaguccgacagcgagggggcccugugguga

SEQ ID NO: 8982 - RNA, 9879 nt, Artificial Sequence
  derived and/or modified CDS sequence (opt1) from DENV-1__HQ332180__SS-prME
agcgugaccaugcugcucaugcugcugcccaccgcccucgccuuccaccugaccacccgcggcggggagccccacaugaucaucagcaagcaggagcggggcaagagccugcuguucaagaccagcgcgggggugaacaugugcacccugaucgccauggaccugggcgagcucugcgaggacaccaugaccuacaagugcccccgcaucaccgaggccgagcccgacgacguggacugcuggugcaacgccaccgacaccugggugaccuacgggaccugcagccagaccggcgagcaccggcgcgacaagcgguccgucgcccuggcgccccacgugggccuggggcucgagacccgcaccgagaccuggaugagcuccgagggcgccuggaagcagauccagcggguggagaccugggcccugcgccaccccggguucacggugaucgcccuguuccucgcgcacgccaucggcaccagcaucacccagaaggggaucaucuucauccugcugaugcucgugacccccuccauggccaugcggugcgugggcaucggcaaccgcgacuucgucgaggggcugagcggcgccacguggguggacgugguccuggagcacggguccugcgugaccaccauggccaagaacaagcccacccucgacaucgagcugcugaagacggaggugaccaaccccgcgguccuccggaagcugugcaucgaggccaagaucagcaacaccaccacggacucccgcugcccgacccagggcgaggccacccugguggaggagcaggacgccaacuucgugugccggcgcaccuucgucgaccggggcugggggaacggcugcggccucuucggcaaggggagccugcugacgugcgccaaguucaagugcgugaccaagcucgagggcaagaucgugcaguacgagaaccugaaguacuccgucaucgugaccgugcacaccggcgaccagcaccaggucgggaacgagacgaccgagcacggcaccaucgcgaccaucacgccccaggcccccacgagcgagauccagcugaccgacuacggggcccucacccuggacugcagcccccgcaccggccuggacuucaacgagauggugcuccugacgaugaaggagaaguccuggcugguccacaagcagugguuccucgaccugccgcugcccuggaccuccggggccagcaccagccaggagaccuggaaccggcaggaccuccuggugacguucaagaccgcccacgcgaagaagcaggagguggucgugcugggcucccaggagggcgccaugcacaccgcccucaccggggccacggagauccagaccagcggcaccaccacgaucuucgccgggcaccugaagugccgccugaagauggacaagcucacccugaagggcauguccuacgugaugugcaccgggagcuucaagcuggagaaggaggucgcggagacccagcacggcacggugcuggugcaggucaaguacgagggcaccgacgcccccugcaagauccccuucuccacccaggacgagaagggggugacccagaacggccggcucaucacggccaacccgaucgugaccgacaaggagaagcccgucaacaucgagaccgagccgcccuucggggagagcuacaucguggugggcgccggcgagaaggcgcugaagcuguccugguucaagaaggggagcuccaucggcaagauguucgaggccaccgcccgcggggcccggcgcauggccauccucggcgacacggcgugggacuucgggagcaucggcggcgucuucaccuccguggggaagcuggugcaccaggucuucggcaccgccuacggggugcuguucagcggcguguccuggaccaugaagaucgggaucggcauccuccugacguggcugggccucaacagccgcuccaccagccuguccaugaccugcaucgccgucgggauggugacccuguaccucggcgccauggugcaggccgacagcgggugcgucaucaacuggaagggccgggagcugaagugcggguccggcaucuucgugacgaacgaggugcacaccuggaccgagcaguacaaguuccaggcggacagcccgaagcgccugagcgccgccaucggcaaggccugggaggagggggucugcggcauccgguccgccacccgccucgagaacaucauguggaagcagaucagcaacgagcugaaccacauccugcucgagaacgacaugaaguucaccgugguggucggggacgcgaacggcauccuggcccaggggaagaagaugauccggccccagcccauggagcacaaguacuccuggaaguccuggggcaaggccaagaucaucggcgccgacauccagaacacgaccuucaucaucgacgggcccgacaccccggagugccccgacggccagcgcgcguggaacaucugggagguggaggacuacggguucggcaucuucaccacgaacaucuggcugaagcuccgggacuccuacacccagaugugcgaccaccgccugaugagcgccgccaucaaggacuccaaggccgugcacgccgacaugggcuacuggaucgagagcgagaagaacgagaccuggaagcuggcgcgggccuccuucaucgaggucaagaccugcacguggcccaagagccacacccucugguccaacggggugcuggagagcgagaugaucauccccaagaucuacggcgggccgaucucccagcacaacuaccgccccggcuacuucacccagaccgccgggcccuggcaccugggcaagcucgagcuggacuucgaccugugcgagggcacgaccguggucguggacgagcacugcgggaaccggggcccgagccuccgcaccaccacggugaccgggaagaucauccacgaguggugcugccgguccugcacccugccgccccugcgcuuccggggcgaggacgggugcugguacggcauggagauccgccccgucaaggagaaggaggagaaccucgugcggagcaugguguccgccggcagcggggaggucgacagcuucucccugggcauccugugcgugagcaucaugaucgaggaggugaugcgcucccgguggagccgcaagaugcucaugaccgggacgcuggccgucuuccugcuccugaucaugggccagcugaccuggaacgaccucauccgccugugcaucauggugggggcgaacgccuccgaccggaugggcaugggcaccacccaccuggcccucauggccacguucaagaugcgcccgauguucgccguggggcugcuguuccggcgccucaccagccgggagguccugcugcucaccaucgggcugucccugauggcgagcauggagcuccccaacucccuggaggagcugggggacggccucgccaugggcaucaugaugcugaagcugcucaccgaguuccagccccaccagcuguggacgacccugcucagccugaccuucgugaagaccacgcugucccucgacuacgccuggaagaccaccgccaugauccugagcaucgugucccuguucccccucugccugagcaccacgucccagaagaccaccuggcugccgguccuccuggggagcuucggcugcaagccccugaccauguuccucaucaccgagaacaagaucugggggcgcaaguccuggccccugaacgagggcaucauggcgaucgggaucgugagcauccugcucuccagccugcugaagaacgacgucccccucgccggcccgcugaucgccggcgggaugcugaucgccugcuacgugaucagcggcuccagcgccgaccucucccuggagaaggcggccgaggugagcugggagcaggaggccgagcacuccggggccagccacaacauccuggucgaggugcaggacgacggcacgaugaagaucaaggacgaggagcgggacgacacccucaccauccugcugaaggccacccuccuggcgguguccggggucuaccccaugagcauccccgccacgcuguucgugugguacuucuggcagaagaagaagcagcgcuccggcgugcucugggacacccccagcccgcccgaggucgagcgggccgugcuggacgacggcaucuaccgcauccugcagcgggggcugcucggccgcucccaggugggggucggcguguuccaggacgggguguuccacaccauguggcacgucacccggggcgccgugcugauguaccagggcaagcgccuggagcccagcugggccuccgugaagaaggaccucaucagcuacgggggcggguggcgguuccagggcuccuggaacacgggggaggagguccaggugaucgcgguggagcccggcaagaacccgaagaacguccagaccacccccggcaccuucaagacgcccgagggggaggugggcgccaucgcccuggacuucaagcccgggaccagcggcuccccgaucgugaaccgcgagggcaagaucgucgggcuguacggcaacgggguggugaccaccagcggcacguacgucuccgccaucgcccaggcgaaggccagccaggaggggccccuccccgagaucgaggacgagguguucaagaagcggaaccugaccaucauggaccugcacccgggcagcggcaagacccgccgguaccuccccgccaucgugcgcgaggccaucaagcggaagcugcgcacccugauccucgcgcccacgcgcgucguggccuccgagauggccgaggcccugaaggggaugcccauccgguaccagaccaccgccgucaagagcgagcacaccggccgcgagaucgucgaccugaugugccacgcgacguucaccaugcggcuccuguccccggugcgcgugcccaacuacaacaugaucaucauggacgaggcccacuucaccgaccccgccagcaucgccgcccggggguacaucuccacccgcgucggcaugggggaggcggccgccaucuucaugacggccacgccgcccggcagcguggaggccuucccccaguccaacgcggugauccaggacgaggagcgggacauccccgagcgcagcuggaacuccggcuacgacuggaucaccgacuuccccgggaagaccgucugguucgugcccagcaucaaguccggcaacgacaucgccaacugccugcggaagaacgggaagcgcgugauccagcucagccggaagacguucgacaccgaguaccagaagaccaagaacaacgacugggacuacgucgugaccacggacaucuccgagaugggcgccaacuuccgcgccgaccgggugaucgacccccgccggugccugaagcccgucauccugaaggacgggcccgagcgcgugauccucgcgggcccgaugcccgugaccgucgccagcgccgcccagcggcgcggccggaucgggcgcaaccagaacaaggagggcgaccaguacguguacauggggcagccccugaacaacgacgaggaccacgcccacuggaccgaggcgaagaugcugcucgacaacaucaacacccccgagggcaucaucccggcccuguucgagcccgagcgcgagaaguccgccgccaucgacggggaguaccggcugcgcggcgaggcccggaagacguucguggagcucaugcgccggggcgaccugcccgucuggcugagcuacaagguggcguccgagggguuccaguacagcgaccgccgguggugcuucgacggcgagcgcaacaaccagguccucgaggagaacauggacguggagaucuggaccaaggagggggagcggaagaagcugcgcccccgguggcuggacgcccgcaccuacuccgacccgcucgcccugcgggaguucaaggaguucgccgccggccgccggagcgugagcggcgaccugauccucgagaucgggaagcugccccagcaccugacccuccgcgcgcagaacgcccuggacaaccuggucaugcuccacaacuccgagcagggcgggaaggccuaccggcacgccauggaggagcugcccgacaccaucgagacgcugaugcuccuggcgcugaucgccgugcucaccggcggggugacccuguucuuccugagcggcaagggccucgggaagaccuccaucggccugcugugcgucacggccagcuccgcccuccuguggauggccagcguggagccccacuggaucgcggccuccaucauccuggaguucuuccucauggugcugcugaucccggagcccgaccgccagcggacgccccaggacaaccagcucgccuacgucgugaucgggcugcuguucaugauccucaccguggccgccaacgagaugggccugcuggagaccacgaagaaggaccucgggaucggcuacgucgcggccgagaaccaccagcacgccaccaugcuggacguggaccugcgcccggccagcgccuggacccucuacgcgguggccaccacggucaucacccccaugaugcggcacaccaucgagaacaccacggccaacaucucccugaccgccaucgccaaccaggcggccauccugaugggccucgacaagggguggcccaucagcaagauggacaucggcgugccccugcuggcccucgggugcuacucccaggugaacccgcugacccugaccgccgcgguccucaugcugguggcccacuacgccaucaucggccccgggcugcaggccaaggccacgcgcgaggcgcagaagcgcaccgccgccggcaucaugaagaaccccaccguggacggcaucgucgccaucgaccucgaccccgugguguacgacgccaaguucgagaagcagcuggggcagaucaugcugcucauccugugcaccagccagauccugcucaugcggacgaccugggcgcugugcgaguccaucacccuggccaccggcccgcucacgacccugugggaggggagccccggcaaguucuggaacaccaccaucgccgucuccauggccaacaucuuccgcggcagcuaccuggccggggcgggccucgccuucucccugaugaagucccucgggggcgggcggcgcgggacgggcgcccagggggagacccucggcgagaaguggaagcggcagcugaaccagcuguccaagagcgaguucaacaccuacaagcgcagcgggaucauggagguggaccgguccgaggccaaggagggccucaagcgcggggagaccacgaagcacgcggugagccggggcaccgccaagcugcgcugguucgucgagcggaaccuggugaagcccgagggcaaggugaucgaccuggggugcggccgcgggggcugguccuacuacugcgccgggcucaagaaggucaccgaggugaagggcuacaccaagggcgggcccggccacgaggagccgauccccauggccaccuacggguggaaccuggugaagcugcacagcggcaaggacgucuucuucaugccgcccgagaagugcgacacgcuccugugcgacaucggggaguccagcccgaaccccaccaucgaggagggccggacccugcgcgugcucaagaugguggagcccuggcugaagggcaaccaguucugcaucaagauccugaaccccuacaugccguccgucguggagacccucgagcagaugcagcggaagcacgggggcaugcuggugcgcaacccccugagccggaacuccacgcacgagauguacugggucagcugcgggaccggcaacaucguguccgccgugaacaugaccagccgcaugcuccugaaccgguucaccauggcgcaccgcaagcccacguacgagcgcgacgucgaccugggcgccgggacccggcacguggccguggagcccgaggucgccaaccucgacaucaucggccagcgcaucgagaacaucaagaacgagcacaaguccaccuggcacuacgacgaggacaacccguacaagaccugggccuaccacgggagcuacgaggugaagcccuccggcagcgcguccagcauggugaacggggucgugcggcugcugacgaagcccugggacgugauccccauggucacccagaucgccaugaccgacaccacgccguucggccagcagcgcguguucaaggagaaggucgacacccggacgccccgcgccaagcggggcaccacgcagaucauggaggugaccgccaaguggcucuggggguuccugucccgcaacaagaagccccggaucugcacccgcgaggaguucacccggaaggugcgcagcaacgccgcgaucggcgccgucuucguggacgagaaccaguggaacagcgccaaggaggccguggaggacgagcgguucugggaccugguccaccgcgagcgggagcuccacaagcaggggaagugcgcgacgugcguguacaacaugaugggcaagcgcgagaagaagcugggggaguucggcaaggccaagggcucccgggccaucugguacauguggcugggggcccgcuuccucgaguucgaggcccugggcuucaugaacgaggaccacugguucagccgggagaacucccugagcgggguggagggcgaggggcuccacaagcugggcuacauccugcgcgacaucuccaagaucccgggcgggaacauguacgcggacgacaccgccggcugggacacccggaucaccgaggacgaccuccagaacgaggccaagaucacggacaucauggagcccgagcacgcccugcuggccaccagcaucuucaagcucaccuaccagaacaaggucgugcgcgugcagcgccccgcgaagaacgggaccgucauggacgugaucucccggcgcgaccagcggggcagcggccagguggggacguacggccugaacaccuucaccaacauggagguccagcugauccgccagauggaguccgaggggaucuuccuccccagcgagcuggagaccccgaaccuggccgagcgggugcucgacuggcuggagaagcacggcgccgagcgccugaagcggauggccaucuccggggacgacugcguggucaagcccaucgacgaccgcuucgccacggcgcucaccgcccugaacgacaugggcaaggugcggaaggacaucccccagugggagcccagcaagggcuggaacgacuggcagcaggucccguucugcucccaccacuuccaccagcugaucaugaaggacgggcgcgagaucgucgugcccugccggaaccaggacgagcucgugggccgcgcccgggucagccagggggccggcuggucccugcgcgagaccgccugccugggcaagagcuacgcgcagauguggcagcucauguacuuccaccggcgcgaccugcggcuggccgccaacgccaucugcuccgcggugcccguggacuggguccccaccagccgcaccacguggagcauccacgcccaccaccaguggaugaccaccgaggacaugcucuccguguggaaccggguguggaucgaggagaacccguggauggaggacaagacccacgucagcuccugggaggaggugcccuaccugggcaagcgcgaggaccaguggugcggcagccugaucgggcucacggcccgcgccaccugggccaccaacauccagguggcgaucaaccagguccggcgccugaucggcaacgagaacuaccuggacuacaugaccuccaugaagcgguucaagaacgagagcgaccccgagggggcccucugguga

SEQ ID NO: 8983 - RNA, 9879 nt, Artificial Sequence
  derived and/or modified CDS sequence (opt1) from DENV-1__HQ332179__SS-prME
agcgugaccaugcugcucaugcugcugcccaccgcccucgccuuccaccugaccacccgcggcggggagccccacaugaucgugagcaagcaggagcggggcaagagccuccuguucaagaccagcgcgggggugaacaugugcacccugaucgccauggaccugggggagcucugcgaggacaccaugaccuacaagugcccccgcaucaccgaggccgagcccgacgacguggacugcuggugcaacgccaccgacaccugggucaccuacgggaccugcagccagaccggggagcaccggcgcgacaagcgguccguggcccuggcgccccacgugggccuggggcucgagacgcgcaccgagaccuggaugagcagcgagggcgccuggaagcagauccagcgggucgagaccugggcccugcgccaccccggguucacggugaucgcccuguuccucgcgcacgccaucggcaccagcaucacccagaaggggaucaucuucauccugcugaugcucgugacccccuccauggccaugcggugcgucggcaucggcaaccgcgacuucguggaggggcugagcggcgccacguggguggacgucgugcuggagcacggguccugcgugaccaccauggccaagaacaagcccacccucgacaucgagcugcugaagacggaggucaccaaccccgcggugcuccggaagcugugcaucgaggccaagaucagcaacaccaccacggacucccgcugcccgacccagggcgaggccacccugguggaggagcaggacgccaacuucgucugccggcgcaccuucguggaccggggcugggggaacggcugcggccuguucggcaaggggagccugcugacgugcgccaaguucaagugcgugaccaagcucgagggcaagaucguccaguacgagaaccugaaguacuccgugaucgugaccguccacaccggcgaccagcaccagguggggaacgagacgaccgagcacggcaccaucgcgaccaucacgccccaggcccccacgagcgagauccagcugaccgacuacggggcccucacccuggacugcagcccccgcaccggccuggacuucaacgagaugguccuccugacgaugaaggagaaguccuggcuggugcacaagcagugguuccucgaccugccgcugcccuggaccuccggggccagcaccagccaggagaccuggaaccggcaggaccuccuggugacguucaagaccgcccacgcgaagaagcaggaggucguggugcugggcucccaggagggcgccaugcacaccgcccucaccggggccacggagauccagaccagcggcaccaccacgaucuucgccgggcaccugaagugccgccugaagauggacaagcucacccugaagggcauguccuacgucaugugcaccgggagcuucaagcuggagaaggagguggcggagacccagcacggcacggugcugguccaggugaaguacgagggcaccgacgcccccugcaagauccccuucuccacccaggacgagaagggggugacccagaacggccggcucaucacggccaacccgaucgucaccgacaaggagaagcccgugaacaucgagaccgagccgcccuucggggagagcuacaucguggucggcgccggcgagaaggcgcugaagcuguccugguucaagaaggggagcuccaucggcaagauguucgaggccaccgcccgcggggcccggcgcauggccauccucggcgacacggcgugggacuucgggagcaucggcggcguguucaccuccguggggaagcugguccaccagguguucggcaccgccuacggggugcuguucagcggcgucuccuggaccaugaagaucgggaucggcauccuccugacguggcugggccucaacagccgcuccaccagccuguccaugaccugcaucgccguggggauggugacccuguaccucggcgucauggugcaggccgacagcgggugcgugaucaacuggaagggccgggagcugaagugcggguccggcaucuucgucacgaacgaggugcacaccuggaccgagcaguacaaguuccaggccgacagcccgaagcgccugagcgcggccaucggcaaggccugggaggagggggugugcggcauccgguccgccacccgccucgagaacaucauguggaagcagaucagcaacgagcugaaccacauccugcucgagaacgacaugaaguucaccgucguggugggggacgccaacggcauccuggcgcaggggaagaagaugauccggccccagcccauggagcacaaguacuccuggaaguccuggggcaaggccaagaucaucggcgccgacauccagaacacgaccuucaucaucgacgggcccgacaccccggagugccccgacggccagcgcgccuggaacaucugggaggucgaggacuacggguucggcaucuucaccacgaacaucuggcugaagcuccgggacuccuacacccagaugugcgaccaccgccugaugagcgcggccaucaaggacuccaaggccgugcacgccgacaugggcuacuggaucgagagcgagaagaacgagaccuggaagcuggcccgggcguccuucaucgaggugaagaccugcacguggcccaagagccacacccucugguccaacgggguccuggagagcgagaugaucauccccaagaucuacggcgggccgaucucccagcacaacuaccgccccggcuacuucacccagaccgccgggcccuggcaccugggcaagcucgagcuggacuucgaccugugcgagggcacgaccgugguggucgacgagcacugcgggaaccggggcccgagccuccgcaccaccacggugaccgggaagaucauccacgaguggugcugccgguccugcacccugccgccccugcgcuuccggggcgaggacgggugcugguacggcauggagauccgccccgugaaggagaaggaggagaaccucguccggagcaugguguccgccggcagcggggagguggacagcuucucccugggcauccugugcgccagcaucaugaucgaggaggucaugcgcucccgguggagccgcaagaugcucaugaccgggacgcuggccguguuccugcuccugaucaugggccagcugaccuggaacgaccucauccgccugugcaucauggugggggcgaacgccuccgaccggaugggcaugggcaccaccuaccuggcccucauggccacguucaagaugcgcccgauguucgccgucgggcugcuguuccggcgccucaccagccgggaggugcugcugcucaccaucggccugucccugguggcgagcgucgagcuccccaacucccuggaggagcugggggacggccucgccaugggcaucaugaugcugaagcugcucaccgaguuccagccccaccagcuguggacgacccugcucagccugaccuucgugaagaccacgcugucccucgacuacgccuggaagaccaccgccaugguccugagcaucgugucccuguucccccucugccugagcaccacgucccagaagaccaccuggcugccggugcuccuggggagcuucggcugcaagccccugaccauguuccucaucaccgagaacaagaucugggggcgcaaguccuggccccugaacgagggcaucauggcgaucgggaucgucagcauccugcucuccagccugcugaagaacgacgugccccucgccggcccgcugaucgccggcgggaugcugaucgccugcuacgugaucagcggcuccagcgccgaccuccugcuggagaaggcggccgaggucuccugggagcaggaggccgagcacagcggggccucccacaacauccucguggaggugcaggacgacggcacgaugaagaucaaggacgaggagcgggacgacacccugaccauccugcucaaggccacccugcuggcggucagcgggguguaccccauguccauccccgccacccucuucgugugguacuucuggcagaagaagaagcagcgcagcggcguccugugggacacccccuccccgcccgagguggagcgggccgugcuggacgacggcaucuaccgcauccugcagcgggggcuccugggccgcagccaggucggggugggcguguuccaggacggggucuuccacaccauguggcacgugacccggggcgccgugcugauguaccagggcaagcgccucgagcccuccugggccagcgucaagaaggaccugaucuccuacgggggcggguggcgguuccagggcagcuggaacacgggggaggagguccaggugaucgcggucgagcccggcaagaacccgaagaacgugcagaccacccccggcaccuucaagacgcccgagggggaggugggcgccaucgcccuggacuucaagcccgggaccuccggcagcccgaucgucaaccgcgagggcaagaucguggggcucuacggcaacgggguggucaccaccuccggcacguacgugagcgccaucgcccaggcgaaggccucccaggaggggccccugcccgagaucgaggacgagguguucaagaagcggaaccugaccaucauggaccuccacccgggcagcggcaagacccgccgguaccugcccgccaucguccgcgaggccaucaagcggaagcugcgcacccucauccuggcgcccacgcgcgugguggccagcgagauggccgaggcccugaaggggaugcccauccgguaccagaccaccgccgucaaguccgagcacaccggccgcgagaucguggaccucaugugccacgcgacguucaccaugcggcugcugagcccggugcgcguccccaacuacaacaugaucaucauggacgaggcccacuucaccgaccccgccuccaucgccgcccggggguacaucagcacccgcgugggcaugggggaggcggccgccaucuucaugacggccacgccgcccggcuccguggaggccuucccccagagcaacgcggucauccaggacgaggagcgggacauccccgagcgcuccuggaacagcggcuacgacuggaucaccgacuuccccgggaagaccgugugguucgugcccuccaucaagagcggcaacgacaucgccaacugccuccggaagaacgggaagcgcgucauccagcugucccggaagacguucgacaccgaguaccagaagaccaagaacaacgacugggacuacguggugaccacggacaucagcgagaugggcgccaacuuccgcgccgaccgggucaucgacccccgccggugccugaagcccgugauccucaaggacgggcccgagcgcgugauccuggcgggcccgaugcccgucaccguggccuccgccgcccagcggcgcggccggaucgggcgcaaccagaacaaggagggcgaccaguacgucuacauggggcagccccugaacaacgacgaggaccacgcccacuggaccgaggcgaagaugcuccuggacaacaucaacacccccgagggcaucaucccggcccuguucgagcccgagcgcgagaaguccgccgccaucgacggggaguaccggcuccgcggcgaggcccggaagacguucguggagcugaugcgccggggcgaccugcccguguggcucuccuacaaggucgcgagcgagggguuccaguacuccgaccgccgguggugcuucgacggcgagcgcaacaaccaggugcuggaggagaacauggacguggagaucuggaccaaggagggggagcggaagaagcugcgcccccgguggcucgacgcccgcaccuacagcgacccgcuggcccugcgggaguucaaggaguucgccgccggccgccgguccgucagcggcgaccucauccuggagaucgggaagcugccccagcaccucacccugcgcgcgcagaacgcccuggacaaccucgugaugcugcacaacagcgagcagggcgggaaggccuaccggcacgccauggaggagcugcccgacaccaucgagacgcucaugcugcuggcgcucaucgccgugcugaccggcggggucacccuguucuuccucuccggcaagggccuggggaagaccagcaucggccugcucugcgugacggccuccagcgcccugcuguggauggccugcguggagccccacuggaucgcggccuccaucauccucgaguucuuccugaugguccugcucaucccggagcccgaccgccagcggacgccccaggacaaccagcuggccuacguggugaucgggcuccucuucaugauccugaccgucgccgccaacgagaugggccugcucgagaccacgaagaaggaccuggggaucggcuacguggcggccgagaaccaccagcacgccaccaugcuggacguggaccuccgcccggccagcgccuggacccuguacgcggucgccaccacggugaucacccccaugaugcggcacaccaucgagaacaccacggccaacaucucccugaccgccaucgccaaccaggcggccauccucaugggccuggacaagggguggcccaucagcaagauggacaucggcgugccccugcucgcccuggggugcuacucccaggucaacccgcugacccucaccgccgcggugcugaugcugguggcccacuacgccaucaucggccccgggcuccaggccaaggccacgcgcgaggcgcagaagcgcaccgccgccggcaucaugaagaaccccaccgucgacggcaucguggccaucgaccuggaccccguggucuacgacgccaaguucgagaagcagcuggggcagaucaugcuccugauccugugcaccagccagauccuccugaugcggacgaccugggcgcugugcgaguccaucacccucgccaccggcccgcugacgacccugugggaggggagccccggcaaguucuggaacaccaccaucgccguguccauggccaacaucuuccgcggcagcuaccucgccggggcgggccuggccuucucccugaugaagucccucgggggcgggcggcgcggcacgggcgcccagggggagacccugggcgagaaguggaagcggcagcugaaccagcucuccaagagcgaguucaacaccuacaagcgcuccgggaucauggagguggaccggagcgaggccaaggagggccugaagcgcggggagaccacgaagcacgcggucagccggggcaccgccaagcugcgcugguucguggagcggaaccuggugaagcccgagggcaaggucaucgaccucgggugcggccgcgggggcugguccuacuacugcgccgggcugaagaaggugaccgaggugaagggcuacaccaagggcgggcccggccacgaggagccgauccccauggccaccuacggguggaaccuggucaagcuccacagcggcaaggacguguucuucaugccgcccgagaagugcgacacgcugcugugcgacaucggggaguccagcccgaaccccaccaucgaggagggccggacccuccgcgugcugaagauggucgagcccuggcugaagggcaaccaguucugcaucaagauccucaaccccuacaugccguccgugguggagacccuggagcagaugcagcggaagcacgggggcaugcugguccgcaacccccucagccggaacuccacgcacgagauguacugggugagcugcgggaccggcaacaucguguccgccgucaacaugaccagccgcaugcugcugaaccgguucaccauggcgcaccgcaagcccacguacgagcgcgacguggaccucggcgccgggacccggcacguggccgucgagcccgagguggccaaccuggacaucaucggccagcgcaucgagaacaucaagaacgagcacaaguccaccuggcacuacgacgaggacaacccguacaagaccugggccuaccacgggagcuacgaggugaagcccuccggcagcgcguccagcauggucaacggggugguccggcugcucacgaagcccugggacgugauccccauggugacccagaucgccaugaccgacaccacgccguucggccagcagcgcgucuucaaggagaagguggacacccggacgccccgcgccaagcggggcaccacgcagaucauggaggugaccgccaaguggcuguggggguuccugucccgcaacaagaagccccggaucugcacccgcgaggaguucacccggaagguccgcagcaacgccgcgaucggcgccguguucguggacgagaaccaguggaacuccgccaaggaggccgucgaggacgagcgguucugggaccucgugcaccgcgagcgggagcugcacaagcaggggaagugcgcgacgugcguguacaacaugaugggcaagcgcgagaagaagcugggggaguucggcaaggccaagggcagccgggccaucugguacauguggcucggggcccgcuuccuggaguucgaggcccugggcuucaugaacgaggaccacugguucagccgggagaacucccucagcggggucgagggcgaggggcugcacaagcugggcuacauccuccgcgacaucuccaagaucccgggcgggaacauguacgcggacgacaccgccggcugggacacccggaucaccgaggacgaccugcagaacgaggccaagaucacggacaucauggagcccgagcacgcccugcucgccaccagcaucuucaagcugaccuaccagaacaagguggugcgcguccagcgccccgcgaagaacgggaccgugauggacgugaucucccggcgcgaccagcggggcagcggccaggucgggacguacggccugaacaccuucaccaacauggaggugcagcucauccgccagauggaguccgaggggaucuuccugcccagcgagcuggagaccccgaaccucgccgagcgggugcuggacuggcuggagaagcacggcgccgagcgccucaagcggauggccaucuccggggacgacugcgucgugaagcccaucgacgaccgcuucgccacggcgcugaccgcccugaacgacaugggcaaggugcggaaggacaucccccagugggagcccagcaagggcuggaacgacuggcagcaggucccguucugcucccaccacuuccaccagcucaucaugaaggacgggcgcgagaucguggugcccugccggaaccaggacgagcuggucggccgcgcccgggugagccagggggccggcuggucccugcgcgagaccgccugccucggcaagagcuacgcgcagauguggcagcugauguacuuccaccggcgcgaccugcggcucgccgccaacgccaucugcuccgcggugcccgucgacugggugcccaccagccgcaccacgugguccauccacgcccaccaccaguggaugaccaccgaggacaugcugagcguguggaaccgggucuggaucgaggagaacccguggauggaggacaagacccacgugagcuccugggaggaggugcccuaccugggcaagcgcgaggaccaguggugcggcagccucaucgggcugacggcccgcgccaccugggccaccaacauccaggucgcgaucaaccaggugcggcgccugaucggcaacgagaacuaccucgacuacaugaccuccaugaagcgguucaagaacgagagcgaccccgagggggcccugugguga

SEQ ID NO: 8984 - RNA, 9879 nt, Artificial Sequence
  derived and/or modified CDS sequence (opt1) from DENV-1__KR919820__SS-prME
accgugguggcccugcucaugcugcugcccaugguguucagcuuccaccucaccacccggggcggggagccgcacaugaucgugaacaagcaggagcggggcaagagccugcuguucaagaccagcgggggcaucaacaugugcacccucaucgccauggaccugggggaccugugcgaggacaccaugacguacaagugcccccggaucaccgaggccgagcccgacgacguggacugcuggugcaacgccaccgacaccugggugaccuacggcaucugcagccccaccggcgagcaccggcgcgagaagcggagcguggcccucgccccgcacguggggcugggccuggagacccgcgccgagaccuggaugagcagcgagggggcguggaagcagauccagcggguggagacgugggcccuccgccaccccggcuucaccgugaucgcccuguuccuggcccacaucaucgggaccuccaucacccagaagggcgucaucuucauccuccugaugcuggugacgcccagcauggcgaugcggugcgugggcgucgggaaccgcgacuucguggagggccucuccggggccaccuggguggacgucgugcuggagcacggcagcugcgugaccaccauggccaagaacaagcccacgcuggacaucgagcuccugaagaccgaggucuccaacccggccgugcugcggaagcucugcaucgaggcccgcaucagcaacaccaccacggacucccggugccccacccagggcgaggcgagccuguccgaggagcaggacaccaacuucgugugccgccggacccuggucgaccgcggguggggcaacgggugcggccucuucgggaagggcagccugaucacgugcgccaaguucgagugccugaccaagauggagggcaagaucgugcaguacgagaaccucaaguacuccgugaucgucaccgugcacaccggggaccagcaccaggucggcaacgagacgaccgggcacggcaccaccgccacgaucacgccccaggcccccaccagcgagauccagcugaccgacuacggggcccugacccucgacugcuccccgcggacgggccuggacuucaacgagauggugcugcucaccaugaaggagaaguccuggcuggugcacaagcagugguuccuggaccucccccugcccugggcgagcggcgccuccagcccccaggagaccuggaaccgccaggaccugcucgucaccuucaagacggcccacgccaagaagcaggagguggugguccuggggucccaggagggcgccaugcacaccgcgcugaccggggccaccgagauccagacgagcggcaccaccaccaucuucgccgggcaccucaagugccggcugaagauggacaagcugacgcucaagggcauguccuacgugaugugcaccggcagcuucaagcugaagaaggagguggccgagacccagcacgggaccguccugguccagguggaguacgagggcacggacgccccgugcaagauccccuucaccacccaggacgagaagggggucauccagaacggccgccugaucaccgcgaaccccaucgugacggacaaggagaagcccgugaacaucgaggccgagccgcccuucggcgaguccuacauggucaucggggugggcgacaaggcccucaagcugagcugguucaagaagggguccagccugggcaagauguucgaggccaccgcgcgcggggcccgccgcauggccauccucggcgacaccgccugggacuucggcuccgucggcggggucuucaccagcauggggaagcuggugcaccagaucuucgggacggccuacggggugcuguucuccggcgucagcuggaccaugaagaucggcaucgggcuccugcugaccuggcucggccugaacucccggagcaccucccugagcaugacgugcaucgcgguggggaucaucacccucuaccugggcgugaugguccaggccgacaccgggugcguggugaacuggaagggccgcgagcugaagugcggcuccgggaucuucgucaccaacgaggugcacacguggaccgagcaguacaaguuccaggccgacagccccaagcggcucagcgccgccaucggcaaggcgugggaggacggggugugcggcauccgcuccgccacccggcuggagaacaucauguggaagcagaucgccaacgagcugaacuacauccuccuggagaacgacaugaaguucaccgucguggugggggacgucaagggcauccugacgcagggcaagaaggggauccgcccccagccgauggagcacaaguacagcuggaaguccuggggcaaggccaagaucaucggggccgacgugcagaacaccaccuucaucaucgacggccccgacacccccgagugccccgacagccagcgggcguggaacaucugggagguggaggacuacggcuucgggaucuucaccacgaacaucuggcucaagcugcgcgacuccuacacccaggucugcgaccaccggcugaugagcgccgccaucaaggacucccgcgccgugcacgcggacaugggcuacuggaucgagagcgagaagaacgagaccuggaagcucucccgggccagcuucaucgaggugaagaccugcacguggccgaagucccacacccuguggagcaacgggguccuggaguccgagaugaucauccccaagaucuacggcgggcccaucagccagcacaacuaccgcccgggcuacuucacccagaccgccggccccuggcaccucgggaagcuggagcuggacuucgaccucugcgagggcacgaccgugguggucgacgagcagugcgggaaccggggccccucccugcgcaccaccacggugaccgggaagaucauccacgaguggugcugccggagcugcacccugcccccgcuccgcuucaagggcgaggacggcugcugguacgggauggagauccggcccgugaaggagaaggaggagaaccuggucaaguccauggugagcgccggcagcgggaagguggacaacuucucccugggccuccugugcaucagcaucauggucgaggaggugaugcgcucccgguggagcgggaagaugcugaugaccggcacgauggccguguuccuccugcuggucaugggccagcucaccuggaacgaccugauccgcgugugcaucauggucggggcgcacgcccuggacuccaugggcauggggaccaccuaccucgcccugauggccacguucaagauccgccccaugcuggccgugggccuccuguuccggaagcugaccagccgcgagauccuccugcugaccaucggccucucccugaucacccccguggagcugccgaacagcaucgaggagcucggggacggccuggcgauggggaucaugaugcugaagcuccugacggacuuccagcccuaccagcugugggccacccuccugucccugaccuucgucaagaccacgcucagccugcacuacgccuggaagaccgccgccauggugcuguccaucgugagccuccugccccugugccucuccaccaccagccagaagacgaccuggcugcccauccugcucggcucccuggggugcaagccgcugaccauguuccucaucagcgagaacaagaucuggggccggcgcuccuggcccaucaacgagggcaucauggcggucgggaucgugagcauccugauguccagccugcucaagaacgacgugccccuggccggcccccugaucgccgggggcaugcucgucgccugcuacgugaucagcggguccagcgcggaccugacccuggagaagacggccgagguguccugggaggaggaggccgagcacagcggcaccgcccacaacauccucgucgaggugcaggacgacggcaccaugaagaucaaggacgaggagcgggaggacacccugaccauccugcucaaggccgcgcugcuggcccucuccgggguguacccgaugagcauccccgccacgcuguucgucugguacuucuggcagaagaagaagcagcgcuccggcgugcugugggacauccccuccccgcccgagguggagaaggccguccuggacgacgggaucuaccggauccuccagcgcggcguguucgggcggucccaggugggcgucggcguguuccaggaggggguguuccacaccauguggcacgucacccgcggcgccgugcugaccuaccaggggaagcggcuggagcccagcugggcguccgugaagaaggaccucaucagcuacggcgggggcuggcgccugcagggcuccuggaacgucggggaggagguccaggugaucgccgucgagcccggcaagaaccccaagaacgugcagacggugcccgggaccuucaagacccacgagggcgaggucggcgccaucgcccuggacuucaagcccgggaccagcggcucccccaucgugaaccgggacgggaagguggucggccucuacgggaacggcguggugacgaccagcggcaccuacgucuccgccaucgcgcagagcaaggugucccaggaggggccgcugcccgagaucgaggacgagguguucaagaagaagaaccugaccaucauggaccuccaccccggcagcgggaagacgcgccgguaccugcccgccaucguccgcgagagcaucaagcggcgccugcggacccucauccuggccccgacccgcgugguggccuccgagauggccgaggcgcugaagggccuccccauccgguaccagaccacggccguccgcaacgagcacaccgggcgcgagaucguggaccugaugugccacgccaccuucaccaugcggcugcucagccccgugcgcguccccaacuacaacaugaucaucauggacgaggcccacuucacggacccggcguccaucgccgcccggggcuacaucagcacccgcgugggcaugggggaggccgccgcgaucuucaugaccgccacgccgcccggcuccgccgaggccuucccccagagcaacuccgugaucuacgacgaggagaaggacaucccggagcggagcuggaacuccggguacgacuggaucacggacuuccagggcaagaccgucugguucgugcccagcaucaagaccgggaacgacaucgccaacugccugcgcaagaacggcaagcgggucauccagcugucccgcaagaccuucgacacggaguaccagaagaccaagaacagcgacugggacuucguggugaccaccgacaucuccgagaugggcgcgaacuuccgggccgaccgcgucaucgacccccggcgcugccucaagcccgugauccugcgggacgggccggagcgcgugauccuggccggccccaugcccgucacgguggccagcgccgcgcagcggcgcgggcggaucggccgcaaccaguccaaggagggggaccaguacaucuacaugggccagccccucaacaacgacgaggaccacgcccacuggaccgaggccaagaugcugcuggacaacaucaacaccccggagggcaucauccccgcccucuucgagcccgagcgggagaaguccgcggccaucgacggggaguaccgccugcgcggcgaggcccggaagaccuucguggagcugaugcgccgcggggaccuccccgucuggcuguccuacaagguggccagcgagggcauccaguacgccgaccgcaaguggugcuucgacggcgagcggaacaaccagauccuggaggagaacauggacguggagaucuggacgaaggagggggagcgcaagaagcuccggccgcgcuggcuggacgcgcggaccuacuccgacccccuggcccuccgcgaguucaaggaguucgccgccggccggcgcagcgucagcggggaccugauccuggagaucggcaagcucccccaccaccugacccagcgggcccagaacgcgcuggacaaccucgugaugcugcacaacuccgagcagggcgggcgcgccuaccggcacgccauggaggagcugcccgacaccaucgagacgcucaugcugcuggccaugaucgccacccucaccggcgggguggcgcuguucuuccugagcggcaaggggcucggcaagaccuccaucgggcugcugugcgucauggccagcuccacccuccuguggauggccagcguggagccgcacuggaucgccgcguccaucgugcuggaguucuuccucaugguccugcugauccccgagcccgaccgccagcggacgccgcaggacaaccagcucgccuacguggugaucggccugcugguccucauccugaccguggccgccaacgagaugggccugcucgagaccaccaagaaggaccuggggaucggcagcgccgcggccgagauccagcaccacacgaccauccuggacguggaccuccaccccgccuccgccuggacccuguacgccgucgcgaccacggugaucacccccaugcugcgccacaccaucgagaacaccacggccaacaugagccucaccgccaucgccaaccaggccgcgauccugauggggcuggacaagggcuggcccaucuccaagauggacaucggggugccgcuccuggcccugggcugcuacagccaggucaaccccaugacccucaccgccgccgugcugaugcugguggcccacuacgcgaucaucggccccgggcuccaggccaaggccacgcgggacgcccagaagcgcaccgcggccggcaucaugaagaaccccaccgucgacgggaucguggccaucgaccuggacccgguggucuacgacaccaaguucgagaagcagcugggccagaucaugcuccugauccugugcacgucccagauccuccugaugcggaccaccugggccuucugcgagagcaucacccuggccacgggcccccucaccacccugugggaggggucccccggcaaguucuggaacaccacgaucgcggugagcauggccaacaucuuccgcggguccuaccuggccggcgccgggcucgccuucagccugaugaagucccugggcggcaaccgccgggggaccggcgcgcagggggagacccucggcgagaaguggaagcgccagcugaaccagcugagcaagcucgaguucaacaccuacaagcggagcgggaucauggagguggaccgcacggaggccaaggagggccugaagcggggcgagaccacccgccacgccgucucccgggggaccgccaagcugcgcugguucguggagcggaaccuggugaagcccgagggcaaggucaucgaccucgggugcggccgcgggggcuggagcuacuacugcgccggccugaagaaggugacggaggugaagggguacaccaagggcgggccgggccacgaggagcccauccccauggcgaccuacggguggaaccuggucaagcuccacuccggcaaggacguguucuucaucccgcccgagaagugcgacacccugcugugcgacaucggcgagagcucccccaaccccaccaucgaggaggggcggacgcuccgcgugcugaagauggucgagcccuggcugcggggcaaccaguucugcaucaaggugcucaacccguacaugcccagcguggucgagacccuggagcgcaugcagcggaagcacgggggcaugcuggugcgcaacccccucucccggaacagcacccacgagauguacuggguguccugcggcaccgggaacaucgucagcgccgugaacaugacgucccgcaugcugcugaaccgguucaccaugacccaccgcaagcccaccuacgagaaggacgucgaccucggcgccgggacgcgccacguggccguggagccggaggucgcgaaccuggacaucaucggccagcggaucgagaacaucaagaacgagcacaagagcaccuggcacuacgacgaggacaaccccuacaagaccugggccuaccacggguccuacgaggugaagcccagcggcuccgccagcuccauggugaacggcgucgugcgccugcucaccaagcccugggacgugaucccgauggucacgcagaucgccaugaccgacaccacccccuucgggcagcagcggguguucaaggagaagguggacacgcgcacccccaaggccaagcggggcaccgcgcaggucauggagaucaccgccggguggcuguggaaguuccugagccgcaagaagaagccgcggaucugcacgcgcgaggaguucacccggaaggugcgcuccaacgccgccaucggcgccguguucgucgacgagaaccaguggaacagcgcgaaggaggccguggacgacgagcgguucugggaccucgugaaccgcgagcgggagcugcacaagcaggggaagugcgcgaccugcgucuacaacaugaugggcaagcgcgagaagaagcugggcgaguucgggaaggccaagggcagccgggccaucugguacauguggcucggggcgcgcuuccuggaguucgaggcccugggcuucaugaacgaggaccacugguucucccgggacaacagccucuccgggguggagggcgagggccugcacaagcugggguacauccuccgcgacaucgcccggauccccggcgggaacauguacgccgacgacaccgcgggcugggacacgcgcaucaccgaggaggaccugcagaacgaggcccgggugaccgagcugauggagcccgaccacgcccagcucgccaccagcaucuuccgccugacguaccagaacaaggucgugcgcgugcagcggcccggcaagaacgggaccgucauggacgugaucucccgccgggaccagcgcggcagcggccaggugggcaccuacgggcugaacaccuucacgaacauggaggcccagcucauccggcagauggaguccgagggcgucuucagcccguccgagcuggagacccccaaccuggcgaaccgcgugcucgacuggcuggagaaguacggcguggagcggcugaagcgcauggccaucagcggggacgacugcgucgugaagcccaucgacgaccgguucgccaccgcccucaccgcccugaacgacaugggcaaggugcgcaaggacaucccccagugggagccgucccggggguggaacgacuggcagcagguccccuucugcagccaccacuuccaccagcugaucaugaaggacggccgcgagaucguggugcccugccggaaccaggacgagcucgucgggcgcgcgcgggugucccagggcgccggcuggagccugcgcgagacggccugccuggggaaguccuacgcccagauguggcagcucauguacuuccaccggcgcgaccugcggcuggccgcgaacgccaucugcagcgccgugcccgucgacugggugccgaccucccgcaccaccuggagcauccacgcccaccaccaguggaugaccacggaggacaugcucagcguguggaaccgcgucuggaucgaggagaaccccuggauggaggacaagacccacgugaccuccugggaggacgugcccuaccugggcaagcgggaggaccaguggugcgggagccugaucggccucuccgcccgcgcgaccugggccaucaacauccaggucgccaucaaccaggugcggaagcugaucgggaacgagcacuaccaggacuacaugacgagcaugcgccgguucaagaacgaguccgagcccgagggcgcccugugguga

SEQ ID NO: 8985 - RNA, 9879 nt, Artificial Sequence
  derived and/or modified CDS sequence (opt1) from DENV-1__DQ285561__SS-prME
agcgugaccaugcugcucaugcugcugcccaccgcccucaccuuccaccugaccacccggggcggggagccccacaugaucgugggcaagcaggagcggggcaagagccuccuguucaagaccagcgccggggugaacaugugcacccugaucgcgauggaccugggggagcucugcgacgacaccaugaccuacaagugcccccgcaucaccgagaccgagcccgacgacguggacugcuggugcaacgccaccgagaccugggugaccuacggcacgugcagccagaccggcgagcaccggcgcgacaagcggagcguggcccuggcgccccacguggggcugggccucgagacccgcaccgagacguggauguccagcgagggggccuggcggcagauccagaagguggagaccugggcccugcgccaccccggcuucaccgugaucgcccuguuccucgcccacgccaucgggaccuccaucacgcagaagggcaucaucuucauccugcugaugcucgugacccccagcauggcgaugcggugcgucggcaucgggaaccgcgacuucguggagggccuguccggggccaccuggguggacgucgugcuggagcacggcagcugcgugaccacgauggccaaggacaagcccacccucgacaucgagcugcugaagaccgaggucaccaaccccgccgugcuccggaagcugugcaucgaggccaagaucuccaacacgaccaccgacagccgcugcccgacccagggcgaggcgacgcugguggaggagcaggacaccaacuucgucugccggcgcaccuucguggaccggggguggggcaacgggugcggccucuucgggaagggcucccugaucacgugcgccaaguucaagugcgugacgaagcuggagggcaagaucguccaguacgagaaccucaaguacagcgugaucgugaccguccacaccggggaccagcaccaggugggcaacgagaccaccgagcacgggacgaucgccaccaucacgccccaggcccccaccuccgagauccagcugacggacuacggcgcccugacccucgacugcagcccccgcaccgggcuggacuucaacgagaugguccugcucaccaugaaggagaaguccuggcuggugcacaagcagugguuccuggaccucccgcugcccuggacgagcggcgcguccaccagccaggagaucuggaaccggcaggaccugcucgugaccuucaagaccgcccacgccaagaagcaggaggucguggugcugggcagccaggagggggccaugcacacggcccugaccggcgcgaccgagauccagaccuccgggacgaccaccaucuucgccggccaccucaagugccgccugaagauggacaagcugacccucaaggggaucagcuacgucaugugcacgggcuccuucaagcuggagaaggagguggccgagacccagcacggcaccgugcugguccaggugaaguacgaggggaccgacgcccccugcaagauccccuucagcucccaggacgagaagggcgugacgcagaacgggcggcuggucaccgccaacccgaucgugaccgacaaggagaagcccgugaacaucgaggcggagccgcccuucggcgagagcuacaucgucgugggcgccggggagaaggcccucaagcuguccugguucaagaagggcagcuccaucgggaagauguucgaggccaccgcgcgcggcgcccggcgcauggccauccugggggacacggccugggacuucggcagcaucggcgggguguucaccuccgucggcaagcucgugcaccagaucuucgggaccgccuacggcgugcuguucagcggggucuccuggaccaugaagaucggcaucggcauccugcucacguggcuggggcugaacagccgcuccaccagccucuccaugaccugcaucgcggugggcaugaucacccuguaccugggggugaugguccaggccgacagcggcugcgugaucaacuggaaggggcgggagcucaagugcggcuccggcaucuucgugacgaacgagguccacaccuggaccgagcaguacaaguuccaggccgacagcccgaagcgccugagcgccgccaucgggaaggcgugggaggagggcgugugcgggauccgguccgccacccgccuggagaacaucauguggaagcagaucagcaacgagcucaaccacauccugcuggagaacgacaugaaguucaccguggucgugggcgacguguccgggauccucgcccagggcaagaaguccauccggccccagcccauggagcacaaguacuccuggaaguccuggggcaaggccaagaucaucggggccgacguccagaacacgaccuucaucaucgacggccccaacaccccggagugccccgacgaccagcgcgcguggaacaucugggagguggaggacuacggguucggcaucuucaccacgaacaucuggcugaagcugcgggacuccuacacccaggugugcgaccaccgccucaugagcgccgccaucaaggacuccaaggccguccacgcggacaugggcuacuggaucgagagcgagaagaacgagaccuggaagcuggcccgggccuccuucaucgaggugaagaccugcaucuggcccaagagccacacgcugugguccaacggggugcucgagagcgagaugaucauccccaagaucuacggcgggccgaucucccagcacaacuaccgccccggcuacuucacccagaccgccgggcccuggcaccugggcaagcuggagcucgacuucgaccugugcgagggcaccacggucgugguggacgagcacugcgggaaccggggcccgagccugcgcaccaccaccgucacggggaagaucauccacgaguggugcugccgguccugcacccugccgccccugcgcuucaagggcgaggacgggugcugguacggcauggagauccggcccgugaaggagaaggaggagaaccuggucaagagcauggucagcgccggcuccggggagguggacagcuucucccucggccugcugugcaucagcaucaugaucgaggaggugaugcgcucccgguggagccgcaagaugcucaugaccgggacccuggcggucuuccugcuccugacgaugggccagcugaccuggaacgaccucauccggcugugcaucauggugggggccaacgccuccgacaacaugggcaugggcaccaccuaccuggcccucauggccacguuccgcaugcgcccgauguucgcgguggggcugcuguuccggcgccucaccagccgggagguccugcugcucaccgugggccugucccuggucgccagcguggagcuccccaacucccuggaggagcugggggacggccucgccaugggcaucaugauccugaagcugcucaccgacuuccagagccaccagcugugggccacgcugcucucccugaccuucgugaagaccaccuucagccugcacuacgccuggaagacgauggcgaugauccucuccaucgucagccuguucccccugugccucuccaccaccagccagaagaccacguggcugcccgugcugcucgggucccugggcugcaagccgcugaccauguuccucaucaccgagaacaagaucugggggcgcaagagcuggccccugaacgagggcaucauggccguggggaucgucagcauccugcucuccagccugcugaagaacgacgugccccucgccggcccccugaucgccggcgggaugcugaucgcgugcuacgugaucuccggcagcuccgccgaccucagccuggagaaggccgccgaggucuccugggaggaggaggccgagcacagcggggcgucccacaacauccugguggagauccaggacgacggcaccaugaagaucaaggacgaggagcgggacgacaccaucacgauccuccugaaggccacccugcucgccaucagcgggguguacccgauguccauccccgccacccuguucgucugguacuucuggcagaagaagaagcagcgcagcggcgugcugugggacacccccagcccgcccgagguggagcgggccguccucgacgacggcaucuaccgcauccugcagcgggggcugcugggccgcagccaggugggggugggcgucuuccaggaggggguguuccacacgauguggcacgugacccggggcgcgguccucauguaccagggcaagcgccuggagcccuccugggccagcgugaagaaggaccugaucuccuacgggggcggguggcgguuccagggcagcuggaacaccggggaggaggugcaggucaucgccguggagcccggcaagaaccccaagaacgugcagaccgcccccggcacguucaagaccuccgagggggaggucggcgccaucgcgcucgacuucaagcccgggaccagcggcagccccaucgugaaccgcgagggcaagaucguggggcuguacggcaacggggucgugaccacguccggcaccuacgugagcgccaucgcccaggccaaggccucccaggaggggccccugccggagaucgaggacgaggucuuccggaagcgcaaccucaccaucauggaccugcaccccggcagcggcaagacccggcgcuaccugcccgcgaucgugcgggaggccaucaagcgcaagcuccggacgcuggugcuggccccgacccgcgucguggccuccgagauggcggaggcccucaaggggaugcccauccgcuaccagaccaccgccgucaagagcgagcacacgggccgggagaucgucgaccugaugugccacgccaccuucaccaugcgccugcucucccccgugcgggugcccaacuacaacaugaucaucauggacgaggcccacuucaccgacccggcgagcaucgccgcccgcggguacaucuccacgcgggucggcaugggggaggccgccgcgaucuucaugaccgccacgccgcccggcagcguggaggccuucccccaguccaacgccgugauccaggacgaggagaaggacaucccggagcgcagcuggaacuccggcuacgacuggaucaccggguuccccggcaagacggucugguucgugcccagcaucaaguccgggaacgacaucgccaacugccugcggaagaacggcaagcgcgugauccagcugagccggaagaccuucgacaccgaguaccagaagaccaagaacaacgacugggacuacgucgugacgaccgacaucuccgagaugggggcgaacuuccgcgccgaccgggugaucgacccccgccggugccucaagccggucauccugaaggacggccccgagcgcgugauccuggccggccccaugcccgucaccguggccagcgcggcccagcggcgcgggcggaucggccgcaaccagaacaaggagggggaccaguacaucuacaugggccagccgcucaacaacgacgaggaccacgcccacuggaccgaggccaagaugcugcuggacaacaucaacacgcccgaggggaucauccccgcccucuucgagcccgagcgggagaaguccgcggccaucgacggcgaguaccgccugcgcggcgaggcccggaagaccuucguggagcugaugcgccgcggggaccucccggucuggcugagcuacaagguggccagcgagggcuuccaguacuccgaccgccgguggugcuucgacggggagcgcaacaaccaggugcuggaggagaacauggacgucgagaucuggaccaaggagggcgagcggaagaagcuccgcccccgguggcuggacgcccgcaccuacagcgacccccuggcgcuccgggaguucaaggaguucgccgccggccgccgguccgugagcggggaccugauccuggagaucggcaagcucccccagcaccugacgcagcgcgcccagaacgcccuggacaaccucgugaugcugcacaacuccgagcagggcgggaaggcguaccggcacgccauggaggagcugccggacaccaucgagacccucaugcugcuggcccucaucgccguccugaccgggggcgugacccuguucuuccucagcggccgcgggcugggcaagacguccaucgggcugcucugcgugaugagcuccagcgcgcugcuguggauggccuccgucgagccccacuggaucgccgccagcaucauccucgaguucuuccugauggugcugcucauccccgagcccgaccggcagcgcaccccgcaggacaaccagcuggccuacguggucaucggccuccucuucaugauccugaccguggcggccaacgagauggggcugcucgagaccacgaagaaggaccugggcaucggccacgccgccgccgagaaccaccaccacgcggccaugcuggacguggaccuccaccccgccuccgccuggacccuguacgccgucgcgaccaccaucaucacgcccaugaugcggcacaccaucgagaacaccaccgccaacaucagccugacggccaucgccaaccaggccgcgauccucauggggcuggacaagggcuggccgaucuccaagauggacaucggggugccccugcucgcccugggcugcuacagccaggugaacccccugacccucaccgccgccguccugaugcugguggcgcacuacgccaucaucgggcccggccuccaggccaaggccacccgcgaggcccagaagcggacggcggccggcaucaugaagaacccgaccguggacgggaucgucgccaucgaccuggaccccgugguguacgacgccaaguucgagaagcagcugggccagaucaugcuccugauccugugcaccucccagauccuccugaugcgcaccacgugggcccugugcgagagcaucacccucgcgaccgggccccugaccacgcugugggagggcucccccggcaaguucuggaacaccaccaucgccgucagcauggccaacaucuuccgcgggagcuaccucgccggcgccgggcuggcguucucccugaugaagucccucggcgggggccggcgcggcaccggggcccagggcgagacgcugggggagaaguggaagcggcagcugaaccagcucuccaagagcgaguucaacaucuacaagcgcuccggcaucguggagguggaccggagcgaggccaaggaggggcugaagcgcggcgagaccaucaagcacgccgucucccggggcaccgcgaagcugcgcugguucguggagcggaaccucgugaagccggaggggaaggucaucgaccugggcugcgggcgcggcggguggagcuacuacugcgccggccugaagaaggugaccgaggugaagggcuacacgaagggcgggcccgggcacgaggagcccauccccauggccaccuacggcuggaaccuggucaagcucuacuccgggaaggacguguucuucaucccgcccgagaagugcgacacccugcugugcgacaucggcgagagcucccccaaccccaccaucgaggagggccggacgcuccgcgugcugaagauggucgagccguggcugcgggggaaccaguucugcaucaagauccucaaccccuacaugcccagcgugguggagacccuggagcagaugcagcgcaagcacggcgggaugcugguccggaacccccucucccgcaacagcacccacgagauguacuggguguccugcggcaccggcaacaucgugagcgccgucaacaugaccucccggaugcugcugaaccgcuucacgauggcccaccggaagccgaccuacgagcgcgacguggaccucggggcgggcacccgccacguggccgucgagcccgagguggccaaccuggacaucaucgggcagcggaucgagaacaucaagaacgagcacaagagcaccuggcacuacgacgaggacaaccccuacaagacgugggccuaccacggcuccuacgaggugaagcccagcgggagcgccuccagcauggucaacggcgugguccgccugcucaccaagccgugggacgugauccccauggugacccagaucgcgaugaccgacacgacccccuucggccagcagcgggucuucaaggagaagguggacacccgcacccccaaggccaagcgggggacggcccagaucauggaggugaccgccaaguggcuguggggcuuccugucccgcaacaagaagccgcggaucugcacccgcgaggaguucacccggaagguccgcagcaacgccgcgaucggggccguguucguggacgagaaccaguggaacuccgccaaggaggccgucgaggacgagcgguucugggaccucgugcgccgggagcgcgagcugcacaagcagggcaagugcgcgacgugcguguacaacaugauggggaagcgggagaagaagcugggcgaguucggcaaggccaaggggagccgcgccaucugguacauguggcucggcgcccgguuccuggaguucgaggcccugggguucaugaacgaggaccacugguucucccgcgagaacagccucuccggcgucgagggggagggccugcacaagcugggcuacauccuccgggacaucagcaagauccccgggggcaacauguacgcggacgacaccgccgggugggacacccgcaucaccgaggacgaccugcagaacgaggccaagaucacggacaucauggagcccgagcacgcccugcucgccaccuccaucuucaagcugaccuaccagaacaagguggugcggguccagcgcccggcgaagaacggcaccgugauggacgugaucagccgccgggaccagcgcggcuccgggcaggucggcacguacgggcugaacaccuucaccaacaugggcgcccagcucauccggcagauggagagcgaggggaucuucucccccagcgagcuggagacccccaaccuggccggccgcgugcucgacuggcuggagaagcacggcaucgagcggcugcgccggauggccaucuccggggacgacugcguggucaagcccaucgacgaccgcuucgccacggcgcucaccgcccugaacgacaugggcaaggugcggaaggacaucccgcagugggagcccagcaagggguggaacgacuggcagcagguccccuucugcagccaccacuuccaccagcugaucaugaaggacggccgcgagaucgucgugcccugccggaaccaggacgagcucguggggcgcgcccgggucucccagggcgccggcuggagccugcgcgagaccgccugccuggggaaguccuacgcgcagauguggcagcucauguacuuccaccggcgcgaccugcggcuggccgccaacgccaucugcagcgcggugccgguggacuggguccccaccucccgcacgaccuggagcauccacgcccaccaccaguggaugaccaccgaggacaugcucuccguguggaaccggguguggaucgaggagaaccccuggauggaggacaagacgcacgucagcuccugggaggacgugcccuaccugggcaagcgcgaggaccaguggugcgggagccugaucggccucaccgcccgcgccaccugggccaccaacauccagguggcgaucaaccagguccggcgccugaucgggaacgagaacuaccuggacuacaugaccuccaugaagcgguucaagaacgagagcgacccggagggcgcccucugguga

SEQ ID NO: 8986 - RNA, 9879 nt, Artificial Sequence
  derived and/or modified CDS sequence (opt1) from DENV-1__DQ285562__SS-prME
agcgugaccaugcugcucaugcugcugcccaccgcccucgccuuccaccugaccacccgcggcggggagccccacaugaucgugagcaagcaggagcggggcaagagccuccuguucaagaccuccgcgggggugaacaugugcacccugaucgccauggaccugggcgagcucugcgaggacaccaugaccuacaagugcccccgcaucaccgaggccgagcccgacgacguggacugcuggugcaacgccaccgacacgugggugaccuacgggaccugcagccagaccggcgagcaccggcgcgacaagcgguccguggcccuggcgccccacgugggccuggggcucgagacgcgcaccgagaccuggaugagcuccgagggcgccuggcggcagauccagaaggucgagaccugggcccugcgccaccccggguucacggugaucgcccuguuccucgcgcacaccaucggcaccagcaucacccagaaggggaucaucuucauccugcugaugcucgugacgcccuccauggccaugcggugcgucggcaucggcaaccgcgacuucguggaggggcugagcggcgccaccuggguggacgucgugcuggagcacggguccugcgugaccaccauggccaagaacaagcccacgcucgacaucgagcugcugaagaccgaggucaccaaccccgccgugcuccggaagcugugcaucgaggcgaagaucagcaacaccacgaccgacucccgcugccccacccagggcgaggccacccugguggaggagcaggacgccaacuucgucugccggcgcacguucguggaccggggcugggggaacggcugcggccucuucggcaaggggagccugcugaccugcgccaaguucaagugcgugaccaagcucgagggcaagaucguccaguacgagaaccugaaguacuccgugaucgugaccguccacacgggcgaccagcaccagguggggaacgagaccaccgagcacggcaccaucgccaccaucacgccccaggcgcccaccagcgagauccagcugaccgacuacggggcccucacccuggacugcagcccccggacgggccuggacuucaacgagaugguccuccugaccaugaaggagaaguccuggcuggugcacaagcagugguuccucgaccugccgcugcccuggaccuccggggccagcaccagccaggagacguggaaccggcaggaccuccuggugaccuucaagaccgcccacgccaagaagcaggaggucguggugcugggcucccaggagggcgcgaugcacaccgcccucacgggggccaccgagauccagaccagcggcaccacgaccaucuucgccgggcaccugaagugccgccugaagauggacaagcucacccugaagggcgucuccuacgugaugugcaccgggagcuucaagcuggagaaggagguggccgagacgcagcacggcaccguccugguccaggugaaguacgagggcaccgacgcgcccugcaagauccccuucuccacccaggacgagaagggggucacgcagaacggccggcucaucaccgccaacccgaucgugaccgacaaggagaagcccgugaacaucgagaccgagccgcccuucggggagagcuacaucgucaucggcgccggcgagaaggcccugaagcuguccugguucaagaaggggagcuccaucggcaagauguucgaggcgacggcccgcggggcccggcgcauggccauccucggcgacaccgccugggacuucgggagcaucggcggcguguucaccuccguggggaagcugguccaccagguguucggcaccgcguacggggugcuguucagcggcgucuccuggacgaugaagaucgggaucggcauccuccugaccuggcugggccucaacagccgcuccaccagccuguccaugaccugcaucgugguggggauggucacgcuguaccucggcgugauggugcaggccgacagcgggugcgucaucaacuggaagggccgggagcugaagugcggguccggcaucuucgugaccaacgaggugcacaccuggaccgagcaguacaaguuccaggccgacagcccgaagcgccugagcgccgccaucggcaaggcgugggaggagggggucugcggcauccgguccgccacccgccucgagaacaucauguggaagcagaucagcaacgagcugaaccacauccugcucgagaacgacaugaaguucacggugguggucggggacgccaacggcauccugacccaggggaagaagaugauccggccccagcccauggagcacaaguacuccuggaaguccuggggcaaggccaagaucaucggcgccgacauccagaacaccaccuucaucaucgacgggcccgacacgccggagugccccgacgaccagcgcgcguggaacaucugggagguggaggacuacggcuucgggaucuucaccaccaacaucuggcugaagcuccgggacuccuacacccagaugugcgaccaccgccugaugagcgccgccaucaaggacuccaaggccgugcacgcggacaugggcuacuggaucgagagcgagaagaacgagacguggaagcuggcccgggccuccuucaucgaggucaagaccugcaucuggccccgcagccacacccucugguccaacggcgugcuggagagcgagaugaucauccccaagaucuacgggggcccgaucucccagcacaacuaccggcccggguacuucacccagacggccggccccuggcaccuggggaagcucgagcuggacuucgaccugugcgagggcaccaccguggucguggacgagcacugcggcaaccgcgggccgagccuccggaccacgaccgugaccggcaagaucauccacgaguggugcugccgcuccugcacccugccgccccugcgguucaagggggaggacggcugcugguacgggauggagauccgccccgucaaggagaaggaggagaaccucgugcggagcaugguguccgccggcagcggcgaggucgacagcuucucccuggggcugcucugcgugagcaucaugguggaggaggucaugcgcucccgguggagccgcaagaugcugaugacgggcacccuggcgguguucuuccuccugaucauggggcagcugaccuggaacgaccucauccgccugugcaucauggugggcgccaacgucuccgaccggauggggaugggcaccacguaccuggcccucauggccaccuucaagaugcgcccgauguucgccguggggcugcuguuccggcgccucaccagccgggagguccugcugcucaccaucgggcugucccugguggcgagcguggagcuccccaacucccuggaggagcugggcgacgggcucgccaugggcaucaugaugcugaagcugcucacggacuuccagagccaccagcuguggaccacccugcucucccugaccuucaucaagacgacccugagccucgacuacgccuggaagaccaucgccaugguccuguccaucgugagccuguucccccucugccuguccaccacgagccagaagaccaccuggcugcccgugcuccugggcuccuucgggugcaagccgcugaccauguuccucaucaccgagaacaagaucuggggccgcaagagcuggccccugaacgaggggaucauggccgucggcaucguguccauccugcucagcagccugcugaagaacgacgugccccucgcggggccccugaucgccggcggcaugcugaucacgugcuacgucaucuccgggagcuccgccgaccucagccuggagaaggccgcggagguguccugggaggaggaggccgagcacagcggcgccucccacaacauccugguggagguccaggacgacgggaccaugaagaucaaggacgaggagcgggacgacacccucaccauccugcugaaggccacgcuccuggccgugagcggcguguacccgauguccauccccgcgacccuguucgucugguacuucuggcagaagaagaagcagcgcagcggggugcucugggacacccccagcccgcccgagguggagcgggccguccuggacgacggcaucuaccgcauccugcagcggggccugcucgggcgcagccaggugggcgugggggucuuccaggacggcguguuccacaccauguggcacgugacgcgcggggccguccugauguaccagggcaagcgccuggagcccuccugggccagcgugaagaaggaccucaucuccuacggcgggggcuggcgguuccaggggagcuggaacaccggcgaggaggugcaggucaucgccguggagcccgggaagaaccccaagaacgugcagaccacccccggcacguucaagacccccgagggcgaggucggggcgaucgcccuggacuucaagcccggcaccuccgggagccccaucgugaaccgcgagggcaagaucgugggccuguacgggaacggcgucgugaccacguccgggaccuacgugagcgccaucgcccaggccaaggcgagccaggagggcccgcuccccgagaucgaggacgaggucuucaagaagcggaaccugaccaucauggaccugcaccccggguccggcaagacccgccgguaccucccggccaucgugcgcgaggccaucaagcggaagcugcgcacgcugauccucgcccccacccgcguggucgccagcgagauggcggaggcccugaagggcaugcccauccgguaccagaccaccgccgugaaguccgagcacacggggcgcgagaucguggaccugaugugccacgccaccuucaccaugcggcuccugagccccguccgcgugccgaacuacaacaugaucaucauggacgaggcgcacuucaccgaccccgccuccaucgccgcccggggcuacaucagcacgcgcguggggaugggcgaggccgcggccaucuucaugaccgccacgccgcccggguccgucgaggccuucccgcagagcaacgccgugauccaggacgaggagcgggacauccccgagcgcuccuggaacagcggcuacgacuggaucaccgacuuccccggcaagacggugugguucguccccuccaucaagagcgggaacgacaucgcgaacugccugcggaagaacggcaagcgcgugauccagcucucccggaagaccuucgacaccgaguaccagaagaccaagaacaacgacugggacuacguggucacgaccgacaucagcgagaugggggccaacuuccgcgccgaccgggugaucgacccgcgccggugccugaagcccgucauccugaaggacggccccgagcgcgugauccucgccgggcccaugccggugaccgucgccuccgcggcccagcggcgcggccggaucggccgcaaccagaacaaggagggggaccaguacaucuacaugggccagccccugaacaacgacgaggaccacgcccacuggaccgaggccaagaugcugcucgacaacaucaacacgcccgaggggaucauccccgcgcuguucgagccggagcgcgagaaguccgccgccaucgacggcgaguaccggcugcgcggggaggcccggaagaccuucguggagcucaugcgccggggcgaccugcccguguggcuguccuacaaggucgccagcgagggcuuccaguacuccgaccgccgguggugcuucgacggggagcgcaacaaccaggugcucgaggagaacauggacguggagaucuggaccaaggagggcgagcggaagaagcugcgcccccgguggcuggacgcgcgcaccuacagcgacccccucgcccugcgggaguucaaggaguucgccgccgggcgccggagcgucuccggcgaccugauccucgagaucggcaagcugccgcagcaccugacccuccgcgcccagaacgcgcuggacaaccuggugaugcuccacaacagcgagcagggcgggaaggccuaccggcacgccauggaggagcugcccgacacgaucgagacccugaugcuccuggcccugaucgccgugcucaccgggggcgucacccuguucuuccuguccgggaagggccucggcaagacgagcaucgggcugcugugcgugauggcguccagcgugcuccuguggauggccuccgucgagccccacuggaucgccgccagcaucauccuggaguucuuccucauggugcugcugauccccgagccggaccgccagcggacgccccaggacaaccagcucgcguacguggucaucggccugcuguucaugauccucaccguggccgccaacgagauggggcugcuggagaccacgaagaaggaccucggcaucgggcacgccguggccgagaaccaccaccacgcgaccaugcuggacaucgaccugcaccccgccuccgccuggacccucuacgccgucgccaccacgaucaucaccccgaugaugcgccacaccaucgagaacaccacggcgaacaucagccugaccgccaucgccaaccaggccgccauccugaugggccucgacaagggcuggcccaucuccaagauggacaucggggugccccugcuggcgcucggcugcuacagccaggugaacccccugacccugaccgccgccguccucaugcugguggcccacuacgccaucaucgggccgggccugcaggcgaaggccacgcgggaggcccagaagcgcaccgccgcggggaucaugaagaaccccaccguggacggcaucgucgccaucgaccucgaccccgugguguacgacgccaaguucgagaagcagcugggccagaucaugcugcucauccugugcaccucccagauccugcucaugcgcacgaccugggcccugugcgagagcaucacccuggccaccgggccccucacgacccugugggagggcuccccggggaaguucuggaacaccaccaucgcggucagcauggccaacaucuuccggggcuccuaccuggccggcgccgggcucgccuucagccugaugaagucccugggcgggggccgccgggggacgggcgcgcagggcgagacccucggggagaaguggaagcgccagcugaaccagcugagcaagagcgaguucaacaccuacaagcgguccggcaucauggagguggaccgcagcgaggccaaggaggggcucaagcggggcgagaccacgaagcacgccgugucccgcgggaccgccaagcugcggugguucgucgagcgcaaccuggugaagcccgagggcaaggugaucgaccugggcugcgggcggggcggguggagcuacuacugcgccggccucaagaaggucaccgaggugaagggguacaccaagggcggccccgggcacgaggagcccaucccgauggcgaccuacggcuggaaccuggugaagcugcacuccgggaaggacgucuucuucacgccgcccgagaagugcgacacccuccugugcgacaucggcgagagcucccccaacccgaccaucgaggaggggcgcacccugcgggugcucaagaugguggagcccuggcugcgcggcaaccaguucugcaucaagauccugaaccccuacaugcccagcgucguggagacgcucgagcagaugcagcggaagcacggcgggaugcuggugcgcaacccgcugucccggaacagcacccacgagauguacugggucuccugcggcaccgggaacaucgugagcgccgugaacaugaccucccgcaugcuccugaaccgguucacgauggcccaccgcaagcccaccuacgagcgcgacgucgaccugggcgccggcacccggcacguggcgguggagcccgagaucgccaaccucgacaucaucgggcagcgcaucgagaacaucaagaacgagcacaagagcaccuggcacuacgacgaggacaaccccuacaagacgugggccuaccacggcuccuacgaggucaagccgagcggguccgccagcuccauggugaacggcgucgugcggcugcugaccaagcccugggacgugauccccauggucacccagaucgccaugaccgacacgacccccuucgggcagcagcgcguguucaaggagaagguggacacccggaccccgcgccccaagcggggcacggcgcagaucauggaggucaccgccaaguggcucuggggcuuccugagccgcaacaagaagccccggaucugcacccgcgaggaguucacccggaaggugcgcagcaacgccgccaucggggccguguucgucgacgagaaccaguggaacuccgcgaaggaggccguggaggacgagcgguucugggaccuggugcaccgcgagcgggagcuccacaagcagggcaagugcgccacgugcgucuacaacaugauggggaagcgcgagaagaagcugggcgaguucgggaaggccaagggcagccgggccaucugguacauguggcugggcgcgcgcuuccucgaguucgaggcccugggguucaugaacgaggaccacugguucucccgggagaacagccuguccggcguggagggggagggccuccacaagcugggguacauccugcgcgacaucagcaagaucccgggcggcaacguguacgccgacgacaccgccgggugggacacccggaucaccgaggacgaccuccagaacgaggcgaagaucacggacaucauggagcccgagcacgcccugcuggccaccuccaucuucaagcucaccuaccagaacaaggucgugcgcgugcagcgccccgccaagagcggcaccgucauggacaucaucucccggcgcgaccagcgggggagcggccaggugggcacguacgggcugaacaccuucaccaacauggaggugcagcugauccgccagauggaguccgagggcaucuucagccccuccgagcucgagaacagcaaccuggccgagcggguccuggacuggcucgagaagcacgggguggagcgccugaagcggauggcgaucuccggcgacgacugcguggucaagccgaccgacgaccgcuucgccacggcccugaccgcccucaacgacauggggaaggugcggaaggacaucccccagugggagcccagcaagggcuggaacgacuggcagcagguccccuucugcucccaccacuuccaccagcugaucaugaaggacggccgcgagaucgucgugccgugccggaaccaggacgagcugguggggcgcgcccgggucagccagggcgcgggguggagccuccgcgagaccgccugccugggcaaguccuacgcccagauguggcagcugauguacuuccaccggcgcgaccuccggcuggccgccaacgcgaucugcagcgccgugcccguggacuggguccccaccucccgcaccacguggagcauccacgcccaccaccaguggaugaccaccgaggacaugcuguccguguggaaccggguguggaucgaggagaaccccuggauggaggacaagacccacgucagcuccugggaggacgugccguaccucgggaagcgcgaggaccaguggugcggcagccugaucggccugacggcccgcgccaccugggcgaccaacauccagguggccaucaagcagguccggcgccucaucgggaacgagaacuaccuggacuacaugaccuccaugaagcgguucaagaacgagagcgaccccgagggcgcccugugguga

SEQ ID NO: 8987 - RNA, 9879 nt, Artificial Sequence
  derived and/or modified CDS sequence (opt1) from DENV-1__DQ285558__SS-prME
agcgugaccaugcugcucaugcugcugcccaccgcccucaccuuccaccugaccacccgcggcggggagccccacaugaucgugggcaagcaggagcggggcaagagccugcuguucaagaccagcgccggggugaacaugugcacccugaucgcgauggaccugggggagcucugcgacgacaccaugaccuacaagugcccccgcaucaccgagacggagcccgacgacguggacugcuggugcaacgccaccgagaccugggugaccuacggcacgugcagccagaccggcgagcaccggcgcgacaagcggagcguggcccuggcgccccacguggggcugggccucgagacccgcaccgagacguggauguccagcgagggggccuggcggcagauccagaagguggagaccugggcccugcgccaccccggcuucaccgugaucgcccuguuccucgcccacgccaucgggaccuccaucacgcagaagggcaucaucuucauccugcugaugcucgugacccccagcauggcgaugcggugcgucggcaucgggaaccgcgacuucguggagggccuguccggggccaccuggguggacgucgugcuggagcacggcagcugcgugaccacgauggccaaggacaagcccacccucgacaucgagcugcugaagaccgaggucaccaaccccgccgugcuccggaagcugugcaucgaggccaagaucuccaacacgaccaccgacagccgcugcccgacccagggcgaggcgacgcugguggaggagcaggacaccaacuucgucugccggcgcaccuucguggaccggggguggggcaacgggugcggccucuucgggaagggcucccugaucacgugcgccaaguucaagugcgugacgaagcuggagggcaagaucguccaguacgagaaccucaaguacagcgugaucgugaccguccacaccggggaccagcaccaggugggcaacgagaccaccgagcacgggacgaucgccaccaucacgccccaggcccccaccuccgagauccagcugacggacuacggcgcccugacccucgacugcagcccccgcaccgggcuggacuucaacgagaugguccugcucaccaugaaggagaaguccuggcuggugcacaagcagugguuccuggaccucccgcugcccuggacgagcggcgcguccaccagccaggagaccuggaaccggcaggaccugcucgugaccuucaagacggcccacgccaagaagcaggaggucguggugcugggcagccaggagggggccaugcacaccgcccugaccggcgcgaccgagauccagacguccgggaccaccaccaucuucgccggccaccucaagugccgccugaagauggacaagcugacgcucaaggggaucagcuacgucaugugcaccggcuccuucaagcuggagaaggagguggccgagacccagcacggcaccgugcugguccaggugaaguacgaggggacggacgcccccugcaagauccccuucagcucccaggacgagaagggcgugacccagaacgggcggcuggucaccgccaacccgaucgugaccgacaaggagaagcccgugaacaucgaggcggagccgcccuucggcgagagcuacaucgucgugggcgccggggagaaggcccucaagcuguccugguucaagaagggcagcuccaucgggaagauguucgaggccacggcgcgcggcgcccggcgcauggccauccugggggacaccgccugggacuucggcagcaucggcgggguguucaccuccgucggcaagcucgugcaccagaucuucgggaccgccuacggcgugcuguucagcggggucuccuggacgaugaagaucggcaucggcauccugcucaccuggcuggggcugaacagccgcuccaccagccucuccaugaccugcaucgcggugggccugaucacgcuguaccucggggugaugguccaggccgacagcggcugcgugaucaacuggaaggggcgggagcugaagugcggcuccggcaucuucgugaccaacgagguccacaccuggaccgagcaguacaaguuccaggccgacagcccgaagcgccugagcgccgccaucgggaaggcgugggaggagggcgugugcgggauccgguccgccacccgccucgagaacaucauguggaagcagaucagcaacgagcugaaccacauccugcucgagaacgacaugaaguucacgguggucgugggcgacguguccgggauccuggcccagggcaagaaguccauccggccccagcccauggagcacaaguacuccuggaaguccuggggcaaggccaagaucaucggggccgacguccagaacaccaccuucaucaucgacggccccaacaccccggagugccccgacgaccagcgcgcguggaacaucugggagguggaggacuacggguucggcaucuucacgaccaacaucuggcugaagcuccgggacuccuacacccaggugugcgaccaccgccugaugagcgccgccaucaaggacuccaaggccguccacgcggacaugggcuacuggaucgagagcgagaagaacgagaccuggaagcuggcccgggccuccuucaucgaggugaagacgugcaucuggcccaagagccacacccucugguccaacggggugcuggagagcgagaugaucauccccaagaucuacggcgggccgaucucccagcacaacuaccgccccggcuacuucacccagaccgccgggcccuggcaccugggcaagcucgagcuggacuucgaccugugcgagggcacgaccgucgugguggacgagcacugcgggaaccggggcccgagccuccgcaccaccacggucaccgggaagaucauccacgaguggugcugccgguccugcacccugccgccccugcgcuucaagggcgaggacgggugcugguacggcauggagauccggcccgugaaggagaaggaggagaaccucgucaagagcauggucagcgccggcuccggggagguggacagcuucucccugggccugcucugcaucagcaucaugaucgaggaggugaugcgcucccgguggagccgcaagaugcugaugaccgggacgcuggcggucuuccuccugcugaccaugggccagcucaccuggaacgaccugauccggcugugcaucauggugggggccaacgccuccgacaacaugggcaugggcaccacguaccucgcccugauggccaccuuccgcaugcgcccgauguucgcgguggggcuccuguuccggcgccugaccagccgggagguccugcuccugaccgugggccugucccucgucgccagcguggagcugcccaacucccuggaggagcucggggacggccuggccaugggcaucaugauccugaagcuccugacggacuuccagagccaccagcugugggccacccuccugucccugaccuucgugaagaccacguucagccuccacuacgccuggaagaccauggcgaugauccuguccaucgucagccuguucccccucugccuguccaccaccagccagaagacgaccuggcugcccgugcuccuggggucccugggcugcaagccgcucaccauguuccugaucaccgagaacaagaucugggggcgcaagagcuggccccugaacgagggcaucauggccguggggaucgucagcauccuccuguccagccugcucaagaacgacgugccccuggccggcccccugaucgccggcgggaugcucaucgcgugcuacgugaucuccggcagcuccgccgaccugagccuggagaaggccgccgaggucuccugggaggaggaggccgagcacagcggggcgucccacaacauccucguggagauccaggacgacggcaccaugaagaucaaggacgaggagcgggacgacacgaucaccauccugcugaaggccacccuccuggccaucagcgggguguacccgauguccauccccgccacccuguucgucugguacuucuggcagaagaagaagcagcgcagcggcgugcucugggacacgcccagcccgcccgagguggagcgggccguccuggacgacggcaucuaccgcauccugcagcgggggcugcucggccgcagccaggugggggugggcgucuuccaggaggggguguuccacaccauguggcacgugacccggggcgcgguccugauguaccagggcaagcgccuggagcccuccugggccagcgugaagaaggaccucaucuccuacgggggcggguggcgguuccagggcagcuggaacaccggggaggaggugcaggucaucgccguggagcccggcaagaaccccaagaacgugcagacggcccccggcaccuucaagaccuccgagggggaggucggcgccaucgcgcuggacuucaagcccgggaccagcggcagccccaucgugaaccgcgagggcaagaucguggggcuguacggcaacggggucgugacgaccuccggcaccuacgugagcgccaucgcccaggccaaggccucccaggaggggccccucccggagaucgaggacgaggucuuccggaagcgcaaccugaccaucauggaccugcaccccggcagcggcaagacgcggcgcuaccuccccgcgaucgugcgggaggccaucaagcgcaagcugcggacccuggugcucgccccgacccgcgucguggccuccgagauggcggaggcccugaaggggaugcccauccgcuaccagaccacggccgucaagagcgagcacaccggccgggagaucgucgaccugaugugccacgccaccuucaccaugcgccuccugucccccgugcgggugcccaacuacaacaugaucaucauggacgaggcccacuucacggacccggcgagcaucgccgcccgcggguacaucuccacccgggucggcaugggggaggccgccgcgaucuucaugaccgccacgccgcccggcagcguggaggccuucccccaguccaacgccgugauccaggacgaggagaaggacaucccggagcgcagcuggaacuccggcuacgacuggaucacggacuuccccgggaagaccgucugguucgugcccagcaucaaguccggcaacgacaucgccaacugccugcggaagaacgggaagcgcgugauccagcucagccggaagaccuucgacaccgaguaccagaagacgaagaacaacgacugggacuacgucgugaccaccgacaucuccgagaugggcgcgaacuuccgcgccgaccgggugaucgacccccgccggugccugaagccggucauccugaaggacgggcccgagcgcgugauccucgccggccccaugcccgucaccguggccagcgcggcccagcggcgcggccggaucgggcgcaaccagaacaaggagggcgaccaguacaucuacauggggcagccgcugaacaacgacgaggaccacgcccacuggacggaggccaagaugcugcucgacaacaucaacacccccgagggcaucauccccgcccuguucgagcccgagcgggagaaguccgcggccaucgacggggaguaccgccugcgcggcgaggcccggaagaccuucguggagcucaugcgccggggcgaccugccggucuggcugagcuacaagguggccagcgagggguuccaguacuccgaccgccgguggugcuucgacggcgagcgcaacaaccaggugcucgaggagaacauggacgucgagaucuggaccaaggagggggagcggaagaagcugcgcccccgguggcuggacgcccgcacguacagcgacccccucgcgcugcgggaguucaaggaguucgccgccggccgccgguccgugagcggcgaccugauccucgagaucgggaagcugccccagcaccugacccagcgcgcccagaacgcccucgacaaccuggugaugcugcacaacuccgagcagggcgggaaggcguaccggcacgccauggaggagcucccggacaccaucgagacccugaugcugcucgcccugaucgccguccugaccggcggggugacccucuucuuccugagcggccgcggccuggggaagaccuccaucggccuccugugcgugaugagcuccagcgcgcugcucuggauggccuccgucgagccccacuggaucgccgccagcaucauccuggaguucuuccugauggugcuccugauccccgagcccgaccggcagcgcaccccgcaggacaaccagcuggccuacguggucaucgggcuccuguucaugauccugaccguggcggccaacgagaugggccuccuggagacgaccaagaaggaccuggggaucggccacgccgccgccgagaaccaccaccacgcggccaugcucgacguggaccugcaccccgccuccgccuggacccuguacgccgucgcgaccacgaucaucacccccaugaugcggcacaccaucgagaacaccacggccaacaucagccucaccgccaucgccaaccaggccgcgauccugaugggccuggacaagggguggccgaucuccaagauggacaucggcgugccccuccuggcccuggggugcuacagccaggugaacccccucacccugaccgccgccguccugaugcucguggcgcacuacgccaucaucggccccgggcugcaggccaaggccacgcgcgaggcccagaagcggaccgcggccggcaucaugaagaacccgaccguggacggcaucgucgccaucgaccuggaccccgugguguacgacgccaaguucgagaagcagcucgggcagaucaugcugcugauccucugcaccucccagauccugcugaugcgcacgaccugggcccucugcgagagcaucacccuggcgaccggcccccugacgacccucugggaggggucccccggcaaguucuggaacaccaccaucgccgucagcauggccaacaucuuccgcggcagcuaccuggccggggccggccuggcguucucccucaugaagucccucgggggcgggcggcgcggcacgggcgcccagggggagacccugggcgagaaguggaagcggcagcucaaccagcuguccaagagcgaguucaacaucuacaagcgcuccgggaucguggagguggaccggagcgaggccaaggagggccugaagcgcggggagaccaucaagcacgccgucucccggggcaccgcgaagcuccgcugguucguggagcggaaccuggugaagccggagggcaaggucaucgaccuggggugcggccgcgggggcuggagcuacuacugcgccgggcugaagaaggugacggaggugaagggcuacaccaagggcgggcccggccacgaggagcccauccccauggccaccuacggguggaaccucgucaagcuguacuccggcaaggacguguucuucaucccgcccgagaagugcgacacccugcucugcgacaucggggagagcucccccaaccccacgaucgaggagggccggacccugcgcgugcugaagauggucgagccguggcuccggggcaaccaguucugcaucaagauccugaaccccuacaugcccagcgugguggagacccuggagcagaugcagcgcaagcacgggggcaugcucguccggaacccccugucccgcaacagcacccacgagauguacuggguguccugcgggaccggcaacaucgugagcgccgucaacaugacgucccggaugcugcucaaccgcuucaccauggcccaccggaagccgaccuacgagcgcgacguggaccugggcgcggggacccgccacguggccgucgagcccgagguggccaaccuggacaucaucggccagcggaucgagaacaucaagaacgagcacaagagcacguggcacuacgacgaggacaaccccuacaagaccugggccuaccacggguccuacgaggugaagcccagcggcagcgccuccagcauggucaacggggugguccgccuccugaccaagccgugggacgugauccccauggugacccagaucgcgaugacggacaccacccccuucggccagcagcgggucuucaaggagaagguggacacccgcacgcccaaggccaagcggggcaccgcccagaucauggaggugaccgccaaguggcuguggggguuccucucccgcaacaagaagccgcggaucugcacccgcgaggaguucacgcggaagguccgcagcaacgccgcgaucggcgccguguucguggacgagaaccaguggaacuccgccaaggaggccgucgaggacgagcgguucugggaccuggugcgccgggagcgcgagcugcacaagcaggggaagugcgcgaccugcguguacaacaugaugggcaagcgggagaagaagcucggggaguucggcaaggccaagggcagccgcgccaucugguacauguggcugggggcccgguuccuggaguucgaggcccucggcuucaugaacgaggaccacugguucucccgcgagaacagccuguccggggucgagggcgaggggcugcacaagcucggcuacauccugcgggacaucagcaagauccccggcgggaacauguacgcggacgacaccgccggcugggacacccgcaucacggaggacgaccugcagaacgaggccaagaucaccgacaucauggagcccgagcacgcccuccuggccaccuccaucuucaagcugaccuaccagaacaagguggugcggguccagcgcccggcgaagaacgggacggugauggacgugaucagccgccgggaccagcgcggcuccggccaggucgggaccuacggccucaacaccuucaccaacaugggggcccagcugauccggcagauggagagcgagggcaucuucucccccagcgagcuggagacgcccaaccucgccgggcgcgugcuggacuggcuggagaagcacggcaucgagcggcuccgccggauggccaucuccggcgacgacugcguggucaagcccaucgacgaccgcuucgccaccgcgcugaccgcccugaacgacauggggaaggugcggaaggacaucccgcagugggagcccagcaagggcuggaacgacuggcagcagguccccuucugcagccaccacuuccaccagcucaucaugaaggacgggcgcgagaucgucgugcccugccggaaccaggacgagcuggugggccgcgcccgggucucccagggggccggcuggagccugcgcgagaccgccugccucggcaaguccuacgcgcagauguggcagcugauguacuuccaccggcgcgaccugcggcucgccgccaacgccaucugcagcgcggugccgguggacuggguccccacgucccgcaccaccuggagcauccacgcccaccaccaguggaugaccacggaggacaugcuguccguguggaaccggguguggaucgaggagaaccccuggauggaggacaagacccacgucagcuccugggaggacgugcccuaccuggggaagcgcgaggaccaguggugcggcagccucaucgggcugaccgcccgcgccaccugggccaccaacauccagguggcgaucaaccagguccggcgccugaucggcaacgagaacuaccucgacuacaugacguccaugaagcgguucaagaacgagagcgacccggagggggcccugugguga

SEQ ID NO: 8988 - RNA, 9879 nt, Artificial Sequence
  derived and/or modified CDS sequence (opt1) from DENV-1__DQ285559__SS-prME
agcgugaccaugcugcucaugcugcugcccaccgcccucaccuuccaccugaccacccgcggcggggagccgcacaugaucgugagcaagcaggagcggggcaagagccugcuguucaagaccagcgugggggugaacaugugcacccugaucgccauggaccugggcgagcucugcgaggacaccaugaccuacaagugcccccgcaucaccgaggcggagcccgacgacguggacugcuggugcaacgccaccgacaccugggugaccuacgggaccugcagccagacgggcgagcaccggcgcgacaagcgguccguggcccuggcgccccacgucggccuggggcucgagacccgcaccgagaccuggaugagcuccgagggcgccuggaagcagauccagaagguggagacgugggcgcugcggcaccccggguucaccgugaucgcccuguuccucgcccacgccaucggcaccagcaucacccagaaggggaucaucuucauccugcugaugcucgugacgcccuccauggcgaugcgcugcgugggcaucggcaaccgggacuucguggaggggcugagcggcgccaccugggucgacguggugcuggagcacggguccugcgucaccaccauggccaagaacaagcccacgcucgacaucgagcugcugaagaccgaggugaccaaccccgccgugcuccgcaagcugugcaucgaggccaagaucagcaacaccacgaccgacucccggugccccacccagggcgaggcgacccuggucgaggagcaggacgccaacuucgugugccgccggacguucguggaccgcggcugggggaacggcugcggccuguucggcaaggggagccugcugaccugcgccaaguucaagugcgucaccaagcucgagggcaagaucgugcaguacgagaaccugaaguacuccgugaucgucaccgugcacacgggcgaccagcaccaggucgggaacgagaccaccgagcacggcaccaucgccaccaucacgccccaggcccccaccagcgagauccagcugaucgacuacggggcgcucacccuggacugcagcccccggaccggccuggacuucaacgagauggugcuccugacgaugaaggggaaguccuggcuggugcacaagcagugguuccucgaccugccgcugcccuggaccuccggcgccagcaccagccaggagaccuggaaccgccaggaccuccuggucacguucaagaccgcccacgccaagaagcaggagguggugguccugggcucccaggagggggccaugcacaccgcgcucaccggcgccacggagauccagaccagcgggaccaccacgaucuucgccggccaccugaagugccggcugaagauggacaagcucacccugaaggggauguccuacgugaugugcaccggcagcuucaagcuggagaaggagguggccgagacccagcacggcacgguccugguccaggugaaguacgaggggaccgacgcccccugcaagauccccuucuccacccaggacgagaagggcgucacccagaacgggcgccucaucacggcgaacccgaucgugaccgacaaggagaagcccgugaacaucgagaccgagccgcccuucggcgagagcuacaucgucgugggcgccggggagaaggcccugaagcuguccugguucaagaagggcagcuccaucgggaagauguucgaggccaccgcgcggggcgcccgccggauggccauccucggggacacggccugggacuucggcagcaucggcgggguguucaccuccgucggcaagcugacccaccagguguucgggaccgccuacggcgugcuguucagcggggucuccuggacgaugaagaucggcaucggcauccuccugaccuggcuggggcucaacagccgcuccaccagccuguccaugaccugcaucgcggugggcauggugacgcuguaccucggggucauggugcaggccgacagcggcugcgugaucaacuggaaggggcgcgagcugaagugcggcuccggcaucuucgucaccaacgaggugcacaccuggaccgagcaguacaaguuccaggccgacagcccgaagaagcugagcgccgccaucgggaaggcgugggaggagggcgugugcgggauccgguccgccacccgccucgagaacaucauguggaagcagaucagcaacgagcugaacuacauccugcucgagaacgacaugaaguucacggucguggugggcgacgccaacgggauccuggcccagggcaagaagaugauccggccccagcccauggagcacaaguacuccuggaaguccuggggcaaggccaagaucaucggggcggacauccagaacaccaccuucaucaucgacggccccgacaccccggagugccccgacgaccagcgcgccuggaacaucugggaggucgaggacuacggguucggcaucuucacgaccaacaucuggcugaagcuccgggacuccuacacccagaugugcgaccaccgccugaugagcgccgccaucaaggacuccaaggcggugcacgccgacaugggcuacuggaucgagagcgagaagaacgagaccuggaagcuggcccgggccuccuucaucgaggugaagacgugcaucuggcccaagagccacacccucugguccaacgggguccuggagagcgagaugaucauccccaagaucuacggcgggccgaucucccagcacaacuaccgccccggcuacuucacccagaccgccgggcccuggcaccugggcaagcucgagcuggacuucgaccugugcgagggcacgaccgugguggucgacgagcacugcgggaaccggggcccgagccuccgcaccaccacggugaccgggaagaucauccacgaguggugcugccgguccugcacccugccgccccugcgcuuccggggcgaggacgggugcugguacggcauggagauccgccccgugaaggagaaggaggagaaccucguccggagcaugguguccgcgggcagcggggagguggacagcuucucccugggcauccugugcgucagcauccucaucgaggaggugaugcgcuccaaguggagccggaagaugcugaugaccgggacgcuggccguguuccuccugcugaucaugggccagcucaccuggaacgaccugacccgccugugcaucauggucggggccaacgccuccgaccggaugggcaugggcaccacguaccucgcccugauggccaccuucaagaugcgcccgauguucgccguggggcuccucuuccgccggcugaccagccgcgaggugcugcuccugaccaucgggcugucccucgucgccagcguggagcugcccaacucccuggaggagcucggggacggccuggccaugggcaucaugauccugaagcuccugacggacuuccagccccaccagcuguggaccacccuccugagccugaccuucaucaagacgacccucucccuggacuacgccuggaagaccauggcgaugacccugagcaucgucucccucuucccccugugccugagcacgaccucccagaagaccaccuggcucccggugcugcuggggagcuucggcugcaagccccucaccauguuccugaucacggagaacaagaucugggggcggaaguccuggcccaucaacgagggcaucauggccguggggaucgucagcauccugcucuccagccugcugaagaacgacgugccccucgccggcccgcugaucgccggcgggaugcugaucgcgugcuacgugaucagcggcuccagcgccgaccucucccuggagaaggccgccgaggucagcugggaggaggaggccgagcacuccgggaccagccacaacauccugguggaggugcaggacgacggcaccaugaagaucaaggacgaggagcgcgacgacacccucacgauccugcugaaggcgacccuccuggccgucuccgggguguaccccaugagcauccccgccacccuguucgugugguacuucuggcagaagaagaagcagcgguccggcguccucugggacacccccagcccgcccgagguggagcgcgccgugcuggacgacggcaucuaccggauccugcagcgcgggcugcucggccggucccaggucggggugggcguguuccaggacggggucuuccacacgauguggcacgugacccgcggcgccgugcugauguaccagggcaagcggcuggagcccagcugggcguccgucaagaaggaccucaucagcuacgggggcggguggcgcuuccagggcuccuggaacaccggggaggagguccaggugaucgccgucgagcccggcaagaacccgaagaacgugcagaccacgcccggcaccuucaagacccccgagggggaggugggcgccaucgcccuggacuucaagcccgggaccagcggcuccccgaucgucaaccgggagggcaagaucguggggcuguacggcaacgggguggucacgaccagcggcaccuacguguccgccaucgcgcaggccaaggccagccaggaggggccccuccccgagaucgaggacgagguguucaagaagcgcaaccugaccaucauggaccugcacccgggcagcggcaagacgcggcgcuaccuccccgccaucguccgggaggccaucaagcgcaagcugcggacccugauccucgcgcccacccgcgugguggccuccgagauggccgaggcccugaaggggaugcccauccgguaccagaccacggcggucaagagcgagcacaccggccgcgagaucguggaccugaugugccacgccaccuucaccaugcgccuccuguccccggugcggguccccaacuacaacaugaucaucauggacgaggcccacuucacggaccccgccagcaucgccgcgcgcggguacaucuccacccgggugggcaugggggaggccgccgccaucuucaugaccgccacgccgcccggcagcguggaggcguucccccaguccaacgccgucauccaggacgaggagaaggacauccccgagcgcagcuggaacuccggcuacgacuggaucacggacuuccccgggaagaccgugugguucgugcccagcaucaaguccggcaacgacaucgccaacugccugcggaagaacgggaagcgcgucauccagcucagccggaagaccuucgacaccgaguaccagaagacgaagaacaacgacugggacuacguggugaccaccgacaucuccgagaugggcgccaacuuccgcgccgaccgggucaucgacccccgccggugccugaagcccgugauccugaaggacgggcccgagcgcgugauccucgcgggcccgaugcccgucaccguggccagcgccgcccagcggcgcggccggaucgggcgcaaccagaacaaggagggcgaccaguacgucuacauggggcagccccugaacaacgacgaggaccacgcgcacuggacggaggccaagaugcugcucgacaacaucaacacccccgagggcaucaucccggcccuguucgagcccgagcgggagaaguccgccgccaucgacggggaguaccgccugcggggcgaggcgcgcaagaccuucguggagcucaugcgccggggcgaccugcccguguggcugagcuacaaggucgccuccgagggguuccaguacagcgaccgccgguggugcuucgacggcgagcgcaacaaccaggugcucgaggagaacauggacguggagaucuggaccaaggagggggagcggaagaagcugcgcccccgguggcuggacgcccgcaccuacuccgacccgcucgcccugcgggaguucaaggaguucgccgcgggccgccggagcgucagcggcgaccugauccucgagaucgggaagcugccccagcaccugacgcuccgcgcccagaacgcccuggacaaccuggugaugcuccacaacuccgagcagggcgggaaggccuaccggcacgccauggaggagcugcccgacaccaucgagacccugaugcuccuggcgcugaucgccgugcucaccggcggggucacgcuguucuuccugagcggcaagggccucgggaagaccuccaucggccugcugugcgugauggccagcuccgcccuccuguggauggcgagcguggagccccacuggaucgccgccuccaucauccuggaguucuuccucaugguccugcugaucccggagcccgaccgccagcggacgccccaggacaaccagcucgccuacguggugaucgggcugcuguucaugauccucaccgucgccgcgaacgagaugggccugcuggagacgaccaagaaggaccucgggaucggccacguggccgccgagaaccaccaccacgccaccaugcuggacguggaccugcgcccggccagcgcguggacccucuacgccgucgccacgaccgugaucacccccaugaugcggcacaccaucgagaacacgaccgccaacaucucccugaccgccaucgcgaaccaggccgccauccugaugggccucgacaagggguggcccaucagcaagauggacaucggcgugccccugcuggcccucgggugcuacucccaggucaacccgcugacccugacggccgcggugcucaugcugguggcccacuacgccaucaucggccccgggcugcaggccaaggcgacccgcgaggcccagaagcggaccgccgccggcaucaugaagaaccccaccgucgacggcaucguggccaucgaccucgaccccguggucuacgacgcgaaguucgagaagcagcuggggcagaucaugcugcucauccugugcacgagccagauccugcucaugcgcaccaccugggcccugugcgaguccaucacccuggccacgggcccgcucaccacccugugggaggggagccccggcaaguucuggaacaccacgaucgccguguccauggccaacaucuuccggggcagcuaccuggcgggggccggccucgccuucucccugaugaagucccucgggggcgggcgccgcgggaccggcgcccagggggagacccucggcgagaaguggaagcggcagcugaaccagcuguccaagagcgaguucaacaccuacaagcgcagcgggaucauggagguggaccgguccgaggccaaggagggccucaagcgcggggagacgaccaagcacgcggucagccggggcaccgccaagcugcgcugguucguggagcggaaccuggugaagcccgagggcaaggucaucgaccuggggugcggccgcgggggcugguccuacuacugcgccgggcucaagaaggugaccgaggugaagggcuacaccaagggcgggcccggccacgaggagccgauccccauggccacguacggguggaaccuggucaagcugcacagcggcaaggacguguucuucaucccgcccgagaagugcgacacccuccugugcgacaucggggaguccagcccgaaccccaccaucgaggagggccggacccugcgcgugcucaagauggucgagcccuggcugaagggcaaccaguucugcaucaagauccugaaccccuacaugccguccgugguggagacgcucgagcagaugcagcggaagcacgggggcaugcugguccgcaacccccugagccggaacuccacccacgagauguacugggugagcugcgggaccggcaacaucguguccgcggucaacaugaccagccgcaugcuccugaaccgguucacgauggcccaccgcaagcccaccuacgagcgggacguggaccugggcgccgggacccgccacguggccgucgagcccgagguggccaaccucgacaucaucggccagcggaucgagaacaucaagaacgagcacaaguccaccuggcacuacgacgaggacaacccguacaagacgugggcguaccacgggagcuacgaggugaagcccuccggcagcgccuccagcauggucaacggggugguccgccugcugaccaagcccugggacgugauccccauggugacccagaucgccaugaccgacacgaccccguucggccagcagcgcgucuucaaggagaagguggacacccggacgccccgcgccaagcggggcacggcccagaucauggaggugaccgcgaaguggcucuggggguuccugucccgcaacaagaagccccggaucugcacccgcgaggaguucacccggaagguccgcagcaacgccgccaucggcgccguguucguggacgagaaccaguggaacagcgccaaggaggcggucgaggacgagcgguucugggaccuggugcaccgcgagcgggagcuccacaagcaggggaagugcgccacgugcguguacaacaugaugggcaagcgcgagaagaagcugggggaguucggcaaggccaagggcucccgggccaucugguacauguggcugggggcgcgcuuccucgaguucgaggcccugggcuucaugaacgaggaccacugguucagccgggagaacucccugagcggggucgagggcgaggggcuccacaagcugggcuacauccugcgcgacaucuccaagaucccgggcgggaacauguacgccgacgacaccgccggcugggacacccggaucaccgaggacgaccuccagaacgaggccaagaucacggacaucauggagcccgagcacgcgcugcuggccaccgccaucuucaagcucaccuaccagaacaagguggugcgcguccagcggcccgccaagagcgggaccgugauggacgugaucucccgccgggaccagcgcggcagcggccaggucgggacguacggccugaacaccuucaccaacauggaggcccagcugauccgccagauggaguccgaggggaucuuccuccccagcgagcuggagaccccgaaccuggcgaagcgggugcucgacuggcuggagaaguacggcgccgagcgccugaagcggauggccaucuccggggacgacugcguggucaagcccaucgacgaccgcuucgccaaggcccucacggcgcugaacgacaugggcaaggugcggaaggacaucccccagugggagcccagcaagggcuggaacgacuggcagcaggucccguucugcucccaccacuuccaccagcugaucaugaaggacgggcgcgagaucgucgugcccugccggaaccaggacgagcucgugggccgcgcccgggucagccagggggccggcuggucccugcgcgagaccgccugccugggcaagagcuacgcccagauguggcagcucauguacuuccaccggcgcgaccugcggcuggcggccaacgccaucugcuccgccgugcccguggacuggguccccaccagccgcaccaccuggagcauccacgcgcaccaccaguggaugacgaccgaggacaugcucuccguguggaaccggguguggaucgaggagaacccguggauggaggacaagacccacgucagcuccugggaggaggugcccuaccugggcaagcgcgaggaccaguggugcggcagccugaucgggcucaccgcccgggccacgugggccaccaacauccagguggccaucaaccagguccgccggcugaucggcaacgagaacuaccuggacuacauggcguccaugaagcgcuucaagaacgagagcgaccccgagggggcccucugguga

SEQ ID NO: 8989 - RNA, 9879 nt, Artificial Sequence
  derived and/or modified CDS sequence (opt1) from DENV-1__AF311956__SS-prME
agcgugaccaugcugcucaugcugcugcccaccgcccucgccuuccaccugaccacccggggcggggagccccacaugaucgugagcaagcaggagcggggcaagagccuccuguucaagaccagcgcgggggugaacaugugcacccugaucgccauggaccugggcgagcucugcgaggacaccaugaccuacaagugcccccggaucaccgaggccgagcccgacgacguggacugcuggugcaacgccaccgacaccugggucaccuacgggaccugcagccagaccggcgagcaccggcgggacaagcgguccguggcccuggcgccccacgugggccuggggcucgagacccggaccgagaccuggaugagcuccgagggcgccuggaagcagauccagaaggucgagaccugggcccugcggcaccccggguucacggugaucgcccuguuccucgcgcacgccaucggcaccagcaucacccagaaggggaucaucuucauccugcugaugcucgugacccccuccauggccaugcgcugcgucggcaucggcaaccgggacuucguggaggggcugagcggcgccacguggguggacgucgugcuggagcacggguccugcgugaccaccauggccaagaacaagcccacccucgacaucgagcugcugaagacggaggucaccaaccccgcggugcuccgcaagcugugcaucgaggccaagaucagcaacaccaccacggacucccggugcccgacccagggcgaggccacccugguggaggagcaggacgccaacuucgucugccgccggaccuucguggaccgcggcugggggaacggcugcggccucuucggcaaggggagccugcugacgugcgccaaguucaagugcgugaccaagcucgagggcaagaucguccaguacgagaaccugaaguacuccgugaucgugaccguccacaccggcgaccagcaccagguggggaacgagacgaccgagcacggcaccaucgcgaccaucacgccccaggcccccacgagcgagauccagcugaccgacuacggggcccucacccuggacugcagcccccggaccggccuggacuucaacgagaugguccuccugacgaugaaggagaaguccuggcuggugcacaagcagugguuccucgaccugccgcugcccuggaccuccggggccagcaccagccaggagaccuggaaccgccaggaccuccuggugacguucaagaccgcccacgcgaagaagcaggaggucguggugcugggcucccaggagggcgccaugcacaccgcccucaccggggccacggagauccagaccagcggcaccaccacgaucuucgccgggcaccugaagugccggcugaagauggacaagcucacccugaagggcaccuccuacgucaugugcaccgggagcuucaagcuggagaaggagguggcggagacgcagcacggcaccgugcugguccaggugaaguacgagggcaccgacgcccccugcaagauccccuucuccacccaggacgagaagggggugacgcagaacggccgccucaucaccgccaacccgaucgucaccgacaaggagaagcccgugaacaucgagaccgagccgcccuucggggagagcuacaucguggucggcgccggcgagaaggcgcugaagcuguccugguucaagaaggggagcuccaucggcaagauguucgaggccacggcccgcggggcccgccggauggccauccucggcgacaccgcgugggacuucgggagcaucggcggcguguucaccuccguggggaagcugguccaccagguguucggcaccgccuacggggugcuguucagcggcgucuccuggacgaugaagaucgggaucggcauccuccugaccuggcugggccucaacagccgcuccaccagccuguccaugaccugcaucgccguggggauggugacgcuguaccucggcgucauggugcaggccgacagcgggugcgugaucaacuggaagggccgcgagcugaagugcggguccggcaucuucgucaccaacgaggugcacaccuggaccgagcaguacaaguuccaggccgacagcccgaagcggcugagcgcggccaucggccgcgccugggaggagggggugugcggcauccgguccgccacccgccucgagaacaucauguggaagcagaucagcaacgagcugaaccacauccugcucgagaacgacaucaaguucacggucgugguggggaacgccaacggcauccuggcgcaggggaagaagaugauccggccccagcccauggagcacaaguacuccuggaaguccuggggcaaggccaagaucaucggcgccgacauccagaacaccaccuucaucaucgacgggcccgacaccccggagugccccgacgagcagcgcgccuggaacaucugggaggucgaggacuacggcuucgggaucuucacgaccaacaucuggcugaagcuccgggacuccuacacccagaugugcgaccaccgccugaugagcgcggccaucaaggacuccaaggccgugcacgccgacaugggcuacuggaucgagagcgagaagaacgagaccuggaagcuggcccgggcguccuucaucgaggugaagacgugcaucuggcccaagagccacacccucugguccaacggcguccuggagagcgagaugaucauccccaagauguacgggggcccgaucucccagcacaacuaccgccccggguacuucacccagaccgccggccccuggcaccuggggaagcucgagcuggacuucgaccugugcgagggcacgaccgugguggucgacgagcacugcggcagccgggggccgucccuccgcaccaccacggugaccggcaagaucauccacgaguggugcugccggagcugcacccugccgccccugcgcuuccgcggggaggacggcugcugguacgggauggagauccgccccgugaaggagaaggaggagaaccucguccgguccauggugagcgccggcagcggcgagguggacuccuucagccuggggauccugugcgucuccaucaugaucgaggaggugaugcgcagccgguggucccgcaagaugcucaugaccggcacgcuggccguguuccugcuccugaucauggggcagcugaccuggaacgaccucauccgccugugcaucauggucggcgccaacgcgagcgacaagauggggaugggcaccaccuaccuggcccucauggccacguucaagaugcggccgauguucgccguggggcugcuguuccgccggcucaccucccgcgaggugcugcugcucaccaucgggcugagccuggucgccuccguggagcuccccaacagccuggaggagcugggcgacgggcucgcgaugggcaucaugaugcugaagcugcucaccgaguuccagccccaccagcuguggacgacccugcucucccugaccuucaucaagaccacgcugagccucgacuacgccuggaagaccaccgccaugguccuguccaucgugagccuguucccccucugccuguccaccacgagccagaagaccaccuggcugccggugcuccugggcuccuucgggugcaagccccugaccauguuccucaucaccgagaacgagaucuggggccgcaagagcuggccccugaacgaggggaucauggccaucggcaucgucuccauccugcucagcagccugcugaagaacgacgugccccucgcggggccgcugaucgccggcggcaugcugaucgccugcuacgugaucuccgggagcuccgccgaccucagccuggagaaggccgcggaggucuccugggaggaggaggccgagcacagcggcacgucccacaacauccugguggaggugcaggacgacgggaccaugaagaucaaggacgaggagcgcgacgacacccucaccauccugcugaaggccacgcuccuggccgucagcggcguguaccccauguccauccccgccacccuguucgugugguacuucuggcagaagaagaagcagcggagcgggguccucugggacacccccuccccgcccgagguggagcgcgcggugcuggacgacggcaucuaccggauccugcagcgcggccugcucgggcggagccaggucggcguggggguguuccaggacggcgucuuccacaccauguggcacgugacgcgcggggccgugcugauguaccagggcaagcggcuggagcccuccugggccagcgucaagaaggaccucaucuccuacggcgggggcuggcgcuuccaggggagcuggaacaccggcgaggagguccaggugaucgccgucgagcccgggaagaacccgaagaacgugcagaccacccccggcacguucaagacccccgagggcgaggugggggccaucgcgcuggacuucaagcccggcaccuccgggagcccgaucgucaaccgggagggcaagaucgugggccuguacgggaacggcguggucaccacguccgggaccuacgugagcgccaucgcccaggccaaggccagccaggagggcccccuccccgagaucgaggacgagguguucaagaagcgcaaccugaccaucauggaccugcacccgggguccggcaagacccggcgcuaccuccccgcgaucguccgggaggccaucaagcgcaagcugcggacgcugauccucgcccccacccgcgugguggccagcgagauggcggaggcccugaagggcaugcccauccgcuaccagaccaccgccgucaaguccgagcacacggggcgggagaucguggaccugaugugccacgccaccuucaccaugcgccuccugagcccggugcggguccccaacuacaacaugaucaucauggacgaggcccacuucaccgaccccgcguccaucgccgcccgcggcuacaucagcacgcggguggggaugggcgaggccgccgcgaucuucaugaccgccacgccgcccggguccguggaggccuucccccagagcaacgccgucauccaggacgaggagcgcgacauccccgagcgguccuggaacagcggcuacgacuggaucaccgacuuccccggcaagacggugugguucgugcccuccaucaagagcgggaacgacaucgccaacugccugcgcaagaacggcaagcgggucauccagcucucccgcaagaccuucgacaccgaguaccagaagaccaagaacaacgacugggacuacguggugacgaccgacaucagcgagaugggggcgaacuuccgggccgaccgcgucaucgacccccggcgcugccugaagcccgugauccugaaggacggccccgagcgggugauccucgccgggccgaugcccgucaccguggccuccgcggcccagcgccggggccgcaucggccggaaccagaacaaggagggggaccaguacgucuacaugggccagccccugaacaacgacgaggaccacgcccacuggaccgaggccaagaugcugcucgacaacaucaacacgcccgaggggaucaucccggcccuguucgagcccgagcgcgagaaguccgcggccaucgacggcgaguaccgccugcgcggggaggcccgcaagaccuucguggagcucaugcggcgcggcgaccugcccguguggcuguccuacaaggucgccagcgagggcuuccaguacuccgaccggcgcuggugcuucgacggggagcggaacaaccaggugcucgaggagaacauggacguggagaucuggaccaaggagggcgagcgcaagaagcugcggccccgcuggcuggacgcccggaccuacagcgacccgcucgcgcugcgcgaguucaaggaguucgccgccgggcggcgcagcgucuccggcgaccugauccucgagaucggcaagcugccccagcaccugacccuccgggcccagaacgcccuggacaaccuggugaugcuccacaacagcgagcagggcgggaaggcguaccgccacgccauggaggagcugcccgacacgaucgagacccugaugcuccuggcccugaucgccgugcucaccgggggcgucacccuguucuuccuguccgggaagggccucggcaagacgagcaucgggcugcugugcgugaccgcguccagcgcccuccuguggauggccuccguggagccccacuggaucgccgccagcaucauccuggaguucuuccucaugguccugcugaucccggagcccgaccggcagcgcacgccccaggacaaccagcucgcguacguggugaucggccugcuguucaugauccucaccgucgccgccaacgagauggggcugcuggagacgaccaagaaggaccucggcaucgggcacguggccgccgagaaccaccagcacgcgaccauccuggacguggaccugcacccggccuccgccuggacccucuacgccgucgccacgaccgugaucacccccaugaugcggcacaccaucgagaacacgaccgcgaacaucagccugaccgccaucgccaaccaggccgccauccugaugggccucgacaagggcuggcccaucuccaagauggaccugggggugccccugcucgcgcugggcugcuacagccaggucaacccgcugacccucacggccgccgugcugaugcugguggcccacuacgcgaucaucgggcccggccuccaggccaaggccacccgcgaggcccagaagcggaccgccgcggggaucaugaagaaccccaccgucgacggcaucguggccaucgaccuggaccccguggucuacgacgccaaguucgagaagcagcugggccagaucaugcuccugauccugugcacgucccagauccuccugaugcgcaccaccugggcccugugcgagagcaucacccucgccacggggccgcugaccacccugugggagggcucccccgggaaguucuggaacaccacgaucgcggugagcauggccaacaucuuccgcggcuccuaccucgccggcgccgggcuggccuucagccugaugaagucccucggcgggggccggcgcgggaccggcgcgcagggcgagacccugggggagaaguggaagcggcagcugaaccagcucagcaagagcgaguucaacaccuacaagcgcuccggcaucauggagguggaccggagcgaggccaaggaggggcugaagcgcggcgagacgaccaagcacgccgucucccgggggaccgccaagcugcgcugguucguggagcggaaccuggugaagcccgagggcaaggucaucgaccucggcugcgggcgcggcggguggagcuacuacugcgcgggccugaagaaggugaccgaggugaagggguacaccaagggcggccccgggcacgaggagccgauccccauggccacguacggcuggaaccuggucaagcuccacuccgggaaggacguguucuucaugccgcccgagaagugcgacacccugcugugcgacaucggcgagagcuccccgaaccccaccaucgaggaggggcggacccuccgcgugcugaagauggucgagcccuggcugcggggcaaccaguucugcaucaagauccucaaccccuacaugccgagcgugguggagacgcuggagcagaugcagcgcaagcacggcgggaugcugguccggaacccccucucccgcaacagcacccacgagauguacuggguguccugcggcaccgggaacaucgugagcgccgucaacaugaccucccggaugcugcugaaccgcuucacgauggcccaccggaagcccaccuacgagcgcgacguggaccucggcgccggcacccgccacguggcggucgagcccgagguggccaaccuggacaucaucgggcagcggaucgagaacaucaagaacgagcacaagagcaccuggcacuacgacgaggacaacccguacaagacgugggccuaccacggcuccuacgaggugaagcccagcggguccgccagcuccauggucaacggcgugguccgccugcucaccaagcccugggacgugauccccauggugacccagaucgccaugaccgacacgaccccguucgggcagcagcgggucuucaaggagaagguggacacccgcacgccccgggcgaagcgcggcacggcccagaucauggaggugaccgccaaguggcuguggggcuuccugagccggaacaagaagccccgcaucugcacccgggaggaguucacccgcaagguccggagcaacgccgccaucggggcgguguucguggacgagaaccaguggaacuccgccaaggaggccgucgaggacgagcgcuucugggaccucgugcaccgggagcgcgagcugcacaagcagggcaagugcgccacgugcguguacaacaugauggggaagcgggagaagaagcugggcgaguucgggaaggcgaagggcagccgcgccaucugguacauguggcucggcgcccgguuccuggaguucgaggcccugggguucaugaacgaggaccacugguucucccgcgagaacagccucuccggcgucgagggggagggccugcacaagcugggguacauccuccgggacaucagcaagaucccgggcggcaacauguacgccgacgacaccgcggggugggacacccgcaucaccgaggacgaccugcagaacgaggccaagaucacggacaucauggagcccgagcacgcccugcucgccaccuccaucuucaagcugaccuaccagaacaagguggugcggguccagcgccccgccaagaacggcaccgugauggacgugaucagccgccgggaccagcgcggguccggccaggucggcacguacgggcugaacaccuucaccaacauggaggugcagcucauccggcagauggagagcgagggcaucuucuuccccuccgagcuggagagcccgaaccuggcggagcgcgugcucgacuggcuggagaagcacggggccgagcggcugaagcgcauggccaucuccggcgacgacugcgucgugaagcccaucgacgaccgguucgccaccgcccucaucgcgcugaacgacauggggaaggugcgcaaggacaucccccagugggagcccagcaagggcuggaacgacuggcagcaggucccguucugcucccaccacuuccaccagcugaucaugaaggacggccgggagaucguggugcccugccgcaaccaggacgagcucgucgggcgggcccgcgugagccagggcgccggguggucccugcgggagacggccugccugggcaagagcuacgcccagauguggcagcucauguacuuccaccgccgggaccugcgccuggcggccaacgccaucugcagcgccgugcccgucgacugggugcccaccucccggaccaccuggagcauccacgcgcaccaccaguggaugaccacggaggacaugcucuccguguggaaccgcgucuggaucgaggagaacccguggauggaggacaagacccacgugagcuccugggaggaggugcccuaccuggggaagcgggaggaccaguggugcggcagccugaucggccucaccgcccgcgccaccugggccacgaacauccaggucgccaucaaccaggugcgccggcugaucgggaacgagaacuaccuggacuacaugaccuccaugaagcgcuucaagaacgagagcgaccccgagggcgcgcucugguga

SEQ ID NO: 8990 - RNA, 9879 nt, Artificial Sequence
  derived and/or modified CDS sequence (opt1) from DENV-1__AF311958__SS-prME
agcgugaccaugcugcucaugcugcugcccaccgcccucgccuuccaccugaccacccggggcggggagccccacaugaucgugagcaagcaggagcggggcaagagccuccuguucaagaccagcgcgggggugaacaugugcacccugaucgccauggaccugggcgagcucugcgaggacaccaugaccuacaagugcccccggaucaccgaggccgagcccgacgacguggacugcuggugcaacgccaccgacaccugggucaccuacgggaccugcagccagaccggcgagcaccggcgggacaagcgguccguggcccuggcgccccacgugggccuggggcucgagacccgcaccgagaccuggaugagcuccgagggcgccuggaagcagauccagaaggucgagaccugggcccugcggcacccgggguucacggugaucgcccuguuccucgcgcacgccaucggcaccagcaucacccagaaggggaucaucuucauccugcugaugcucgugacccccuccauggccaugcgcugcgucggcaucggcaaccgggacuucguggaggggcugagcggcgccacguggguggacgucgugcuggagcacggguccugcgugaccaccauggccaagaacaagcccacccucgacaucgagcugcugaagacggaggucaccaaccccgcggugcuccgcaagcugugcaucgaggccaagaucagcaacaccaccacggacucccggugcccgacccagggcgaggccacccugguggaggagcaggacgccaacuucgucugccgccggaccuucguggaccgcggcugggggaacggcugcggccucuucggcaaggggagccugcugacgugcgccaaguucaagugcgugaccaagcucgagggcaagaucguccaguacgagaaccugaaguacuccgugaucgugaccguccacaccggcgaccagcaccagguggggaacgagacgaccgagcacggcaccaucgcgaccaucacgccccaggcccccacgagcgagauccagcugaccgacuacgggacccucacccuggacugcagcccccggacgggccuggacuucaacgagaugguccuccugaccaugaaggagaaguccuggcuggugcacaagcagugguuccucgaccugccgcugcccuggaccuccggggccagcaccagccaggagacguggaaccgccaggaccuccuggugaccuucaagaccgcccacgccaagaagcaggaggucguggugcugggcucccaggagggcgcgaugcacaccgcccucacgggggccaccgagauccagaccagcggcaccacgaccaucuucgccgggcaccugaagugccggcugaagauggacaagcucacccugaagggcaccuccuacgucaugugcacggggagcuucaagcuggagaaggagguggccgagacccagcacggcaccgugcugguccaggugaaguacgagggcaccgacgcgcccugcaagauccccuucuccacgcaggacgagaagggggugacccagaacggccgccucaucaccgccaacccgaucgucaccgacaaggagaagcccgugaacaucgagacggagccgcccuucggggagagcuacaucguggucggcgccggcgagaaggcccugaagcuguccugguucaagaaggggagcuccaucggcaagauguucgaggcgaccgcccgcggggcccgccggauggccauccucggcgacaccgccugggacuucgggagcaucggcggcguguucaccuccguggggaagcugguccaccagguguucggcacggcguacggggugcuguucagcggcgucuccuggaccaugaagaucgggaucggcauccuccugaccuggcugggccucaacagccgcuccaccagccuguccaugacgugcaucgccguggggauggugacccuguaccucggcgucauggugcaggccgacagcgggugcgugaucaacuggaagggccgcgagcugaagugcggguccggcaucuucgucaccaacgaggugcacaccuggaccgagcaguacaaguuccaggccgacagcccgaagcggcugagcgccgcgaucggccgcgccugggaggagggggugugcggcauccgguccgccacgcgccucgagaacaucauguggaagcagaucagcaacgagcugaaccacauccugcucgagaacgacaucaaguucaccgucgugguggggaacgccaacggcauccuggcccaggggaagaagaugauccggccccagcccauggagcacaaguacuccuggaaguccuggggcaaggcgaagaucaucggcgccgacauccagaacaccaccuucaucaucgacgggcccgacacgccggagugccccgacgagcagcgcgccuggaacaucugggaggucgaggacuacggcuucgggaucuucaccaccaacaucuggcugaagcuccgggacuccuacacccagaugugcgaccaccgccugaugagcgccgcgaucaaggacuccaaggccgugcacgccgacaugggcuacuggaucgagagcgagaagaacgagacguggaagcuggcccgggccuccuucaucgaggugaagaccugcaucuggcccaagagccacacccucugguccaacggcguccuggagagcgagaugaucauccccaagauguacgggggcccgaucucccagcacaacuaccgccccggguacuucacccagacggcgggccccuggcaccuggggaagcucgagcuggacuucgaccugugcgagggcaccaccgugguggucgacgagcacugcggcagccgggggccgucccuccgcaccacgaccgugaccggcaagaucauccacgaguggugcugccggagcugcacccugccgccccugcgcuuccgcggggaggacggcugcugguacgggauggagauccgccccgugaaggagaaggaggagaaccucguccgguccauggugagcgccggcagcggcgagguggacuccuucagccuggggauccugugcgucuccaucaugaucgaggaggugaugcgcagccgguggucccgcaagaugcucaugacgggcacccuggccguguuccugcuccugaucauggggcagcugaccuggaacgaccucauccgccugugcaucauggucggcgccaacgccagcgacaagauggggaugggcaccacguaccuggcgcucauggccaccuucaagaugcggccgauguucgccguggggcugcuguuccgccggcucaccucccgcgaggugcugcugcucaccaucgggcugagccuggucgccuccguggagcuccccaacagccuggaggagcugggcgacgggcucgccaugggcaucaugaugcugaagcugcucacggaguuccagccccaccagcuguggaccacccugcucucccugaccuucaucaagacgacccugagccucgacuacgcguggaagaccaccgccaugguccuguccaucgugagccuguucccccucugccuguccacgaccagccagaagaccaccuggcugccggugcuccugggcuccuucgggugcaagccccugaccauguuccucaucacggaguacgagaucuggggccgcaagagcuggccccugaacgaggggaucauggccaucggcaucgucuccauccugcucagcagccugcugaagaacgacgugccccucgccgggccgcugaucgcgggcggcaugcugaucgccugcuacgugaucuccgggagcuccgccgaccucagccuggagaaggccgccgaggucuccugggaggaggaggcggagcacagcggcaccucccacaacauccugguggaggugcaggacgacgggaccaugaagaucaaggacgaggagcgcgacgacacccucacgauccugcugaaggccacccuccuggccgucagcggcguguaccccauguccauccccgccacccuguucgugugguacuucuggcagaagaagaagcagcggagcgggguccucugggacacccccuccccgcccgagguggagcgcgccgugcuggacgacggcaucuaccggauccugcagcgcggccugcucgggcggagccaggucggcguggggguguuccaggacggcgucuuccacacgauguggcacgugacccgcggggcggugcugauguaccagggcaagcggcuggagcccuccugggccagcgucaagaaggaccucaucuccuacggcgggggcuggcgcuuccaggggagcuggaacaccggcgaggagguccaggugaucgccgucgagcccgggaagaacccgaagaacgugcagaccacgcccggcaccuucaagacccccgagggcgaggugggggccaucgcccuggacuucaagcccggcaccuccgggagcccgaucgucaaccgggagggcaagaucgugggccuguacgggaacggcguggucacgaccuccgggaccuacgugagcgcgaucgcccaggccaaggccagccaggaggagccccuccccgagaucgaggacgagguguucaagaagcgcaaccugaccaucauggaccugcacccgggcuccgggaagacgcggcgcuaccuccccgccaucguccgggaggcgaucaagcgcaagcugcggacccugauccucgcccccacccgcgugguggccagcgagauggccgaggcgcugaagggcaugcccauccgcuaccagaccacggccgucaaguccgagcacaccggccgggagaucguggaccugaugugccacgccaccuucaccaugcgccuccugagcccggugcggguccccaacuacaacaugaucaucauggacgaggcccacuucacggaccccgccuccaucgcggcccgcggguacaucagcacccgggugggcaugggggaggccgccgccaucuucaugaccgcgacgccgcccggcuccguggaggccuucccccagagcaacgccgucauccaggacgaggagcgcgacauccccgagcgguccuggaacagcggguacgacuggaucacggacuuccccggcaagaccgugugguucgugcccuccaucaagagcggcaacgacaucgccaacugccugcgcaagaacgggaagcgggucauccagcucucccgcaagaccuucgacaccgaguaccagaagacgaagaacaacgacugggacuacguggugaccaccgacaucagcgagaugggcgccaacuuccgggcggaccgcgucaucgacccccggcgcugccugaagcccgugauccugaaggacgggcccgagcgggugauccucgccggcccgaugcccgucaccguggccuccgccgcgcagcgccgggggcgcaucggccggaaccagaacaaggagggcgaccaguacgucuacauggggcagccccugaacaacgacgaggaccacgcccacuggacggaggccaagaugcugcucgacaacaucaacacccccgagggcaucaucccggcccuguucgagcccgagcgcgagaaguccgccgcgaucgacggggaguaccgccugcggggcgaggcccgcaagaccuucguggagcucaugcggcgcggggaccugcccguguggcuguccuacaaggucgccagcgagggcuuccaguacuccgaccggcgcuggugcuucgacggcgagcggaacaaccaggugcucgaggagaacauggacguggagaucuggaccaaggagggggagcgcaagaagcugcggccccgcuggcuggacgcccggaccuacagcgacccgcucgcccugcgcgaguucaaggaguucgcggccggccggcgcagcgucuccggggaccugauccucgagaucggcaagcugccccagcaccugacgcuccgggcccagaacgcccuggacaaccuggugaugcuccacaacagcgagcagggcgggaaggccuaccgccacgcgauggaggagcugcccgacaccaucgagacccugaugcuccuggcccugaucgccgugcucaccggcggggucacgcuguucuuccuguccggcaaggggcucggcaagaccagcaucggccugcugugcgugaccgccuccagcgcgcuccuguggauggccuccguggagccccacuggaucgccgccagcaucauccuggaguucuuccucaugguccugcugaucccggagcccgaccggcagcgcacgccccaggacaaccagcucgccuacguggugaucgggcugcuguucaugauccucacggucgcggccaacgagaugggccugcuggagaccaccaagaaggaccucgggaucggccacguggccgccgagaaccaccagcacgccaccaugcuggacguggaccugcacccggcguccgccuggacgcucuacgccgucgccaccaccgugaucacccccaugaugcggcacacgaucgagaacaccaccgccaacaucagccugaccgcgaucgccaaccaggccgccauccugauggggcucgacaagggcuggcccaucuccaagauggaccugggcgugccccugcucgcccuggggugcuacagccaggucaacccgcugacgcucaccgcggccgugcugaugcugguggcccacuacgccaucaucggccccgggcuccaggcgaaggccacccgcgaggcccagaagcggaccgccgccggcaucaugaagaaccccacggucgacgggaucguggcgaucgaccuggaccccguggucuacgacgccaaguucgagaagcagcugggccagaucaugcuccugauccugugcaccucccagauccuccugaugcgcaccaccugggcccugugcgagagcaucacgcucgccaccggcccgcugaccacccugugggaggggucccccggcaaguucuggaacacgaccaucgccgugagcauggcgaacaucuuccgcggguccuaccucgccggcgccggccuggccuucagccugaugaagucccucgggggcgggcggcgcggcaccggggcccagggcgagacccugggcgagaaguggaagcggcagcugaaccagcucagcaagagcgaguucaacacguacaagcgcuccgggaucauggagguggaccggagcgaggcgaaggagggccugaagcgcggggagaccaccaagcacgccgucucccggggcgccgccaagcugcgcugguucguggagcggaaccuggugaagcccgaggggaaggucaucgaccucggcugcggccgcgggggcuggagcuacuacugcgcggggcugaagaaggugaccgaggugaagggcuacaccaagggcgggcccggccacgaggagccgauccccauggccacguacggguggaaccuggucaagcuccacuccggcaaggacguguucuucaugccgcccgagaagugcgacacccugcugugcgacaucggggagagcuccccgaaccccaccaucgaggagggccggacccuccgcgugcugaagauggucgagcccuggcugcgggggaaccaguucugcaucaagauccucaaccccuacaugccgagcgugguggagacgcuggagcagaugcagcgcaagcacggcggcaugcugguccggaacccccucucccgcaacagcacccacgagauguacuggguguccugcgggaccggcaacaucgugagcgccgucaacaugaccucccggaugcugcugaaccgcuucacgauggcccaccggaagcccaccuacgagcgcgacguggaccucggggccggcacccgccacguggcggucgagcccgagguggccaaccuggacaucaucggccagcggaucgagaacaucaagaacgagcacaagagcaccuggcacuacgacgaggacaacccguacaagacgugggccuaccacggguccuacgaggugaagcccagcggcuccgccagcuccauggucaacggggugguccgccugcucaccaagcccugggacgugauccccauggugacccagaucgccaugaccgacacgaccccguucggccagcagcgggucuucaaggagaagguggacacccgcacgccccgggcgaagcgcgggacggcccagaucauggaggugaccgccaaguggcuguggggcuuccugagccggaacaagaagccccgcaucugcacccgggaggaguucacccgcaagguccggagcaacgccgccaucggcgcgguguucguggacgagaaccaguggaacuccgccaaggaggccgucgaggacgagcgcuucugggaccucgugcaccgggagcgcgagcugcacaagcaggggaagugcgccacgugcguguacaacaugaugggcaagcgggagaagaagcugggggaguucggcaaggcgaaggggagccgcgccaucugguacauguggcucggcgcccgguuccuggaguucgaggcccugggcuucaugaacgaggaccacugguucucccgcgagaacagccucuccggggucgagggcgaggggcugcacaagcugggcuacauccuccgggacaucagcaagauccccggcgggaacauguacgccgacgacaccgcggggugggacacccgcaucaccgaggacgaccugcagaacgaggccaagaucacggacaucauggagcccgagcacgcccugcucgccaccuccaucuucaagcugaccuaccagaacaagguggugcggguccagcgccccgccaagaacgggaccgugauggacgugaucagccgccgggaccagcgcggcuccgggcaggucggcacguacggccugaacaccuucaccaacauggaggugcagcucauccggcagauggagagcgaggggaucuucuuccccuccgagcuggagagcccgaaccuggcggagcgcgugcucgacuggcuggagaagcacggcgccgagcggcugaagcgcauggccaucuccggggacgacugcgucgugaagcccaucgacgaccgguucgccaccgcccucaucgcgcugaacgacaugggcaaggugcgcaaggacaucccccagugggagcccagcaagggguggaacgacuggcagcaggucccguucugcucccaccacuuccaccagcugaucaugaaggacggccgggagaucguggugcccugccgcaaccaggacgagcucgucggccgggcccgcgugagccagggggccggcuggucccugcgggagacggccugccugggcaagagcuacgcccagauguggcagcucauguacuuccaccgccgggaccugcgccuggcggccaacgccaucugcagcgccgugcccgucgacugggugcccaccucccggaccaccuggagcauccacgcgcaccaccaguggaugaccacggaggacaugcucuccguguggaaccgcgucuggaucgaggagaacccguggauggaggacaagacccacgugagcuccugggaggaggugcccuaccugggcaagcgggaggaccaguggugcgggagccugaucggccucaccgcccgcgccaccugggccacgaacauccaggucgccaucaaccaggugcgccggcugaucggcaacgagaacuaccuggacuacaugaccuccaugaagcgcuucaagaacgagagcgaccccgagggggcgcucugguga

SEQ ID NO: 8991 - RNA, 9879 nt, Artificial Sequence
  derived and/or modified CDS sequence (opt1) from DENV-1__AF311957__SS-prME
agcgugaccaugcugcucaugcugcugcccaccgcccucgccuuccaccugaccacccggggcggggagccccacaugaucgugagcaagcaggagcggggcaagagccuccuguucaagaccagcgccggggugaacaugugcacccugaucgccauggaccugggcgagcucugcgaggacaccaugaccuacaagugcccccggaucaccgaggccgagcccgacgacguggacugcuggugcaacgccaccgacaccugggucaccuacgggaccugcagccagaccggcgagcaccggcgggacaagcgguccguggcccuggcgccccacgugggccuggggcucgagacgcggaccgagaccuggaugagcagcgagggcgccuggaagcagauccagaaggucgagaccugggcccugcggcaccccggguucacggugaucgcccuguuccucgcgcacgccaucggcaccagcaucacccagaaggggaucaucuucauccugcugaugcucgugacccccuccauggccaugcgcugcgucggcaucggcaaccgggacuucguggaggggcugagcggcgccacguggguggacgucgugcuggagcacggguccugcgugaccaccauggccaagaacaagcccacccucgacaucgagcugcugaagacggaggucaccaaccccgcggugcuccgcaagcugugcaucgaggccaagaucagcaacaccaccacggacucccggugcccgacccagggcgaggccacccugguggaggagcaggacgccaacuucgucugccgccggaccuucguggaccgcggcugggggaacggcugcggccucuucggcaaggggagccugcugacgugcgccaaguucaagugcgugaccaagcucgagggcaagaucguccaguacgagaaccugaaguacuccgugaucgugaccguccacaccggcgaccagcaccagguggggaacgagacgaccgagcacggcaccaucgcgaccaucacgccccaggcccccacgagcgagauccagcugaccgacuacggggcccucacccuggacugcagcccccggaccggccuggacuucaacgagaugguccuccugacgaugaaggagaaguccuggcuggugcacaagcagugguuccucgaccugccgcugcccuggaccuccggggccagcaccagccaggagaccuggaaccgccaggaccuccuggugacguucaagaccgcccacgcgaagaagcaggaggucguggugcugggcucccaggagggcgccaugcacaccgcccucaccggggccacggagauccagaccagcggcaccaccacgaucuucgccgggcaccugaagugccggcugaagauggacaagcucacccugaagggcaccuccuacgucaugugcaccgggagcuucaagcuggagaaggagguggcggagacgcagcacggcaccgugcugguccaggugaaguacgagggcaccgacgcccccugcaagauccccuucuccacccaggacgagaagggggugacgcagaacggccgccucaucaccgccaacccgaucgucaccgacaaggagaagcccgugaacaucgagaccgagccgcccuucggggagagcuacaucguggucggcgccggcgagaaggcgcugaagcuguccugguucaagaaggggagcuccaucggcaagauguucgaggccacggcccgcggggcccgccggauggccauccucggcgacaccgcgugggacuucgggagcaucggcggcguguucaccuccguggggaagcugguccaccagguguucggcaccgccuacggggugcuguucagcggcgucuccuggacgaugaagaucgggaucggcauccuccugaccuggcugggccucaacagccgcuccaccagccuguccaugaccugcaucgccguggggauggugacgcuguaccucggcgucauggugcaggccgacagcgggugcgugaucaacuggaagggccgcgagcugaagugcggguccggcaucuucgucaccaacgaggugcacaccuggaccgagcaguacaaguuccaggccgacagcccgaagcggcugagcgcggccaucggccgcgccugggaggagggggugugcggcauccgguccgccacccgccucgagaacaucauguggaagcagaucagcaacgagcugaaccacauccugcucgagaacgacaucaaguucacggucgugguggggaacgccaacggcauccuggcgcaggggaagaagaugauccggccccagcccauggagcacaaguacuccuggaaguccuggggcaaggccaagaucaucggcgccgacauccagaacaccaccuucaucaucgacgggcccgacaccccggagugccccgacgagcagcgcgccuggaacaucugggaggucgaggacuacggcuucgggaucuucacgaccaacaucuggcugaagcuccgggacuccuacacccagaugugcgaccaccgccugaugagcgcggccaucaaggacuccaaggccgugcacgccgacaugggcuacuggaucgagagcgagaagaacgagaccuggaagcuggcccgggcguccuucaucgaggugaagacgugcaucuggcccaagagccacacccucugguccaacggcguccuggagagcgagaugaucauccccaagauguacgggggcccgaucucccagcacaacuaccgccccggguacuucacccagaccgccggccccuggcaccuggggaagcucgagcuggacuucgaccugugcgagggcacgaccgugguggucgacgagcacugcggcagccgggggccgucccuccgcaccaccacggugaccggcaagaucauccacgaguggugcugccggagcugcacccugccgccccugcgcuuccgcggggaggacggcugcugguacgggauggagauccgccccgugaaggagaaggaggagaaccucguccgguccauggugagcgccggcagcggcgagguggacuccuucagccuggggauccugugcgucuccaucaugaucgaggaggugaugcgcagccgguggucccgcaagaugcucaugaccggcacgcuggccguguuccugcuccugaucauggggcagcugaccuggaacgaccucauccgccugugcaucauggucggcgccaacgcgagcgacaagauggggaugggcaccaccuaccuggcccucauggccacguucaagaugcggccgauguucgccguggggcugcuguuccgccggcucaccucccgcgaggugcugcugcucaccaucgggcugagccuggucgccuccguggagcuccccaacagccuggaggagcugggcgacgggcucgcgaugggcaucaugaugcugaagcugcucaccgaguuccagccccaccagcuguggacgacccugcucucccugaccuucaucaagaccacgcugagccucgacuacgccuggaagaccaccgccaccguccuguccaucgugagccuguucccccucugccuguccacgaccagccagaagaccaccuggcugccggugcuccugggcuccuucgggugcaagccccugaccauguuccucaucacggagaacgagaucuggggccgcaagagcuggccccugaacgaggggaucauggccaucggcaucgucuccauccugcucagcagccugcugaagaacgacgugccccucgcggggccgcugaucgccggcggcaugcugaucgccugcuacgugaucuccgggagcuccgccgaccucagccuggagaaggccgcggaggucuccugggaggaggaggccgagcacagcggcaccucccacaacauccugguggaggugcaggacgacgggaccaugaagaucaaggacgaggagcgcgacgacacccucacgauccugcugaaggccacccuccuggccgucagcggcguguaccccauguccauccccgccacccuguucgugugguacuucuggcagaagaagaagcagcggagcgggguccucugggacacccccuccccgcccgagguggagcgcgcggugcuggacgacggcaucuaccggauccugcagcgcggccugcucgggcggagccaggucggcguggggguguuccaggacggcgucuuccacacgauguggcacgugacccgcggggccgugcugauguaccagggcaagcggcuggagcccuccugggccagcgucaagaaggaccucaucuccuacggcgggggcuggcgcuuccaggggagcuggaacaccggcgaggagguccaggugaucgccgucgagcccgggaagaacccgaagaacgugcagaccacgcccggcaccuucaagacccccgagggcgaggugggggccaucgcgcuggacuucaagcccggcaccuccgggagcccgaucgucaaccgggagggcaagaucgugggccuguacgggaacggcguggucacgaccuccgggaccuacgugagcgccaucgcccaggccaaggccagccaggagggcccccuccccgagaucgaggacgagguguucaagaagcgcaaccugaccaucauggaccugcacccgggguccggcaagacgcggcgcuaccuccccgcgaucguccgggaggccaucaagcgcaagcugcggacccugauccucgcccccacccgcgugguggccagcgagauggcggaggcccugaagggcaugcccauccgcuaccagaccacggccgucaaguccgagcacaccgggcgggagaucguggaccugaugugccacgccaccuucaccaugcgccuccugagcccggugcggguccccaacuacaacaugaucaucauggacgaggcccacuucacggaccccgcguccaucgccgcccgcggcuacaucagcacccggguggggaugggcgaggccgccgcgaucuucaugaccgccacgccgcccggguccguggaggccuucccccagagcaacgccgucauccaggacgaggagcgcgacauccccgagcgguccuggaacagcggcuacgacuggaucacggacuuccccggcaagaccgugugguucgugcccuccaucaagagcgggaacgacaucgccaacugccugcgcaagaacggcaagcgggucauccagcucucccgcaagaccuucgacaccgaguaccagaagacgaagaacaacgacugggacuacguggugaccaccgacaucagcgagaugggggcgaacuuccgggccgaccgcgucaucgacccccggcgcugccugaagcccgugauccugaaggacggccccgagcgggugauccucgccgggccgaugcccgucaccguggccuccgcggcccagcgccggggccgcaucggccggaaccagaacaaggagggggaccaguacgucuacaugggccagccccugaacaacgacgaggaccacgcccacuggacggaggccaagaugcugcucgacaacaucaacacccccgaggggaucaucccggcccuguucgagcccgagcgcgagaaguccgcggccaucgacggcgaguaccgccugcgcggggaggcccgcaagaccuucguggagcucaugcggcgcggcgaccugcccguguggcuguccuacaaggucgccagcgagggcuuccaguacuccgaccggcgcuggugcuucgacggggagcggaacaaccaggugcucgaggagaacauggacguggagaucuggaccaaggagggcgagcgcaagaagcugcggccccgcuggcuggacgcccggaccuacagcgacccgcucgcgcugcgcgaguucaaggaguucgccgccgggcggcgcagcgucuccagcgaccugauccucgagaucggcaagcugccccagcaccugacgcuccgggcccagaacgcccuggacaaccuggugaugcuccacaacuccgagcagggcgggaaggcguaccgccacgccauggaggagcugcccgacaccaucgagacccugaugcuccuggcccugaucgccgugcucaccggcggggucacgcuguucuuccugagcggcaaggggcucggcaagaccuccaucggccugcugugcgugaccgcgagcuccgcccuccuguggauggccagcguggagccccacuggaucgccgccuccaucauccuggaguucuuccucaugguccugcugaucccggagcccgaccggcagcgcacgccccaggacaaccagcucgcguacguggugaucgggcugcuguucaugauccucacggucgccgccaacgagaugggccugcuggagaccaccaagaaggaccucgggaucggccacguggccgccgagaaccaccagcacgcgaccaugcuggacguggaccugcacccggccagcgccuggacgcucuacgccgucgccaccaccgugaucacccccaugaugcggcacacgaucgagaacaccaccgcgaacaucucccugaccgccaucgccaaccaggccgccauccugauggggcucgacaagggcuggcccaucagcaagauggaccugggcgugccccugcucgcgcuggggugcuacucccaggucaacccgcugacgcucaccgccgccgugcugaugcugguggcccacuacgcgaucaucggccccgggcuccaggccaaggccacccgcgaggcccagaagcggaccgccgcgggcaucaugaagaaccccacggucgacgggaucguggccaucgaccuggaccccguggucuacgacgccaaguucgagaagcagcugggccagaucaugcuccugauccugugcaccagccagauccuccugaugcgcaccaccugggcccugugcgaguccaucacgcucgccaccggcccgcugaccacccugugggaggggagccccggcaaguucuggaacacgaccaucgcgguguccauggccaacaucuuccgcgggagcuaccucgccggcgccggccuggccuucucccugaugaagucccucgggggcgggcggcgcggcaccggggcgcagggcgagacccugggcgagaaguggaagcggcagcugaaccagcucagcaaguccgaguucaacacguacaagcgcagcgggaucauggagguggaccgguccgaggccaaggagggccugaagcgcggggagaccaccaagcacgccgucagccggggcaccgccaagcugcgcugguucguggagcggaaccuggugaagcccgaggggaaggucaucgaccucggcugcggccgcgggggcugguccuacuacugcgcggggcugaagaaggugaccgaggugaagggcuacacgaagggcgggcccggccacgaggagccgauccccauggccaccuacggguggaaccuggucaagcuccacagcggcaaggacguguucuucaucccgcccgagaagugcgacacccugcugugcgacaucggggaguccagcccgaaccccaccaucgaggagggccggacgcuccgcgugcugaagauggucgagcccuggcugcgggggaaccaguucugcaucaagauccucaaccccuacaugccguccgugguggagacccuggagcagaugcagcgcaagcacggcggcaugcugguccggaacccccucagccgcaacuccacccacgagauguacugggugagcugcgggaccggcaacaucguguccgccgucaacaugacgagccggaugcugcugaaccgcuucaccauggcccaccggaagcccaccuacgagcgcgacguggaccucggggccggcacccgccacguggcggucgagcccgagguggccaaccuggacaucaucggccagcggaucgagaacaucaagaacgagcacaaguccacguggcacuacgacgaggacaacccguacaagaccugggccuaccacgggagcuacgaggugaagcccuccggcagcgccuccagcauggucaacggggugguccgccugcucaccaagcccugggacgugauccccauggugacccagaucgccaugacggacaccaccccguucggccagcagcgggucuucaaggagaagguggacacccgcacgccccgggcgaagcgcgggaccgcccagaucauggaggugaccgccaaguggcuguggggcuuccugagccggaacaagaagccccgcaucugcacccgggaggaguucacgcgcaagguccgguccaacgccgccaucggcgcgguguucguggacgagaaccaguggaacagcgccaaggaggccgucgaggacgagcgcuucugggaccucgugcaccgggagcgcgagcugcacaagcaggggaagugcgcgaccugcguguacaacaugaugggcaagcgggagaagaagcugggggaguucggcaaggcgaaggggucccgcgccaucugguacauguggcucggcgcccgguuccuggaguucgaggcccugggcuucaugaacgaggaccacugguucagccgcgagaacucccucagcggggucgagggcgaggggcugcacaagcugggcuacauccuccgggacaucuccaagaucccgggcgggaacauguacgccgacgacaccgcggggugggacacccgcaucacggaggacgaccugcagaacgaggccaagaucaccgacaucauggagcccgagcacgcccugcucgccaccagcaucuucaagcugaccuaccagaacaagguggugcggguccagcgccccgccaagaacgggacggugauggacgugaucucccgccgggaccagcgcggcagcgggcaggucggcaccuacggccugaacaccuucaccaacauggaggugcagcucauccggcagauggaguccgaggggaucuucuuccccagcgagcuggaguccccgaaccuggcggagcgcgugcucgacuggcuggagaagcacggcgccgagcggcugaagcgcauggccaucagcggggacgacugcgucgugaagcccaucgacgaccgguucgccacggcccucaucgcgcugaacgacaugggcaaggugcgcaaggacaucccccagugggagcccuccaagggguggaacgacuggcagcaggucccguucugcagccaccacuuccaccagcugaucaugaaggacggccgggagaucguggugcccugccgcaaccaggacgagcucgucggccgggcccgcgugucccagggggccggcuggagccugcgggagaccgccugccugggcaagagcuacgcccagauguggcagcucauguacuuccaccgccgggaccugcgccuggcggccaacgccaucugcuccgccgugcccgucgacugggugcccaccagccggaccaccugguccauccacgcgcaccaccaguggaugacgaccgaggacaugcucagcguguggaaccgcgucuggaucgaggagaacccguggauggaggacaagacccacguguccagcugggaggaggugcccuaccugggcaagcgggaggaccaguggugcgggucccugaucggccucaccgcccgcgccacgugggccaccaacauccaggucgccaucaaccaggugcgccggcugaucggcaacgagaacuaccuggacuacaugaccagcaugaagcgcuucaagaacgaguccgaccccgagggggcgcucugguga

SEQ ID NO: 8992 - RNA, 9879 nt, Artificial Sequence
  derived and/or modified CDS sequence (opt1) from DENV-1__EU280167__SS-prME
agcgugaccaugcugcucacccugaugcccaccgcccuggccuuccaccucaccacccggggcggggagccccacaugaucgugagcaagcaggagcggggcaagagccugcuguucaagaccuccgcgggggugaacaugugcacccucaucgccauggaccugggcgagcugugcgaggacaccgugaccuacaagugcccccggaucaccgaggccgagcccgacgacgucgacugcuggugcaacgccaccgacaccugggugaccuacgggaccugcagccagacgggcgagcaccggcgggacauccgguccguggcccucgcgccccacgucggccuggggcuggagacccggaccgagaccuggaugagcuccgagggcgccuggaagcagauccagcggguggacacgugcgugcuccgccacccgggguucaccgucaucgcccuguuccuggcccacgcgaucggcaccagcaucucccagaaggggaucaucuucauccuccugaugcuggugacccccagcaugacgaugcggugcgugggcaucggcucccgcgacuucgucgaggggcucagcggcgccaccuggguggacgugguccuggagcacggguccugcgugaccagcauggccaaggacaagcccacccuggacaucgagcuccugaagacggaggugcccaaccccgccguccugcggaagcucugcaucgaggccaagaucuccaacaccaccaccgacagccgcugccccacgcagggcgaggcgacccugguggaggagcaggacgccaacuucgugugccggcgcaccuucgucgaccggggcugggggaacggcugcgggcuguucggcaaggggucccuccugaccugcgacaaguucaagugcgugacgaagcuggagggcaagaucauccaguacgagaacuucaaguacagcgugaucgucaccgugcacaccggcgaccagcaccaggucgggaacgaguccaccgagcacggcacgaccgccaccaucacgccccaggcccccaccacggagauccagcucaccgacuacggggcccugacccuggacugcagcccgcgcaccggccucgacuucaacgagauggugcugcugacgaugaaggagaaguccuggcucgugcacaagcagugguuccuggaccugccccuccccuggaccuccggggcgagcaccucccgggagaccuggaaccgccaggaccugcuggucacguucaagaccgcccacgccaagaagcaggagguggugguccucggcagccaggagggcgccaugcacaccgcccugaccggggcgacggagauccagaccuccggcaccaccacgaucuucgccgggcaccugaagugccggcucaagauggacaagcugacccugaagggcaugagcuacgugaugugcaccggguccuucaagcucgagaaggagguggccgagacccagcacggcacgguccuggugcagaucaaguacgagggcaccgacgcccccugcaagaucccguucagcacccaggacgagaagggggugacccagaacggccgccugaucacggccaaccccaucgucaccgacaaggagaagcccgugaacaucgaggcggagcccccguucggggaguccuacaucgugaucggcgucggcgagaaggcccugaagcucagcugguucaagaagggguccagcaucggcaagauguucgaggccaccgcccgcggggcccgccgcauggccauccugggcgacaccgccugggacuucggguccaucggcggcguguucacgagcguggggaagcugguccaccagaucuucggcaccgccuacggggugcuguucuccggcgugagcuggaccaugaagaucgggaucggcguccugcugaccuggcucggccugaacucccggagcacgucccugagcaugaccugcaucgccguggggcucgugacccuguaccugggcgucauggugcaggcggacagcgggugcgugaucaacuggaagggccgcgggcucaagugcggcuccggcaucuucgucaccaacgaggugcacacguggaccgggcaguacaaguuccaggccgacagccccaagggccuguccgccgccaucgggaaggccugggaggagggcgugugcgggauccggagcgcgacccgccuggagaacaucauguggaagcagaucuccaacgagcucaaccacauccugcuggagaacgacaugaaguucaccgucguggugggcgacgucgccggcauccucgcccaggggaagaagaugauccggccccagcccauggagcacaaguacagcuggaagaacuggggcaaggccaagaucaucggggccgacgugcagaacuccaccuucaucaucgacggcccgaacacgcccgagugcagcgacgaccagcgcgcguggaacaucugggagguggaggacuacggcuucgggaucuucaccaccaacaucuggcugaagcugcgggacuccuacacccaggucugcgaccaccgccucaugagcgccgccaucaaggacuccaaggccgugcacgcggacaugggcuacuggaucgagagcgagaagaacgagacguggaagcuggcccgggccuccuucaucgaggugaagaccugcaucuggcccaagagccacacccugugguccaacgggguccucgagagcgagaugaucauccccaagaucuacggcgggccgaucucccagcacaacuaccgccccggcuacuucacccagacggccggccccuggcaccuggggaagcuggagcucgacuucgaccugugcgagggcaccaccgugguggucgacgagcacugcgggaaccggggcccgagccuggggaccacgaccgugaccggcaagaucauccacgaguggugcugccgcagcugcacccugccgccccuccgguuccgcggcgaggacgggugcugguacggcauggagauccggcccgugaaggagaaggaggagaaccuggucaaguccauggugagcgccggguccggcgagguggacagcuucucccucgggcugcugugcaucagcaucaugaucgaggaggucaugcgcucccgguggagccgcaagaugcucaugacgggcacccuggcgguguucuuccugcucaucaugggccagcugaccuggaacgaccugauccggcucugcaucauggugggggccaacgccuccgaccgcaugggcauggggaccacguaccuggcccugauggccaccuucaagaugcgcccgauguucgcggucggccuccuguuccggcgccugaccagccgggaggugcuccugcugaccaucggccucucccuggucgccagcguggagcugcccaacucccucgaggagcugggggacggccuggccauggggaucaugauccucaagcugcugacggacuuccgcagccaccagcucugggccacccugcuguccaugaccuucaucaagaccgccuucagccuccacuacgcguggaagacgauggccauggugcuguccaucgucagccuguucccccucugccuguacaccaccucccagaagaccacguggcugcccgugcuccugggcagccuggggugcaagccgcucaccauguuccugaucgccgagaacaagaucuggggccgcaagagcuggccccugaacgagggcaucauggccguggggaucgucuccauccuccugagcucccugcucaagaacgacgugccccuggcgggcccccugaucgccgggggcaugcucaucgccugcuacgugaucagcggguccagcgccgaccugucccuggagaaggccgcggaggucagcugggaggaggaggccgagcacuccggcgccagccacaacauccucguggaggugcaggacgacggcaccaugaagaucaaggacgaggagcgcgacgacacccugacgauccugcucaaggccacccugcuggccgucuccgggguguacccgcucagcauccccgcgacccuguucguguggugcuucuggcagaagaagaagcagcgguccggcguccugugggacacccccagcccgcccaagguggagcgcgccgugcucgacgacgggaucuaccggaucaugcagcgcggccugcuggggcggucccaggucggcgugggcguguuccaggagaacgucuuccacaccauguggcacgugacgcgcggggccgugcugauguaccagggcaagcggcucgagcccagcugggccuccgucaagaaggaccugaucagcuacgggggcggguggcgccugcagggcuccuggaacaccggcgaggagguccaggugaucgccgucgagcccgggaagaaccccaagaacgugcagaccgcgcccggcaccuucaagacgcccgagggggaggugggcgccaucgcccucgacuucaagcccggcaccagcgggagccccaucgucaaccgggagggcaagaucguggggcuguacggcaacgggguggucaccaccuccggcacguacgugagcgccaucgcccaggcgaaggccucccaggagggcccgcugcccgagaucgaggacgagguguuccgcaagcggaaccucaccaucauggaccugcaccccgggagcggcaagacccgccgguaccugccggccaucguccgcgaggccaucaagcggaagaugcgcacccucauccuggcgcccacgcgcgugguggccuccgagauggccgaggcccugaaggggaugcccauccgguaccagaccaccgccgucaagagcgagcacaccggcaaggagaucguggaccucaugugccacgcgacguucaccaugcgccugcugucccccgugcgggucccgaacuacaacaugaucaucauggacgaggcccacuucaccgaccccagcuccaucgccgcccgcggguacaucagcacccgggugggcaugggcgaggccgcggccaucuucaugacggccacgccgcccggguccguggaggccuucccgcagagcaacgccgucauccaggacgaggagcgcgacauccccgagcgguccuggaacagcggcuacgaguggaucaccgacuuccccgggaagaccgugugguucgugcccuccaucaaggcgggcaacgacaucacgaacugccuccgcaagaacgggaagcgggucauccagcugagccgcaagaccuucgacaccgaguaccagaagaccaagaacaacgacugggacuacguggugacgaccgacaucuccgagaugggcgccaacuuccgggccgaccgcgucauggacccgcggcgcugccugaagcccgugauccucaaggacggccccgagcgggucauccuggccgggcccaugccggugaccguggcgagcgccgcccagcgccggggccgcaucgggcggaaccacaacaaggagggcgaccaguacaucuacauggggcagccccugaccaacgacgaggaccacgcccacuggacggaggccaagaugcuccuggacaacaucaacacccccgagggcaucauccccgcgcuguucgagccggagcgcgagaaguccgccgccaucgacggcgaguaccgccuccgcggggaggcccgcaagaccuucgucgagcugaugcggcgcggcgaccugcccguguggcucagccacaagguggccagcgagggguuccaguacuccgaccggcgcuggugcuucgacggcgagcggaacaaccagguccuggaggagaacauggacguggagaucuggaccaaggagggcgagcgcaagaagcugcggccccgcuggcucgacgcgcggacguacagcgacccccuggcccugcgcgaguucaaggaguucgccgccgggcggcgcuccgugagcggcgaccucauccuggagaucgggaagcugccgcagcaccucacccagcgggcccagaacgcgcuggacaaccuggucaugcuccacaacuccgagcagggcgggcgcgccuaccggcacgccauggaggagcugcccgacaccaucgagacccugaugcuccuggcccugaucgcggugcucacgggcggcgugacccuguucuuccugagcgggaagggccucgggaagaccuccaucggccugcugugcgucauggccagcuccgugcuccuguggauggccagcguggagccccacuggaucgccgccuccaucauccuggaguucuuccucaugguccugcugauccccgagccggaccgccagcggacgccccaggacaaccagcucgcguacguggugaucgggcugcuguucaugauccucaccgucgccgccaacgagaugggccugcuggagacgaccaagaaggaccucggcaucgggcacguggccguggagaaccaccaccacgccgcgaugcuggacgucgaccugcaccccgccagcgccuggacccucuacgccguggccaccacgaucaucaccccgaugaugcgccacaccaucgagaacaccacggcgaacaucucccugaccgccaucgccaaccaggccgccauccugaugggccucgacaagggguggcccaucagcaagauggacaucggcgugccccugcuggcgcucgggugcuacucccaggucaacccccugacccugaccgccgccgugcucaugcugguggcccacuacgcgaucaucggcccgggccugcaggccaaggccacgcgggaggcccagaagcgcaccgccgcggggaucaugaagaaccccaccaucgacggcaucgucgccaucgaccucgaccccgugguguacgacgccaaguucgagaagcagcuggggcagaucaugcugcucauccugugcaccagccagauccugcucaugcgcacgaccugggcccugugcgaguccaucacccuggccaccggcccccucacgacccugugggagggcagcccggggaaguucuggaacaccaccaucgcggucuccauggccaacaucuuccggggcagcuaccuggccggggccggccucgccuucagccugaugaagucccucgggggcggccgccgggggacgggcgcgcagggggagacccucggcgagaaguggaagcgccagcugaaccagcugagcaaguccgaguucaacaccuacaagcggagcgggaucauggagguggaccgcuccgaggccaaggagggccucaagcggggcgagaccacgaagcacgccgugagccgcgggaccgccaagcugcggugguucgucgagcgcaaccuggugaagcccgagggcaaggugaucgaccucgggugcggccgcgggggcugguccuacuacugcgcgggccugaagaaggucaccgaggugaagggguacaccaagggcgggcccggccacgaggagcccaucccgauggccacguacggguggaaccuggugaagcugcacagcggcaaggacgucuucuucaucccgcccgagaagugcgacacccuccugugcgacaucggcgaguccagccccaacccgaccaucgaggaggggcgcacccugcgggugcucaagaugguggagcccuggcugcgcggcaaccaguucugcaucaagauccugaaccccuacaugcccuccgucguggagacgcucgagcagaugcagcggaagcacgggggcaugcuggugcgcaacccgcugagccggaacuccacccacgagauguacugggucagcugcggcaccgggaacaucguguccgccgugaacaugaccagccgcaugcuccugaaccgguucaccauggcccaccgcaagcccacguacgagcgcgacgucgaccugggcgccgggacccggcacguggcgguggagcccgaggucgccaaccucgacaucaucggccagcgcaucgagaacaucaagcacgagcacaaguccaccuggcacuacgacgaggacaaccccuacaagaccugggccuaccacgggagcuacgaggugaagccguccggcagcgccagcuccauggucaacggcguggugaagcugcugacgaagcccugggacgucauccccauggugacccagaucgccaugaccgacaccacgcccuucgggcagcagcggguguucaaggagaaggucgacacccgcaccccgaaggcgaagcggggcaccgcccagaucaugguggugacggcccgcuggcucuggagcuuccugucccggaacaagaagccccgcaucugcacccgggaggaguucacccgcaagguccggagcaacgccgccaucggggcgguguucguggacgagaaccaguggaacuccgccaaggaggccgucgaggacgaccgcuucugggaccuggugcaccgggagcgcgagcuccacaagcagggcaagugcgcgaccugcguguacaacacgauggggaagcgggagaagaagcugggcgaguucggcaaggcgaaggggagccgcgccaucugguacauguggcugggcgcccgguuccucgaguucgaggcccugggguucaugaacgaggaccacugguucucccgcgagaacagccuguccggcgucgagggggagggccuccacaagcugggcuacauccugcgggacaucagcaagauccccgggggcaacauguacgccgacgacaccgcggggugggacacccgcaucaccgagggcgaccuccagaacgaggccaagaucacggacaucauggagccggagcacgcccugcuggccaaguccaucuucaagcucaccuaccagaacaagguggugcggguccagcgccccgccaagaacggcaccgugauggacgugaucagccgccgggaccagcgcggguccggccaggucgggaccuacggccugaacacguucaccaacauggaggcgcagcugauccggcagauggagagcgaggggaucuucucccccaacgagcucgagacccccaaccuggccgagcgcgugcuggacuggcucgagaaguacggcguggagcggcugaagcgcauggccaucagcggcgacgacugcgucgugaagccgaucgacgaccgguucgccaccgcccugacggcgcucaacgacauggggaaggugcgcaaggacaucccccagugggagcccuccaagggcuggaacgacuggcagcagguccccuucugcagccaccacuuccaccagcugaucaugaaggacgggcgggagaucguggugccgugccgcaaccaggacgagcuggucggccgggcccgcgugagccagggggccggcuggucccuccgggagaccgccugccugggcaagagcuacgcccagauguggcagcugauguacuuccaccgccgggaccuccgccuggcggccaacgccaucugcuccgccgugcccgucgacugggugcccaccagccggaccacgugguccauccacgcgcaccaccaguggaugaccaccgaggacaugcugagcguguggaaccgcgucuggaucgaggagaaccccuggauggaggacaagacccggaucuccagcugggaggacgugccguaccucggggagcgcgaggaccaguggugcggcucccugaucgggcugacggcccgcgccaccugggccaccaacgugcaggucgccaucaaccaggugcggcgccucaucggcaacgagaacuacagcgacuacaugaccuccaugaagcgguucaagaacaagagcgagcccgagggggcgcugugguga

SEQ ID NO: 8993 - RNA, 9876 nt, Artificial Sequence
  derived and/or modified CDS sequence (opt1) from DENV-2__AJ968413__SS-prME
accgccgggaugaucaucaugcugauccccaccgugauggccuuccaccucaccacccggaacggggagccccacaugaucgucagccggcaggagaagggcaagagccugcuguucaagaccgaggacggggugaacaugugcacccucauggcgauggaccugggcgagcugugcgaggacaccaucaccuacaagugcccccuccugcggcagaacgagcccgaggacaucgacugcuggugcaacagcaccagcaccugggugaccuacgggaccugcaccaccaccggcgagcaccggcgcgagaagcggagcgucgcccuggugccccacgugggcauggggcucgagacccgcaccgagaccuggauguccagcgagggcgccuggaagcacgcccagcggaucgagacguggauccugcgccaccccggguucacccugauggccgcgauccucgccuacaccaucggcaccacgcacuuccagcgggcccugaucuucauccugcucaccgccgucgcgcccuccaugaccaugcgcugcaucgggaucagcaaccgggacuucguggagggcguguccggcgggagcugggucgacaucgugcuggagcacggcuccugcgugaccacgauggccaagaacaagcccacccuggacuucgagcucaucaagaccgaggccaagcagcuggccacccugcgcaaguacugcaucgaggccaagcucacgaacaccaccaccgagagccggugccccacgcagggggagcccucccugaacgaggagcaggacaagcgcuucgucugcaagcacagcaugguggaccggggcuggggcaacgggugcggccuguucgggaagggcgggaucgugaccugcgcgauguucacgugcaagaagaacauggagggcaagaucguccagcccgagaaccucgaguacaccaucgugaucacgccccacuccggcgaggagcacgccguggggaacgacaccggcaagcacgggaaggagaucaagaucacgccccagagcuccaucaccgaggccgagcugaccggcuacgggacggucaccauggagugcagcccgcgcaccggccuggacuucaacgagauggugcuccugcagauggagaacaaggccuggcuggugcaccggcagugguuccucgaccugccccugcccuggcuccccggcgccgacacccagggguccaacuggauccagaaggagacgcuggucaccuucaagaacccgcacgcgaagaagcaggacguggugguccugggcagccaggagggggccaugcacaccgcccucaccggcgccacggagauccagaugagcuccgggaaccugcuguucaccggccaccucaagugccgccugcggauggacaagcugcagcucaagggcaugagcuacuccaugugcaccgggaaguucaagguggucaaggagaucgccgagacccagcacggcacgaucguggugcgcguccaguacgagggggacggcagccccugcaagauccccuucgagaucauggaccuggagaagcggcacgugcugggccgccucaucaccgugaaccccaucgucaccgagaaggacuccccggugaacaucgaggcggagccgcccuucggggacagcuacgugaucaucggcgucgagcccgggcagcugaagcugaacugguucaagaagggcuccagcaucgggcagauguucgagaccacgaugcgcggcgccaagcggauggccauccucggcgacaccgccugggacuucgggucccugggcgggguguucaccagcaucggcaaggcccugcaccagguguucggggcgaucuacggcgccgccuucuccggcgucagcuggaccaugaagauccugaucggggugaucaucacguggaucggcaugaacucccgcagcaccucccucagcgugucccugguccugguggggguggucacccucuaccugggcguggugguccaggccgacagcgggugcgugguguccuggaagaacaaggagcugaagugcggcagcggcaucuucaucaccgacaacguccacacguggaccgagcaguacaaguuccagccggagagccccuccaagcucgcgagcgccauccagaaggcccaccaggaggggaucugcggcauccgguccgugacccgccuggagaaccugauguggaagcagaucacccccgagcucaaccacauccugagcgagaacgaggugaagcugacgaucaugaccggggacaucaagggcaucaugcacgccgggaagcggucccuccgcccccagccgaccgagcugcgguacagcuggaagaccuggggcaaggccaagauccuguccacggagagccacaaccagaccuuccucaucgacggccccgagaccgcggagugccccaacaccaaccgcgccuggaacucccuggaggucgaggacuacggguucggcguguucacgaccaacaucuggcugaagcuccgggagaagcaggacguguucugcgacagcaagcugauguccgccgccaucaaggacaaccgcgccguccacgcggacaugggguacuggaucgagagcgcccugaacgacaccuggaagaucgagaaggccuccuucaucgaggucaagagcugccacuggccgaagucccacacccucuggagcaacggcgugcuggaguccgagaugaucauccccaagaacuucgccggccccgugagccagcacaacuaccggcccggguaccacacccagacggccggcccguggcaccuggggaagcucgagauggacuucgacuucugcgagggcaccaccgugguggucaccgaggacugcgggaaccgcggccccagccugcggacgaccaccgcguccggcaagcugaucaccgaguggugcugccgcagcugcacgcugccgccccuccgguaccgcggggaggacggcugcugguacgggauggagauccggccgcugaaggagaaggaggagaaccucgugaacucccuggugaccgccggccacgggcagaucgacaacuucagccugggcguccucggcauggcccuguuccuggaggagaugcuccgcacccggguggggaccaagcacgccacgcugcugguggcggucuccuucgugacccucaucaccggcaacaugagcuuccgcgaccuggggcgcgugauggucauggugggcgccaccaugacggacgacaucgggaugggcgugaccuaccuggcccuccuggccgccuucaagguccggcccaccuucgcggccggccugcuccugcgcaagcugaccuccaaggagcucaugaugacgaccaucgggguggugcugcugagccaguccaccauccccgagaccauccucgagcugacggacgcccuggcccucggcaugaugguccugaagaucgugcggaagauggagcgcuaccagcuggccgucaccaucaccgcgauccucugcgugcccaacgccgugauccugcagaacgccuggaaggucagcugcaccauccuggccgugguguccgucagcccgcuccugcugacguccagccagcagaaggccgacuggaucccccucgcgcugaccaucaaggggcugaaccccaccgccaucuuccucaccacgcugucccggaccagcaagaagcgcuccuggccccugaacgaggccaucauggccgugggcauggugagcauccucgcguccagccugcugaagaacgacaucccgaugaccggcccccucgucgccgggggccugcugaccgugugcuacgugcucacggggcggagcgccgaccuggagcuggagaaggccgccgacguccgcugggaggaccaggcggagaucuccggcagcucccccauccucagcaucaccaucuccgaggacgggagcauguccaucaagaacgaggaggaggagcagacccugaccauccugauccggaccggccuccuggugaucagcggccuguuccccguguccaucccgaucacggccgccgccugguaccucugggaggucaagaagcagcgcgccggggugcugugggacgugcccuccccgccgcccgucggcaaggcggagcuggaggacggggccuaccggaucaagcagaagggcauccucggguacucccagaucggcgccggcguguacaaggaggggaccuuccacaccauguggcacgugacccgcggcgccguccugaugcacaaggggaagcggaucgagcccagcugggccgacgugaagaaggaccugaucuccuacggcgggggcuggaagcucgagggcgaguggaaggagggggaggaggugcagguccuggcgcuggagcccggcaagaacccccgcgccgugcagacgaagcccggccucuucaagaccaacaccggcaccaucggggccgugagccuggacuucucccccggcacgagcggcucccccaucaucgacaagaaggggaaggucgugggccuguacgggaacggcguggucacccggaacggcgccuacgugagcgccaucgcgcagaccgagaaguccaucgaggacaacccggagaucgaggacgacaucuuccgcaagaagcggcugaccaucauggaccuccaccccggggccggcaagacgaagcgcuaccugcccgccaucgugcgggaggccaucaagcgcgggcugcggacccucauccuggcgcccacccgcgucguggccgccgagauggaggaggcccugcgcggccucccgauccgguaccagacccccgccauccgcgcggagcacacggggcgggagaucguggaccugaugugccacgccaccuucaccaugcgccugcucagccccguccgggugcccaacuacaaccugaucaucauggacgaggcccacuucaccgacccggccagcaucgccgcgcgcggcuacaucuccacgcggguggagaugggcgaggccgccgggaucuucaugaccgccacgccgcccggcagccgcgaccccuucccgcaguccaacgcccccaucauggacgaggagcgggagauccccgagcgcagcuggaacuccgggcacgagugggucaccgacuucaagggcaagacggugugguucgugcccagcaucaaggcggggaacgacaucgccgccugccugcggaagaacggcaagaaggucauccagcucucccgcaagaccuucgacagcgaguacgugaagacccggaccaacgacugggacuucguggucacgaccgacaucuccgagaugggcgccaacuucaaggcggagcgcgugaucgacccgcggcgcugcaugaagcccgugauccugaccgacggggaggagcgggucauccuggccggccccaugcccgugacccacagcuccgccgcccagcgccgggggcgcaucggccgcaacccgaagaacgagaacgaccaguacaucuacaugggggagccccucgagaacgacgaggacugcgcccacuggaaggaggcgaagaugcugcuggacaacaucaacacgcccgagggcaucauccccagcauguucgagccggagcgggagaagguggacgccaucgacggcgaguaccgccuccgcggggaggcccgcaagaccuucgucgaccugaugcggcgcggcgaccugcccguguggcucgccuacaaggucgccgcggaggggaucaacuacgccgaccggcgcuggugcuucgacggcauccggaacaaccagauccuggaggagaacguggagguggagaucuggaccaaggagggggagcgcaagaagcugaagccccgguggcucgacgcccgcaucuacuccgacccgcuggcccugaaggaguucaaggaguucgccgcgggccgcaagagccucacccugaaccugaucacggagaugggccgccuccccaccuucaugacccagaaggcccgggacgcccuggacaaccuggccguccuccacaccgcggaggccgggggccgcgccuacaaccacgcccuguccgagcugcccgagacgcucgagacccugcugcuccugacccugcucgccaccgugaccgggggcaucuuccuguuccugaugagcggccgggggaucggcaagaugacgcucgggaugugcugcaucaucaccgcguccauccugcugugguacgcccagauccagccccacuggaucgccgccagcaucauccucgaguucuuccugaucgugcugcucaucccggagcccgagaagcagcgcacgccccaggacaaccagcugaccuacgucgugaucgccauccugacgguggucgcggccaccauggccaacgagaugggcuuccucgagaagaccaagaaggaccuggggcugggcuccaucaccacgcagcagcccgagagcaacauccucgacaucgaccugcggccggccagcgccuggacccuguacgcgguggccaccaccuucgugacgcccaugcuccgccacuccaucgagaacagcuccgucaacgugagccugaccgccaucgccaaccaggccaccgugcugaugggccucgggaagggcuggccccuguccaagauggacaucggggucccccugcucgcgaucggcugcuacagccaggugaacccgaucacccugacggccgcccugcuccugcugguggcccacuacgcgaucaucgggcccggccuccaggccaaggccacccgggaggcccagaagcgcgccgcggccggcaucaugaagaaccccaccgucgacgggaucaccgugaucgaccuggaccccaucccguacgaccccaaguucgagaagcagcugggccaggugaugcuccugguccugugcgugacccaggugcucaugaugcgcaccaccugggcccugugcgaggcccugacccucgccacggggcccaucuccacccugugggagggcaaccccgggcgguucuggaacaccaccaucgcggucagcauggccaacaucuuccgcggcuccuaccuggccggcgccgggcuccuguucagcaucaugaagaacacgaccaacacccggcgcggcaccgggaacaucggcgagacgcugggcgagaaguggaagaaccggcucaacgcccuggggaaguccgaguuccagaucuacaagaaguccggcauccaggagguggaccgcacccuggcgaaggaggggaucaagcggggcgagaccgaccaccacgccgugucccgcgggagcgccaagcuccggugguucgucgagcgcaacauggugaccccggagggcaagguggucgaccugggcugcgggcggggcgggugguccuacuacugcggcgggcugaagaacgugcgcgaggugaagggccucacgaagggcgggcccggccacgaggagcccauccccaugagcaccuacggguggaaccugguccggcugcaguccggcguggacguguucuucaccccgcccgagaagugcgacacccuccugugcgacaucggggagagcucccccaaccccaccgucgaggccggccgcacgcugcgggugcucaaccugguggagaacuggcugaacaacaacauccaguucugcaucaagguccugaacccguacaugcccagcgugaucgagaagauggaggcgcuccagcgcaaguacggcggggcccuggugcggaacccccugagccgcaacuccacccacgagauguacugggucagcaacgccuccggcaacaucgugagcuccgugaacaugaucagccggaugcucaucaaccgcuucaccaugaagcacaagaaggccaccuacgagccggacgucgaccugggguccggcacgcgcaacaucgggaucgagagcgaggugcccaaccuggacaucaucggcaagcggaucgagaagaucaagcaggagcacgagaccuccuggcacuacgaccaggaccaccccuacaagaccugggccuaccacggcagcuacgagaccaagcagacgggguccgcgagcuccauggugaacggcgucgugcgccuccugaccaagcccugggacguggucccgauggugacccagauggccaugaccgacacgacccccuucgggcagcagcgggucuucaaggagaagguggacacccgcacccaggagcccaaggagggcacgaagaagcugaugaagaucaccgccgaguggcucuggaaggagcugggcaagaagaagacgccccggaugugcacccgcgaggaguucacgcggaaggugcgcagcaacgccgcccugggggcgaucuucaccgacgagaacaaguggaaguccgcccgggaggccgucgaggacagccgcuucuggggccucguggacaaggagcggaaccugcaccuggaggggaagugcgagaccugcguguacaacaugaugggcaagcgcgagaagaagcucggggaguucggcaaggccaagggcucccgggccaucugguacauguggcugggggcgcgcuuccuggaguucgaggcccucggcuuccugaacgaggaccacugguucagccgggagaacucccugagcggggucgagggcgaggggcuccacaagcugggcuacauccugcgcgacgugagcaagaaggagggcggggccauguacgccgacgacaccgcgggcugggacacgcggaucacccucgaggaccugaagaacgaggagauggugaccaaccacauggagggggagcacaagaagcuggccgaggccaucuucaagcucaccuaccagaacaaggucgugcgcgugcagcggccgacgccccgcggcaccgucauggacaucaucucccggcgcgaccagcgcgggagcggccaggugggcaccuacgggcugaacaccuucacgaacauggaggcccagcugauccggcagauggagggcgaggggguguucaaguccauccagcaccucaccgucaccgaggagaucgccgugcagaacuggcuggcgcgcgugggccgggagcgccugagccggauggccaucuccggcgacgacugcgucgugaagccccucgacgaccgcuucgccagcgcccugaccgcccugaacgacauggggaaggugcggaaggacauccagcagugggagcccucccgcggcuggaacgacuggacgcaggucccguucugcagccaccacuuccacgagcucaucaugaaggacgggcgggugcuggugguccccugccgcaaccaggacgagcugaucggccgggcgcgcaucucccagggggccggcuggagccuccgggagaccgccugccugggcaaguccuacgcccagauguggagccugauguacuuccaccgccgggaccuccgccuggccgcgaacgccaucugcuccgccgugcccagccacugggugcccaccucccggaccaccuggagcauccacgccaagcacgaguggaugacgaccgaggacaugcugaccgucuggaaccgcguguggauccaggagaacccguggauggaggacaagacccccguggaguccugggaggagauccccuaccucgggaagcgggaggaccaguggugcggcagccugaucgggcugacgagccgcgccaccugggcgaagaacauccagaccgccaucaaccagguccgcucccucaucggcaacgaggaguacaccgacuacaugcccagcaugaagcgguuccgccgggaggaggaggaggccggggugcugugguga

SEQ ID NO: 8994 - RNA, 9876 nt, Artificial Sequence
  derived and/or modified CDS sequence (opt1) from DENV-2__AB543624__SS-prME
agcgcggggaugaucaucaugcugauccccaccgugauggccuuccaccucaccacccgcaacggggagccgcacaugaucgucggcauccaggagaagggcaagagccugcuguucaagaccgaggacggcgugaacaugugcacccucauggcgauggaccugggggagcugugcgaggacaccaucaccuacaagugcccccuccugcggcagaacgagcccgaggacaucgacugcuggugcaacagcaccagcaccugggugaccuacgggaccugcaccaccaccggcgagcaccgccgggagaagcgcagcgucgcccuggugccccacguggggaugggccucgagacccggaccgagaccuggauguccagcgagggggccuggaagcacgcccagcgcaucgagaccuggauccugcggcacccgggcuucacgaucauggccgcgauccuggccuacaccaucgggaccacccacuuccagcgcguccucaucuucauccugcugacggccguggcccccuccaugaccaugcggugcaucggcaucagcaaccgcgacuucguggagggcgucuccgggggcagcuggguggacaucgugcucgagcacggguccugcgucaccaccauggcgaagaacaagcccacgcuggacuucgagcugaucaagaccgaggccaagcagcccgccacccuccggaaguacugcaucgaggccaagcugaccaacacgaccaccgagagccgcugcccgacccagggcgagcccucccugaaggaggagcaggacaagcgguucgugugcaagcacagcaugguggaccgcggcugggggaacggcugcggccuguucggcaagggcgggaucgucacgugcgccauguucacgugcaagaagaacauggagggcaagaucgugcagcccgagaaccuggaguacaccaucguggucacgccccacuccggggaggagcacgcggugggcaacgacacggggaagcacggcaaggagaucaaggugaccccgcagagcuccaucaccgaggccgagcugaucggguacggcaccgucaccauggagugcagcccccggacgggccucgacuucaacgagauggugcugcugcagauggagaacaaggccuggcucgugcaccgccagugguuccuggaccugccccuccccuggcugccgggggccgacaagcaggaguccaacuggauccagaaggagacccuggucaccuucaagaacccccacgccaagaagcaggacguggucgugcucggcagccccgagggggcgaugcacaccgcccugacgggcgccaccgagauccagaugagcuccgggaaccuccuguucaccggccaccugaagugccggcugcgcauggacaagcuccagcugaagggcaugagcuacuccaugugcaccgggaaguucaagguggucaaggagaucgccgagacgcagcacggcaccaucgugauccgggugcaguacgagggggacggcagccccugcaagaucccguucgagaucauggaccuggagaagcgcuacguccucggccggcugaucaccgugaaccccaucgugaccgagaaggacaaccccgucaacaucgaggccgagcccccguucggggacuccuacaucaucaucggcguggagcccgggcagcugaagcucaacugguucaagaagggcagcuccaucgggcagauguucgagacgaccaugcgcggcgcgaagcgcauggccauccugggcgacaccgccugggacuucgggagccugggcgggguguucaccuccaucggcaaggcccuccaccaggucuucggggccaucuacggcgcggccuucagcggcguguccuggacgaugaagauccugaucggggugaucaucaccuggaucggcaugaacagccgguccaccagccuguccgucagccuggugcucguggggaucgucacccuguaccugggcgugauggugcaggccgacuccgggugcgucgugagcuggaagaacaaggagcucaagugcggcuccggcaucuucaucacggacaacgugcacaccuggaccgagcaguacaaguuccagcccgagagccccagcaagcuggccuccgcgauccagaaggcccaggaggaggggaucugcggcauccgcagcgucacccggcuggagaaccucauguggaagcagaucgccccggagcugaaccacauccuggccgagaacgaggugaagcucacgaucaugaccggggacaucaagggcaucaugcaggccgggaagcgcucccugcggccccagcccaccgagcugaaguacagcuggaagaccuggggcaaggcgaagaugcucuccacggagagcuacaaccagaccuuccugaucgacggcccggagaccgccgagugccccaacaccaaccgcgccuggaacucccuggagguggaggacuacggguucggcgucuucacgaccaacaucuggcucaagcugaaggagcggcaggacgccuucugcgacagcaagcugauguccgccgcgaucaaggacaaccgcgccgugcacgccgacaugggguacuggaucgagagcgcccucaacgacaccuggaagaucgagaaggccuccuucaucgaggugaagaacugccacuggcccaagagccacacccugugguccaacggcguccuggagagcgagaugaucauccccaagaaccucgcgggcccggugucccagcacaacuaccggcccggguaccacacgcagaucgccggccccuggcaccuggggaagcuggagauggacuucgacuucugcgacggcaccaccgugaucgucaccgaggacugcgggaaccgcggccccagccuccggaccacgaccgccuccggcaagcugaucaccgaguggugcugccgcagcugcacccugccgccccuccgguaccgcggggaggacggcugcugguacgggauggagauccggccccugaaggagaaggaggagaaccuggugaacagccucgugacggccggccacgggcaggucgacaacuucucccugggcgugcugggcauggcccucuuccuggaggagaugcugcgcacccggguggggaccaagcacgccauccuccuggucgccgugagcuucgugacccugaucacgggcaacauguccuucaaggaccucgggcgcgucguggugauggucggcgccaccauggccgacgacaucgggaugggcgugaccuaccuggcgcugcucgccgccuucaaggugcggcccaccuucgccgccggccugcugcuccgcaagcugacgagcaaggagcugaugaugaccaccaucgggaucguccuccugucccagagcaccaucccggagacggugcuggagcucaccgacgcgcuggcccugggcaugauggugcucaagaucguccgcaacauggagaaguaccagcuggccgugaccaucauggccauccugugcguccccaacgccgugauccuccagaacgcguggaagguguccugcaccauccuggccgucgugagcgugagcccccugcuccugacgagcucccagcagaagaccgacuggaucccccuggcccucaccaucaaggggcugaacccgaccgccaucuuccugacgacccucagccggaccaacaagaagcgcuccuggccccugaacgaggcgaucauggccgucggcauggugagcauccuggccuccagccuccugaagaacgacauccccaugaccggcccccugguggccgggggccuccugacggucugcuacgugcugaccgggcgguccgccgaccucgagcuggagcgcgcgaccgacgugaagugggaggaccaggccgagaucagcggcuccagcccgauccugagcaucaccaucuccgaggacgggagcauguccaucaagaacgaggaggaggagcagacgcucaccauccugauccggaccggccugcucgucaucagcggccuguuccccaucuccauccccaucaccgccgccgccugguaccugugggaggugaagaagcagcgcgcgggggugcucugggacguccccagcccgccgcccaugggcaaggccgagcuggaggacggggccuaccggaucaagcagaagggcauccugggguacucccagaucggcgccggcguguacaaggaggggacguuccacaccauguggcacgugacccgcggcgccguccucaugcacaaggggaagcggaucgagccgagcugggcggacgugaagaaggaccugaucuccuacggcgggggcuggaagcuggagggcgaguggaaggagggggaggaggugcagguccucgcccuggagcccggcaagaacccccgcgccgugcagaccaagcccgggcuguucaagaccaacaacggcacgaucggggccgugagccucgacuucuccccgggcaccagcggcucccccaucaucgacaagaaggggaaggucgugggccuguacgggaacggcguggucacccggagcggcgccuacguguccgcgaucgcccagaccgagaaguccaucgaggacaaccccgagaucgaggacgacaucuuccgcaagcggcgccugacgaucauggaccugcaccccggggccggcaagaccaagcgguaccucccggccaucgugcgcgaggcgaucaagcgggggcugcgcacccugauccucgcccccacccgggucguggccgccgagauggaggaggcccugcgcggccugcccauccgguaccagacgcccgcgauccgcgccgagcacaccgggcgcgagaucguggaccucaugugccacgccaccuucaccaugcggcugcuguccccgguccgcgugcccaacuacaaccucaucaucauggacgaggcccacuucacggaccccgccagcaucgcggcccggggcuacaucuccacccgcguggagaugggcgaggccgccgggaucuucaugaccgccacgccgcccggcagccgggaccccuucccccagagcaacgcgcccaucaucgacgaggagcgcgagauccccgagcgguccuggaacagcgggcacgagugggucacggacuucaagggcaagaccgugugguucgugcccuccaucaaggccgggaacgacaucgccgccugccugcgcaagaacggcaagaaggucauccagcugagccggaagaccuucgacuccgaguacgugaagacccgcacgaacgacugggacuucguggucaccaccgacaucagcgagaugggcgcgaacuucaaggccgagcgggugaucgacccccgccggugcaugaagcccgugauccucaccgacggggaggagcgcgucauccuggccggcccgaugcccgugacgcacuccagcgccgcccagcggcgcgggcggaucggccgcaaccccaagaacgagaacgaccaguacaucuacaugggggagccccuggagaacgacgaggacugcgcgcacuggaaggaggccaagaugcuccuggacaacaucaacaccccggagggcaucauccccuccauguucgagcccgagcgggagaagguggacgccaucgacggcgaguaccgccugcgcggggaggcccggaagaccuucgucgaccucaugcgccggggcgaccugccgguguggcuggccuacaagguggcggccgaggggaucaacuacgccgaccgccgguggugcuucgacggcaucaagaacaaccagauccucgaggagaacgucgagguggagaucuggaccaaggagggggagcgcaagaagcugaagccccgguggcuggacgcccgcaucuacagcgacccccucgcccugaaggaguucaaggaguucgcggccggccggaagucccugacgcucaaccugaucaccgagaugggccgccugcccaccuucaugacccagaagacgcgggacgcccucgacaaccuggccguccugcacaccgcggaggccgggggccgcgccuacaaccacgcccucagcgagcugccggagacccuggagacccuccugcugcucacgcugcuggccaccgugaccgggggcaucuuccucuuccugauguccggccgggggaucggcaagaugacccuggggaugugcugcaucaucacggcgagcauccuccugugguacgcccagauccagccccacuggaucgccgccuccaucauccuggaguucuuccucaucgugcugcugauccccgagcccgagaagcagcgcaccccgcaggacaaccagcucaccuacgucgugaucgccauccugaccguggucgcggccaccauggccaacgagaugggcuuccuggagaagacgaagaaggaccucgggcugggcagcaucgccacccagcaccccgaguccaacauccuggacaucgaccuccggcccgccagcgcguggacccuguacgccguggccaccacguucaucacccccaugcugcgccacuccaucgagaacagcagcgugaacgucucccucaccgccaucgccaaccaggcgaccgugcugaugggccuggggaagggcuggccgcucagcaagauggacaucggggugccccugcuggccaucggcugcuacucccaggucaaccccaucacgcucaccgccgcccugcugcuccugguggcgcacuacgccaucaucgggcccggccugcaggccaaggccacccgggaggcccagaagcgcgcggccgccggcaucaugaagaacccgaccguggacgggaucacggucaucgaccucgaccccauccccuacgaccccaaguucgagaagcagcugggccaggugaugcugcucauccugugcgugacccagguccugaugaugcggaccaccugggcccucugcgaggcccugacgcuggcgaccgggccgaucagcccccucugggagggcaaccccgggcgcuucuggaacaccaccaucgccguguccauggccaacaucuuccggggcagcuaccuggccggcgccgggcuccucuucuccaucaugaagaacacgaccaacacccgccgcggcaccgggaacaucggcgagacgcugggcgagaaguggaagucccggcugaacgcgcucgggaaguccgaguuccagaucuacaagaaguccggcauccaggagguggaccgcacccuggccaaggaggggaucaagcggggcgagaccgaccaccacgccgucucccgcgggagcgccaagcugcggugguucguggagcgcaacauggugacccccgagggcaaggucguggaccucggcugcgggcggggcgggugguccuacuacugcggcgggcugaagaacgugcgcgaggucaagggccugacgaagggcgggccgggccacgaggagcccauccccaugagcaccuacggguggaaccucgugcggcugcaguccggcguggacgucuucuucaucccgcccgagaagugcgacacccugcucugcgacaucggggagagcucccccaaccccaccguggaggcgggccgcacgcugcgggugcugaaccucgucgagaacuggcugaacaaccacacccacuucugcaucaaggugcugaacccguacaugcccagcgugcuggagaagauggaggcccuccagcgcaaguacggcggggcccugguccggaacccccugucccgcaacagcacccacgagauguacugggugagcaacgccuccggcaacaucgugagcuccgucaacaugaucagccggaugcucaucaaccgcuucaccaugcggcacaagaaggccacguacgagcccgacguggaccugggguccggcacccgcaacaucgggaucgagagcgagaucccgaaccuggacaucaucggcaagcggaucgagaagaucaagcaggagcacgagaccuccuggcacuacgaccaggaccaccccuacaagaccugggcguaccacggcagcuacgagaccaagcagacgggguccgccagcuccauggugaacggcgucgugcgccuccugaccaagcccugggacgugcugcccaccgucacccagauggccaugacggacaccaccccguucgggcagcagcgcguguucaaggagaagguggacacccggacgcaggagcccaaggagggcaccaagaagcucaugaagaucaccgccgaguggcuguggaaggagcugggcaagaagaagacgccccgcaugugcacgcgggaggaguucacccgcaagguccggagcaacgccgcgcucggggccaucuucaccgacgagaacaaguggaaguccgcccgcgaggccguggaggacagccgguucugggagcugguggacaaggagcgcaaccugcaccucgagggcaagugcgagaccugcgucuacaacaugauggggaagcgggagaagaagcugggcgaguucgggaaggccaagggcucccgcgcgaucugguacauguggcugggcgcccgguuccucgaguucgaggcccugggguuccugaacgaggaccacugguucagccgcgagaacucccucagcggcguggagggggagggccugcacaagcugggguacauccuccgggacgucuccaagaaggagggcggcgccauguacgcggacgacacggccgggugggacacccgcaucacccuggaggaccugaagaacgaggagauggugaccaaccacauggagggcgagcacaagaagcucgccgaggccaucuucaagcugacguaccagaacaaggugguccgggugcagcgccccaccccgcgggggaccgugauggacaucaucagccgccgggaccagcgcggcagcgggcaggucggcaccuacggccugaacacguucaccaacauggaggcccagcucauccggcagauggagggggagggcguguucaagaacauccagcgccugaccgugaccgaggaggucgcggugcacaacuggcuggcccgcguggggcgggagcgccucucccggauggccaucagcggcgacgacugcgucgugaagccccuggacgaccgcuucgccaacgcccugacggcgcucaacgacaugggcaagauccggaaggacauccagcagugggagcccuccaagggguggaacgacuggacccaggugcccuucugcagccaccacuuccacgagcugaucaugaaggacggccgcguccugguggugccgugccggaaccaggacgagcucaucgggcgcgcccggaucucccagggcgccggguggagccugcgcgagaccgccugccugggcaaguccuacgcccagauguggagccucauguacuuccaccggcgcgaccugcggcuggcggccaacgccaucugcuccgccguccccagccacugggugcccaccucccgcacgaccuggagcauccacgccaagcacgaguggaugaccaccgaggacaugcucacgguguggaaccgggucuggauccgcgagaaccccuggauggaggacaagaccccgguggaguccugggaggagauccccuaccugggcaagcgggaggaccaguggugcgggagccugaucggccucaccucccgcgcgaccugggccaagaacauccaggccgccaucaaccaggugcggagccugaucgggaacgaggaguacaccgacuacaugcccuccaugaagcgcuuccgccgggaggaggaggaggcgggcguccugugguga

SEQ ID NO: 8995 - RNA, 9876 nt, Artificial Sequence
  derived and/or modified CDS sequence (opt1) from DENV-2__AB189122__SS-prME
accgccggcgugaucaucaugaugauccccaccgugauggccuuccaccugaccacccggaacggggagccccacaugaucgugagccggcaggagaagggcaagucccuccuguucaagaccgagaacggggugaacaugugcacccugauggccauggaccucggcgagcugugcgaggacaccaucaccuacaacugcccccugcuccgccagaacgagcccgaggacaucgacugcuggugcaacagcaccuccaccugggucaccuacgggaccugcaccgccaccggcgagcaccggcgcgagaagcggagcguggcccuggcgccccacgugggcauggggcuggagacgcgcaccgagaccuggauguccagcgagggcgccuggaagcacgcgcagcggaucgagaccuggguccuccgccaccccggguucacgaucauggccgccauccuggccuacaccaucggcaccaccuacuuccagcgggugcugaucuucauccuccugacggcgguggcccccuccaugaccaugcgcugcaucgggaucagcaaccgggacuucgucgagggcguguccggcgggagcuggguggacaucguccuggagcacggcuccugcgugaccaccauggccaagaacaagcccacgcucgacuucgagcugaucaagaccgaggccaagcaccccgccacccugcgcaaguacugcaucgaggcgaagcucaccaacacgaccaccgccagccggugcccgacccagggggagcccucccugaacgaggagcaggacaagcgcuucgugugcaagcacagcauggucgaccggggcuggggcaacgggugcggccuguucgggaagggcgggaucgugacgugcgccauguucacgugcaagaagaacauggagggcaaggugguccagcccgagaaccucgaguacaccaucgugaucacgccccacuccggcgaggagaacgccguggggaacgacaccggcaagcacgggaaggagaucaaggucaccccgcagagcuccaucaccgaggccgagcugaccggcuacgggaccgugacgauggagugcagcccccgcaccggccuggacuucaacgagauggugcuccugcagauggagaacaaggcguggcugguccaccggcagugguuccucgaccugccccugcccuggcucccgggcgccgacacccagggguccaacuggauccagaaggagacccuggugacguucaagaacccccacgccaagaagcaggacgucguggugcugggcagccaggagggggccaugcacaccgcccucaccggcgcgaccgagauccagaugagcuccgggaaccugcuguucacgggccaccucaagugccgccugcggauggacaagcugcagcucaagggcaugagcuacuccaugugcaccgggaaguucaaggucgugaaggagaucgccgagacccagcacggcaccaucgugauccgcguccaguacgagggggacggcagccccugcaagauccccuucgagaucauggaccuggagaagcggcacgugcugggccgccucaucacggugaacccgaucgucaccgagaaggacucccccgugaacaucgaggccgagccgcccuucggggacagcuacaucaucaucggcguggagccggggcagcugaagcugaacugguucaagaagggcuccagcaucgggcagauguucgagaccaccaugcgcggcgccaagcggauggccauccucggcgacacggcgugggacuucgggucccugggcggggucuucaccagcaucggcaaggcccugcaccagguguucggggccaucuacggcgccgcguucuccggcgugagcuggaccaugaagauccucaucggggucgugaucaccuggaucggcaugaacucccgcagcacgucccugagcgugucccugguccugguggggguggucacccucuaccugggcgugauggugcaggccgacagcgggugcgucguguccuggaagaacaaggagcugaagugcggcagcggcaucuucaucaccgacaacgugcacaccuggacggagcaguacaaguuccagcccgagagccccuccaagcucgccagcgccauccagaaggcccacgaggaggggaucugcggcauccgguccgucacccgccuggagaaccugauguggaagcagaucacccccgagcucaaccacauccugagcgagaacgaggugaagcugaccaucaugacgggggacaucaagggcaucaugcaggcggggaagcggucccuccgcccgcagcccaccgagcugaaguacagcuggaaggccuggggcaaggccaagaugcuguccaccgagcuccacaaccacaccuuccugaucgacggccccgagacggccgagugcccgaacaccaaccgggccuggaacagccuggagguggaggacuacggguucggcgucuucaccaccaacaucuggcucaagcugaaggagcgccaggacguguucugcgacuccaagcugaugagcgcggccaucaaggacaaccgggccgugcacgccgacaugggguacuggaucgaguccgcccucaacgacacguggaagaucgagaaggcgagcuucaucgaggucaaguccugccacuggcccaagagccacacccugugguccaacggcgugcuggagagcgagaugaucauccccaagaacuucgccggccccgugucccagcacaacuaccgcccgggguaccacacccagaccgccggccccuggcaccucgggaagcuggagauggacuucgacuucugcgagggcaccacggucguggugaccgaggacugcgggaaccggggccccagccugcgcaccaccacggccagcggcaagcucaucaccgaguggugcugccgguccugcacccugcccccgcugcgcuaccgcggggaggacggcugcugguacgggauggagauccgcccccucaaggagaaggaggagaaccuggucaacagccuggugaccgcgggccacgggcagaucgacaacuucucccucggcgugcugggcauggcccuguuccucgaggagaugcugcggacgcgcgucgggaccaagcacgccauccugcucguggccgugagcuucgucacccugaucaccggcaacauguccuuccgggaccuggggcgcgugauggugauggucggcgccacgaugaccgacgacaucgggaugggcgugaccuaccucgcgcugcuggccgccuucaaggugcgccccaccuucgccgccggccuccugcugcggaagcucacgagcaaggagcugaugaugaccaccaucgggaucguccugcucucccagagcaccauccccgagacgauccuggagcugaccgacgcgcucgcccugggcaugauggugcugaagaucguccgcaacauggagaaguaccagcucgccgugaccaucauggccauccugugcgugccgaacgccgucauccugcagaacgcguggaagguguccugcaccacgcucgccguggucagcgugagcccccugcugcucaccagcucccagcagaaggccgacuggaucccccuggcccugaccaucaaggggcucaaccccaccgcgaucuuccugacgacccugagccggaccuccaagaagcgcagcuggccgcucaacgaggccaucauggccgugggcauggucuccauccuggccagcucccugcucaagaacgacauccccaugaccggcccccugguggccgggggccugcucacggugugcuacguccugaccgggcggagcgcggaccuggagcucgagcgcgccgccgacgugcggugggaggagcaggccgagaucagcggcuccagccccauccuguccaucaccaucagcgaggacggguccaugagcaucaagaacgaggaggaggagcagacccugacgauccucauccgcaccggccugcuggugaucuccggccucuucccggucagcauccccaucaccgccgcggccugguaccugugggaggugaagaagcagcgggccggggugcugugggacguccccagcccgccgcccgugggcaaggccgagcucgaggacggggccuaccgcaucaagcagaagggcauccugggguacagccagaucggcgugggcgucuacaaggaggggaccuuccacaccauguggcacgugacgcggggcgcggugcugaugcacaaggggaagcgcaucgagcccuccugggccgacgucaagaaggaccucaucagcuacggcgggggcuggaagcuggagggcgaguggaaggagggggaggagguccaggugcuggcccucgagcccggcaagaacccccgggccguccagaccaagcccgggcuguucaagaccaacaccggcacgaucggggccgugucccuggacuucagccccggcaccuccggcagccccaucguggacaagaaggggaaggucgugggccucuacgggaacggcguggucacccgcuccggcaccuacgugagcgcgaucgcccagacggagaagaacaucgaggacaaccccgagaucgaggacgacaucuuccggaagaagcgccugaccaucauggaccugcaccccggggccggcaagaccaagcgguaccugcccgccaucgugcgcgaggcgaucaagcgggggcuccgcacccugauccuggccccgacgcgggucguggccgccgagauggaggaggcccuccgcggccugcccauccgcuaccagacccccgcgauccgggccgagcacaccgggcgcgagaucguggaccugaugugccacgccaccuucacgaugcggcuccugucccccauccgcgucccgaacuacaaccugaucaucauggacgaggcccacuucaccgaccccgccagcaucgcggcccggggcuacaucagcacccgcguggagaugggcgaggccgccgggaucuucaugaccgccacgccgcccggcucccgggacccguucccccagagcaacgcgcccaucauggacgaggagcgcgagauccccgagcgguccuggaacagcgggcacgagugggugaccgacuucaagggcaagaccgucugguucgugccguccaucaaggccgggaacgacaucgccgccugccuccgcaagaacggcaagaaggugauccagcugagccggaagaccuucgacuccgaguacaucaagacgcgcaccaacgacugggacuucgucgugaccaccgacaucagcgagaugggcgcgaacuucaaggccgagcgggugaucgacccccgccggugcaugaagcccgucauccugacggacggggaggagcgcgugauccucgccggccccaugccggugacccacuccagcgccgcccagcggcgcgggcgggucggccgcaaccccaagaacgagaacgaccaguacaucuacaugggggagccccuggagaacgacgaggacugcgcgcacuggaaggaggccaagaugcugcucgacaacaucaacacccccgagggcaucaucccguccauguucgagcccgagcgcgagaagguggacgccaucgacggcgaguaccggcugcgcggggaggcccggaagaccuucgucgaccugaugcgccggggcgaccuccccguguggcuggccuaccgcguggcggccgaggggaucaacuacgccgaccggcgcuggugcuucgacggcgucaagaacaaccagauccuggaggagaacguggagguggagaucuggacgaaggagggggagcggaagaagcucaagccgcgcuggcuggacgcccggaucuacagcgacccccuggcccucaaggaguucaaggaguucgcggccggccgcaagucccugacccugaaccucaucaccgagaugggccggcugcccaccuucaugacgcagaaggcccgcaacgcccuggacaaccucgcgguccugcacaccgccgaggccgggggccgggccuacaaccacgcccugagcgagcuccccgagacccuggagacccugcuccugcugacgcuccuggcgaccgugaccgggggcaucuuccuguuccucauguccggcaaggggaucggcaagaugacccuggggaugugcugcaucaucaccgccagcgugcugcucugguacgcccagauccagccgcacuggaucgccgccuccaucauccuggaguucuuccugaucguccuccugauccccgagcccgagaagcagcgcacgccccaggacaaccagcugaccuacguggugaucgcgauccucaccgucguggccgccaccauggccaacgagaugggcuuccuggagaagacgaagaaggacuucgggcugggcagcaucgccacccagcagccggaguccaacauccucgacaucgaccugcggcccgcgagcgccuggacccuguacgccguggccaccacguucaucacccccaugcuccgccacagcaucgagaacuccagcgucaacgugucccugaccgccaucgcgaaccaggccaccgugcugaugggccucgggaagggcuggccccugagcaagauggacaucggggucccgcugcucgccaucggcugcuacucccaggugaaccccaucacgcugaccgccgcgcugcuccugcugguggcccacuacgccaucaucgggcccggccuccaggccaaggccacccgggaggcgcagaagcgcgccgccgccggcaucaugaagaaccccaccgucgacgggaucacggugaucgaccuggacccgauccccuacgaccccaaguucgagaagcagcugggccaggugaugcuccugguccugugcgugacccaggugcucaugaugcggaccaccugggcccugugcgaggcgcugacgcucgccaccgggcccaucagcacccugugggagggcaacccggggcgcuucuggaacaccacgaucgccgucuccauggccaacaucuuccgcggcagcuaccuggccggcgcggggcuccuguucuccaucaugaagaacaccgccaacacccggcgcggcaccgggaacacgggcgagacccugggcgagaaguggaagaaccggcucaacgcccuggggaaguccgaguuccagguguacaagaaguccggcauccaggagguggaccgcacccuggccaaggaggggaucgagcggggcgagaccgaccaccacgcggucagccgcggguccgccaagcuccggugguucguggagcgcaaccuggugacgcccgagggcaaggucguggaccugggcugcgggcggggcggguggagcuacuacugcggcgggcucaagaacgugaaggaggucaagggccugaccaagggcgggcccggccacgaggagcccaucccgauguccaccuacggguggaaccuggugcgccuccagagcggcguggacgucuucuucacgccgcccgagaagugcgacacgcugcugugcgacaucggggaguccagccccaacccgaccguggaggccggccggacccuccgcgugcugaaccuggucgagaacuggcucaacaacaacacccaguucugcaucaaggugcugaaccccuacaugcccuccgugaucgagaagauggaggcccugcagcggaaguacggcggggcccugguccgcaacccgcucagccggaacagcacccacgagauguacuggguguccaacgcgagcggcaacaucguguccagcgucaacaugaucucccgcaugcugaucaaccgguucacgaugcgccacaagaaggccaccuacgagcccgacguggaccuggggagcggcacccggaacaucgggaucgaguccgagauccccaaccucgacaucaucggcaagcgcaucgagaagaucaagcaggagcacgagaccagcuggcacuacgaccaggaccaccccuacaagacgugggccuaccacggcuccuacgagaccaagcagaccgggagcgccuccagcauggugaacggcgucgugcgccugcugaccaagccgugggacgucauccccauggugacgcagauggccaugaccgacaccacccccuucgggcagcagcggguguucaaggagaaggucgacacgcgcacccaggagcccaaggagggcaccaagaagcucaugaagaucaccgcggaguggcuguggaaggagcugggcaagaagaagacgccgcggaugugcacccgcgaggaguucacccggaaggugcgcuccaacgccgcccucggggccaucuucaccgacgagaacaaguggaaguccgcccgggaggcgguggaggacuccggcuucugggagcuggucgacaaggagcgcaaccugcaccucgaggggaagugcgagacgugcguguacaacaugaugggcaagcgggagaagaagcugggggaguucggcaaggccaagggcagccgcgccaucugguacauguggcugggggcccgguuccucgaguucgaggcgcugggcuuccugaacgaggaccacugguucucccgcgagaacagccucuccgggguggagggcgaggggcugcacaagcugggcuacauccuccgggacgucagcaagaaggagggcggggccauguacgccgacgacaccgccggcugggacacccgcaucacccuggaggaccugaagaacgaggagauggugacgaaccacauggagggggagcacaagaagcucgccgaggcgaucuucaagcugaccuaccagaacaaggugguccgggugcagcgccccacgccccggggcaccgugauggacaucaucagccgccgggaccagcgcggguccggccaggucgugacguacggccugaacaccuucaccaacauggaggcccagcucauccggcagauggagggggagggcguguucaagagcauccagcaccugaccgucacggaggagaucgccgugaagaacuggcuggcccgcguggggcgcgagcggcucucccgcauggccaucagcggcgacgacugcgucgugaagccccuggacgaccgguucgcguccgcccugaccgcccucaacgacaugggcaaggugcgcaaggacauccagcagugggagccgagccggggguggaacgacuggacccagguccccuucugcucccaccacuuccacgagcugaucaugaaggacggccgcgugcuggugguccccugccggaaccaggacgagcucaucgggcgcgcccggaucagccagggcgccggguggucccugcgcgagaccgcgugccugggcaagagcuacgcccagauguggucccucauguacuuccaccggcgcgaccugcggcuggccgccaacgccaucugcagcgcggugcccucccacugggugccgacgagccgcaccaccugguccauccacgccacccacgaguggaugaccacggaggacaugcucaccgucuggaaccggguguggauccaggagaaccccuggauggaggacaagacccccguggagagcugggaggagauccccuaccugggcaagcgcgaggaccaguggugcgggucccugaucggccucaccagccgggccacgugggccaagaacauccagaccgcgaucaaccagguccgcagccugaucgggaacgaggaguacaccgacuacaugccguccaugaagcgguuccgccgcgaggaggaggaggccggcgugcugugguga

SEQ ID NO: 8996 - RNA, 9876 nt, Artificial Sequence
  derived and/or modified CDS sequence (opt1) from DENV-2__AB189123__SS-prME
accgccggcgugaucaucaugaugauccccaccgucauggccuuccaccugaccacccggaacggggagccccacaugaucgugucccggcaggagaagggcaagucccuccuguucaagaccgagaacggggugaacaugugcacccugauggccauggaccucggcgagcugugcgaggacaccaucaccuacaacugcccccugcuccgccagaacgagcccgaggacaucgacugcuggugcaacagcaccuccaccugggucaccuacgggaccugcaccgccaccggcgagcaccggcgcgagaagcggagcguggcccuggcgccccacgugggcauggggcuggagacgcgcaccgagaccuggauguccagcgagggcgccuggaagcacgcgcagcggaucgagaccuggguccuccgccaccccggguucacgaucauggccgccauccuggccuacaccaucggcaccaccuacuuccagcgggugcugaucuucauccuccugacggcgguggcccccuccaugaccaugcgcugcaucgggaucagcaaccgggacuucgucgagggcguguccggcgggagcuggguggacaucguccuggagcacggcuccugcgugaccaccauggccaagaacaagcccacgcucgacuucgagcugaucaagaccgaggccaagcaccccgccacccugcgcaaguacugcaucgaggcgaagcucaccaacacgaccaccgccagccggugcccgacccagggggagcccucccugaacgaggagcaggacaagcgcuucgugugcaagcacagcauggucgaccggggcuggggcaacgggugcggccuguucgggaagggcgggaucgugacgugcgccauguucacgugcaagaagaacauggagggcaaggugguccagcccgagaaccucgaguacaccaucgugaucacgccccacuccggcgaggagaacgccguggggaacgacaccggcaagcacgggaaggagaucaaggucaccccgcagagcuccaucaccgaggccgagcugaccggcuacgggaccgugacgauggagugcagcccccgcaccggccuggacuucaacgagauggugcuccugcagauggagaacaaggcguggcugguccaccggcagugguuccucgaccugccccugcccuggcucccgggcgccgacacccagggguccaacuggauccagaaggagacccuggugacguucaagaacccccacgccaagaagcaggacgucguggugcugggcagccaggagggggccaugcacaccgcccucaccggcgcgaccgagauccagaugagcuccgggaaccugcuguucacgggccaccucaagugccgccugcggauggacaagcugcagcucaagggcaugagcuacuccaugugcaccgggaaguucaaggucgugaaggagaucgccgagacccagcacggcaccaucgugauccgcguccaguacgagggggacggcagccccugcaagauccccuucgagaucauggaccuggagaagcggcacgugcugggccgccucaucacggugaacccgaucgucaccgagaaggacucccccgugaacaucgaggccgagccgcccuucggggacagcuacaucaucaucggcguggagccggggcagcugaagcugaacugguucaagaagggcuccagcaucgggcagauguucgagaccaccaugcgcggcgccaagcggauggccauccucggcgacacggcgugggacuucgggucccugggcggggucuucaccagcaucggcaaggcccugcaccagguguucggggccaucuacggcgccgcguucuccggcgugagcuggaccaugaagauccucaucggggucgugaucaccuggaucggcaugaacucccgcagcacgucccugagcgugucccugguccugguggggguggucacccucuaccugggcgugauggugcaggccgacagcgggugcgucguguccuggaagaacaaggagcugaagugcggcagcggcaucuucaucaccgacaacgugcacaccuggacggagcaguacaaguuccagcccgagagccccuccaagcucgccagcgccauccagaaggcccacgaggaggggaucugcggcauccgguccgucacccgccuggagaaccugauguggaagcagaucacccccgagcucaaccacauccugagcgagaacgaggugaagcugaccaucaugacgggggacaucaagggcaucaugcaggcggggaagcggucccuccgcccgcagcccaccgagcugaaguacagcuggaaggccuggggcaaggccaagaugcuguccaccgagcuccacaaccacaccuuccugaucgacggccccgagacggccgagugcccgaacaccaaccgggccuggaacagccuggagguggaggacuacggguucggcgucuucaccaccaacaucuggcucaagcugaaggagcgccaggacguguucugcgacuccaagcugaugagcgcggccaucaaggacaaccgggccgugcacgccgacaugggguacuggaucgaguccgcccucaacgacacguggaagaucgagaaggcgagcuucaucgaggucaaguccugccacuggcccaagagccacacccugugguccaacggcgugcuggagagcgagaugaucauccccaagaacuucgccggccccgugucccagcacaacuaccgcccgggguaccacacccagaccgccggccccuggcaccucgggaagcuggagauggacuucgacuucugcgagggcaccacggucguggugaccgaggacugcgggaaccggggccccagccugcgcaccaccacggccagcggcaagcucaucaccgaguggugcugccgguccugcacccugcccccgcugcgcuaccgcggggaggacggcugcugguacgggauggagauccgcccccucaaggagaaggaggagaaccuggucaacagccuggugaccgcgggccacgggcagaucgacaacuucucccucggcgugcugggcauggcccuguuccucgaggagaugcugcggacgcgcgucgggaccaagcacgccauccugcucguggccgugagcuucgucacccugaucaccggcaacauguccuuccgggaccuggggcgcgugauggugauggucggcgccacgaugaccgacgacaucgggaugggcgugaccuaccucgcgcugcuggccgccuucaaggugcgccccaccuucgccgccggccuccugcugcggaagcucacgagcaaggagcugaugaugaccaccaucgggaucguccugcucucccagagcaccauccccgagacgauccuggagcugaccgacgcgcucgcccugggcaugauggugcugaagaucguccgcaacauggagaaguaccagcucgccgugaccaucauggccauccugugcgugccgaacgccgucauccugcagaacgcguggaagguguccugcaccacgcucgccguggucagcgugagcccccugcugcucaccagcucccagcagaaggccgacuggaucccccuggcccugaccaucaaggggcucaaccccaccgcgaucuuccugacgacccugagccggaccuccaagaagcgcagcuggccgcucaacgaggccaucauggccgugggcauggucuccauccuggccagcucccugcucaagaacgacauccccaugaccggcccccugguggccgggggccugcucacggugugcuacguccugaccgggcggagcgcggaccuggagcucgagcgcgccgccgacgugcggugggaggagcaggccgagaucagcggcuccagccccauccuguccaucaccaucagcgaggacggguccaugagcaucaagaacgaggaggaggagcagacccugacgauccucauccgcaccggccugcuggugaucuccggccucuucccggucagcauccccaucaccgccgcggccugguaccugugggaggugaagaagcagcgggccggggugcugugggacguccccagcccgccgcccgugggcaaggccgagcucgaggacggggccuaccgcaucaagcagaagggcauccugggguacagccagaucggcgcgggcguguacaaggaggggaccuuccacaccauguggcacgucacgcggggcgccgugcugaugcacaaggggaagcgcaucgagcccuccugggccgacgugaagaaggaccucaucagcuacggcgggggcuggaagcuggagggcgaguggaaggagggggaggagguccaggugcuggcccucgagcccggcaagaacccccgggccgugcagaccaagcccgggcuguucaagaccaacaccggcacgaucggggcggucucccuggacuucagccccggcaccuccggcagccccaucguggacaagaaggggaagguggucggccucuacgggaacggcguggugacccgcuccggcaccuacgucagcgccaucgcccagacggagaagaacaucgaggacaaccccgagaucgaggacgacaucuuccggaagaagcgccugaccaucauggaccugcaccccggggccggcaagaccaagcgguaccugcccgcgaucgugcgcgaggccaucaagcgggggcuccgcacccugauccuggccccgacgcggguggucgccgccgagauggaggaggcgcuccgcggccugcccauccgcuaccagacccccgccauccgggccgagcacaccgggcgcgagaucguggaccugaugugccacgccaccuucacgaugcggcuccugucccccauccgcgugccgaacuacaaccugaucaucauggacgaggcccacuucaccgaccccgcgagcaucgccgcccggggcuacaucagcacccgcgucgagaugggcgaggccgccgggaucuucaugaccgcgacgccgcccggcucccgggacccguucccccagagcaacgcccccaucauggacgaggagcgcgagauccccgagcgguccuggaacagcgggcacgagugggugaccgacuucaagggcaagaccgugugguucgucccguccaucaaggccgggaacgacaucgccgcgugccuccgcaagaacggcaagaaggugauccagcugagccggaagaccuucgacuccgaguacaucaagacgcgcaccaacgacugggacuucguggucaccaccgacaucagcgagaugggcgccaacuucaaggccgagcgggugaucgacccccgccggugcaugaagcccgugauccugacggacggggaggagcgcgucauccucgccggccccaugccggugacccacuccaucgccgcgcagcggcgcgggcgggugggccgcaaccccaagaacgagaacgaccaguacaucuacaugggggagccccuggagaacgacgaggacugcgcccacuggaaggaggccaagaugcugcucgacaacaucaacacccccgagggcaucaucccgagcauguucgagcccgagcgcgagaaggucgacgccaucgacggcgaguaccggcugcgcggggaggcccggaagaccuucguggaccugaugcgccggggcgaccuccccgucuggcuggcguaccgcguggccgccgaggggaucaacuacgccgaccggcgcuggugcuucgacggcgugaagaacaaccagauccuggaggagaacgucgagguggagaucuggacgaaggagggggagcggaagaagcucaagccgcgcuggcuggacgcccggaucuacuccgacccccuggcgcucaaggaguucaaggaguucgccgccggccgcaagagccugacccugaaccucaucaccgagaugggccggcugcccaccuucaugacgcagaaggcccgcaacgcgcuggacaaccucgccgugcugcacaccgccgaggccgggggccgggccuacaaccacgcgcuguccgagcuccccgagacccuggagacccugcuccugcugacgcuccuggccaccgucaccgggggcaucuuccuguuccucaugagcggcaaggggaucggcaagaugacccuggggaugugcugcaucaucaccgccuccgugcugcucugguacgcccagauccagccgcacuggaucgccgcgagcaucauccuggaguucuuccugaucgugcuccugauccccgagcccgagaagcagcgcacgccccaggacaaccagcugaccuacgucgugaucgccauccucaccguggucgccgccaccauggccaacgagaugggcuuccuggagaagacgaagaaggacuucgggcugggcuccaucgcgacccagcagccggagagcaacauccucgacaucgaccugcggcccgccuccgccuggacccuguacgccguggccaccacguucaucacccccaugcuccgccacagcaucgagaacagcuccgugaacgucagccugaccgcgaucgccaaccaggccaccgugcugaugggccucgggaagggcuggccccuguccaagauggacaucggggugccgcugcucgccaucggcugcuacagccaggucaaccccaucacgcugaccgcggcccugcuccugcugguggcccacuacgccaucaucgggcccggccuccaggccaaggcgacccgggaggcccagaagcgcgccgccgccggcaucaugaagaaccccaccguggacgggaucacggucaucgaccuggacccgauccccuacgaccccaaguucgagaagcagcugggccaggugaugcuccuggugcugugcgucacccaggugcucaugaugcggaccaccugggcgcugugcgaggcccugacgcucgccaccgggcccaucuccacccugugggagggcaacccggggcgcuucuggaacaccacgaucgccgugagcauggccaacaucuuccgcggcuccuaccuggcgggcgccgggcuccuguucagcaucaugaagaacaccgccaacacccggcgcggcaccgggaacacgggcgagacccugggcgagaaguggaagaaccggcucaacgcccuggggaaguccgaguuccagaucuacaagaaguccggcauccaggaggucgaccgcacccuggcgaaggaggggaucgagcggggcgagaccgaccaccacgccgugucccgcgggagcgccaagcuccggugcuucguggagcgcaaccuggucacgcccgagggcaaggugguggaccugggcugcgggcggggcgggugguccuacuacugcggcgggcucaagaacgucaaggaggugaagggccugaccaagggcgggcccggccacgaggagcccaucccgaugagcaccuacggguggaaccuggugcgccuccaguccggcgucgacguguucuucacgccgcccgagaagugcgacacgcugcugugcgacaucggggagagcucccccaacccgaccguggaggccggccggacccuccgcguccugaaccugguggagaacuggcucaagaacaacacccaguucugcaucaaggugcugaaccccuacaugcccagcgucaucgagaagauggaggcccugcagcggaaguacggcggggcgcuggugcgcaacccgcucucccggaacagcacccacgagauguacugggugagcaacgccuccggcaacaucgucagcuccgugaacaugaucagccgcaugcugaucaaccgguucacgaugcgccacaagaaggccaccuacgagcccgacguggaccugggguccggcacccggaacaucgggaucgagagcgagauccccaaccucgacaucaucggcaagcgcaucgagaagaucaagcaggagcacgagaccuccuggcacuacgaccaggaccaccccuacaagacgugggccuaccacggcagcuacgagaccaagcagaccggguccgccagcuccauggucaacggcguggugcgccugcugaccaagccgugggacgucauccccauggugacgcagauggcgaugaccgacaccacccccuucgggcagcagcgggucuucaaggagaagguggacacgcgcacccaggagcccaaggagggcaccaagaagcucaugaagaucaccgccgaguggcuguggaaggagcugggcaagaagaagacgccgcggaugugcacccgcgaggaguucacccggaaggugcgcagcaacgccgcccucggggccaucuucaccgacgagaacaaguggaaguccgcgcgggaggccgucgaggacagcggcuucugggagcugguggacaaggagcgcaaccugcaccucgaggggaagugcgagacgugcguguacaacaugaugggcaagcgggagaagaagcugggggaguucggcaaggccaagggcucccgcgccaucugguacauguggcugggggcgcgguuccucgaguucgaggcccugggcuuccugaacgaggaccacugguucagccgcgagaacucccucagcggggucgagggcgaggggcugcacaagcugggcuacauccuccgggacguguccaagaaggagggcggggccauguacgccgacgacaccgccggcugggacacccgcaucacccuggaggaccugaagaacgaggagauggugacgaaccacauggagggggagcacaagaagcucgcggaggccaucuucaagcugaccuaccagaacaaggucgugcgggugcagcgccccacgccccggggcaccguccuggacaucaucagccgccgggaccagcgcgggagcggccagguggugacguacggccucaacaccuucaccaacauggaggcccagcugauccggcagauggagggggagggcgucuucaaguccauccagcaccugaccgugacggaggagaucgccgugaagaacuggcucgcccgcgucgggcgcgagcggcugagccgcauggcgaucuccggcgacgacugcguggugaagccccuggacgaccgguucgccagcgcccucaccgcccugaacgacaugggcaagguccgcaaggacauccagcagugggagccgucccggggguggaacgacuggacccaggugcccuucugcagccaccacuuccacgagcugaucaugaaggacggccgcgugcucgucgugcccugccggaaccaggacgagcugaucgggcgcgcccggaucucccagggcgcgggguggagccugcgcgagaccgccugccucggcaaguccuacgcccagauguggagccugauguacuuccaccggcgcgaccugcggcucgccgccaacgcgaucugcuccgccgugcccagccacugggucccgacgucccgcaccaccuggagcauccacgccacccacgaguggaugaccacggaggacaugcugaccguguggaaccggguguggauccaggagaaccccuggauggaggacaagacccccgucgaguccugggaggagauccccuaccugggcaagcgcgaggaccaguggugcgggagccucaucggccugaccucccgggccacgugggcgaagaacauccagaccgccaucaaccaggugcgcagccugaucgggaacgaggaguacaccgacuacaugccgagcaugaagcgguuccgccgcgaggaggaggaggccggcgugcucugguga

SEQ ID NO: 8997 - RNA, 9876 nt, Artificial Sequence
  derived and/or modified CDS sequence (opt1) from DENV-2__AB189124__SS-prME
accgccggcgugaucaucaugaugauccccaccgucauggccuuccaccugaccacccggaacggggagccccacaugaucgugagccggcaggagaagggcaagucccuccuguucaagaccgagaacggggugaacaugugcacccugauggccauggaccucggcgagcugugcgaggacaccaucaccuacaacugcccccugcuccgccagaacgagcccgaggacaucgacugcuggugcaacagcaccuccaccugggucaccuacgggaccugcaccgccaccggcgagcaccggcgcgagaagcggagcguggcccuggcgccccacgugggcauggggcuggagacgcgcaccgagaccuggauguccagcgagggcgccuggaagcacgcgcagcggaucgagaccuggguccuccgccaccccggguucacgaucauggccgccauccuggccuacaccaucggcaccaccuacuuccagcgggugcugaucuucauccuccugacggcgguggcccccuccaugaccaugcgcugcaucgggaucagcaaccgggacuucgucgagggcguguccggcgggagcuggguggacaucguccuggagcacggcuccugcgugaccaccauggccaagaacaagcccacgcucgacuucgagcugaucaagaccgaggccaagcaccccgccacccugcgcaaguacugcaucgaggcgaagcucaccaacacgaccaccgccagccggugcccgacccagggggagcccucccugaacgaggagcaggacaagcgcuucgugugcaagcacagcauggucgaccggggcuggggcaacgggugcggccuguucgggaagggcgggaucgugacgugcgccauguucacgugcaagaagaacauggagggcaaggugguccagcccgagaaccucgaguacaccaucgugaucacgccccacuccggcgaggagaacgccguggggaacgacaccggcaagcacgggaaggagaucaaggucaccccgcagagcuccaucaccgaggccgagcugaccggcuacgggaccgugacgauggagugcagcccccgcaccggccuggacuucaacgagauggugcuccugcagauggagaacaaggcguggcugguccaccggcagugguuccucgaccugccccugcccuggcucccgggcgccgacacccagggguccaacuggauccagaaggagacccuggugacguucaagaacccccacgccaagaagcaggacgucguggugcugggcagccaggagggggccaugcacaccgcccucaccggcgcgaccgagauccagaugagcuccgggaaccugcuguucacgggccaccucaagugccgccugcggauggacaagcugcagcucaagggcaugagcuacuccaugugcaccgggaaguucaaggucgugaaggagaucgccgagacccagcacggcaccaucgugauccgcguccaguacgagggggacggcagccccugcaagauccccuucgagaucauggaccuggagaagcggcacgugcugggccgccucaucacggugaacccgaucgucaccgagaaggacucccccgugaacaucgaggccgagccgcccuucggggacagcuacaucaucaucggcguggagccggggcagcugaagcugaacugguucaagaagggcuccagcaucgggcagauguucgagaccaccaugcgcggcgccaagcggauggccauccucggcgacacggcgugggacuucgggucccugggcggggucuucaccagcaucggcaaggcccugcaccagguguucggggccaucuacggcgccgcguucuccggcgugagcuggaccaugaagauccucaucggggucgugaucaccuggaucggcaugaacucccgcagcacgucccugagcgugucccugguccugguggggguggucacccucuaccugggcgugauggugcaggccgacagcgggugcgucguguccuggaagaacaaggagcugaagugcggcagcggcaucuucaucaccgacaacgugcacaccuggacggagcaguacaaguuccagcccgagagccccuccaagcucgccagcgccauccagaaggcccacgaggaggggaucugcggcauccgguccgucacccgccuggagaaccugauguggaagcagaucacccccgagcucaaccacauccugagcgagaacgaggugaagcugaccaucaugacgggggacaucaagggcaucaugcaggcggggaagcggucccuccgcccgcagcccaccgagcugaaguacagcuggaaggccuggggcaaggccaagaugcuguccaccgagcuccacaaccacaccuuccugaucgacggccccgagacggccgagugcccgaacaccaaccgggccuggaacagccuggagguggaggacuacggguucggcgucuucaccaccaacaucuggcucaagcugaaggagcgccaggacguguucugcgacuccaagcugaugagcgcggccaucaaggacaaccgggccgugcacgccgacaugggguacuggaucgaguccgcccucaacgacacguggaagaucgagaaggcgagcuucaucgaggucaaguccugccacuggcccaagagccacacccugugguccaacggcgugcuggagagcgagaugaucauccccaagaacuucgccggccccgugucccagcacaacuaccgcccgggguaccacacccagaccgccggccccuggcaccucgggaagcuggagauggacuucgacuucugcgagggcaccacggucguggugaccgaggacugcgggaaccggggccccagccugcgcaccaccacggccagcggcaagcucaucaccgaguggugcugccgguccugcacccugcccccgcugcgcuaccgcggggaggacggcugcugguacgggauggagauccgcccccucaaggagaaggaggagaaccuggucaacagccuggugaccgcgggccacgggcagaucgacaacuucucccucggcgugcugggcauggcccuguuccucgaggagaugcugcggacgcgcgucgggaccaagcacgccauccugcucguggccgugagcuucgucacccugaucaccggcaacauguccuuccgggaccuggggcgcgugauggugauggucggcgccacgaugaccgacgacaucgggaugggcgugaccuaccucgcgcugcuggccgccuucaaggugcgccccaccuucgccgccggccuccugcugcggaagcucacgagcaaggagcugaugaugaccaccaucgggaucguccugcucucccagagcaccauccccgagacgauccuggagcugaccgacgcgcucgcccugggcaugauggugcugaagaucguccgcaacauggagaaguaccagcucgccgugaccaucauggccauccugugcgugccgaacgccgucauccugcagaacgcguggaagguguccugcaccacgcucgccguggucagcgugagcccccugcugcucaccagcucccagcagaaggccgacuggaucccccuggcccugaccaucaaggggcucaaccccaccgcgaucuuccugacgacccugagccggaccuccaagaagcgcagcuggccgcucaacgaggccaucauggccgugggcauggucuccauccuggccagcucccugcucaagaacgacauccccaugaccggcccccugguggccgggggccugcucacggugugcuacguccugaccgggcggagcgcggaccuggagcucgagcgcgccgccgacgugcggugggaggagcaggccgagaucagcggcuccagccccauccuguccaucaccaucagcgaggacggguccaugagcaucaagaacgaggaggaggagcagacccugacgauccucauccgcaccggccugcuggugaucuccggccucuucccggucagcauccccaucaccgccgcggccugguaccugugggaggugaagaagcagcgggccggggugcugugggacguccccagcccgccgcccgugggcaaggccgagcucgaggacggggccuaccgcaucaagcagaagggcauccugggguacagccagaucggcgcgggcguguacaaggaggggaccuuccacaccauguggcacgucacgcggggcgccgugcugaugcacaaggggaagcgcaucgagcccuccugggccgacgugaagaaggaccucaucagcuacggcgggggcuggaagcuggagggcgaguggaaggagggggaggagguccaggugcuggcccucgagcccggcaagaacccccgggccgugcagaccaagcccgggcuguucaagaccaacaccggcacgaucggggcggucucccuggacuucagccccggcaccuccggcagccccaucguggacaagaaggggaagguggucggccucuacgggaacggcguggugacccgcuccggcaccuacgucagcgccaucgcccagacggagaagaacaucgaggacaaccccgagaucgaggacgacaucuuccggaagaagcgccugaccaucauggaccugcaccccggggccggcaagaccaagcgguaccugcccgcgaucgugcgcgaggccaucaagcgggggcuccgcacccugauccuggccccgacgcggguggucgccgccgagauggaggaggcgcuccgcggccugcccauccgcuaccagacccccgccauccgggccgagcacaccgggcgcgagaucguggaccugaugugccacgccaccuucacgaugcggcuccugucccccauccgcgugccgaacuacaaccugaucaucauggacgaggcccacuucaccgaccccgcgagcaucgccgcccggggcuacaucagcacccgcgucgagaugggcgaggccgccgggaucuucaugaccgcgacgccgcccggcucccgggacccguucccccagagcaacgcccccaucauggacgaggagcgcgagauccccgagcgguccuggaacagcgggcacgagugggugaccgacuucaagggcaagaccgugugguucgucccguccaucaaggccgggaacgacaucgccgcgugccuccgcaagaacggcaagaaggugauccagcugagccggaagaccuucgacuccgaguacaucaagacgcgcaccaacgacugggacuucguggucaccaccgacaucagcgagaugggcgccaacuucaaggccgagcgggugaucgacccccgccggugcaugaagcccgugauccugacggacggggaggagcgcgucauccucgccggccccaugccggugacccacuccagcgccgcgcagcggcgcgggcgggugggccgcaaccccaagaacgagaacgaccaguacaucuacaugggggagccccuggagaacgacgaggacugcgcccacuggaaggaggccaagaugcugcucgacaacaucaacacccccgagggcaucaucccguccauguucgagcccgagcgcgagaaggucgacgccaucgacggcgaguaccggcugcgcggggaggcccggaagaccuucguggaccugaugcgccggggcgaccuccccgucuggcuggcguaccgcguggccgccgaggggaucaacuacgccgaccggcgcuggugcuucgacggcgugaagaacaaccagauccuggaggagaacgucgagguggagaucuggacgaaggagggggagcggaagaagcucaagccgcgcuggcuggacgcccggaucuacagcgacccccuggcgcucaaggaguucaaggaguucgccgccggccgcaagucccugacccugaaccucaucaccgagaugggccggcugcccaccuucaugacgcagaaggcccgcaacgcgcuggacaaccucgccgugcugcacaccgccgaggccgggggccgggccuacaaccacgcgcugagcgagcuccccgagacccuggagacccugcuccugcugacgcuccuggccaccgucaccgggggcaucuuccuguuccucauguccggcaaggggaucggcaagaugacccuggggaugugcugcaucaucaccgccagcgugcugcucugguacgcccagauccagccgcacuggaucgccgcguccaucauccuggaguucuuccugaucgugcuccugauccccgagcccgagaagcagcgcacgccccaggacaaccagcugaccuacgucgugaucgccauccucaccguggucgccgccaccauggccaacgagaugggcuuccuggagaagacgaagaaggacuucgggcugggcagcaucgcgacccagcagccggaguccaacauccucgacaucgaccugcggcccgccagcgccuggacccuguacgccguggccaccacguucaucacccccaugcuccgccacagcaucgagaacuccagcgugaacgucucccugaccgcgaucgccaaccaggccaccgugcugaugggccucgggaagggcuggccccugagcaagauggacaucggggugccgcugcucgccaucggcugcuacucccaggucaaccccaucacgcugaccgcggcccugcuccugcugguggcccacuacgccaucaucgggcccggccuccaggccaaggcgacccgggaggcccagaagcgcgccgccgccggcaucaugaagaaccccaccguggacgggaucacggucaucgaccuggacccgauccccuacgaccccaaguucgagaagcagcugggccaggugaugcuccuggugcugugcgucacccaggugcucaugaugcggaccaccugggcgcugugcgaggcccugacgcucgccaccgggcccaucagcacccugugggagggcaacccggggcgcuucuggaacaccacgaucgccguguccauggccaacaucuuccgcggcagcuaccuggcgggcgccgggcuccuguucuccaucaugaagaacaccgccaacacccggcgcggcaccgggaacacgggcgagacccugggcgagaaguggaagaaccggcucaacgcccuggggaaguccgaguuccagaucuacaagaaguccggcauccaggaggucgaccgcacccuggcgaaggaggggaucgagcggggcgagaccgaccaccacgccgugagccgcggguccgccaagcuccggugguucguggagcgcaaccuggucacgcccgagggcaaggugguggaccugggcugcgggcggggcggguggagcuacuacugcggcgggcucaagaacgucaaggaggugaagggccugaccaagggcgggcccggccacgaggagcccaucccgauguccaccuacggguggaaccuggugcgccuccagagcggcgucgacguguucuucacgccgcccgagaagugcgacacgcugcugugcgacaucggggaguccagccccaacccgaccguggaggccggccggacccuccgcguccugaaccugguggagaacuggcucaagaacaacacccaguucugcaucaaggugcugaaccccuacaugcccuccgucaucgagaagauggaggcccugcagcggaaguacggcggggcgcuggugcgcaacccgcucagccggaacagcacccacgagauguacuggguguccaacgccagcggcaacaucgucuccagcgugaacaugaucucccgcaugcugaucaaccgguucacgaugcgccacaagaaggccaccuacgagcccgacguggaccuggggagcggcacccggaacaucgggaucgaguccgagauccccaaccucgacaucaucggcaagcgcaucgagaagaucaagcaggagcacgagaccagcuggcacuacgaccaggaccaccccuacaagacgugggccuaccacggcuccuacgagaccaagcagaccgggagcgccuccagcauggucaacggcguggugcgccugcugaccaagccgugggacgucauccccauggugacgcagauggcgaugaccgacaccacccccuucgggcagcagcgggucuucaaggagaagguggacacgcgcacccaggagcccaaggagggcaccaagaagcucaugaagaucaccgccgaguggcuguggaaggagcugggcaagaagaagacgccgcggaugugcacccgcgaggaguucacccggaaggugcgcuccaacgccgcccucggggccaucuucaccgacgagaacaaguggaaguccgcgcgggaggccgucgaggacuccggcuucugggagcugguggacaaggagcgcaaccugcaccucgaggggaagugcgagacgugcguguacaacaugaugggcaagcgggagaagaagcugggggaguucggcaaggccaagggcagccgcgccaucugguacauguggcugggggcgcgguuccucgaguucgaggcccugggcuuccugaacgaggaccacugguucucccgcgagaacagccucuccggggucgagggcgaggggcugcacaagcugggcuacauccuccgggacgugagcaagaaggagggcggggccauguacgccgacgacaccgccggcugggacacccgcaucacccuggaggaccugaagaacgaggagauggugacgaaccacauggagggggagcacaagaagcucgcggaggccaucuucaagcugaccuaccagaacaaggucgugcgggugcagcgccccacgccccggggcaccgucauggacaucaucagccgccgggaccagcgcggguccggccagguggugacguacggccugaacaccuucaccaacauggaggcccagcucauccggcagauggagggggagggcgucuucaagagcauccagcaccugaccgugacggaggagaucgccgugaagaacuggcuggcccgcgucgggcgcgagcggcucucccgcauggcgaucagcggcgacgacugcguggugaagccccuggacgaccgguucgccuccgcccugaccgcccucaacgacaugggcaagguccgcaaggacauccagcagugggagccgagccggggguggaacgacuggacccaggugcccuucugcucccaccacuuccacgagcugaucaugaaggacggccgcgugcuggucgugcccugccggaaccaggacgagcucaucgggcgcgcccggaucagccagggcgcgggguggucccugcgcgagaccgccugccugggcaagagcuacgcccagauguggucccucauguacuuccaccggcgcgaccugcggcuggccgccaacgcgaucugcagcgccgugcccucccacugggucccgacgagccgcaccaccugguccauccacgccacccacgaguggaugaccacggaggacaugcucaccguguggaaccggguguggauccaggagaaccccuggauggaggacaagacccccgucgagagcugggaggagauccccuaccugggcaagcgcgaggaccaguggugcgggucccugaucggccucaccagccgggccacgugggcgaagaacauccagaccgccaucaaccaggugcgcagccugaucgggaacgaggaguacaccgacuacaugccguccaugaagcgguuccgccgcgaggaggaggaggccggcgugcugugguga

SEQ ID NO: 8998 - RNA, 9876 nt, Artificial Sequence
  derived and/or modified CDS sequence (opt1) from DENV-2__AB122020__SS-prME
accgccggcgugaucgucaugcugauccccaccgccauggcguuccaccucaccacccggaacggggagccccacaugaucgugggccggcaggagaaggggaagucccugcuguucaagaccgaggacggcgugaacaugugcacccucauggccaucgaccugggggagcugugcgaggacaccaucaccuacaagugcccccuccugcgccagaacgagcccgaggacaucgacugcuggugcaacagcaccagcaccugggucaccuacgggaccugcaccaccacgggcgagcaccggcgcgagaagcgguccguggcccuggugccccacgucgggaugggccucgagacccggaccgagaccuggaugagcuccgagggggccuggaagcacgugcagcggaucgagaccuggauccugcgccacccgggcuucaccaucauggccgcgauccuggccuacaccaucgggaccacgcacuuccagcgggcccucaucuucauccugcugaccgccguggcgcccagcaugaccaugcgcugcaucggcaucuccaaccgggacuucgucgagggcgugagcgggggcuccuggguggacaucguccucgagcacgggagcugcgugaccacgauggccaagaacaagcccacccuggacuucgagcugaucaagaccgaggccaagcagcccgccacccuccgcaaguacugcaucgaggccaagcugacgaacaccaccaccgagucccggugcccgacgcagggcgagcccagccugaacgaggagcaggacaagcgcuucaucugcaagcacuccaugguggaccggggcugggggaacggcugcgggcuguucggcaagggcgggaucgugaccugcgcgauguucacgugcaagaagaacauggagggcaagaucgugcagcccgagaaccuggaguacaccaucgugaucacgccccacagcggggaggagcacgccgucggcaacgacaccgggaagcacggcaaggagaucaagaucaccccgcaguccagcaccaccgaggccgagcugacgggguacggcaccgugaccauggagugcagcccccggaccggccucgacuucaacgagauggugcugcugcagauggaggacaaggccuggcucguccaccggcagugguuccuggaccugccccuccccuggcugccgggggccgacacgcagggcagcaacuggauccagaaggagacccuggugaccuucaagaacccccacgcgaagaagcaggacguggucgugcucgggucccaggagggcgccaugcacaccgcccugacgggggccaccgagauccagaugagcagcggcaaccuccuguucaccggccaccugaagugccgccugcggauggacaagcuccagcugaaggggauguccuacagcaugugcaccggcaaguucaagaucgucaaggagaucgccgagacgcagcacgggaccaucgugauccgcgugcaguacgagggcgacggcucccccugcaagauccccuucgagaucaccgaccuggagaagcggcacguccucgggcgccugaucaccgugaacccgaucgugacggagaaggacagccccgucaacaucgaggcggagccgcccuucggcgacuccuacaucaucguggggguggagccgggccagcugaagcucaacugguucaagaaggggagcuccaucggccagauguucgagaccaccaugcgcggcgccaagcggauggccauccugggggacaccgccugggacuucggcagccucggcggggucuucacguccaucgggaaggcccuccaccagguguucggggcgaucuacggcgccgccuucagcgggguguccuggaccaugaagauccugaucggcgucaucaucaccuggaucgggaugaacagccgcuccaccagccuguccgugagccuggugcucgucggcguggugacgcuguaccugggggccaugguccaggcggacuccggcugcaucgugagcuggaagaacaaggagcucaagugcggcuccgggaucuucaucaccgacaacgugcacaccuggaccgagcaguacaaguuccagcccgagagccccagcaagcuggccuccgccauccagaaggcccacgaggagggcaucugcgggauccggagcgucacgcgccuggagaaccucauguggaagcagaucacccccgagcugaaccacauccuguccgagaacgaggugaagcucaccaucaugaccggcgacaucaaggggaucaugcaggccggcaagcggagccugcgcccgcagcccacggagcugaaguacuccuggaagaccuggggcaaggcgaagaugcucagcaccgagucccacaaccagaccuuccugaucgacgggcccgagacggccgagugcccgaacaccaaccgggccuggaacagccuggagguggaggacuacggcuucggggucuucaccaccaacaucuggcucaagcugcgcgagaagcaggacguguucugcgacuccaagcugaugagcgccgccaucaaggacaaccgggcggugcacgccgacaugggcuacuggaucgaguccgcccucaacgacaccuggaagauggagaaggccagcuucaucgaggucaaguccugccacuggcccaagagccacacgcugugguccaacggcgugcuggagagcgagaugaucauccccaagaacuucgccgggcccgugucccagcacaacuaccgcccgggcuaccacacccagaccgcggggcccuggcaccucggcaagcuggagauggacuucgacuucugcgaggggaccacggucguggugaccgaggacugcggcaaccggggccccagccugcgcaccaccacggccagcgggaagcucaucaccgaguggugcugccgguccugcacccugcccccgcugcgcuaccggggcgaggacgggugcugguacggcauggagauccgcccccucaaggagaaggaggagaaccuggucaacagccuggugaccgccgggcacggccagaucgacaacuucucccucggcgugcuggggauggcccuguuccucgaggagaugcugcggacgcgcgucggcaccaagcacgcgauccugcucguggcccugagcuucgugacccugaucaccgggaacauguccuuccgggaccucggccgcgucauggugauggugggggccacgaugaccgacgacaucggcaugggcgucaccuaccuggcccugcucgccgcguucaaggugcgccccaccuucgccgccgggcugcugcuccggaagcugacgagcaaggagcugaugauggccaccaucggcaucgcccuccugucccagagcacccugcccgagaccauccucgagcugacggacgcgcuggcccucgggaugauggugcugaagaucguccgcaacauggagaaguaccagcuggccgugaccaucauggccaucuccugcgugccgaacgccgucauccuccagaacgcguggaaggugagcugcaccauccuggccgccguguccgucagcccccugcuccugaccuccagccagcagaaggccgacuggaucccccuggcgcucacgaucaagggccugaaccccaccgccaucuuccugaccacccucucccggacgagcaagaagcgcuccuggccgcugaacgaggccaucauggccgugggcauggucagcauccuggccuccagccuccugaagaacgacauccccaugaccgggccccugguggcgggcgggcuccugaccgugugcuacguccugaccggccggagcgccgaccucgagcuggagcgcgccgccgacgugaagugggaggaccaggccgagaucuccgggagcucccccauccugagcaucacgaucuccgaggacggcagcauguccaucaagaacgaggaggaggagcagacccucaccauccugauccggaccggccugcucgugaucagcggggucuucccgguguccauccccaucaccgcggccgccugguaccugugggaggugaagaagcagcgcgccggcguccugugggacgugcccagcccgccgcccguggggaaggccgagcucgaggacggcgcguaccggaucaagcagcgcgggauccugggcuacucccagaucggcgccggggucuacaaggagggcacguuccacaccauguggcacgugacccgcggggccgugcugaugcaccgcggcaagcggaucgagcccagcugggccgacgucaagaaggaccucaucuccuacgggggcggcuggaagcuggagggggaguggaaggagggcgaggagguccaggugcuggcccucgagcccgggaagaacccccgcgcgguccagaccaagcccggcaucuucaagacgaacaccgggaccaucggcgccgugagccuggacuucucccccggcaccagcgggucccccaucguggaccggaagggcaaggucguggggcuguacggcaacggcguggucacgcgcagcggggccuacguguccgccaucgcgcagaccgagaaguccaucgaggacaaccccgagaucgaggacgacaucuuccggaagaagcgccucaccaucauggaccugcaccccggcgccgggaagaccaagcgguaccugcccgccaucgugcgcgaggccaucaagcggggccugcgcacgcucauccuggccccgacccgcgucguggcggccgagauggaggaggcccugcgggggcuccccauccgcuaccagacccccgccauccgggccgagcacaccggccgcgagaucguggaccugaugugccacgcgacguucaccaugcggcugcucagccccguccgcgugccgaacuacaaccugaucaucauggacgaggcccacuucaccgaccccgccuccaucgccgcccggggcuacaucagcacccgcguggagaugggggaggcggccggcaucuucaugacggccacgccgcccgggucccgggacccguucccccagagcaacgcccccaucauggacgaggagcgcgagauccccgagcgguccuggaacagcggccacgagugggucaccgacuucaaggggaagaccgugugguucgugccguccaucaaggcgggcaacgacaucgccgccugccugcgcaagaacggcaagaaggucauccagcucagccggaagacguucgacuccgaguacgugaagacccgcgccaacgacugggacuucguggucaccaccgacaucagcgagaugggggccaacuucaaggcggagcgggugaucgacccccgccggugcaugaagcccgugauccugacggacggcgaggagcgcgucauccuggccgggcccaugccggugacccacuccagcgccgcccagcggcgcggccgcaucgggcggaaccccaagaacgagaacgaccaguacaucuacaugggcgagccccucgagaacgacgaggacugcgcccacuggaaggaggcgaagaugcugcuggacaacaucaacacccccgagggcaucaucccguccauguucgagcccgagcgcgagaagguggacgccaucgacggggaguaccggcuccgcggcgaggcccggaagaccuucgucgaccugaugcgccgcggggaccugcccguguggcucgccuacaagguggccgcggagggcaucaacuacgccgaccgcaaguggugcuucgacgggaucaagaacaaccagauccuggaggagaacgucgagguggagaucuggacgaaggagggcgagcggaagaagcugaagccgcgcuggcucgacgcccggaucuacagcgacccccuggcccugaaggaguucaaggaguucgcggccggccgcaagucccucacccugaaccugaucaccgagauggggcggcuccccaccuucaugacgcagaaggcccgcaacgcccuggacaaccuggccgugcuccacaccgcggaggucggcgggcgggccuacaaccacgcccugagcgagcugcccgagacccucgagacccugcugcuccugacgcugcucgccaccgugaccggcggcaucuuccuguuccugauguccgggaagggcaucgggaagaugacccucggcaugugcugcaucaucaccgccagcauccugcugugguacgcgcagauccagccgcacuggaucgccgccuccaucauccucgaguucuuccugaucguccugcucauccccgagcccgagaagcagcgcacgccccaggacaaccagcugaccuacguggugaucgccauccugaccgucguggccgcgaccauggccaacgagaugggguuccucgagaagacgaagaaggaccugggcuucggcagcaucaccacccaggagagcgaguccaacauccuggacaucgaccuccggccggccagcgccuggacccuguacgccguggcgacgaccuucgucacccccaugcugcgccacuccaucgagaacagcuccgugaacgugagccucaccgccaucgccaaccaggccacgguccugauggggcugggcaagggguggccccucuccaagauggacaucggcgugccccugcuggcgaucgggugcuacagccaggugaacccgaucacccucaccgccgcccugcugcuccuggucgcccacuacgccaucaucggccccggccugcaggcgaaggccacccgggaggcccagaagcgcgccgccgcggggaucaugaagaaccccacgguggacggcaucaccgugaucgaccucgagcccaucccguacgaccccaaguucgagaagcagcuggggcaggucaugcugcucauccugugcgugacccaggugcugaugaugcggaccacgugggcccucugcgaggcccugacccuggccaccggccccaucuccacccucugggaggggaaccccggccgcuucuggaacacgaccaucgccgucagcauggcgaacaucuuccgcggcuccuaccuggccggggccggccuccuguucagcaucaugaagaacaccaccaacacgcggcgcgggaccggcaacgugggcgagacccugggggagaaguggaagucccggcugaacgcccucggcaagagcgaguuccagaucuacaagaaguccgggauccaggagguggaccgcacccuggcgaaggagggcaucaagcgcggggagacggaccaccacgccgucagccgcggcuccgccaagcugcggugguucguggagcgcaacauggugaccccggagggcaaggucguggaccucgggugcggccgcgggggcuggagcuacuacugcgggggccugaagaacgugcgcgaggucaagggccugaccaagggcggccccgggcacgaggagcccauccccauguccaccuacggcuggaaccucgugcggcugcagagcgggguggacgucuucuucacgccgcccgagaagugcgacacccugcucugcgacaucggcgagagcucccccaaccccaccaucgaggccggccgcacccugcgggugcugaaccucguggagaacuggcugaacaacaacacccaguucugcaucaagguccugaacccguacaugcccagcgugaucgagaagauggagacgcuccagcgcaaguacgggggcgcccuggugcggaacccccugucccgcaacagcacccacgagauguacugggucuccaacgcgaccgggaacaucgugagcuccgugaacaugaucagccggaugcugaucaaccgcuucaccaugaagcacaagaaggccacguacgagccggacgucgaccucggcuccgggacccggaacaucggcaucgagagcgagauccccaaccuggacaucaucggcaagcgcaucgagaagaucaagcaggagcacgagaccuccuggcacuacgaccaggaccaccccuacaagaccugggccuaccacgggagcuacgagacgaagcagaccggcuccgccagcuccauggugaacggggugguccgccugcucaccaagcccugggacguggugccgauggucacccagauggccaugacggacaccacccccuucggccagcagcggguguucaaggagaagguggacacccgcacgcaggagcccaaggagggcaccaagaagcugaugaagaucaccgcggaguggcuguggaaggagcucgggaaggagaagacgccccggaugugcacgcgcgaggaguucacccggaagguccgcagcaacgccgcccugggcgccaucuucaccgacgagaacaaguggaaguccgcccgggaggcgguggaggacgggcgcuucugggagcugguggaccgggagcgcaaccuccaccuggagggcaagugcgagaccugcgucuacaacaugauggggaagcgggagaagaagcugggcgaguucggcaaggccaaggggagccgcgccaucugguacauguggcucggcgcccgguuccuggaguucgaggcgcugggguuccucaacgaggaccacugguucucccgcggcaacagccugagcgggguggagggcgagggccugcaccggcucggguacauccugcgcgaggucggcaagaaggagggcggcgccauguacgccgacgacacggccgggugggacacccggaucacccuggaggaccucaagaacgaggagauggugaccaaccacaugaagggcgagcacaagaagcuggccgaggcgaucuucaagcugacguaccagaacaaggugguccgcgugcagcggccgacgccccggggcaccgugauggacaucaucucccggaaggaccagcgcgggagcggccaggucgggaccuacggccucaacacguucaccaacauggaggcccagcugauccgccagauggagggcgaggggaucuucaaguccauccagcaccugaccgccaccgaggagaucgccgugcagaacuggcucgcccgggugggccgcgagcggcugagccgcauggcgaucuccggggacgacugcgucgugaagcccaucgacgaccgguucgccagcgcccugacggcccucaacgacaugggcaaggugcgcaaggacauccagcagugggagcccucccggggguggaacgacuggacccaggucccguucugcagccaccacuuccacgagcuggugaugaaggacggccgcgugcuggucgugcccugccggaaccaggacgagcucaucggccgcgcccggaucucccagggggcgggcuggagccugaaggagaccgccugccuggggaaguccuacgcccagauguggacccucauguacuuccaccgccgggaccugcgccuggccgccaacgcgaucugcagcgccgugcccucccacuggguccccaccagccggacgaccugguccauccacgccaagcacgaguggaugaccaccgaggacaugcucgccguguggaaccgcguguggauccaggagaacccguggauggaggacaagacgcccgucgagagcugggaggaggugcccuaccugggcaagcgggaggaccaguggugcgggucccugaucggccucaccagccgcgcgaccugggccaagaacauccagaccgccaucaaccaggugcggagccugaucggcaacgaggaguacacggacuacaugcccuccaugaagcgcuuccgccgggaggaggaggaggccgggguccugugguga

SEQ ID NO: 8999 - RNA, 9876 nt, Artificial Sequence
  derived and/or modified CDS sequence (opt1) from DENV-2__LC121816__SS-prME
accguggggaugaucaucaugcugauccccaccgccauggccuuccaccucaccacccgcaacggggagccccacaugaucgugagccggcaggagaagggcaagagccugcuguucaagaccgaggacggggugaacaugugcacccucauggcgauggaccugggggagcugugcgaggacaccgugaccuacaacugcccccuccugcgccagaacgagcccgaggacaucgacugcuggugcaacagcaccagcaccugggucaccuacgggaccugcaccgccaccggggagcaccggcgcgagaagcggagcguggcccuggugccccacgucggcauggggcucgagacccgcaccgagaccuggauguccagcgagggcgccuggaagcacgcccagcggaucgagaccuggauccugcgccaccccggguucacgaucauggcggccauccuggcccacaccaucggcaccaccuacuuccagcgggugcucaucuucauccugcugacggccguggcgcccuccaugaccaugcgcugcaucgggaucagcaaccgggacuucgucgagggcguguccggcgggagcuggguggacaucguccucgagcacggcuccugcgugaccaccauggccaagaacaagcccacgcuggacuucgagcugaucaagaccgaggccaagcagcccgccacccuccgcaaguacugcaucgaggccaagcugaccaacacgaccaccgcgagccggugcccgacccagggggagcccucccugaacgaggagcaggacaagcgcuucgugugcaagcacagcauggucgaccggggcuggggcaacgggugcggccucuucgggaagggcgggaucgugacgugcgccauguucacgugcaagaagaacauggagggcaagaucgugcagcccgagaaccuggaguacaccaucgucaucacgccccacuccggcgaggagaacgccguggggaacgacacgggcaagcacgggaaggaggugaaggucaccccgcagagcuccaucaccgaggccgagcugaccggcuacgggaccgugacgauggagugcagcccccgcaccggccucgacuucaacgagauggugcugcugcagauggagaacaaggccuggcucguccaccggcagugguuccuggaccugccccuccccuggcugccgggcgcggacacccagggguccaacuggauccagaaggagacccuggugacguucaagaacccccacgccaagaagcaggacgucguggugcucggcagccaggagggggccaugcacaccgcccugaccggcgccaccgagauccagaugagcuccgggaaccuccuguucacgggccaccugaagugccgccugcggauggacaagcuccagcugaagggcaugagcuacuccaugugcaccgggaaguucaaggucgugaaggagaucgcggagacccagcacggcaccaucgugauccgcguccaguacgagggggacggcagccccugcaagauccccuucgagaucauggaccuggagaagcggcacgugcucggccgccugaucacggugaacccgaucgucaccgagcgcgacucccccgugaacaucgaggccgagccgcccuucggggacagcuacaucaucaucggcguggagccggggcagcugaagcucuccugguucaagaagggcagcuccaucgggcagauguucgagaccaccaugcggggcgccaagcgcauggccauccugggcgacacggccugggacuucgggagccugggcggggucuucaccuccaucggcaaggcgcuccaccagguguucggggccaucuacggcgccgccuucagcggcguguccuggaccaugaagauccugaucggggucgugaucaccuggaucggcaugaacagccgguccacgagccuguccgugagccugguccucguggggguggucacccuguaccugggcgugauggugcaggcggacuccgggugcgucgugagcuggaagaacaaggagcucaagugcggcagcggcaucuucaucaccgacaacgugcacaccuggacggagcaguacaaguuccagcccgagucccccagcaagcuggccuccgccauccagaaggccuacgaggaggggaucugcggcauccgcagcgucacccggcuggagaaccucauguggaagcagaucacccccgagcugaaccacauccuguccgagaacgaggugaagcucaccaucaugacgggggacaucaagggcaucaugcaggccgggaagcgcagccugcggccgcagcccaccgagcugaaguacuccuggaagaccuggggcaaggcgaagaugcucagcaccgagcaccacaaccagacgcugcugaucgacggccccgagaccgccgagugcccgaacaccaaccgcgccuggaacucccucgagguggaggacuacggguucggcgucuucaccacgaacaucuggcugaagcugaaggagcggcaggacguguucugcgacagcaagcucauguccgccgccaucaaggacaaccgcgcggugcacgccgacaugggguacuggaucgagagcgcccugaacgacaccuggaagaucgagaaggccuccuucaucgaggucaagagcugccacuggcccaagucccacacccuguggagcaacggcgugcucgaguccgagaugaucauccccaagaacuucgccggccccgugagccagcacaacuaccggccgggguaccacacccagaccgcgggccccuggcaccuggggaagcuggagauggacuucgacuucugcgagggcacgaccgucguggugaccgaggacugcgggaaccgcggccccagccuccggaccacgaccgccuccggcaagcugaucaccgaguggugcugccgcagcugcacccugcccccgcuccgguaccgcggggaggacggcugcugguacgggauggagauccggccccugaaggagaaggaggagaaccuggucaacucccucgugacggccggccacgggcagaucgacaacuucagccugggcgugcugggcauggcccucuuccuggaggagaugcugcgcacccgggucgggaccaagcacgcgcuccugcugguggccguguccuucaugacccucaucacgggcaacaugagcuuccgcgaccuggggcgcgucauggugauggugggcgccgccaugaccgacgacaucgggaugggcgucaccuaccuggcccuccuggcggccuucaaggugcggcccaccuucgccgccggccugcuccugcgcaagcugacguccaaggagcucaugaugaccaccaucgggaucgugcugcugagccaguccaccauccccgagacgauccucgagcugaccgacgcccuggcgcucggcaugaugauccugaagaucguccggaacauggagaaguaccagcuggccgugaccaucauggccauccucugcgucccgaacgccgugauccugcagaacgccuggaaggugagcugcaccauccuggcggucguguccgugacgccccuccugcugaccagcucccgccagaaggccgacuggaucccccucgcccugaccaucaaggggcugaaccccaccgccaucuuccucacgacccugagccggaccaacaagaagcgcuccuggccgcugaacgaggcgaucauggccgucggcauggugagcauccucgccuccagccugcugaagaacgacauccccaugaccggcccccucguggccgggggccugcugacggucugcuacgugcucaccgggcgguccgccgaccuggagcuggagcgcgcggccgacgugcggugggaggaccaggccgagaucagcggcagcucccccauccucagcaucaccaucuccgaggacgggagcauguccaucaagaacgaggaggaggagcagacccugacgauccugauccgcaccggccuccuggucaucagcggccuguucccgguguccauccccaucaccgccgccgcgugguaccucugggaggugaagaagcagcgggccgggguccugugggacgugcccagcccgccgcccgugggcaaggccgagcuggaggacggggccuaccgcaucaagcagaagggcauccucggguacucccagaucggcgccggcgucuacaaggaggggaccuuccacaccauguggcacgugacgcggggcgcggugcugaugcacaaggggaagcgcaucgagcccagcugggccgacguccggaaggaccugaucuccuacggcgggggcuggaagcucgagggcgaguggaaggagggggaggagguccaggugcuggcccuggagcccggcaagaacccccgcgccguccagaccaagcccggccuguucaagaccgacaccggcacgaucggggccgugagccuggacuucucccccggcaccagcggcucccccaucguggacaagaaggggaaggucgugggccuguacgggaacggcguggucacccggagcggcaccuacguguccgcgaucgcccagacggagaaguccaucgaggacaaccccgagaucgaggacgacaucuuccgcaagcggcgccugaccaucauggaccuccaccccggggccggcaagaccaagcgguaccugcccgccaucgugcgcgaggcgaucaagcgcgggcugcggacccucauccuggccccgacgcgcgucguggccgccgagauggaggaggcccugcggggccuccccauccgcuaccagacccccgcgauccgggccgagcacaccgggcgcgagaucguggaccugaugugccacgccaccuucacgaugcggcugcucucccccguccgcgugccgaacuacaaccugaucaucauggacgaggcccacuucaccgaccccgccagcaucgcggcccggggcuacaucagcacccgcguggagaugggcgaggccgccgggaucuucaugaccgccacgccgcccggcucccgggacccguucccccagagcaacgcgcccaucauggacgaggagcgcgagauccccgagcgguccuggaacagcgggcacgagugggucaccgacuucaagggcaagaccgugugguucgugccguccaucaaggccgggaacgacaucgccgccugccugcgcaagaacggcaagaaggucauccagcucagccggaagaccuucgacuccgaguacaucaagacgcgcaccaacgacugggacuucguggugaccaccgacaucagcgagaugggcgcgaacuucaaggccgagcgggucaucgacccccgccggugcaugaagcccgugauccugacggacggggaggagcgcgugauccuggccggccccaugccggucacccacuccagcgccgcccagcgccgggggcgcaucggccggaaccccaagaacgagaacgaccaguacaucuacaugggggagccccucgagaacgacgaggacugcgcgcacuggaaggaggccaagaugcugcuggacaacaucaacacccccgagggcaucaucccguccauguucgagcccgagcgcgagaagguggacgccaucgacggcgaguaccggcuccgcggggaggcccggaagaccuucguggaccugaugcgccggggcgaccugcccgucuggcucgccuaccgcguggcggccgaggggaucaacuacgccgaccggcgcuggugcuucgacggcgucaagaacaaccagauccuggaggagaacguggagguggagaucuggacgaaggagggggagcggaagaagcugaagccgcgcuggcucgacgcccggaucuacagcgacccccuggcccugaaggaguucaaggaguucgcggccggccgcaagucccucacccugaaccugaucaccgagaugggccggcuccccaccuucaugacgcagaaggcccgcaacgcccuggacaaccuggcgguccuccacaccgccgaggccgggggccgggccuacaaccacgcccugagcgagcugcccgagacccucgagacccugcugcuccugacgcugcucgcgaccgugaccgggggcaucuuccuguuccugauguccggcaaggggaucggcaagaugacccucgggaugugcugcaucaucaccgccagcauccugcugugguacgcccagauccagccgcacuggaucgccgccuccaucauccucgaguucuuccugaucgugcugcucauccccgagcccgagaagcagcgcacgccccaggacaaccagcugaccuacgucgugaucgcgauccugaccguggucgccgccaccauggccaacgagaugggcuuccucgagaagacgaagaaggacuucgggcugggcagcaucgccacccagcagccggaguccaacauccuggacaucgaccuccggcccgcgagcgccuggacccuguacgccguggccaccacguucaucacccccaugcugcgccacagcaucgagaacuccagcgugaacgucucccucaccgccaucgcgaaccaggccaccgugcugaugggccuggggaagggcuggccccucagcaagauggacaucggggugccgcugcuggccaucggcugcuacucccaggucaaccccaucacgcucaccgccgcgcugcugcuccugguggcccacuacgccaucaucgggcccggccugcaggccaaggccacccgcgaggcgcagaagcgggccgccgccggcaucaugaagaaccccaccguggacgggaucacggucaucgaccucgacccgauccccuacgaccccaaguucgagaagcagcugggccaggugaugcugcucgugcugugcgucacccaggugcugaugaugcgcaccaccugggcccucugcgaggcgcugacgcuggccaccgggcccaucagcacccucugggagggcaacccggggcgguucuggaacaccacgaucgccguguccauggccaacaucuuccgcggcagcuaccuggccggcgcggggcuccucuucuccaucaugaagaacaccaccaacacccggcgcggcacggggaacaccggcgagacccugggcgagaaguggaagaaccggcugaacgcccucggcaagagcgaguuccagaccuacaagaaguccggcauccaggaggucgaccgcacgcuggccaaggaggggaucaagcggggcgagaccgaccaccacgccgugagccgcggguccgcgaagcugcggugguucguggagcgcaaccucgucacccccgagggcaaggugguggaccugggcugcgggcggggcggguggagcuacuacugcggcgggcugaagaacguccgcgaggugaagggccucaccaagggcgggcccggccacgaggagcccaucccgauguccacguacggguggaaccuggugcggcugcagagcggcgucgacguguucuucacgccgcccgagaagugcgacacccuccugugcgacaucggggaguccagccccaacccgaccguggaggccggccgcacccugcggguccucaaccugguggagaacuggcugaacaacaacacgcaguucugcaucaaggugcugaaccccuacaugcccuccgucaucgagaagauggaggcccuccagcgcaaguacggcggggcccuggugcggaacccgcugagccgcaacagcacccacgagauguacuggguguccaacgccagcggcaacaucgucuccagcgugaacaugaucucccgcaugcucaucaaccgguucaccaugcgccacaagaaggcgaccuacgagcccgacguggaccuggggagcggcacgcggaacaucgggaucgaguccgagacccccaaccuggacaucaucggcaagcgcaucgagaagauccggcaggagcacgagaccagcuggcacuacgaccaggaccaccccuacaagaccugggccuaccacggcuccuacgagacgaagcagaccgggagcgccuccagcauggucaacggcguggugcgccuccugaccaagccgugggacgucauccccauggugacccagauggccaugacggacaccacccccuucgggcagcagcggguguucaaggagaaggucgacacccgcacgcaggagcccaaggagggcaccaagaagcugaugaagaucaccgccaaguggcucuggaaggagcugggcaagaagaagaccccgcggaugugcacgcgcgaggaguucacccggaaggugcgcuccaacgcggcccugggggccaucuucaccgacgagaacaaguggaaguccgcccgggaggccgucgaggacucccgcuucugggagcucguggacaaggagcggaaccugcaccuggagggcaagugcgagaccugcguguacaacaugauggggaagcgcgagaagaagcucggcgaguucgggaaggcgaagggcagccgggccaucugguacauguggcugggcgcccgcuuccuggaguucgaggcccucggguuccugaacgaggaccacugguucucccgggagaacagccuguccggcgucgagggggagggccuccacaagcugggguacauccugcgcgacgugagcaagaaggagggcggcgcgauguacgccgacgacacggccgggugggacacccggaucacccucgaggaccugaagaacgaggagauggugaccaaccacauggagggcgagcacaagaagcuggccgaggccaucuucaagcucacguaccagaacaaggucgugcgcgugcagcgccccacgccccgggggaccgucauggacaucaucagccgccgggaccagcgcggcuccggccaggugggcaccuacggccugaacacguucaccaacaugggggcgcagcugauccggcagauggagggcgaggggguguucaagagcauccagcaccucaccgccaccgaggagaucgccguccaggacuggcuggcccgcgugggccgggagcgccugucccggauggccaucagcggcgacgacugcguggucaagccccucgacgaccgcuucgcguccgcccugacggcccugaacgacauggggaaggugcggaaggacauccagcagugggagccgagccgcggcuggaacgacuggacccaggugcccuucugcucccaccacuuccacgagcucaucaugaaggacgggcggguccugguggugcccugccgcaaccaggacgagcugaucggccgggcccgcaucagccagggggccggcuggucccuccgggagaccgcgugccugggcaagagcuacgcccagauguggucccugauguacuuccaccgccgggaccuccgccuggccgccaacgccaucugcagcgcgguccccucccacugggugccgaccagccgcaccacgugguccauccacgccaagcacgaguggaugaccaccgaggacaugcugaccguguggaaccgggucuggauccaggagaaccccuggauggaggacaagacgcccguggagagcugggaggagauccccuaccucgggaagcgcgaggaccaguggugcggcucccugaucgggcugaccagccgggccaccugggccaagaacauccagaccgcgaucaaccaggugcgcagccucaucggcaacgaggaguacacggacuacaugccguccaugaagcgguuccgccgggaggaggaggaggccgggguccugugguga

SEQ ID NO: 9000 - RNA, 9876 nt, Artificial Sequence
  derived and/or modified CDS sequence (opt1) from DENV-2__LC111438__SS-prME
accgccggcaucaucaucaugaugauccccaccgugauggccuuccaccugaccacccgcaacggggagccccacaugaucgucagccggcaggagaagggcaagagccuccuguucaagaccgagaacggggugaacaugugcacccugauggcgauggaccucggcgagcugugcgaggacaccaucaccuacaacugcccccugcuccgccagaacgagcccgaggacaucgacugcuggugcaacagcaccuccaccugggugaccuacgggaccugcaccgccaccggcgagcaccggcgcgagaagcggagcgucgcccuggugccccacgugggcauggggcuggagacccgcaccgagaccuggauguccagcgagggcgccuggaagcacgcccagcggaucgagaccuggguccuccgccaccccggguucaccaucauggcggccauccuggccuacaccaucggcaccacccacuuccagcgggugcugaucuucauccuccugacggccguggcgcccuccaugaccaugcgcugcaucgggaucagcaaccgggacuucgucgagggcguguccggcgggagcuggguggacaucguccuggagcacggcuccugcgugaccaccauggccaagaacaagcccacgcucgacuucgagcugaucaagaccgaggccaagcaccccgccacccugcgcaaguacugcaucgaggccaagcucaccaacacgaccaccgcgagccggugccccacccagggggagcccucccugaacgaggagcaggacaagcgcuucgugugcaagcacagcauggucgaccggggcuggggcaacgggugcggccuguucgggaagggcgggaucgugacgugcgccauguucacgugcaagaagaacauggagggcaaggugguccagcccgagaaccucgaguacaccaucgugaucacgccccacuccggcgaggagaacgccguggggaacgacacgggcaagcacgggaaggagaucaaggucacgccccagagcuccaucaccgaggccgagcugaccggcuacgggaccgugaccauggagugcagcccccgcaccggccuggacuucaacgagauggugcuccugcagauggagaacaaggccuggcugguccaccggcagugguuccucgaccugccccugcccuggcucccgggcgcggacacccagggguccaacuggauccagaaggagacccuggugacguucaagaacccccacgccaagaagcaggacgucguggugcugggcagccaggagggggccaugcacaccgcccucaccggcgccaccgagauccagaugagcuccgggaaccugcuguucacgggccaccucaagugccgccugcggauggacaagcugcagcucaagggcaugagcuacuccaugugcaccgggaaguucaaggucgugaaggagaucgcggagacccagcacggcaccaucgugauccgcguccaguacgagggggacggcagccccugcaagauccccuucgagaucauggaccuggagaagcggcacgugcugggccgccucaucacggugaacccgaucgucaccgagaaggacucccccgugaacaucgaggccgagccgcccuucggggacagcuacaucaucaucggcguggagccggggcagcugaagcuguccugguucaagaagggcagcuccaucgggcagauguucgagaccaccaugcgcggcgccaagcggauggccauccucggcgacacggccugggacuucgggagccugggcggggucuucaccuccaucggcaaggcgcugcaccagguguucggggccaucuacggcgccgccuucagcggcguguccuggaccaugaagauccucaucggggucgugaucaccuggaucggcaugaacagccgcuccacgagccuguccgugagccugguccugguggggguggucacccucuaccugggcgugauggugcaggcggacuccgggugcgucgugagcuggaagaacaaggagcugaagugcggcagcggcaucuucaucaccgacaacgugcacaccuggacggagcaguacaaguuccagcccgagagcccgcccaagcucgccagcgccauccagaaggcccacgaggaggggaucugcggcauccgguccgucacccgccuggagaaccugauguggaagcagaucaccccggagcucaaccacauccugagcgagaacgaggugaagcugaccaucaugacgggggacaucaagggcaucaugcaggccgggaagcggucccuccgcccccagcccaccgagcugaaguacagcuggaaggcguggggcaaggccaagaugcuguccaccgagcuccacaaccacaccuuccugaucgacggcccggagacggccgagugccccaacaccaaccgggccuggaacagccuggagguggaggacuacggguucggcgucuucaccaccaacaucuggcucaagcugaaggagaagcaggacguguucugcgacuccaagcugaugagcgccgcgaucaaggacaaccgcgccgugcacgccgacaugggguacuggaucgaguccgcccucaacgacacguggaagaucgagaaggccagcuucaucgaggucaaguccugccacuggcccaagagccacacccugugguccaacggcgugcuggagagcgagaugaucauccccaagaacuucgcgggcccggugucccagcacaacuaccggcccggguaccacacccagaccgccggccccuggcaccucgggagccuggagauggacuucgacuucugcgagggcaccacggucguggugaccgaggacugcgggaaccgcggccccagccugcggaccaccacggccuccggcaagcucaucaccgaguggugcugccgcagcugcacccugccgccccugcgguaccgcggggaggacggcugcugguacgggauggagauccggccccucaaggagaaggaggagaaccuggucaacucccuggugaccgccggccacgggcagaucgacaacuucagccucggcgugcugggcauggcgcuguuccucgaggagaugcugcgcacgcgggucgggaccaagcacgccauccugcucguggccguguccuucgucacccugaucaccggcaacaugagcuuccgcgaccuggggcgggugauggugauggucggcgccacgaugaccgacgacaucgggaugggcgugaccuaccucgcccugcuggcggccuucaagauccgccccaccuucgccgccggccuccugcugcgcaagcucacguccaaggagcugaugaugaccaccaucgggaucgugcugcucagccaguccaccaucccggagacgauccuggagcugaccgacgcccucgcgcugggcaugaugguccugaagaucgugcggaacauggagaaguaccagcucgccgucaccaucauggccauccugugcgugcccaacgccgugauccugcagaacgccuggaaggucagcugcaccacgcucgcggugguguccgucagcccccugcugcucaccuccagccagcagaaggccgacuggaucccccuggcccugaccaucaaggggcucaacccgaccgccaucuuccugacgacccugucccgcaccagcaagaagcgguccuggccccucaacgaggcgaucauggccgugggcauggugagcauccuggccuccagccugcucaagaacgacauccccaugaccggcccccuggucgccgggggccugcucacggugugcuacgugcugaccgggcgcagcgccgaccuggagcucgagcgggcggccgacguccgcugggaggagcaggccgagaucuccggcagcuccccgauccugagcaucaccaucuccgaggacgggagcauguccaucaagaacgaggaggaggagcagacccugacgauccucauccggaccggccugcuggugaucagcggccucuuccccguguccauccccaucaccgccgccgcgugguaccugugggaggucaagaagcagcgcgccggggugcugugggacgugcccagcccgccgcccgucggcaaggccgagcucgaggacggggccuaccggaucaagcagaagggcauccugggguacucccagaucggcgccggcguguacaaggaggggaccuuccacaccauguggcacgugacgcgcggcgcgguccugaugcacaaggggaagcggaucgagccgagcugggccgacgugaagaaggaccucaucuccuacggcgggggcuggaagcuggagggcgaguggaaggagggggaggaggugcagguccuggcccucgagcccggcaagaacccccgcgccgugcagaccaagcccgggcuguucaagaccaacaccggcacgaucggggccgugagccuggacuucuccccgggcaccagcggcucccccaucgucgacaagaaggggaagguggugggccucuacgggaacggcgucgugacccggagcggcaccuacguguccgcgaucgcccagacggagaaguccaucgaggacaaccccgagaucgaggacgacaucuuccgcaagaagcggcugaccaucauggaccugcaccccggggccggcaagaccaagcgcuaccugccggccaucguccgggaggcgaucaagcgcgggcuccggacccugauccuggcccccacgcgcgugguggccgccgagauggaggaggcccuccggggccugcccauccgcuaccagacccccgcgauccgcgccgagcacaccgggcgggagaucgucgaccugaugugccacgccaccuucacgaugcgccuccugagcccgauccgggugcccaacuacaaccugaucaucauggacgaggcccacuucaccgaccccgccagcaucgcggcccgcggcuacaucagcacccggguggagaugggcgaggccgccgggaucuucaugaccgccacgcccccgggcucccgcgaccccuucccccagagcaacgcgcccaucauggacgaggagcgggagaucccggagcgcuccuggaacagcgggcacgagugggucaccgacuucaagggcaagaccgugugguucgugcccuccaucaaggccgggaacgacaucgccgccugccuccggaagaacggcaagaaggucauccagcugagccgcaagaccuucgacuccgaguacaucaagacgcggaccaacgacugggacuucguggugaccaccgacaucagcgagaugggcgcgaacuucaaggccgagcgcgucaucgacccccggcgcugcaugaagcccgugauccugacggacggggaggagcgggugauccucgccggcccgaugcccgucacccacuccagcgccgcccagcgccgggggcgcgugggccggaaccccaagaacgagaacgaccaguacaucuacaugggggagccccuggagaacgacgaggacugcgcgcacuggaaggaggccaagaugcugcucgacaacaucaacaccccggagggcaucauccccuccauguucgagcccgagcgcgagaagguggacgccaucgacggcgaguaccgccugcgcggggaggcccgcaagaccuucgucgaccugaugcggcgcggcgaccucccgguguggcuggccuaccgggucgcggccgaggggaucaacuacgccgaccgccgguggugcuucgacggcgugaagaacaaccagauccuggaggagaacguggaggucgagaucuggacgaaggagggggagcgcaagaagcucaagccccgguggcuggacgcccgcaucuacagcgacccccuggcccucaaggaguucaaggaguucgcggccggccggaagucccuggcccugaaccucaucaccgagaugggccgccugcccaccuucaugacccagaaggcccggaacgcgcuggacaaccucgccgugcugcacacggccgaggccgggggccgcgccuacaaccacgcgcugagcgagcucccggagacccuggagacccugcuccugcugacccuccuggccacggugaccgggggcaucuuccuguuccucauguccggcaaggggaucggcaagaugaccauggggaugugcugcaucaucaccgccagcauccugcugugguacgcccagauccagccccacuggaucgccgcguccaucauccucgaguucuuccugaucguccugcucauccccgagcccgagaagcagcggaccccgcaggacaaccagcugacguacguggugaucgccauccugaccgucguggccgccaccauggccaacgagaugggcuuccucgagaagaccaagaaggacuucgggcugggcagcaucgcgacgcagcagcccgagagcaacauccuggacaucgaccuccgccccgccuccgccuggacccuguacgccguggccaccaccuucaucacgcccaugcugcggcacagcaucgagaacuccagcgucaacgugucccucaccgcgaucgccaaccaggccaccgugcugaugggccuggggaagggcuggccgcucagcaagauggacaucggggucccccugcuggccaucggcugcuacucccaggugaaccccaucacccucauggcggcccugcugcuccugguggcccacuacgccaucaucgggcccggccugcaggccaaggcgacgcgcgaggcccagaagcgggccgccgccggcaucaugaagaacccgaccgucgacgggaucaccgugaucgaccucgaccccauccccuacgaccccaaguucgagaagcagcugggccaggugaugcugcucguccugugcgugacccaggugcugaugaugcgcacgaccugggcgcucugcgaggcccugacccuggccaccgggccgaucagcacgcucugggagggcaaccccgggcgguucuggaacaccaccaucgccgucuccauggccaacaucuuccgcggcagcuaccuggcgggcgccgggcuccuguucuccaucaugaagaacaccgccaacacgcgccggggcaccgggaacaccggcgagacccugggcgagaaguggaagaaccgccugaacgcccucgggaaguccgaguuccagaucuacaagaaguccggcauccaggagguggaccggacgcuggcgaaggaggggaucaagcgcggcgagaccgaccaccacgccgugagccggggguccgccaagcugcgcugguucgucgagcggaaccucgugacccccgagggcaagguggucgaccugggcugcgggcgcggcggguggagcuacuacugcggcgggcugaagaacgugaaggaggugaagggccucaccaagggcgggcccggccacgaggagccgauccccauguccacguacggguggaaccugguccggcugcagagcggcguggacguguucuucacgccgcccgagaagugcgacacccuccugugcgacaucggggaguccagcccgaaccccaccgucgaggccggccgcacgcugcgggugcucaaccugguggagaacuggcugaacaacaacacccaguucugcaucaagguccucaaccccuacaugccgagcgugaucgagaagauggaggcccugcagcgcaaguacggcggggcgcuggugcggaacccccugucccgcaacagcacccacgagauguacugggucuccaacgccagcggcaacaucguguccagcgugaacaugaucucccggaugcucaucaaccgcuucaccaugcggcacaagaaggccaccuacgagcccgacgucgaccuggggagcggcacgcgcaacaucgggaucgaguccgagacccccaaccuggacaucaucggcaagcggaucgagaagaucaagcaggagcacgagaccagcuggcacuacgaccaggaccacccguacaagaccugggccuaccacggcuccuacgagacgaagcagaccgggagcgccuccagcauggugaacggcgugguccgccuccugaccaagcccugggacgugauccccauggugacccagauggcgaugacggacaccacccccuucgggcagcagcgcgucuucaaggagaagguggacacccggacgcaggagccgaaggagggcaccaagaagcugaugaagaucaccgccaaguggcucuggaaggagcugggcaagaagaagacgccccggaugugcacgcgggaggaguucacccgcaagguccgguccaacgccgcccugggggccaucuucaccgacgagaacaaguggaaguccgcgcgcgaggccguggaggacuccggcuucugggagcucguggacaaggagcggaaccugcaccuggaggggaagugcgagaccugcgucuacaacaugaugggcaagcgcgagaagaagcucggggaguucggcaaggccaagggcagccgggccaucugguacauguggcugggggcgcgcuuccuggaguucgaggcccucggcuuccugaacgaggaccacugguucucccgggagaacagccugagcgggguggagggcgaggggcuccacaagcugggcuacauccugcgcgacguguccaagaaggagggcggggccauguacgccgacgacacggccggcugggacacccggaucacccucgaggaccugaagaacgaggagaucgucaccaacuacauggagggggagcacaagaagcuggcggaggccaucuucaagcucacguaccagaacaagguggugcgcguccagcggcccacgccccgcggcaccgugauggacaucaucagccggcgcgaccagcggggguccggccagguggucaccuacggccugaacacguucaccaacauggaggcccagcugauccgccagauggagggggagggcguguucaagagcauccagcaccucaccgugaccgaggagaucgccgucgagaacuggcuggugcggguggggcgcgagcgccugucccggauggccaucagcggcgacgacugcgucgugaagccgcucgacgaccgcuucgcguccgcccugacggcccugaacgacaugggcaaggugcggaaggacauccagcagugggagcccagccgcggguggaacgacuggacccagguccccuucugcucccaccacuuccacgagcucaucaugaaggacggccgggugcuggugguccccugccgcaaccaggacgagcugaucgggcgggcccgcaucagccagggcgccggguggucccuccgggagaccgcgugccugggcaagagcuacgcccagauguggucccugauguacuuccaccgccgggaccuccgccuggccgccaacgccaucugcagcgcggugccgucccacugggugcccaccagccggacgaccugguccauccacgccacccacgaguggaugaccaccgaggacaugcugacggucuggaaccgcguguggauccaggagaaccccuggauggaggacaagacccccguggagagcugggaggagaucccguaccucggcaagcgggaggaccaguggugcgggagccugaucggccugaccucccgcgccaccugggccaagaacauccagacggcgaucaaccagguccggagccucaucgggaacgaggaguacaccgacuacaugcccuccaugaagcgcuuccggcgcgaggaggaggaggccggcgugcugugguga

SEQ ID NO: 9001 - RNA, 9876 nt, Artificial Sequence
  derived and/or modified CDS sequence (opt1) from DENV-2__KF744400__SS-prME
accgccggcaugaucaucaugcugauccccaccgugauggccuuccaccucaccacccgcaacggggagccccacaugaucgucagccggcaggagaagggcaagagccugcuguucaagaccgagaacggggugaacaugugcacccucauggcgauggaccugggcgagcugugcgaggacaccaucaccuacaagugcccccuccugcgccagaacgagcccgaggacaucgacugcuggugcaacagcaccagcaccugggugaccuacgggaccugcaccaccacgggcgagcaccggcgcgagaagcggagcgucgcccuggugccccacgugggcauggggcucgagacccgcaccgagaccuggaugagcagcgagggcgccuggaagcacgcccagcggaucgagacguggauccugcgccaccccggguucacccugauggccgcgauccucgccuacaccaucggcaccacgcacuuccagcgggcccugaucuucauccugcucaccgccgucgcgcccuccaugaccaugcgcugcaucgggaucagcaaccgggacuucguggagggcguguccggcgggagcugggucgacaucgugcuggagcacggcuccugcgugaccacgauggccaagaacaagcccacccuggacuucgagcucaucaagaccgaggccaaggagcccgccacccugcgcaaguacugcaucgaggccaagcugacgaacaccaccaccgagagccggugcccgacgcagggggagcccucccucaacgaggagcaggacaagcgcuucgucugcaagcacagcaugguggaccggggcuggggcaacgggugcggccuguucgggaagggcgggaucgugaccugcgcgauguucacgugcaagaagaacauggagggcaagaucguccagcccgagaaccuggaguacaccaucgugaucacgccccacuccggcgaggagcacgccguggggaacgacaccggcaagcacgggaaggagaucaagaucaccccgcagagcuccaccaccgaggccgagcucacgggcuacgggaccgucaccauggagugcagcccccgcaccggccuggacuucaacgagauggugcugcuccagauggagaacaaggccuggcuggugcaccggcagugguuccuggaccucccccugcccuggcugccgggcgccgacacgcagggguccaacuggauccagaaggagacccucgucaccuucaagaacccccacgcgaagaagcaggacguggugguccugggcagccaggagggggccaugcacaccgcccugacgggcgccaccgacauccagaugagcuccgggaaccuccuguucaccggccaccugaagugccgccuccggauggacaagcugcagcugaagggcaugagcuacuccaugugcaccgggaaguucaagguggucaaggagaucgccgagacgcagcacggcaccaucguggugcgcguccaguacgagggggacggcagccccugcaagauccccuucgagaucauggaccucgagaagcggcacgugcugggccgccugaucaccgugaacccgaucgucaccgagaaggacucccccgugaacaucgaggcggagccgcccuucggggacagcuacgugaucaucggcgucgagccggggcagcucaagcugaacugguucaagaagggcuccagcaucgggcagauguucgagacgaccaugcgcggcgccaagcggauggccauccugggcgacaccgccugggacuucgggucccucggcgggguguucaccagcaucggcaaggcccugcaccagguguucggggcgaucuacggcgccgccuucuccggcgucagcuggacgaugaagauccugaucggggugaucaucaccuggaucggcaugaacucccgcagcaccucccugagcgugucccucguccugguggggguggucacccuguaccucggcguggugguccaggccgacagcgggugcgugguguccuggaagaacaaggagcugaagugcggcagcggcaucuucaucacggacaacguccacaccuggaccgagcaguacaaguuccagcccgagagccccuccaagcuggcgagcgccauccagaaggcccaccaggaggggaucugcggcauccgguccgugacccgccucgagaaccugauguggaagcagaucacgcccgagcugaaccacauccucagcgagaacgaggugaagcugaccaucaugaccggggacaucaagggcaucaugcacgccgggaagcggucccugcgcccgcagcccaccgagcuccgguacagcuggaagacguggggcaaggccaagauccuguccaccgagagccacaaccagaccuuccugaucgacggccccgagaccgcggagugcccgaacacgaaccgcgccuggaacucccucgaggucgaggacuacggguucggcguguucaccaccaacaucuggcugaagcugcgggagaagcaggacgccuucugcgaccccaagcucaugagcgccgccaucaaggacaaccgcgcggugcacgccgacaugggguacuggaucgaguccgcccugaacgacaccuggaagaucgagaaggccagcuucaucgaggucaagaacugccacuggcccaagucccacacccuguggagcaacggcgugcucgaguccgagaugaucauccccaagaacuucgccggcccggugagccagcacaacuaccggcccggguaccacacgcagaccgcgggccccuggcaccuggggaagcuggagcucgacuucgacuucugcgagggcaccaccgucguggugacggaggacugcgggaaccgcggccccucccugcggaccaccaccgccagcggcaagcugaucacggaguggugcugccgcagcugcacccucccgccccugcgguacaagggggaggacggcugcugguacgggauggagauccgcccccugaaggagaaggaggagaaccucgucuccagccuggugaccgccggccacgggcagaucgacaacuucucccugggcgugcucggcauggcccuguuccuggaggagaugcuccggacccgcgucgggaugaagcacgcgauccugcugguggccgugagcuucgucacgcucaucaccggcaacauguccuuccgggaccuggggcgcgugauggugauggucggcgccaccaugaccgacgacaucgggaugggcgugacguaccuggcccuccuggccgcguucaaggugcgccccaccuucgccgccggccugcuccugcggaagcugaccagcaaggagcucaugaugaccacgaucgggaucguccugcugucccagagcaccaucccggagaccauccucgagcugaccgacgcccuggcccucggcaugauggugcugaagaucgugcgcaagauggagcgguaccagcuggcggucacgaucauggccauccucugcgugcccaacuccgucauccugcagaacgccuggaaggugagcugcaccauccuggccguggucuccgugagcccccuccugcugaccuccagccagcagaaggccgacuggaucccccucgcgcugaccaucaaggggcugaacccgacggccaucuuccucaccacccugucccgcaccagcaagaagcgguccuggccccugaacgaggccaucauggccgugggcauggucagcauccucgcguccagccugcugaagaacgacauccccaugacgggcccccucguggccgggggccugcugaccgugugcuacguccucaccgggcgcagcgccgaccuggagcuggagaaggccgccgacgugcggugggaggaccaggcggagaucuccggcagcuccccgauccucagcgugaucgucuccgaggacgggagcauguccaucaagaacgaggaggaggagcagauccugaccauccugauccgcacgggccuccuggugaucagcggccuguuccccguguccauccccaucaccgccgccgccugguaccucugggaggucaagaagcagcgggccggggugcugugggacgugcccagcccgccgcccgucggcaaggcggagcuggaggacggggccuaccgcaucaagcagaagggcauccucggguacucccagaucggcgccggcguguacaaggaggggaccuuccacaccauguggcacgugacccggggcgccguccugaugcacaaggggaagcgcaucgagccgagcugggccgacgugaagaaggaccugaucuccuacggcgggggcuggaagcucgagggcgaguggaaggagggggaggaggugcagguccuggcgcuggagcccggcaagaacccccgggccgugcagacgaagcccggccucuucaagaccaacgccggcaccaucggggccgugagccuggacuucuccccgggcaccagcggcucccccaucaucgacaagaaggggaaggucgugggccuguacgggaacggcguggucacgcgcaacggcagcuacguguccgccaucgcgcagaccgagaaguccaucgaggacaaccccgagaucgaggacgacaucuuccggaagaagcgccugaccaucauggaccuccaccccggggccggcaagaccaagcgguaccugccggccaucgugcgcgaggccaucaagcgggggcugcgcacgcucauccuggcgcccacccgggucguggccgccgagauggaggaggcccugcgcggccuccccauccgcuaccagacccccgccauccgggcggagcacaccgggcgcgagaucguggaccugaugugccacgccacguucaccaugcggcugcucagcccgauccgcguccccaacuacaaccugaucaucauggacgaggcccacuucaccgaccccgccuccaucgccgcgcggggcuacaucagcacccgcguggagaugggcgaggccgccgggaucuucaugacggccacgccgcccggcucccgggaccccuucccccagagcaacgcccccaucauggacgaggagcgcgagauccccgagcgguccuggaacagcgggcacgagugggugaccgacuucaagggcaagaccgucugguucgugcccuccaucaaggcggggaacgacaucgccgccugccugcgcaagaacggcaagaaggugauccagcucagccggaagacguucgacuccgaguacgucaagacccgcaccaacgacugggacuucguggugaccacggacaucagcgagaugggcgccaacuucaaggcggagcgggucaucgacccccgccggugcaugaagcccgugauccugaccgacggggaggagcgcgugauccuggccggcccgaugcccgucacccacuccagcgccgcccagcggcgcgggcggaucggccgcaaccccaagaacgagaacgaccaguacaucuacaugggggagccccucgagaacgacgaggacugcgcccacuggaaggaggcgaagaugcugcuggacaacaucaacaccccggagggcaucauccccuccauguucgagcccgagcgcgagaagguggacgccaucgacggcgaguaccggcuccgcggggaggcccggaagacguucguggaccugaugcgccggggcgaccugccggucuggcucgccuacaagguggccgcggaggggaucaacuacgccgaccgccgguggugcuucgacggcauccgcaacaaccagauccuggaggagaacgucgagguggagaucuggaccaaggagggggagcggaagaagcugaagccccgcuggcucgacgcccggaucuacagcgacccccuggcccugaaggaguucaaggaguucgccgcgggccgcaagucccucacccugaaccugaucaccgagaugggccggcuccccacguucaugacccagaaggcccgcgacgcccuggacaaccuggccgugcuccacaccgcggaggccgggggccgggccuacaaccacgcccugagcgagcugccggagacccucgagacgcugcugcuccugacccugcucgccaccgucaccgggggcaucuuccuguuccugauguccggccgcgggaucggcaagaugacgcucgggaugugcugcaucaucaccgcgagcauccugcugugguacgcccagauccagccccacuggaucgccgccuccaucauccucgaguucuuccugaucgugcugcucauccccgagcccgagaagcagcggaccccgcaggacaaccagcugaccuacguggucaucgccauccugaccgugguggcggccacgauggccaacgagaugggcuuccucgagaagaccaagaaggaccuggggcugggcagcaucgccacccagcagcccgagagcaacauccucgacaucgaccugcgccccgccuccgcguggacccuguacgccgucgccacgaccuucaucacccccaugcuccggcacagcaucgagaacuccagcgugaacgugucccugaccgccaucgccaaccaggcgacgguccugaugggccucgggaagggcuggccgcugagcaagauggacaucggggugccccugcucgccaucggcugcuacucccaggugaaccccaucacccugaccgccgcccugcuccugcuggucgcgcacuacgccaucaucgggcccggccuccaggccaaggccacccgcgaggcccagaagcgggcggccgccggcaucaugaagaacccgacgguggacgggaucaccgccaucgaccuggaccccauccccuacgaccccaaguucgagaagcagcugggccaggugaugcuccugguccugugcgugacccaggugcucaugaugcgcaccacgugggcccugugcgaggcgcugacccucgccaccgggccgaucagcacccugugggagggcaaccccgggcgcuucuggaacacgaccaucgccgucuccauggccaacaucuuccggggcagcuaccuggccggcgcggggcuccuguucuccaucaugaagaacaccaccaacacgcgccggggcaccgggaacaucggcgagacccugggcgagaaguggaagucccgccucaacgcccuggggaaguccgaguuccagaucuacaagaaguccggcauccaggagguggaccggacccuggccaaggaggggaucaagcgcggcgagacggaccaccacgccgugucccgggggagcgcgaagcuccgcugguucgucgagcggaacauggugacccccgagggcaagguggucgaccugggcugcgggcgcggcgggugguccuacuacugcggcgggcugaagaacgugcgggaggugaagggccucaccaagggcgggcccggccacgaggagccgauccccaugagcaccuacggguggaaccugguccgccugcaguccggcguggacguguucuucacgccgcccgagaagugcgacacccuccugugcgacaucggggagagcagcccgaaccccaccgucgaggccggccggacccugcgcgugcucaaccugguggagaacuggcugaacaacaacacgcaguucugcaucaagguccugaaccccuacaugccguccgugaucgagaagauggaggcccuccagcggaaguacggcggggcccuggugcgcaacccccugagccggaacuccacccacgagauguacugggucagcaacgccuccggcaacaucgugagcuccgugaacaugaucagccgcaugcucaucaaccgguucaccaugaagcacaagaaggcgaccuacgagcccgacgucgaccugggguccgggaccugcaacaucgggaucgagagcgaggugcccaaccuggacaucaucggcaagcgcaucgagaagaucaagcaggagcacgagacguccuggcacuacgaccaggaccacccguacaagaccugggccuaccacggcagcuacgaggccaagcagaccggguccgccagcuccauggugaacggcgucgugcgccuccugaccaagcccugggacgugauccccauggucacgcagauggccaugaccgacaccacccccuucgggcagcagcggguguucaaggagaagguggacacgcgcacccaggagccgaaggagggcaccaagaagcugaugaagaucaccgcggaguggcucuggaaggagcugggcaagaagaagacgccccggaugugcacccgcgaggaguucacccggaagguccgcagcaacgccgcccugggggccaucuucaccgacgagaacaaguggaaguccgcccgggaggcgguggaggacagccgcuucugggagcucgucgacaaggagcggaaccugcaccuggagggcaagugcgagacgugcguguacaacaugauggggaagcgcgagaagaagcucggcgaguucgggaaggccaagggcucccgggccaucugguacauguggcugggcgcccgcuuccuggaguucgaggcgcucggguuccugaacgaggaccacugguucagccgggagaacagccuguccggcguggagggggagggccucuacaagcugggguacauccugcgcgacgucagcaagaaggagggcggcgccauguacgccgacgacaccgccgggugggacacccggaucacccucgaggaccugaagaacgaggagauggugacgaaccacauggagggcgagcacaagaagcuggccgaggcgaucuucaagcucaccuaccagaacaaggugguccgcgugcagcggcccacgccccgcgggaccgugauggacaucaucucccggcgcgaccagcggggcagcgggcaggucggcacguacggccugaacaccuucaccaacauggaggcccagcugauccgccagauggagggggagggcaucuucaaguccauccagcaccucaccgccacggaggagaucgccgugcagaacuggcugacccgcguggggcgggagcgccugagccggauggccaucuccggcgacgacugcgucgugaagccgcucgacgaccgcuucgcgagcgcccugaccgcccugaacgacaugggcaaggugcggaaggacauccagcagugggagcccucccgcggguggaacgacuggacccagguccccuucugcagccaccacuuccacgagcucaucaugaaggacggccgggugcuggugguccccugccgcaaccaggacgagcugaucgggcgggcccgcaucucccagggcgccggguggagccuccgggagacggcgugccugggcaaguccuacgcccagauguggagccugauguacuuccaccgccgggaccuccgccuggccgccaacgccaucugcuccgcggugccgagccacugggugcccaccucccggaccaccuggagcauccacgccaagcacgaguggaugacgaccgaggacaugcugaccgucuggaaccgcguguggauccaggagaaccccuggauggaggacaagacccccguggagagcugggaggagaucccguaccucggcaagcgggaggaccaguggugcgggucccugaucggccugaccagccgcgccacgugggccaagaacauccagaccgcgaucaaccagguccggucccucaucgggaacgaggaguacaccgacuacaugcccagcaugaagcgcuuccgccgggaggaggaggaggccggcgugcugugguga

SEQ ID NO: 9002 - RNA, 9876 nt, Artificial Sequence
  derived and/or modified CDS sequence (opt1) from DENV-2__KF744401__SS-prME
accgccgggaugaucaucaugcugauccccaccgugauggccuuccaccucaccacccgcaacggggagccccacaugaucgucagccggcaggagaagggcaagagccugcuguucaagaccgagaacggggugaacaugugcacccucauggcgauggaccugggcgagcugugcgaggacaccaucaccuacaagugcccccuccugcgccagaacgagcccgaggacaucgacugcuggugcaacagcaccagcaccugggugaccuacgggaccugcaccaccacgggcgagcaccggcgcgagaagcggagcgucgcccuggugccccacgugggcauggggcucgagacccgcaccgagaccuggaugagcagcgagggcgccuggaagcacgcccagcggaucgagacguggauccugcgccaccccggguucacccugauggccgcgauccucgccuacaccaucggcaccacgcacuuccagcgggcccugaucuucauccugcucaccgccgucgcgcccuccaugaccaugcgcugcaucgggaucagcaaccgggacuucguggagggcguguccggcgggagcugggucgacaucgugcuggagcacggcuccugcgugaccacgauggccaagaacaagcccacccuggacuucgagcucaucaagaccgaggccaaggagcccgccacccugcgcaaguacugcaucgaggccaagcugacgaacaccaccaccgagagccggugcccgacgcagggggagcccucccucaacgaggagcaggacaagcgcuucgucugcaagcacagcaugguggaccggggcuggggcaacgggugcggccuguucgggaagggcgggaucgugaccugcgcgauguucacgugcaagaagaacauggagggcaagaucguccagcccgagaaccuggaguacaccaucgugaucacgccccacuccggcgaggagcacgccguggggaacgacaccggcaagcacgggaaggagaucaagaucaccccgcagagcuccaccaccgaggccgagcucacgggcuacgggaccgucaccauggagugcagcccccgcaccggccuggacuucaacgagauggugcugcuccagauggagaacaaggccuggcuggugcaccggcagugguuccuggaccucccccugcccuggcugccgggcgccgacacgcagggguccaacuggauccagaaggagacccucgucaccuucaagaacccccacgcgaagaagcaggacguggugguccugggcagccaggagggggccaugcacaccgcccugacgggcgccaccgagauccagaugagcuccgggaaccuccuguucaccggccaccugaagugccgccuccggauggacaagcugcagcugaagggcaugagcuacuccaugugcaccgggaaguucaagguggucaaggagaucgccgagacgcagcacggcaccaucguggugcgcguccaguacgagggggacggcagccccugcaagauccccuucgagaucauggaccucgagaagcggcacgugcugggccgccugaucaccgugaacccgaucgucaccgagaaggacucccccgugaacaucgaggcggagccgcccuucggggacagcuacgugaucaucggcgucgagccggggcagcucaagcugaacugguucaagaagggcuccagcaucgggcagauguucgagacgaccaugcgcggcgccaagcggauggccauccugggcgacaccgccugggacuucgggucccucggcgggguguucaccagcaucggcaaggcccugcaccagguguucggggcgaucuacggcgccgccuucuccggcgucagcuggacgaugaagauccugaucggggugaucaucaccuggaucggcaugaacucccgcagcaccucccugagcgugucccucguccugguggggguggucacccuguaccucggcguggugguccaggccgacagcgggugcgugguguccuggaagaacaaggagcugaagugcggcagcggcaucuucaucacggacaacguccacaccuggaccgagcaguacaaguuccagcccgagagccccuccaagcuggcgagcgccauccagaaggcccaccaggaggggaucugcggcauccgguccgugacccgccucgagaaccugauguggaagcagaucacgcccgagcugaaccacauccucagcgagaacgaggugaagcugaccaucaugaccggggacaucaagggcaucaugcacgccgggaagcggucccugcgcccgcagcccaccgagcuccgguacagcuggaagacguggggcaaggccaagauccuguccaccgagagccacaaccagaccuuccugaucgacggccccgagaccgcggagugcccgaacacgaaccgcgccuggaacucccucgaggucgaggacuacggguucggcguguucaccaccaacaucuggcugaagcugcgggagaagcaggacgccuucugcgaccccaagcucaugagcgccgccaucaaggacaaccgcgcggugcacgccgacaugggguacuggaucgaguccgcccugaacgacaccuggaagaucgagaaggccagcuucaucgaggucaagaacugccacuggcccaagucccacacccuguggagcaacggcgugcucgaguccgagaugaucauccccaagaacuucgccggcccggugagccagcacaacuaccggcccggguaccacacgcagaccgcgggccccuggcaccuggggaagcuggagcucgacuucgacuucugcgagggcaccaccgucguggugacggaggacugcgggaaccgcggccccucccugcggaccaccaccgccagcggcaagcugaucacggaguggugcugccgcagcugcacccucccgccccugcgguacaagggggaggacggcugcugguacgggauggagauccgcccccugaaggagaaggaggagaaccucgucuccagccuggugaccgccggccacgggcagaucgacaacuucucccugggcgugcucggcauggcccuguuccuggaggagaugcuccggacccgcgucgggaugaagcacgcgauccugcugguggccgugagcuucgucacgcucaucaccggcaacauguccuuccgggaccuggggcgcgugauggugauggucggcgccaccaugaccgacgacaucgggaugggcgugacguaccuggcccuccuggccgcguucaaggugcgccccaccuucgccgccggccugcuccugcggaagcugaccagcaaggagcucaugaugaccacgaucgggaucguccugcugucccagagcaccaucccggagaccauccucgagcugaccgacgcccuggcccucggcaugauggugcugaagaucgugcgcaagauggagcgguaccagcuggcggucacgaucauggccauccucugcgugcccaacuccgucauccugcagaacgccuggaaggugagcugcaccauccuggccguggucuccgugagcccccuccugcugaccuccagccagcagaaggccgacuggaucccccucgcgcugaccaucaaggggcugaacccgacggccaucuuccucaccacccugucccgcaccagcaagaagcgguccuggccccugaacgaggccaucauggccgugggcauggucagcauccucgcguccagccugcugaagaacgacauccccaugacgggcccccucguggccgggggccugcugaccgugugcuacguccucaccgggcgcagcgccgaccuggagcuggagaaggccgccgacgugcggugggaggaccaggcggagaucuccggcagcuccccgauccucagcgugaucgucuccgaggacgggagcauguccaucaagaacgaggaggaggagcagacccugacgauccugauccgcaccggccuccuggugaucagcggccuguuccccguguccauccccaucaccgccgccgccugguaccucugggaggucaagaagcagcgggccggggugcugugggacgugcccagcccgccgcccgucggcaaggcggagcuggaggacggggccuaccgcaucaagcagaagggcauccucggguacucccagaucggcgccggcguguacaaggaggggaccuuccacaccauguggcacgugacgcggggcgccguccugaugcacaaggggaagcgcaucgagccgagcugggccgacgugaagaaggaccugaucuccuacggcgggggcuggaagcucgagggcgaguggaaggagggggaggaggugcagguccuggcgcuggagcccggcaagaacccccgggccgugcagaccaagcccggccucuucaagaccaacgccggcaccaucggggccgugagccuggacuucuccccgggcacgagcggcucccccaucaucgacaagaaggggaaggucgugggccuguacgggaacggcguggucacccgcaacggcagcuacguguccgccaucgcgcagaccgagaaguccaucgaggacaaccccgagaucgaggacgacaucuuccggaagaagcgccugaccaucauggaccuccaccccggggccggcaagacgaagcgguaccugccggccaucgugcgcgaggccaucaagcgggggcugcgcacccucauccuggcgcccacccgggucguggccgccgagauggaggaggcccugcgcggccuccccauccgcuaccagacccccgccauccgggcggagcacacggggcgcgagaucguggaccugaugugccacgccaccuucaccaugcggcugcucagcccgauccgcguccccaacuacaaccugaucaucauggacgaggcccacuucaccgaccccgccuccaucgccgcgcggggcuacaucagcacgcgcguggagaugggcgaggccgccgggaucuucaugaccgccacgccgcccggcucccgggaccccuucccccagagcaacgcccccaucauggacgaggagcgcgagauccccgagcgguccuggaacagcgggcacgagugggugaccgacuucaagggcaagacggucugguucgugcccuccaucaaggcggggaacgacaucgccgccugccugcgcaagaacggcaagaaggugauccagcucagccggaagaccuucgacuccgaguacgucaagacccgcaccaacgacugggacuucguggugacgaccgacaucagcgagaugggcgccaacuucaaggcggagcgggucaucgacccccgccggugcaugaagcccgugauccugaccgacggggaggagcgcgugauccuggccggcccgaugcccgucacccacuccagcgccgcccagcggcgcgggcggaucggccgcaaccccaagaacgagaacgaccaguacaucuacaugggggagccccucgagaacgacgaggacugcgcccacuggaaggaggcgaagaugcugcuggacaacaucaacacgccggagggcaucauccccuccauguucgagcccgagcgcgagaagguggacgccaucgacggcgaguaccggcuccgcggggaggcccggaagaccuucguggaccugaugcgccggggcgaccugccggucuggcucgccuacaagguggccgcggaggggaucaacuacgccgaccgccgguggugcuucgacggcauccgcaacaaccagauccuggaggagaacgucgagguggagaucuggaccaaggagggggagcggaagaagcugaagccccgcuggcucgacgcccggaucuacagcgacccccuggcccugaaggaguucaaggaguucgccgcgggccgcaagucccucacccugaaccugaucacggagaugggccggcuccccaccuucaugacccagaaggcccgcgacgcccuggacaaccuggccgugcuccacaccgcggaggccgggggccgggccuacaaccacgcccugagcgagcugccggagacgcucgagacccugcugcuccugacccugcucgccaccgucaccggcgggaucuuccuguuccugauguccgggcgcgggaucggcaagaugacccucgggaugugcugcaucaucaccgcgagcauccugcugugguacgcccagauccagccccacuggaucgccgccuccaucauccucgaguucuuccugaucgugcugcucauccccgagcccgagaagcagcggaccccgcaggacaaccagcugaccuacguggucaucgccauccugacggugguggcggccaccauggccaacgagaugggcuuccucgagaagaccaagaaggaccuggggcugggcagcaucgccacccagcagcccgagagcaacauccucgacaucgaccugcgccccgccuccgcguggacgcuguacgccgucgccaccaccuucaucacccccaugcuccggcacagcaucgagaacuccagcgugaacgugucccugacggccaucgccaaccaggcgaccguccugaugggccucgggaagggcuggccgcugagcaagauggacaucggggugccccugcucgccaucggcugcuacucccaggugaaccccaucacccugaccgccgcccugcuccugcuggucgcgcacuacgccaucaucgggcccggccuccaggccaaggccacgcgcgaggcccagaagcgggcggccgccggcaucaugaagaacccgaccguggacgggaucaccgccaucgaccuggaccccauccccuacgaccccaaguucgagaagcagcugggccaggugaugcuccugguccugugcgugacccaggugcucgucaugcgcacgaccugggcccugugcgaggcgcugacccucgccaccgggccgaucagcacgcugugggagggcaaccccgggcgcuucuggaacaccaccaucgccguguccauggccaacaucuuccggggcagcuaccuggccggcgcggggcuccuguucuccaucaugaagaacaccacgaacacccgccggggcaccgggaacaucggcgagacccugggcgagaaguggaagucccgccucaacgcccuggggaaguccgaguuccagaucuacaagaaguccggcauccaggagguggaccggacgcuggccaaggaggggaucaagcgcggcgagaccgaccaccacgccgucucccgggggagcgcgaagcuccgcugguucguggagcggaacauggugacccccgagggcaaggucguggaccugggcugcgggcgcggcgggugguccuacuacugcggcgggcugaagaacgugcgggaggucaagggccucaccaagggcgggcccggccacgaggagccgauccccaugagcacguacggguggaaccuggugcgccugcaguccggcguggacgucuucuucacgccgcccgagaagugcgacacccuccugugcgacaucggggagagcagcccgaaccccaccguggaggccggccggacgcugcgcgugcucaaccuggucgagaacuggcugaacaacaacacccaguucugcaucaaggugcugaaccccuacaugccguccgugaucgagaagauggaggcccuccagcggaaguacggcggggcccugguccgcaacccccugagccggaacuccacccacgagauguacugggugagcaacgccuccggcaacaucgugagcuccgucaacaugaucagccgcaugcucaucaaccgguucaccaugaagcacaagaaggcgaccuacgagcccgacguggaccugggguccggcacgcgcaacaucgggaucgagagcgaggugcccaaccuggacaucaucggcaagcgcaucgagaagaucaagcaggagcacgagaccuccuggcacuacgaccaggaccacccguacaagaccugggccuaccacggcagcuacgaggccaagcagaccggguccgccagcuccauggucaacggcguggugcggcuccugacgaagcccugggacgucauccccauggugacccagauggccaugaccgacaccacgcccuucgggcagcagcgcguguucaaggagaaggucgacacccggacccaggagccgaaggagggcaccaagaagcugaugaagaucacggcggaguggcucuggaaggagcugggcaagaagaagacgccccgcaugugcacccgggaggaguucacccgcaaggugcggagcaacgccgcccugggggccaucuucacggacgagaacaaguggaaguccgcccgcgaggcggucgaggacagccgguucugggagcucguggacaaggagcgcaaccugcaccuggagggcaagugcgagaccugcguguacaacaugauggggaagcgggagaagaagcucggcgaguucgggaaggccaagggcucccgcgccaucugguacauguggcugggcgcccgguuccuggaguucgaggcgcucggguuccugaacgaggaccacugguucagccgcgagaacagccuguccggcgucgagggggagggccucuacaagcugggguacauccugcgggacgugagcaagaaggagggcggcgccauguacgccgacgacaccgccgggugggacacccgcaucacgcucgaggaccugaagaacgaggagauggugaccaaccacauggagggcgagcacaagaagcuggccgaggcgaucuucaagcucaccuaccagaacaaggucgugcgggugcagcgccccacgccccgggggacggucauggacaucaucucccgccgggaccagcgcggcagcggccaggugggcaccuacggccugaacaccuucaccaacauggaggcccagcugauccgccagauggagggggagggcaucuucaaguccauccagcaccucacggccaccgaggagaucgccgugcagaacuggcugacccgggucgggcgcgagcggcugagccgcauggccaucuccggcgacgacugcguggugaagccgcucgacgaccgguucgcgagcgcccugaccgcccugaacgacaugggcaagguccgcaaggacauccagcagugggagcccucccggggguggaacgacuggacccaggugcccuucugcagccaccacuuccacgagcucaucaugaaggacggccgcgugcuggucgugcccugccggaaccaggacgagcugaucgggcgcgcccggaucucccagggcgccggguggagccuccgcgagaccgcgugccugggcaaguccuacgcccagauguggagccugauguacuuccaccggcgcgaccuccggcuggccgccaacgccaucugcuccgcggugccgagccacuggguccccaccucccgcaccacguggagcauccacgccaagcacgaguggaugaccaccgaggacaugcugaccguguggaaccggguguggauccaggagaaccccuggauggaggacaagacccccgucgagagcugggaggagaucccguaccucggcaagcgcgaggaccaguggugcgggucccugaucggccugacgagccgggccaccugggccaagaacauccagaccgcgaucaaccaggugcgcucccucaucgggaacgaggaguacaccgacuacaugcccagcaugaagcgcuuccggcgcgaggaggaggaggccggcgugcugugguga

SEQ ID NO: 9003 - RNA, 9876 nt, Artificial Sequence
  derived and/or modified CDS sequence (opt1) from DENV-2__KF744402__SS-prME
accgcgggcaugaucaucaugcugauccccaccgugauggccuuccaccucaccacccgcaacggggagccccacaugaucgugagccggcaggagaagggcaagagccugcuguucaagaccgaggacggggugaacaugugcacccucauggcgauggaccugggcgagcugugcgaggacaccaucaccuacaagugcccccuccugcgccagaacgagcccgaggacaucgacugcuggugcaacagcaccagcaccugggugaccuacgggaccugcaccaccaccggcgagcaccggcgcgagaagcggagcgucgcccuggugccccacgugggcauggggcucgagacccgcaccgagaccuggauguccagcgagggcgccuggaagcacgcccagcggaucgagaccuggauccugcgccaccccggguucacccugauggccgcgauccucgccuacaccaucggcaccacgaacuuccagcgggcccugaucuucauccugcucaccgccgucgcgcccuccaugaccaugcgcugcaucgggaucagcaaccgggacuucguggagggcguguccggcgggagcugggucgacaucgugcuggagcacggcuccugcgugaccacgauggccaagaacaagcccacccuggacuucgagcucaucaagaccgaggccaagcaccccgccacccugcgcaaguacugcaucgaggccaagcugacgaacaccaccaccgagagccggugcccgacgcagggggagcccucccucaacgaggagcaggacaagcgcuucgucugcaagcacagcaugguggaccggggcuggggcaacgggugcggccuguucgggaagggcgggaucgugaccugcgcgauguucacgugcaagaagaacauggagggcaagaucguccagcccgagaaccuggaguacaccaucgugaucacgccccacuccggcgaggagcacgccguggggaacgacaccggcaagcacgggaaggagaucaaggucaccccgcagagcuccaucaccgaggccgagcucaccggcuacgggacggugaccauggagugcagcccccgcaccggccuggacuucaacgagauggugcugcuccagauggagaacaaggccuggcugguccaccggcagugguuccuggaccucccccugcccuggcugccgggcgccgacacccagggguccaacuggauccagaaggagacgcucgugaccuucaagaacccccacgcgaagaagcaggacguggucgugcugggcagccaggagggggccaugcacaccgcccugaccggcgccacggagauccagaugagcuccgggaaccuccuguucaccggccaccugaagugccgccuccggauggacaagcugcagcugaagggcaugagcuacuccaugugcaccgggaaguucaaggucgugaaggagaucgccgagacccagcacggcacgaucgugguccgcgugcaguacgagggggacggcagccccugcaagauccccuucgagaucauggaccucgagaagcggcacgugcugggccgccugaucaccgucaacccgaucgugaccgagaaggacucccccgugaacaucgaggcggagccgcccuucggggacagcuacgucaucaucggcguggagccggggcagcucaagcugaacugguucaagaagggcuccagcaucgggcagauguucgagaccacgaugcgcggcgccaagcggauggccauccugggcgacaccgccugggacuucgggucccucggcgggguguucaccagcaucggcaaggcccugcaccaggucuucggggcgaucuacggcgccgccuucuccggcgugagcuggaccaugaagauccugaucggggugaucaucacguggaucggcaugaacucccgcagcaccucccugagcgucucccucauccugguggggguggucacccuguaccucggcguggugguccaggccgacagcgggugcgugguguccuggcggaacaaggagcugaagugcggcagcggcaucuucaucaccgacaacguccacacguggaccgagcaguacaaguuccagcccgagagccccuccaagcuggcgagcgccauccagaaggcccaccaggaggggaucugcggcauccgcuccgugacccggcucgagaaccugauguggaagcagaucacccccgagcugaaccacauccucagcgagaacgaggugaagcugacgaucaugaccggggacaucaagggcaucaugcacgccgggaagcgcucccugcggccgcagcccaccgagcuccgcuacagcuggaagaccuggggccgggccaagauccuguccacggagagccacaaccagaccuuccugaucgacggccccgagaccgcggagugcccgaacaccaaccgcgccuggaacucccucgaggucgaggacuacggguucggcguguucacgaccaacaucuggcugaagcugaaggagcggcaggacguguucugcgacagcaagcucauguccgccgccaucaaggacaaccgcgccguccacgcggacaugggguacuggaucgagagcgcccugaacgacaccuggaagaucgagaaggccuccuucaucgaggucaagagcugccacuggcccaagucccacacccuguggagcaacggcgugcucgaguccgagaugaucauccccaagaacuucgccggccccgugagccagcacaacuaccggccgggguaccacacccagacggccggccccuggcaccuggggaagcuggagauggacuucgacuucugcgagggcaccaccgugguggucaccgaggacugcgggaaccgcggccccagccuccggacgaccaccgcguccggcaagcugaucaccgaguggugcugccgcagcugcacgcugcccccgcuccgguaccgcggggaggacggcugcugguacgggauggagauccggccccugaaggagaaggaggagaaccuggugaacucccucgugaccgccggccacgggcagaucgacaacuucagccugggcguccugggcauggcccucuuccuggaggagaugcugcgcacccgcguggggaccaagcacacgauccuccugguggccgucuccuucgugacccugaucaccggcaacaugagcuuccgggaccucgggcgcgugauggucauggugggcgcgaccaugacggacaacaucgggaugggcgugaccuaccuggcccugcucgccgccuucaagguccggcccaccuucgccgcgggccugcugcuccgcaagcugaccuccaaggagcugaugaugacgaccaucgggaucgugcuccugagccaguccaccauccccgagaccauccuggagcucacggacgcccuggcccugggcaugauggugcucaagaucguccggaacauggagaaguaccagcuggccgugaccaucauggccauccugugcgucccgaacgcggugauccuccagaacgccuggaaggugagcugcaccauccuggccgucguguccgugagcccccugcuccugaccuccagccagcagaaggccgacuggaucccccuggcccucacgaucaaggggcugaaccccaccgcgaucuuccugaccacccucucccgcacgagcaagaagcgguccuggccgcugaacgaggccaucauggccgucggcauggugagcauccuggccuccagccuccugaagaacgacauccccaucaccggcccccugguggccggcgggcuccugaccgucugcuacgugcugaccgggcgcagcgccgaccucgagcuggagcgggccgccgacgugcgcugggaggagcaggccgagaucuccgggagcucccccauccugagcaucaucaucuccgaggacgggagcauguccaucaagaacgaggaggaggagcagacgcucaccauccugauccggaccggccugcucgucaucagcggccuguucccgguguccauccccaucaccgcggccgccugguaccugugggaggugaagaagcagcgcgccgggguccucugggacgugcccagcccgccgcccgugggcaaggccgagcuggaggacggggcguaccggaucaagcagaagggcauccugggguacucccagaucggcgccggcgucuacaaggaggggaccuuccacacgauguggcacgugacccgcggcgccgugcucaugcacaaggggaagcggaucgagcccagcugggccgacgucaagaaggaccugaucuccuacggcgggggcuggaagcuggagggcgaguggaaggagggggaggagguccaggugcucgcccuggagcccggcaagaacccccgcgcgguccagaccaagcccgggcuguucaagaccaacgccggcacgaucggggccgugagccucgacuucucccccggcaccagcggcucccccaucaucgacaagaaggggaagguggucggccuguacgggaacggcguggugacccggaacggcagcuacgucuccgccaucgcccagaccggcaagagcaucgaggacaaccccgagaucgaggacgacaucuuccgcaagaagcggcugacgaucauggaccugcaccccggcgcggggaagaccaagcgcuaccuccccgccaucgugcgggaggccaucaagcgcggccugcgcacccugauccucgccccgacccggguggucgcggccgagauggaggaggcccugcgcgggcugcccauccgguaccagacgcccgccauccgcgccgagcacaccggccgggagaucguggaccucaugugccacgcgaccuucaccaugcgccugcugagccccauccgggugccgaacuacaaccucaucaucauggacgaggcccacuucacggaccccgccuccaucgccgcccgcggcuacaucagcacccgggucgagaugggggaggcggccggcaucuucaugaccgccacgccgcccgggucccgcgacccguucccccagagcaacgcccccaucauggacgaggagcgggagauccccgagcgcuccuggaacagcggccacgagugggugacggacuucaaggggaagaccgugugguucgucccguccaucaaggccggcaacgacaucgcggccugccugcggaagaacggcaagaaggugauccagcugagccgcaagaccuucgacuccgaguacgugaagacccggacgaacgacugggacuucgucgugaccaccgacaucagcgagaugggggccaacuucaaggccgagcgcgugaucgacccccggcgcugcaugaagcccgucauccucaccgacggcgaggagcgggugauccuggcggggcccaugccggugacgcacuccagcgccgcccagcgccgcggccggaucgggcgcaaccccaagaacgagaacgaccaguacaucuacaugggcgagccccuggagaacgacgaggaccacgcccacuggaaggaggccaagaugcuccuggacaacaucaacacccccgagggcaucaucccguccauguucgagcccgagcgggagaaggucgacgcgaucgacggggaguaccgccugcggggcgaggcccgcaagaccuucguggaccucaugcggcgcggggaccugcccguguggcuggccuacaaggucgccgccgagggcaucaacuacgcggaccggcgcuggugcuucgacgggauccggaacaaccagauccucgaggagaacguggaggucgagaucuggaccaaggagggcgagcgcaagaagcugaagccgcgguggcuggacgcccgcaucuacagcgacccccucgcccugaaggaguucaaggaguucgccgccggccggaagucccugacgcucaaccugaucaccgagauggggcgccugcccaccuucaugacccagaaggcgcgggacgcccucgacaaccuggccgugcugcacacggccgaggcgggcgggcgcgccuacaaccacgcccucagcgagcugcccgagacccuggagacccuccugcugcucacccugcuggccacggugaccggcggcaucuuccucuuccugauguccgggaagggcaucgggaagaugacccugggcaugugcugcaucaucaccgccagcguccuccugugguacgcgcagauccagccgcacuggaucgccgccuccaucauccuggaguucuuccucaucgugcugcugauccccgagcccgagaagcagcggacgccccaggacaaccagcucacguacguggucaucgccauccugaccgugguggccgcgaccauggccaacgagaugggguuccuggagaagaccaagaaggacuucggccucggcagcaucgccacgcagcagccggagagcaacauccuggacaucgaccugcgccccgccuccgccuggacccucuacgcggucgccaccaccuucaucacgcccaugcugcggcacagcaucgagaacuccagcgugaacgugucccugaccgccaucgccaaccaggccaccguccucauggggcugggcaagggguggccccugagcaagauggacaucggcgugccgcuccuggcgaucgggugcuacucccaggugaaccccaucacccugacggccgcccuccugcugcucgucgcccacuacgcgaucaucggccccggccugcaggccaaggccacccgcgaggcccagaagcgcgccgcggccgggaucaugaagaaccccaccguggacggcaucaccgugaucgaccuggacccgauccccuacgaccccaaguucgagaagcagcucgggcaggucaugcugcuggugcucugcgugacgcagguccugaugaugcggaccaccugggcccugugcgaggcccucacccuggccacgggccccaucagcacccugugggaggggaacccgggccgcuucuggaacaccaccaucgcgguguccauggccaacaucuuccggggcagcuaccucgccggggccggccugcuguucuccaucaugaagaacacgaccaacacccgccgggggaccggcaacaucggcgagacgcucggggagaaguggaagucccgccugaacgcccugggcaaguccgaguuccagaucuacaagaaguccgggauccaggagguggaccggacccucgcgaaggagggcaucaagcgcggggagaccgaccaccacgccgucucccggggcagcgccaagcugcgcugguucguggagcggaacauggugacccccgagggcaaggucguggaccuggggugcggccgcgggggcugguccuacuacugcgggggccucaagaacgugcgggaggucaagggccugacgaagggcgggcccgggcacgaggagcccaucccgaugagcaccuacggcuggaaccuggugcgccuccaguccgggguggacgucuucuucacgccgcccgagaagugcgacacccugcugugcgacaucggcgagagcagccccaacccgacgguggaggccggccggacccuccgcgugcugaaccuggucgagaacuggcucaacaacaacacccaguucugcaucaaggugcugaaccccuacaugcccuccgugaucgagaagauggaggcgcugcagcggaaguacgggggcgcccugguccgcaacccgcucagccggaacuccacccacgagauguacugggugagcaacgccuccgggaacaucgugagcuccgucaacaugaucagccgcaugcugaucaaccgcuucaccaugcggcacaagaaggccacguacgagcccgacguggaccugggcuccgggacccgcaacaucggcaucgagagcgaggugcccaaccucgacaucaucggcaagcggaucgagaagaucaagcaggagcacgagaccuccuggcacuacgaccaggaccaccccuacaagaccugggccuaccacgggagcuacgagacgaagcagaccggcuccgcgagcuccauggucaacgggguggugcgccugcugaccaagccgugggacgucauccccauggugacccagauggccaugacggacaccacccccuucggccagcagcggguguucaaggagaaggucgacacccgcacgcaggagcccaaggagggcaccaagaagcucaugaagaucaccgccgaguggcuguggaaggagcuggggaagaagaagaccccgcggaugugcacgcgcgaggaguucacccggaaggugcgcagcaacgccgcccucggcgcgaucuucaccgacgagaacaaguggaaguccgcccgggaggccgucgaggacagccgcuucugggagcugguggacaaggagcggaaccugcaccucgaggggaagugcgagaccugcguguacaacaugaugggcaagcgcgagaagaagcugggggaguucggcaaggccaagggcucccgggccaucugguacauguggcugggggcgcgcuuccucgaguucgaggcccugggcuuccugaacgaggaccacugguucagccgggagaacagccucuccggggucgagggcgaggggcugcacaagcugggcuacauccuccgcgacgugagcaagaaggagggcggggccauguacgccgacgacacggcgggcugggacacccggaucacccuggaggaccugaagaacgaggagauggugaccaaccacauggagggggagcacaagaagcucgccgaggccaucuucaagcugacguaccagaacaaggucgugcgcgugcagcggcccacgccccgcggcaccgucauggacaucaucucccgccgggaccagcgcgggagcggccaggugggcaccuacgggcugaacacguucaccaacauggaggcccagcucauccggcagauggagggcgaggggguguucaaguccauccagcaccugaccgccaccgaggagaucgcgguccagaacuggcuggcccgcgugggccgggagcgccucagccggauggccaucuccggcgacgacugcguggucaagccccuggacgaccgcuucgccagcgcccugacggcgcucaacgacauggggaaggugcggaaggacauccagcagugggagccgucccgcggcuggaacgacuggacccaggugcccuucugcagccaccacuuccacgagcugaucaugaaggacgggcggguccugguggugcccugccgcaaccaggacgagcucaucggccgggcccgcaucucccagggggccggcuggagccugcgggagaccgccugccugggcaaguccuacgcccagauguggagccucauguacuuccaccgccgggaccugcgccuggcggccaacgccaucugcuccgccguccccagccacugggugccgaccucccggacgaccuggagcauccacgccaagcacgaguggaugaccaccgaggacaugcucaccguguggaaccgcgucuggauccaggagaaccccuggauggaggacaagacgcccguggagagcugggaggagauccccuaccuggggaagcgcgaggaccaguggugcggcucccugaucgggcucaccagccgggcgaccugggccaagaacauccagaccgccaucaaccaggugcgcucccugaucggcaacgaggaguacacggacuacaugccgagcaugaagcgguuccgccgggaggaggaggaggccgggguccugugguga

SEQ ID NO: 9004 - RNA, 9876 nt, Artificial Sequence
  derived and/or modified CDS sequence (opt1) from DENV-2__KF744408__SS-prME
accgcgggcaugaucaucaugcugauccccaccgugauggccuuccaccucaccacccggaacggggagccccacaugaucgucagccggcaggagaagggcaagucccugcuguucaagaccgaggacggggugaacaugugcacccucauggcgauggaccugggcgagcugugcgaggacaccaucaccuacaagugcccccuccugcggcagaacgagcccgaggacaucgacugcuggugcaacagcaccuccaccugggugaccuacgggaccugcaccaccaccggcgagcaccggcgcgagaagcggagcgucgcccuggugccccacgugggcauggggcucgagacccggaccgagaccuggauguccagcgagggcgccuggaagcacgcccagcggaucgagacguggauccugcgccaccccggguucacccugauggccgcgauccucgccuacaccaucggcaccacgaacuuccagcgggcccugaucuucauccugcucaccgccgucgcgcccuccaugaccaugcgcugcaucgggaucagcaaccgggacuucguggagggcguguccggcgggagcugggucgacaucgugcuggagcacggcuccugcgugaccacgauggccaagaacaagcccacccuggacuucgagcucaucaagaccgaggccaagcaccccgccacccugcgcaaguacugcaucgaggccaagcugacgaacaccaccaccgcgagccggugcccgacgcagggggagcccucccucaacgaggagcaggacaagcgcuucgucugcaagcacagcaugguggaccggggcuggggcaacgggugcggccuguucgggaagggcgggaucgugaccugcgccauguucacgugcaagaagaacauggagggcaagaucguccagcccgagaaccuggaguacaccaucgugaucacgccccacuccggcgaggagcacgccguggggaacgacaccggcaagcacgggaaggagaucaagaucaccccgcagagcuccaucaccgaggccgagcucaccggcuacgggacggucaccauggagugcagcccccgcaccggccugggcuucaacgagauggugcugcuccagauggaggacaaggccuggcuggugcaccggcagugguuccuggaccucccccugcccuggcugccgggggcggacacccagggcuccaacuggauccagaaggagacgcucgucaccuucaagaacccccacgccaagaagcaggacguggugguccuggggagccaggagggcgccaugcacaccgcccugaccggggccacggagauccagaugagcuccggcaaccuccuguucaccggccaccugaagugccgccuccggauggacaagcugcagcugaaggggaugagcuacuccaugugcaccggcaaguucaagguggucaaggagaucgcggagacccagcacgggacgaucguggugcgcguccaguacgagggcgacggcagccccugcaagauccccuucgagaucauggaccucgagaagcggcacgugcuggggcgccugaucaccgugaacccgaucgucaccgagaaggacucccccgugaacaucgaggccgagccgcccuucggcgacagcuacgugaucaucggggucgagccgggccagcucaagcuguccugguucaagaaggggagcuccaucggccagauguucgagaccacgaugcgcggcgccaagcggauggccauccugggggacaccgccugggacuucggcagccucgggggcguguucaccuccaucgggaaggcgcugcaccagguguucggcgccaucuacggcgccgccuucagcggggucuccuggaccaugaagauccugaucggcgugaucaucacguggaucgggaugaacagccgcuccaccagccuguccgugagccucguccuggugggcguggucacccuguaccucgggguggugguccaggcggacuccggcugcguggugagcuggcggaacaaggagcugaagugcggcagcgggaucuucaucaccgacaacguccacacguggaccgagcaguacaaguuccagcccgagucccccagcaagcuggccuccgccauccagaaggcccaccaggagggcaucugcgggauccgcagcgugacccggcucgagaaccugauguggaagcagaucacccccgagcugaaccacauccucuccgagaacgaggugaagcugacgaucaugaccggcgacaucaaggggaucaugcaggccggcaagcgcagccugcggccgcagcccaccgagcuccgcuacuccuggaagaccuggggcaaggcgaagauccugagcacggagucccacaaccagaccuuccugaucgacgggcccgagaccgccgagugcccgaacaccaaccgggccuggaacagccucgaggucgaggacuacggcuucgggguguucacgaccaacaucuggcugcgccugcgggagaagcaggacgccuucugcgacuccaagcucaugagcgccgcgaucaaggacaaccgcgccgugcacgccgacaugggcuacuggaucgaguccgcccugaacgacaccuggaagaucgagaaggccagcuucaucgaggucaaguccugccacuggcccaagagccacacccugugguccaacggcgugcucgagagcgagaugaucauccccaagaacuucgcggggcccgugagccagcacaacuaccggccgggcuaccacacccagacggccgggcccuggcaccugggcaagcuggagauggacuucgacuucugcaaggggaccaccgucguggugaccgaggacugcggcaaccgcggccccucccuccggacgaccaccgccagcgggaagcugaucaccgaguggugcugccgcuccugcacgcugcccccgcuccgguaccgcggcgaggacgggugcugguacggcauggagauccggccccugaaggagaaggaggagaaccuggucaacagccucgugaccgccgggcacggccagaucgacaacuucucccugggcgugcuggggauggcccuguuccuggaggagaugcugcgcacccgcgucggcaccaagcacgccauccuccugguggccgugagcuucgucacgcugaucaccgggaacauguccuuccgggaccucggccgcgugauggugauggucggggccaccaugaccgacgacaucggcaugggcgugacguaccuggcccugcucgcggccuucaaggugcggcccaccuucgccgccgggcugcugcuccgcaagcugaccagcaaggagcugaugaugaccacgaucggcaucguccuccugucccagagcaccauccccgagaccauccuggagcucaccgacgcccuggcgcuggggaugauggugcucaagaucgugcggaacauggagaaguaccagcuggccgucacgaucauggccauccugugcgugccgaacgccgucauccuccagaacgccuggaagguguccugcaccauccuggcgguggucagcgugagcccccugcuccugaccagcucccagcagaaggccgacuggaucccccuggcccucaccaucaagggccugaaccccacggccaucuuccugaccacccucagccgcaccuccaagaagcggagcuggccgcugaacgaggcgaucauggccgugggcauggucuccauccuggccagcagccuccugaagaacgacauccccaugacggggccccugguggccggcgggcuccugaccgugugcuacguccugaccggccgcuccgccgaccucgagcuggagaaggcggccgacgugcggugggaggaccaggccgagaucagcggguccagccccauccuguccaucaucaucagcgaggacggcuccaugagcaucaagaacgaggaggaggagcagacccucacgauccugauccgcaccggccugcucgugaucuccgggcuguucccggucagcauccccaucaccgccgccgcgugguaccugugggaggugaagaagcagcgggccggcgugcucugggacguccccagcccgccgcccguggggaaggccgagcuggaggacggcgccuaccgcaucaagcagaaggggauccugggcuacagccagaucggcgccgggguguacaaggagggcaccuuccacaccauguggcacgucacgcgcggggcggugcucaugcacaagggcaagcgcaucgagcccuccugggccgacgugaagaaggaccugaucagcuacgggggcggcuggaagcuggagggggaguggaaggagggcgaggagguccaggugcucgcccuggagcccgggaagaacccccgggccgugcagaccaagcccggccuguucaagaccaacgccgggaccaucggcgcggucucccucgacuucagccccggcacguccgggagccccaucaucgacaagaagggcaaggugguggggcuguacggcaacggcgucgugacccgcaacggguccuacgugagcgccaucgcccagaccgagaaguccaucgaggacaaccccgagaucgaggacgacaucuuccggaagaagcgccugaccaucauggaccugcaccccggcgccgggaagacgaagcgguaccuccccgcgaucguccgcgaggccaucaagcggggccugcgcacccugauccucgccccgacccgcgugguggccgccgagauggaggaggcgcugcgggggcugcccauccgcuaccagacccccgccauccgggccgagcacacgggccgcgagaucgucgaccucaugugccacgccaccuucaccaugcggcugcugucccccauccgcgugccgaacuacaaccucaucaucauggacgaggcccacuucaccgaccccgcgagcaucgccgcccggggcuacaucuccacgcgcguggagaugggggaggccgccggcaucuucaugaccgcgacgccgcccgggagccgggacccguucccccaguccaacgcccccaucauggacgaggagcgcgagauccccgagcggagcuggaacuccggccacgagugggucaccgacuucaaggggaagacggugugguucgugccgagcaucaaggccggcaacgacaucgccgcgugccugcgcaagaacggcaagaaggucauccagcugucccggaagaccuucgacagcgaguacgugaagacccgcaccaacgacugggacuucguggucacgaccgacaucuccgagaugggggccaacuucaaggccgagcgggugaucgacccccgccggugcaugaagcccgugauccucaccgacggcgaggagcgcgucauccuggccgggcccaugccggugacccacagcuccgccgcgcagcggcgcggccgcaucgggcggaaccccaagaacgagaacgaccaguacaucuacaugggcgagccccuggagaacgacgaggacugcgcccacuggaaggaggccaagaugcuccuggacaacaucaacacgcccgagggcaucaucccgagcauguucgagcccgagcgcgagaagguggacgccaucgacggggaguaccggcugcgcggcgaggcccggaagaccuucgucgaccucaugcgccgcggggaccugcccguguggcuggcguacaagguggccgccgagggcaucaacuacgccgaccgccgguggugcuucgacgggauccgcaacaaccagauccucgaggagaacgucgagguggagaucuggaccaaggagggcgagcggaagaagcugaagccgcgcuggcuggacgcccggaucuacuccgacccccucgcgcugaaggaguucaaggaguucgccgccggccgcaagagccugacccucaaccugaucacggagauggggcggcugcccaccuucaugacccagaaggcccgcaacgcgcucgacaaccuggccguccugcacaccgccgaggccggcgggcgggccuacaaccacgcgcucuccgagcugcccgagacgcuggagacccuccugcugcucacccugcuggccaccgugacgggcggcaucuuccucuuccugaugagcgggaagggcaucgggaagaugacccugggcaugugcugcaucaucaccgccuccgugcuccugugguacgcccagauccagccgcacuggaucgccgcgagcaucauccuggaguucuuccucaucguccugcugauccccgagcccgagaagcagcgcacgccccaggacaaccagcucaccuacguggugaucgccauccugacggucguggccgccaccauggccaacgagaugggguuccuggagaagaccaagaaggaccucggccugggcagcaucaccacgcagcagccggaguccaacauccuggacaucgaccuccggcccgcgagcgccuggacccuguacgccguggccaccaccuucaucacgcccaugcugcgccacuccaucgagaacagcuccgucaacgugagccucaccgccaucgcgaaccaggccaccgugcugauggggcugggcaagggguggccccucuccaagauggacaucggcgucccgcugcuggccaucgggugcuacagccaggugaaccccaucacccucacggccgcgcugcugcuccugguggcccacuacgccaucaucggccccggccugcaggccaaggccacccgggaggcgcagaagcgcgccgccgccgggaucaugaagaaccccaccgucgacggcaucaccgugaucgaccucgacccgauccccuacgaccccaaguucgagaagcagcugggccaggugaugcugcucguccugugcgugacccaggugcugaugaugcgcaccaccugggcccucugcgaggcgcugacccuggccacgggccccaucuccacccucugggaggggaacccgggccgguucuggaacaccaccaucgccgucagcauggccaacaucuuccgcggcuccuaccuggccggggcgggccuccucuucagcaucaugaagaacacgaccaacacccggcgcgggaccggcaacaucggcgagacgcugggggagaaguggaagucccggcugaacgcccucggcaagagcgaguuccagaucuacaagaaguccgggauccaggagguggaccgcacccuggccaaggagggcaucaagcgcggggagaccgaccaccacgccgugagccgcggcuccgcgaagcugcggugguucgucgagcgcaacaugaucacccccgagggcaaggugguggaccucgggugcggccgcggcggguggagcuacuacugcggcgggcugaagaacguccgcgaggugaaggggcugacgaagggcgggcccgggcacgaggagcccaucccgauguccaccuacggcuggaaccucgugcggcugcagagcggggucgacguguucuucacgccgcccgagaagugcgacacccugcucugcgacaucggcgagagcucccccaacccgacgguggaggccggccgcacccugcggguccugaaccucguggagaacuggcugaacaacaacacccaguucugcaucaaggugcugaaccccuacaugcccagcgucaucgagaagauggaggcccugcagcgcaaguacgggggcgcccucgugcggaacccgcugucccgcaacagcacccacgagauguacuggguguccaacgccagcgggaacaucgucuccagcgugaacaugaucucccggaugcugaucaaccgcuucaccaugaagcacaagaaggcgacguacgagcccgacguggaccucggcagcgggacccgcaacaucggcaucgaguccgagguccccaaccuggacaucaucggcaagcggaucgagaagaucaagcaggagcacgagaccagcuggcacuacgaccaggaccaccccuacaagaccugggccuaccacggguccuacgagacgaagcagaccggcagcgccuccagcauggugaacggggugguccgccugcucaccaagccgugggacgugauccccauggugacccagauggccaugacggacaccacccccuucggccagcagcgggucuucaaggagaagguggacacccgcacgcaggagcccaaggagggcaccaagaagcugaugaagaucaccgccgaguggcuguggaaggagcucgggaagaagaagaccccgcggaugugcacgcgcgaggaguucacccggaaggugcgcuccaacgcggcccugggcgccaucuucaccgacgagaacaaguggaaguccgcccgggaggccgucgaggacucccgcuucugggagcugguggacaaggagcggaaccuccaccuggaggggaagugcgagaccugcgucuacaacaugaugggcaagcgcgagaagaagcugggggaguucggcaaggcgaagggcagccgggccaucugguacauguggcucggggcccgcuuccuggaguucgaggcccugggcuuccucaacgaggaccacugguucagccgggagaacucccugagcgggguggagggcgaggggcugcacaagcucggcuacauccugcgcgacguguccaagaaggagggcggggcgauguacgccgacgacacggccggcugggacacccggaucacccuggaggaccucaagaacgaggagauggucaccaaccacauggagggggagcacaagaagcuggccgaggccaucuucaagcugacguaccagaacaagguggugcgcguccagcggcccacgccccggggcaccgugauggacaucaucagccggcgcgaccagcgcggguccggccaggugggcaccuacgggcucaacacguucaccaacauggaggcgcagcugauccggcagauggagggcgagggggucuucaagagcauccagcaccugaccgccaccgaggagaucgccgugcagaacuggcucgcccgcgugggccgggagcgccugucccggauggccaucagcggcgacgacugcgucgugaagccccuggacgaccgcuucgcguccgcccucacggcccugaacgacauggggaaggugcggaaggacauccagcagugggagccgagcaagggcuggaacgacuggacccagguccccuucugcucccaccacuuccacgagcugaucaugaaggacgggcgcgugcucgugguccccugccggaaccaggacgagcugaucggccgcgcccggaucagccagggggccggcuggucccugcgcgagaccgcgugccucggcaagagcuacgcccagauguggucccugauguacuuccaccggcgcgaccugcggcucgccgccaacgccaucugcagcgcggugcccucccacugggugccgaccagccgcacgaccuggagcauccacgccaagcacgaguggaugaccaccgaggacaugcugaccgucuggaaccggguguggauccaggagaaccccuggauggaggacaagacgcccguggaguccugggaggagauccccuaccuggggaagcgcgaggaccaguggugcggcagccucaucgggcugaccucccgggccaccugggccaagaacauccagaccgcgaucaaccagguccgcagccugaucggcaacgaggaguacacggacuacaugccguccaugaagcgcuuccggcgcgaggaggaggaggccggggugcucugguga

SEQ ID NO: 9005 - RNA, 9876 nt, Artificial Sequence
  derived and/or modified CDS sequence (opt1) from DENV-2__JX669476__SS-prME
accgccggcgugaucgucaugcugauccccaccgccauggcguuccaccucaccacccgcaacggggagccccacaugaucgugggccggcaggagaagggcaagagccugcuguucaagaccgaggacggcgugaacaugugcacccucauggccaucgaccugggggagcugugcgaggacaccaucaccuacaagugcccccuccugcgccagaacgagcccgaggacaucgacugcuggugcaacagcaccagcaccugggucaccuacgggaccugcaccaccacgggcgagcaccggcgcgagaagcgguccguggcccuggugccccacgucgggaugggccucgagacccgcaccgagaccuggaugagcagcgagggggccuggaagcacgugcagcggaucgagaccuggauccugcgccaccccggcuucaccaucauggccgcgauccuggccuacaccaucgggaccacccacuuccagcgggcccucaucuucauccugcugaccgccguggcgcccagcaugaccaugcgcugcaucggcaucuccaaccgggacuucgucgagggcgugagcgggggcuccuggguggacaucguccucgagcacgggagcugcgugaccaccauggccaagaacaagcccacccuggacuucgagcugaucaagaccgaggccaagcagcccgccacccuccgcaaguacugcaucgaggccaagcugacgaacaccaccaccgagucccggugcccgacgcagggcgagcccagccugaacgaggagcaggacaagcgcuucaucugcaagcacuccaugguggaccggggcugggggaacggcugcgggcuguucggcaagggcgggaucgugaccugcgcgauguucacgugcaagaagaacauggagggcaagaucgugcagagcgagaaccuggaguacaccaucgugaucacgccccacuccggggaggagcacgccgucggcaacgacaccgggaagcacggcaaggagaucaagaucacgccccagagcuccaccaccgaggccgagcugacgggguacggcaccgugaccauggagugcagcccgcgcaccggccucgacuucaacgagauggugcugcugcagauggaggacaaggccuggcucguccaccggcagugguuccuggaccugccccuccccuggcugcccggggccgacacgcagggcuccaacuggauccagaaggagacccuggugaccuucaagaacccgcacgcgaagaagcaggacguggucgugcucgggagccaggagggcgccaugcacaccgcccugacgggggccaccgagauccagaugagcuccggcaaccuccuguucaccggccaccugaagugccgccugcggauggacaagcuccagcugaaggggaugagcuacuccaugugcaccggcaaguucaagaucgucaaggagaucgccgagacgcagcacgggaccaucgugauccgcgugcaguacgagggcgacggcagccccugcaagauccccuucgagaucaccgaccuggagaagcggcacguccucgggcgccugaucaccgugaaccccaucgugacggagaaggacuccccggucaacaucgaggcggagccgcccuucggcgacagcuacaucaucguggggguggagcccggccagcugaagcucaacugguucaagaagggguccagcaucggccagauguucgagaccaccaugcgcggcgccaagcggauggccauccugggggacaccgccugggacuucggcucccucggcggggucuucacgagcaucgggaaggcccuccaccagguguucggggcgaucuacggcgccgccuucuccggggugagcuggaccaugaagauccugaucggcgucaucaucaccuggaucgggaugaacucccgcagcaccucccugagcgugucccuggugcucgucggcguggugacgcuguaccugggggccaugguccaggcggacagcggcugcaucguguccuggaagaacaaggagcucaagugcggcagcgggaucuucaucaccgacaacgugcacaccuggaccgagcaguacaaguuccagccggaguuccccagcaagcuggccuccgccauccagaaggcccacgaggagggcaucugcgggauccggagcgucacgcgccuggagaaccucauguggaagcagaucacccccgagcugaaccacauccuguccgagaacgaggugaagcucaccaucaugaccggcgacaucaaggggaucaugcaggccggcaagcggagccugcgcccccagccgacggagcugaaguacuccuggaagaccuggggcaaggcgaagaugcucagcaccgagucccacaaccagaccuuccugaucgacgggcccgagacggccgagugccccaacaccaaccgggccuggaacagccuggagguggaggacuacggcuucggggucuucaccaccaacaucuggcucaagcugcgcgagaagcaggacguguucugcgacuccaagcugaugagcgccgccaucaaggacaaccgggcggugcacgccgacaugggcuacuggaucgaguccgcccucaacgacaccuggaaggucgagaaggccagcuucaucgaggugaaguccugccacuggcccaagagccacacgcugugguccaacggcgugcuggagagcgagaugaucauccccaagaacuucgccgggcccgucucccagcacaacuaccgccccggcuaccacacccagaccgcggggccguggcaccucggcaagcuggagauggacuucgacuucugcgaggggaccacggugguggucaccgaggacugcggcaaccggggccccagccugcgcaccaccacggccagcgggaagcucaucaccgaguggugcugccgguccugcacccugccgccccugcgcuaccggggcgaggacgggugcugguacggcauggagauccgcccgcucaaggagaaggaggagaaccuggugaacagccuggugaccgccgggcacggccagaucgacaacuucucccucggcguccuggggauggcccuguuccucgaggagaugcugcggacgcgcgugggcaccaagcacgcgauccugcucguggcccugagcuucgucacccugaucaccgggaacauguccuuccgggaccucggccgcgugauggugauggucggggccacgaugaccgacgacaucggcaugggcgugaccuaccuggcccugcucgccgcguucaaggugcgccccaccuucgccgccgggcugcugcuccggaagcugacgagcaaggagcugaugauggccaccaucggcaucgcccuccugucccagagcacccugcccgagaccauccucgagcugacggacgcgcuggcccucgggaugauggcccugaagaucguccgcaacauggagaaguaccagcuggccgugaccaucauggccaucuccugcgugcccaacgcggucauccuccagaacgccuggaaggugagcugcaccauccuggccgccguguccgucagcccgcugcuccugaccuccagccagcagaagacggacuggaucccccuggcgcucaccaucaagggccugaaccccaccgccaucuuccugaccacgcucucccggaccagcaagaagcgcuccuggccccugaacgaggccaucauggccgugggcauggucagcauccuggccuccagccuccugaagaacgacaucccgaugaccgggccccugguggcgggcgggcuccugaccgugugcuacguccugacgggccggagcgccgaccucgagcuggagcgcgccgccgacgugaagugggaggaccaggccgagaucuccgggagcucccccauccugagcaucaccaucuccgaggacggcagcauguccaucaagaacgaggaggaggagcagacccucaccauccugauccggaccggccugcucgugaucagcggggucuuccccguguccaucccgaucacggcggccgccugguaccugugggaggugaagaagcagcgcgccggcguccugugggacgugcccuccccgccgcccguggagaaggccgagcucgaggacggggcguaccggaucaagcagcgcggcauccugggguacucccagaucggcgccggcgucuacaaggaggggaccuuccacaccauguggcacgugacccggggcgccgugcugaugcaccgcgggaagcggaucgagcccagcugggccgacgucaagaaggaccucaucuccuacggcgggggcuggaagcuggagggcgaguggaaggagggggaggagguccaggugcuggcccucgagcccggcaagaacccgcgcgcgguccagacgaagcccgggaucuucaagaccaacaccggcaccaucggggccgugagccuggacuucucccccggcacgagcggcucccccaucguggaccggaaggggaaggucgugggccuguacgggaacggcguggucacccgcagcggcgccuacguguccgccaucgcgcagaccgagaaguccaucgaggacaacccggagaucgaggacgacaucuuccggaagaagcgccucaccaucauggaccugcaccccggggccggcaagacgaagcgguaccugcccgccaucgugcgcgaggccaucaagcgggggcugcgcacccucauccuggcccccacccgcgucguggcggccgagauggaggaggcccugcggggccucccgauccgcuaccagacccccgccauccgggccgagcacacggggcgcgagaucguggaccugaugugccacgcgaccuucaccaugcggcugcucagccccguccgcgugcccaacuacaaccugaucaucauggacgaggcccacuucaccgacccggccuccaucgccgcccggggcuacaucagcacgcgcguggagaugggcgaggcggccgggaucuucaugaccgccacgccgcccggcucccgggaccccuucccgcagagcaacgcccccaucauggacgaggagcgcgagauccccgagcgguccuggaacagcgggcacgagugggucaccgacuucaagggcaagacggugugguucgugcccuccaucaaggcggggaacgacaucgccgccugccugcgcaagaacggcaagaaggucauccagcucagccggaagaccuucgacuccgaguacgugaagacccgcgccaacgacugggacuucguggucaccacggacaucagcgagaugggcgccaacuucaaggcggagcgggugaucgacccgcgccggugcaugaagcccgugauccugaccgacggggaggagcgcgucauccuggccggccccaugcccgugacccacuccagcgccgcccagcggcgcgggcgcaucggccggaacccgaagaacgagaacgaccaguacaucuacaugggggagccccucgagaacgacgaggacugcgcccacuggaaggaggcgaagaugcugcuggacaacaucaacacccccgagggcaucauccccuccauguucgagccggagcgcgagaagguggacgccaucgacggcgaguaccggcuccgcggggaggcccggaagacguucgucgaccugaugcgccggggcgaccugcccguguggcucgccuacaagguggccgcggaggggaucaacuacgccgaccgcaaguggugcuucgacggcaucaagaacaaccagauccuggaggagaacgucgagguggagaucuggaccaaggagggggagcggaagaagcugaagccccgcuggcucgacgcccggaucuacagcgacccgcuggcccugaaggaguucaaggaguucgcggccggccgcaagucccucacccugaaccugaucaccgagaugggccggcuccccacguucaugacccagaaggcccgcaacgcccuggacaaccuggccgugcuccacaccgcggaggucgggggccgggccuacacccacgcccugagcgagcugcccgagacgcucgagacccugcugcuccugacccugcucgccgccgugaccgggggcaucuuccuguuccugauguccggcaaggggaucggcaagaugacccucgggaugugcugcaucaucacggcgagcauccugcugugguacgcccagauccagccccacuggaucgccgccuccaucauccucgaguucuuccugaucguccugcucaucccggagcccgagaagcagcgcacgccccaggacaaccagcugaccuacguggugaucgccauccugaccgucguggcggccacgauggccaacgagaugggcuuccucgagaagaccaagaaggaccugggguucggcagcaucaccacccaggagagcgaguccaacauccuggacaucgaccuccggcccgccagcgccuggacgcuguacgcgguggccaccaccuucgucaccccgaugcugcgccacuccaucgagaacagcuccgugaacgugagccucacggccaucgccaaccaggcgaccguccugaugggccuggggaagggcuggccccucuccaagauggacaucggggugccccugcuggccaucggcugcuacagccaggugaaccccaucacccucaccgccgcccugcugcuccuggucgcccacuacgcgaucaucgggccgggccugcaggccaaggccacgcgggaggcccagaagcgcgccgcggccggcaucaugaagaaccccaccguggacgggaucaccgugaucgaccucgagcccauccccuacgacccgaaguucgagaagcagcugggccaggucaugcugcucauccugugcgugacccaggugcugaugaugcggacgaccugggcccucugcgaggcccugacccuggccaccgggcccaucuccacgcucugggagggcaaccccgggcgcuucuggaacaccaccaucgcggucagcauggccaacaucuuccgcggcuccuaccuggccggcgccgggcuccuguucagcaucaugaagaacaccacgaacacccggcgcggcaccgggaacgugggcgagacccugggcgagaaguggaagucccggcugaacgcgcucggcaagagcgaguuccagaucuacaagaaguccggcauccaggagguggaccgcacgcuggccaaggaggggaucaagcggggcgagaccgaccaccacgccgucagccgcggguccgccaagcugcggugguucguggagcgcaacauggugacccccgagggcaaggucguggaccucggcugcgggcggggcggguggagcuacuacugcggcgggcugaagaacgugcgcgaggucaagggccugaccaagggcgggccgggccacgaggagcccauccccauguccacguacggguggaaccucgugcggcugcagagcggcguggacgucuucuucacgccgcccgagaagugcgacacccugcucugcgacaucggggagagcucccccaaccccaccaucgaggccggccgcacccugcgggugcugaaccucguggagaacuggcugaacaacaacacgcaguucugcaucaagguccugaaccccuacaugcccagcgugaucgagaagauggagacccuccagcgcaaguacggcggggcgcuggugcggaacccccugucccgcaacagcacccacgagauguacugggucuccaacgccaccggcaacaucgugagcuccgugaacaugaucagccggaugcugaucaaccgcuucacgaugaagcacaagaaggccaccuacgagcccgacgucgaccucggguccggcacccggaacaucgggaucgagagcgagaucccgaaccuggacaucaucggcaagcgcaucgagaagaucaagcaggagcacgagaucuccuggcacuacgaccaggaccaccccuacaagaccugggccuaccacggcagcuacgagacgaagcagaccggguccgccagcuccauggugaacggcgugguccgccugcucaccaagcccugggacguggugcccauggucacccagauggcgaugacggacaccaccccguucgggcagcagcggguguucaaggagaagguggacacccgcacgcaggagcccaaggagggcaccaagaagcugaugaagaucaccgccgaguggcuguggaaggagcucggcaaggagaagacgccccggaugugcacgcgcgaggaguucacccggaagguccgcagcaacgccgcccugggggccguguucaccgacgagaacaaguggaaguccgcgcgggaggccguggaggacgaccgcuucugggagcuggucgaccgggagcgcaaccuccaccuggagggcaagugcgagaccugcguguacaacaugauggggaagcgggagaagaagcugggcgaguucgggaaggccaagggcagccgcgccaucugguacauguggcucggcgcgcgguuccuggaguucgaggcccugggguuccucaacgaggaccacugguucucccgcggcaacagccugagcggggucgagggcgaggggcugcaccggcucggcuacauccugcgcgaggugggcaagaaggagggcggggccauguacgccgacgacacggccgggugggacacccggaucacccuggaggaccucaagaacgaggagauggugaccaaccacaugaagggcgagcacaagaagcuggcggaggccaucuucaagcugacguaccagaacaaggucgugcgcgugcagcggcccaccccgcgcgggaccgucauggacaucaucucccggaaggaccagcgcggcagcggccagguggggaccuacggccucaacacguucaccaacauggaggcccagcugauccgccagauggagggggagggcaucuucaaguccauccagcaccugaccgccaccgaggagaucgccgugcagaacuggcucgcgcgggucggccgcgagcggcugagccgcauggccaucuccggggacgacugcguggugaagcccaucgacgaccgguucgccagcgcccugacggcccucaacgacaugggcaagguccgcaaggacauccagcagugggagcccucccggggguggaacgacuggacccaggugcccuucugcagccaccacuuccacgagcuggugaugaaggacggccgcguccugguggugccgugccggaaccaggacgagcucaucgggcgcgcgcggaucucccagggcgccggcuggagccugaaggagaccgccugccuggggaaguccuacgcccagauguggacccucauguacuuccaccgccgggaccugcgccuggccgcgaacgccaucugcagcgccguccccucccacugggugcccaccagccggacgaccugguccauccacgccaagcacgaguggaugaccaccgaggacaugcucacgguguggaaccgcgucuggauccaggagaaccccuggauggaggacaagaccccgguggagagcugggaggaggugcccuaccugggcaagcgggaggaccaguggugcgggucccugaucggccucaccagccgcgcgaccugggccaagaacauccagacggccaucaaccagguccggagccugaucgggaacgagggcuacaccgacuacaugcccuccaugaagcgcuuccgccgggaggaggaggaggccggcgugcugugguga

SEQ ID NO: 9006 - RNA, 9876 nt, Artificial Sequence
  derived and/or modified CDS sequence (opt1) from DENV-2__JX475906__SS-prME
accgugggcaugaucaucaugcugauccccaccgccauggccuuccaccucaccacccggaacggggagccccacaugaucgugagccggcaggagaagggcaagagccugcuguucaagaccgaggacggggugaacaugugcacccucauggcgauggaccugggcgagcugugcgaggacaccgugaccuacaacugcccccuccugcggcagaacgagcccgaggacaucgacugcuggugcaacagcaccuccaccugggucaccuacgggaccugcaccgccaccggcgagcaccggcgcgagaagcggagcguggcccuggugccccacgucggcauggggcucgagacccgcaccgagaccuggauguccagcgagggcgccuggaagcacgcccagcggaucgagaccuggauccugcgccaccccggguucacgaucauggcggccauccuggccuacaccaucggcaccaccuacuuccagcgggugcucaucuucauccugcugacggccguggcgcccuccaugaccaugcgcugcaucgggaucagcaaccgggacuucgucgagggcguguccggcgggagcuggguggacaucguccucgagcacggcuccugcgugaccaccauggccaagaacaagcccacgcuggacuucgagcugaucaagaccgaggccaagcagcccgccacccuccgcaaguacugcaucgaggccaagcugaccaacacgaccaccgcgagccggugcccgacccagggggagcccucccugaacgaggagcaggacaagcgcuucgugugcaagcacagcauggucgaccggggcuggggcaacgggugcggccucuucgggaagggcgggaucgugacgugcgccauguucacgugcaagaagaacauggagggcaagaucgugcagcccgagaaccuggaguacaccaucgucaucacgccccacuccggcgaggagaacgccguggggaacgacacgggcaagcacgggaaggaggugaaggucaccccgcagagcuccaucaccgaggccgagcugaccggcuacgggaccgugacgauggagugcagcccccgcaccggccucgacuucaacgagauggugcugcugcagauggagaacaaggccuggcucguccaccggcagugguuccuggaccugccccuccccuggcugccgggcgcggacacccagggguccaacuggauccagaaggagacccuggugacguucaagaacccccacgccaagaagcaggacgucguggugcucggcagccaggagggggccaugcacaccgcccugaccggcgccaccgagauccagaugagcuccgggaaccuccuguucacgggccaccugaagugccgccugcggauggacaagcuccagcugaagggcaugagcuacuccaugugcaccgggaaguucaaggucgugaaggagaucgcggagacccagcacggcaccaucgugauccgcguccaguacgagggggacggcagccccugcaagauccccuucgagaucauggaccuggagaagcggcacgugcucggccgccugaucacggugaacccgaucgucaccgagaaggacucccccgugaacaucgaggccgagccgcccuucggggacagcuacaucaucaucggcguggagccggggcagcugaagcucuccugguucaagaagggcagcuccaucgggcagauguucgagaccaccaugcgcggcgccaagcggauggccauccugggcgacacggccugggacuucgggagccugggcggggucuucaccuccaucggcaaggcgcuccaccagguguucggggccaucuacggcgccgccuucagcggcguguccuggaccaugaagauccugaucggggucgugaucaccuggaucggcaugaacagccgcuccacgagccuguccgugagccugguccucguggggguggucacccuguaccugggcgugauggugcaggcggacuccgggugcgucgugagcuggaagaacaaggagcucaagugcggcagcggcaucuucaucaccgacaacgugcacaccuggacggagcaguacaaguuccagcccgagucccccagcaagcuggccuccgccauccagaaggcccacgaggaggggaucugcggcauccggagcgucacccgccuggagaaccucauguggaagcagaucacccccgagcugaaccacauccuguccgagaacgaggugaagcucaccaucaugacgggggacaucaagggcaucaugcaggccgggaagcggagccugcgcccgcagcccaccgagcugaaguacuccuggaagaccuggggcaaggcgaagaugcucagcaccgagccccacaaccagacguuccugaucgacggcccggagaccgccgagugccccaacaccaaccgggccuggaacucccuggagguggaggacuacggguucggcgucuucaccacgaacaucuggcucaagcugaaggagcgccaggacguguucugcgacagcaagcugauguccgccgccaucaaggacaaccgggcggugcacgccgacaugggguacuggaucgagagcgcccucaacgacaccuggaagaucgagaaggccuccuucaucgaggucaagagcugccacuggcccaagucccacacccuguggagcaacggcgugcuggaguccgagaugaucauccccaagaacuucgccggcccggugagccagcacaacuaccgccccggguaccacacccagaccgcgggccccuggcaccucgggaagcuggagauggacuucgacuucugcgagggcacgaccgucguggugaccgaggacugcgggaaccggggccccagccugcgcaccacgaccgccuccggcaagcucaucaccgaguggugcugccggagcugcacccugccgccccugcgcuaccgcggggaggacggcugcugguacgggauggagauccgcccccucaaggagaaggaggagaaccuggucaacucccuggugacggccggccacgggcagaucgacaacuucagccucggcgugcugggcauggcccuguuccucgaggagaugcugcggacccgcgucgggaccaagcacgcgcugcuccugguggccguguccuucaugacccugaucacgggcaacaugagcuuccgggaccucgggcgcgucauggugauggugggcgccgccaugaccgacgacaucgggaugggcgucaccuaccuggcccugcucgcggccuucaaggugcgccccaccuucgccgccggccugcugcuccggaagcugacguccaaggagcugaugaugaccaccaucgggaucgugcuccugagccaguccaccaucccggagacgauccuggagcucaccgacgcccuggcgcugggcaugaugauccucaagaucguccgcaacauggagaaguaccagcuggccgugaccaucauggccauccugugcguccccaacgccgugauccuccagaacgccuggaaggugagcugcaccauccuggcggucguguccgugagcccccugcuccugacguccagccggcagaaggccgacuggaucccccuggcccucaccaucaaggggcugaacccgaccgccaucuuccugaccacgcucucccgcaccaacaagaagcggagcuggccccugaacgaggcgaucauggccgucggcaugguguccauccuggccagcucccuccugaagaacgacauccccaugaccggcccccugguggccgggggccuccugaccgucugcuacgugcugacggggcgcagcgccgaccucgagcuggagcgggcggccgacgugcgcugggaggaccaggccgagaucagcggcuccagcccgauccuguccaucaccaucagcgaggacggguccaugagcaucaagaacgaggaggaggagcagacccucaccauccugauccggacgggccugcucgucaucuccggccuguuccccgugagcauccccaucaccgccgccgcgugguaccugugggaggugaagaagcagcgcgccgggguccucugggacgugcccuccccgccgcccgugggcaaggccgagcuggaggacggggccuaccggaucaagcagaagggcauccugggguacagccagaucggcgccggcgucuacaaggaggggaccuuccacaccauguggcacgugacccgcggcgcggugcucaugcacaaggggaagcggaucgagccguccugggccgacguccgcaaggaccugaucagcuacggcgggggcuggaagcuggagggcgaguggaaggagggggaggagguccaggugcucgcccuggagcccggcaagaacccccgggccguccagacgaagcccgggcuguucaagaccaacaccggcaccaucggggccgugucccucgacuucagcccgggcacguccggcagccccaucguggacaagaaggggaaggucgugggccuguacgggaacggcguggucacccgcuccggcaccuacgugagcgcgaucgcccaggccgagaaguccaucgaggacaaccccgagaucgaggacgacaucuuccggaagcgccggcugaccaucauggaccugcaccccggggccggcaagacgaagcgcuaccucccggcgaucgugcgggaggccaucaagcgcgggcugcgcacccugauccucgcccccacccgggucguggccgccgagauggaggaggcgcugcgcggccugcccauccgguaccagacccccgccauccgcgccgagcacacggggcgggagaucguggaccucaugugccacgccaccuucaccaugcgccugcugagcccgguccgggugcccaacuacaaccucaucaucauggacgaggcccacuucaccgaccccgcgagcaucgccgcccgcggcuacaucuccacgcggguggagaugggcgaggccgccgggaucuucaugaccgcgacgccgcccggcagccgcgaccccuucccccaguccaacgcccccaucauggacgaggagcgggagauccccgagcgcagcuggaacuccgggcacgagugggucaccgacuucaagggcaagacggugugguucgugcccagcaucaaggccgggaacgacaucgccgcgugccugcggaagaacggcaagaaggucauccagcugucccgcaagaccuucgacagcgaguacaucaagacccggaccaacgacugggacuucguggugacgaccgacaucuccgagaugggcgccaacuucaaggccgagcgcgucaucgacccccggcgcugcaugaagcccgugauccucaccgacggggaggagcgggugauccuggccggcccgaugcccgucacccacagcuccgccgcgcagcgccgcgggcggaucggccgcaaccccaagaacgagaacgaccaguacaucuacaugggggagccccuggagaacgacgaggacugcgcccacuggaaggaggccaagaugcuccuggacaacaucaacacgccggagggcaucauccccagcauguucgagcccgagcgggagaagguggacgccaucgacggcgaguaccgccugcgcggggaggcccgcaagaccuucguggaccucaugcggcgcggcgaccugccggucuggcuggcguaccggguggccgccgaggggaucaacuacgccgaccgccgguggugcuucgacggcgucaagaacaaccagauccucgaggagaacguggagguggagaucuggaccaaggagggggagcgcaagaagcugaagccccgguggcuggacgcccgcaucuacuccgacccccucgcgcugaaggaguucaaggaguucgccgccggccgcaagagccugacccucaaccugaucacggagaugggccgccugcccaccuucaugacccagaaggcccggaacgcgcucgacaaccuggccguccugcacaccgccgaggccgggggccgcgccuacaaccacgcgcucuccgagcugccggagacgcuggagacccuccugcugcucacccugcuggccaccgugaccgggggcaucuuccucuuccugaugagcggcaaggggaucggcaagaugacccuggggaugugcugcaucaucaccgccuccauccuccugugguacgcccagauccagccccacuggaucgccgcgagcaucauccuggaguucuuccucaucgugcugcugauccccgagcccgagaagcagcggaccccgcaggacaaccagcucaccuacgucgugaucgccauccugacgguggucgccgccaccauggccaacgagaugggcuuccuggagaagaccaagaaggacuucgggcucggcuccaucgcgacccagcagcccgagagcaacauccuggacaucgaccugcgccccgccagcgccuggacgcucuacgccguggccaccaccuucaucacccccaugcugcggcacuccaucgagaacagcuccgugaacgucagccugacggcgaucgccaaccaggccaccgugcucaugggccuggggaagggcuggccgcuguccaagauggacaucggggugccccuccuggccaucggcugcuacagccaggucaaccccaucacccugaccgcggcccuccugcugcucguggcccacuacgccaucaucgggcccggccugcaggccaaggcgacgcgcgaggcccagaagcgcgccgccgccggcaucaugaagaacccgaccguggacgggaucaccgucaucgaccuggaccccauccccuacgaccccaaguucgagaagcagcucggccaggugaugcugcuggugcucugcgucacccaggugcugaugaugcggacgaccugggcgcugugcgaggcccucacccuggccaccgggccgaucuccacgcugugggagggcaaccccgggcgcuucuggaacaccaccaucgccgugagcauggccaacaucuuccggggcuccuaccucgcgggcgccgggcugcuguucagcaucaugaagaacaccacgaacacccgccggggcaccgggaacaccggcgagacgcucggcgagaaguggaagaaccgccugaacgcccuggggaaguccgaguuccagaucuacaagaaguccggcauccaggaggucgaccggacccucgccaaggaggggaucaagcgcggcgagaccgaccaccacgcggugucccgggggagcgccaagcugcgcugguucguggagcggaaccuggucacccccgagggcaaggugguggaccucggcugcgggcgcggcgggugguccuacuacugcggcgggcugaagaacguccgggaggugaagggccugacgaagggcgggcccggccacgaggagccgauccccaugagcaccuacggguggaaccucgugcgccugcaguccggcgucgacguguucuucacgccgcccgagaagugcgacacccugcucugcgacaucggggagagcuccccgaaccccacgguggaggccggccggacccugcgcguccugaaccucguggagaacuggcugaacaacaacacccaguucugcaucaaggugcugaaccccuacaugccgagcgucaucgagaagauggaggcccugcagcggaaguacggcggggcccucgugcgcaacccccugagccggaacuccacccacgagauguacugggugagcaacgcguccggcaacaucgucagcuccgugaacaugaucagccgcaugcugaucaaccgcuucaccaugcggcacaagaaggccacguacgagcccgacguggaccucggguccggcacccgcaacaucgggaucgagagcgagacccccaaccuggacaucaucggcaagcggaucgagaagaucaagcaggagcacgagaccuccuggcacuacgaccaggaccacccguacaagacgugggccuaccacggcagcuacgagaccaagcagaccggguccgccagcuccauggucaacggcguggugcgccugcucaccaagcccugggacgucauccccauggugacgcagauggccaugaccgacaccacccccuucgggcagcagcggguguucaaggagaaggucgacacgcgcacccaggagccgaaggagggcaccaagaagcugaugaagaucaccgcggaguggcuguggaaggagcucggcaagaagaagacgccccggaugugcacccgcgaggaguucacccggaaggugcgcagcaacgccgcccugggggccaucuucaccgacgagaacaaguggaaguccgcccgggaggcggucgaggacagccgcuucugggagcugguggacaaggagcggaaccuccaccuggagggcaagugcgagacgugcguguacaacaugauggggaagcgcgagaagaagcugggcgaguucgggaaggccaagggcucccgggccaucugguacauguggcucggcgcccgcuuccuggaguucgaggcgcugggguuccucaacgaggaccacugguucagccgggagaacucccugagcggcgucgagggggagggccugcacaagcucggguacauccugcgcgacgugagcaagaaggagggcggcgccauguacgccgacgacaccgccgggugggacacccggaucacccuggaggaccucaagaacgaggagauggugacgaaccacauggagggcgagcacaagaagcuggccgaggcgaucuucaagcugaccuaccagaacaaggucgugcgcgugcagcggcccacgccccgggggaccgucauggacaucaucucccgccgggaccagcgcggcagcggccagguggggacguacggccucaacaccuucaccaacaugggggcccagcugauccggcagauggagggcgaggggguguucaaguccauccagcaccugaccgccacggaggagaucgccguccaggacuggcucgcccgcgugggccgggagcgccugagccggauggcgaucuccggcgacgacugcguggucaagccgcuggacgaccgcuucgccagcgcccucaccgcccugaacgacauggggaaggugcggaaggacauccagcagugggagcccucccgcggcuggaacgacuggacccaggugcccuucugcagccaccacuuccacgagcugaucaugaaggacgggcggguccucguggugcccugccgcaaccaggacgagcugaucggccgggcccgcaucucccagggggcgggcuggagccugcgggagaccgccugccucggcaaguccuacgcccagauguggagccugauguacuuccaccgccgggaccugcgccucgccgccaacgcgaucugcuccgccgucccgagccacugggugcccacgucccggaccaccuggagcauccacgccaagcacgaguggaugaccaccgaggacaugcugacgguguggaaccgcgucuggauccaggagaaccccuggauggaggacaagacccccguggaguccugggaggagaucccguaccuggggaagcgcgaggaccaguggugcggcagccucaucgggcugaccagccgggccaccugggcgaagaacauccagacggccaucaaccaggugcgcucccugaucggcaacgaggaguacaccgacuacaugcccagcaugaagcgguuccgccgggaggaggaggaggccgggguccucugguga

SEQ ID NO: 9007 - RNA, 9876 nt, Artificial Sequence
  derived and/or modified CDS sequence (opt1) from DENV-2__JX669477__SS-prME
accgccggcgugaucgucaugcugauccccaccgccauggcguuccaccucaccacccggaacggggagccccacaugaucgugggccggcaggagaaggggaagucccugcuguucaagaccgaggacggcgugaacaugugcacccucauggccaucgaccugggggagcugugcgaggacaccaucaccuacaagugcccccuccugcgccagaacgagcccgaggacaucgacugcuggugcaacagcaccagcaccugggucaccuacgggaccugcaccaccacgggcgagcaccggcgcgagaagcgguccguggcccuggugccccacgucgggaugggccucgagacccgcaccgagaccuggaugagcuccgagggggccuggaagcacgugcagcggaucgagaccuggauccugcgccacccgggcuucaccaucauggccgcgauccuggccuacaccaucgggaccacgcacuuccagcgggcccucaucuucauccugcugaccgccguggcgcccagcaugaccaugcgcugcaucggcaucuccaaccgggacuucgucgagggcgugagcgggggcuccuggguggacaucguccucgagcacgggagcugcgugaccacgauggccaagaacaagcccacccuggacuucgagcugaucaagaccgaggccaagcagcccgccacccuccgcaaguacugcaucgaggccaagcugacgaacaccaccaccgagucccggugcccgacgcagggcgagcccagccugaacgaggagcaggacaagcgcuucaucugcaagcacuccaugguggaccggggcugggggaacggcugcgggcuguucggcaagggcgggaucgugaccugcgcgauguucacgugcaagaagaacauggagggcaagaucgugcagcccgagaaccuggaguacaccaucgugaucacgccccacagcggggaggagcacgccgucggcaacgacaccgggaagcacggcaaggagaucaagaucaccccgcaguccagcaccaccgaggccgagcugacgggguacggcaccgugaccauggagugcagcccccggaccggccucgacuucaacgagauggugcugcugcagauggaggacaaggccuggcucguccaccggcagugguuccuggaccugccccuccccuggcugccgggggccgacacgcagggcagcaacuggauccagaaggagacccuggugaccuucaagaacccccacgcgaagaagcaggacguggucgugcucgggucccaggagggcgccaugcacaccgcccugacgggggccaccgagauccagaugagcagcggcaaccuccuguucaccggccaccugaagugccgccugcggauggacaagcuccagcugaaggggauguccuacagcaugugcaccggcaaguucaagaucgucaaggagaucgccgagacgcagcacgggaccaucgugauccgcgugcaguacgagggcgacggcucccccugcaagauccccuucgagaucaccgaccuggagaagcggcacguccucgggcgccugaucaccgugaacccgaucgugacggagaaggacagccccgucaacaucgaggcggagccgcccuucggcgacuccuacaucaucguggggguggagccgggccagcugaagcucaacugguucaagaaggggagcuccaucggccagauguucgagaccaccaugcgcggcgccaagcggauggccauccugggggacaccgccugggacuucggcagccucggcggggucuucacguccaucgggaaggcccuccaccagguguucggggcgaucuacggcgccgccuucagcgggguguccuggaccaugaagauccugaucggcgucaucaucaccuggaucgggaugaacagccgcuccaccagccuguccgugagccuggugcucgucggcguggugacgcuguaccugggggccaugguccaggcggacuccggcugcaucgugagcuggaagaacaaggagcucaagugcggcuccgggaucuucaucaccgacaacgugcacaccuggaccgagcaguacaaguuccagcccgagagccccagcaagcuggccuccgccauccagaaggcccacgaggagggcaucugcgggauccggagcgucacgcgccuggagaaccucauguggaagcagaucacccccgagcugaaccacauccuguccgagaacgaggugaagcucaccaucaugaccggcgacaucaaggggaucaugcaggccggcaagcggagccugcgcccgcagcccacggagcugaaguacuccuggaagaccuggggcaaggcgaagaugcucagcaccgagucccacaaccagaccuuccugaucgacgggcccgagacggccgagugcccgaacaccaaccgggccuggaacagccuggagguggaggacuacggcuucggggucuucaccaccaacaucuggcucaagcugcgcgagaagcaggacguguucugcgacuccaagcugaugagcgccgccaucaaggacaaccgggcggugcacgccgacaugggcuacuggaucgaguccgcccucaacgacaccuggaagauggagaaggccagcuucaucgaggucaaguccugccacuggcccaagagccacacgcugugguccaacggcgugcuggagagcgagaugaucauccccaagaacuucgccgggcccgugucccagcacaacuaccgcccgggcuaccacacccagaccgcggggcccuggcaccucggcaagcuggagauggacuucgacuucugcgaggggaccacggucguggugaccgaggacugcggcaaccggggccccagccugcgcaccaccacggccagcgggaagcucaucaccgaguggugcugccgguccugcacccugcccccgcugcgcuaccggggcgaggacgggugcugguacggcauggagauccgcccccucaaggagaaggaggagaaccuggucaacagccuggugaccgccgggcacggccagaucgacaacuucucccucggcgugcuggggauggcccuguuccucgaggagaugcugcggacgcgcgucggcaccaagcacgcgauccugcucguggcccugagcuucgugacccugaucaccgggaacauguccuuccgggaccucggccgcgucauggugauggugggggccacgaugaccgacgacaucggcaugggcgucaccuaccuggcccugcucgccgcguucaaggugcgccccaccuucgccgccgggcugcugcuccggaagcugacgagcaaggagcugaugauggccaccaucggcaucgcccuccugucccagagcacccugcccgagaccauccucgagcugacggacgcgcuggcccucgggaugauggcccugaagaucgugcgcaacauggagaaguaccagcuggccgucaccaucauggccaucuccugcgugccgaacaccgugauccuccagaacgcguggaaggucagcugcaccauccuggccgccguguccgugagcccccugcuccugacguccagccagcagaaggccgacuggaucccccuggcgcucaccaucaagggccugaaccccaccgccaucuuccugaccacgcucucccggaccagcaagaagcgcuccuggccgcugaacgaggccaucauggccgucggcauggugagcauccuggccuccagccuccugaagaacgacauccccaugaccgggccccuggucgcgggcgggcuccugaccgugugcuacgugcugacgggccggagcgccgaccucgagcuggagcgcgccgccgacgucaagugggaggaccaggccgagaucuccgggagcucccccauccugagcaucaccaucuccgaggacggcagcauguccaucaagaacgaggaggaggagcagacccucaccauccugauccggaccggccugcucgugaucagcgggguguucccggucuccauccccaucacggcggccgccugguaccugugggaggugaagaagcagcgcgccggcgugcugugggacguccccagcccgccgcccguggggaaggccgagcucgaggacggcgcguaccggaucaagcagcgcgggauccugggcuacucccagaucggcgccgggguguacaaggagggcaccuuccacaccauguggcacgucacccgcggggccgugcugaugcaccgcggcaagcggaucgagcccagcugggccgacgugaagaaggaccucaucuccuacgggggcggcuggaagcuggagggggaguggaaggagggcgaggagguccaggugcuggcccucgagcccgggaagaacccccgcgcggugcagacgaagcccggcaucuucaagaccaacaccgggaccaucggcgccgucagccuggacuucucccccggcacgagcgggucccccaucguggaccggaagggcaagguggucgggcuguacggcaacggcguggugacccgcagcggggccuacgucuccgccaucgcgcagaccgagaaguccaucgaggacaaccccgagaucgaggacgacaucuuccggaagaagcgccucaccaucauggaccugcaccccggcgccgggaagacgaagcgguaccugcccgccaucgugcgcgaggccaucaagcggggccugcgcacccucauccuggccccgacccgcguggucgcggccgagauggaggaggcccugcgggggcuccccauccgcuaccagacccccgccauccgggccgagcacacgggccgcgagaucguggaccugaugugccacgcgaccuucaccaugcggcugcucagccccgugcgcgucccgaacuacaaccugaucaucauggacgaggcccacuucaccgaccccgccuccaucgccgcccggggcuacaucagcacgcgcguggagaugggggaggcggccggcaucuucaugaccgccacgccgcccgggucccgggacccguucccccagagcaacgcccccaucauggacgaggagcgcgagauccccgagcgguccuggaacagcggccacgagugggugaccgacuucaaggggaagacggucugguucgugccguccaucaaggcgggcaacgacaucgccgccugccugcgcaagaacggcaagaaggugauccagcucagccggaagaccuucgacuccgaguacgucaagacccgcgccaacgacugggacuucguggugaccacggacaucagcgagaugggggccaacuucaaggcggagcgggucaucgacccccgccggugcaugaagcccgugauccugaccgacggcgaggagcgcgugauccuggccgggcccaugccggucacccacuccagcgccgcccagcggcgcggccgcaucgggcggaaccccaagaacgagaacgaccaguacaucuacaugggcgagccccucgagaacgacgaggacugcgcccacuggaaggaggcgaagaugcugcuggacaacaucaacacccccgagggcaucaucccguccauguucgagcccgagcgcgagaagguggacgccaucgacggggaguaccggcuccgcggcgaggcccggaagacguucguggaccugaugcgccgcggggaccugcccgucuggcucgccuacaagguggccgcggagggcaucaacuacgccgaccgcaaguggugcuucgacgggaucaagaacaaccagauccuggaggagaacguggaggucgagaucuggaccaaggagggcgagcggaagaagcugaagccgcgcuggcucgacgcccggaucuacagcgacccccuggcccugaaggaguucaaggaguucgcggccggccgcaagucccucacccugaaccugaucaccgagauggggcggcuccccacguucaugacccagaaggcccgcaacgcccuggacaaccuggccgugcuccacaccgcggaggugggcgggaaggcccacacccacgcccugagcgagcugcccgagacgcucgagacccugcugcuccugacccugcucgccgccgucaccggcggcaucuuccuguuccugauguccgggaagggcaucgggaagaugacccucggcaugugcugcaucaucacggcgagcauccugcugugguacgcccagauccagccgcacuggaucgccgccuccaucauccucgaguucuuccugaucgugcugcucauccccgagcccgagaagcagcggacgccccaggacaaccagcugaccuacgucgugaucgccauccugaccguggucgcggccacgauggccaacgagaugggguuccucgagaagaccaagaaggaccugggcuucggcagcaucaccacccaggagagcgaguccaacauccuggacaucgaccuccgcccggccagcgccuggacgcuguacgcgguggccaccaccuucgugacccccaugcugcggcacuccaucgagaacagcuccgucaacgugagccucacggccaucgccaaccaggcgaccgugcugauggggcugggcaagggguggccccucuccaagauggacaucggcgucccccugcuggccaucgggugcuacagccaggugaacccgaucacccucaccgccgcccugcugcuccugguggcccacuacgcgaucaucggccccggccugcaggccaaggccacgcgcgaggcccagaagcgggccgcggccgggaucaugaagaaccccaccgucgacggcaucaccgugaucgaccucgagcccaucccguacgaccccaaguucgagaagcagcuggggcaggucaugcugcucauccugugcgucacccaggugcugaugaugcgcacgaccugggcccucugcgaggcccugacccuggccaccggccccaucuccacgcucugggaggggaaccccggccgguucuggaacaccaccaucgcggugagcauggccaacaucuuccgcggcuccuaccuggccggggccggccuccuguucagcaucaugaagaacaccacgaacacccgccgggggaccggcaacgucggcgagacccugggggagaaguggaagucccgccugaacgcgcucggcaagagcgaguuccagaucuacaagaaguccgggauccaggagguggaccggacgcuggccaaggagggcaucaagcgcggggagaccgaccaccacgccgugagccggggcuccgccaagcugcgcugguucgucgagcggaacauggugaccccggagggcaagguggucgaccucgggugcggccgcgggggcuggagcuacuacugcgggggccugaagaacgugcgggaggugaagggccugaccaagggcgggcccgggcacgaggagcccauccccauguccacguacggcuggaaccucguccgccugcagagcgggguggacguguucuucaccccgcccgagaagugcgacacccugcucugcgacaucggcgagagcucccccaaccccaccaucgaggccggccggacccugcgcguccugaaccucguggagaacuggcugaacaacaacacgcaguucugcaucaaggugcugaacccguacaugcccagcgucaucgagaagauggagacccuccagcggaaguacgggggcgcgcuggugcgcaacccccugucccggaacagcacccacgagauguacuggguguccaacgccaccgggaacaucgucagcuccgugaacaugaucagccgcaugcugaucaaccgguucacgaugaagcacaagaaggccaccuacgagccggacguggaccucggcuccgggacccgcaacaucggcaucgagagcgagauccccaaccuggacaucaucggcaagcggaucgagaagaucaagcaggagcacgagaccuccuggcacuacgaccaggaccaccccuacaagacgugggccuaccacgggagcuacgagaccaagcagaccggcuccgccagcuccauggucaacgggguggugcgccugcucaccaagcccugggacgucgugccgauggugacgcagauggcgaugaccgacaccacccccuucggccagcagcgcgucuucaaggagaagguggacacgcggacccaggagcccaaggagggcaccaagaagcugaugaagaucaccgccgaguggcuguggaaggagcucgggaaggagaagacgccccgcaugugcacccgggaggaguucacccgcaaggugcggagcaacgccgcccugggcgccgucuucaccgacgagaacaaguggaaguccgcgcgcgaggccguggaggacgggcgguucugggagcugguggaccgcgagcggaaccuccaccuggagggcaagugcgagacgugcgucuacaacaugauggggaagcgcgagaagaagcugggcgaguucggcaaggccaaggggagccgggccaucugguacauguggcucggcgcgcgcuuccuggaguucgaggcccugggguuccucaacgaggaccacugguucucccgggagaacagccugagcggcguggagggggagggccugcaccgccucggcuacauccugcgggacgucuccaagaaggagggcggcgccauguacgccgacgacaccgccgggugggacacccgcaucacccuggaggaccucaagaacgaggagauggugacgaaccacaugaagggcgagcacaagaagcuggcggaggccaucuucaagcugaccuaccagaacaaggugguccgggugcagcgcccgacgccccgggggaccgugauggacaucaucagccgcaaggaccagcggggcuccggccaggucgggacguacggccucaacaccuucaccaacauggaggcccagcugauccgccagauggagggggagggcaucuuccgcagcauccagcaccugaccgccacggaggagaucgccgugcagaacuggcucgcgcgggugggccgcgagcggcugucccgcauggccaucagcggggacgacugcgucgugaagcccaucgacgaccgguucgccuccgcccugaccgcccucaacgacaugggcaaggugcgcaaggacauccagcagugggagcccagccggggguggaacgacuggacccaggucccguucugcucccaccacuuccacgagcuggugaugaaggacggccgcgugcuggucgugcccugccggaaccaggacgagcucaucgggcgcgcgcggaucagccagggcgccggcuggucccugaaggagaccgccugccugggcaagagcuacgcccagauguggacccucauguacuuccaccgccgggaccugcgccuggccgcgaacgccaucugcuccgccgugcccagccacuggguccccacgucccggaccaccuggagcauccacgccaagcacgaguggaugaccacggaggacaugcucgcgguguggaaccgcguguggauccaggagaacccguggauggaggacaagacccccgucgaguccugggaggaggugcccuaccugggcaagcgggaggaccaguggugcgggagccugaucggccucaccagccgcgccaccugggccaagaacauccagacggccaucaaccaggugcggucccugaucgggaacgagggcuacaccgacuacaugcccagcaugaagcgcuuccgccgggaggaggaggaggccggcguccugugguga

SEQ ID NO: 9008 - RNA, 9876 nt, Artificial Sequence
  derived and/or modified CDS sequence (opt1) from DENV-2__JX669478__SS-prME
accgccggcgugaucgucaugcugauccccaccgccauggcguuccaccucaccacccgcaacggggagccccacaugaucgugggccggcaggagaaggggaagucccugcuguucaagaccgaggacggcgugaacaugugcacccucauggccaucgaccugggggagcugugcgaggacaccaucaccuacaagugcccccuccugcgccagaacgagcccgaggacaucgacugcuggugcaacagcaccagcaccugggucaccuacgggaccugcaccaccacgggcgagcaccggcgcgagaagcgguccguggcccuggugccccacgucgggaugggccucgagacccgcaccgagaccuggaugagcuccgagggggccuggaagcacgugcagcggaucgagaccuggauccugcgccacccgggcuucaccaucauggccgcgauccuggccuacaccaucgggaccacgcacuuccagcgggcccucaucuucauccugcugaccgccguggcgcccagcaugaccaugcgcugcaucggcaucuccaaccgggacuucgucgagggcgugagcgggggcuccuggguggacaucguccucgagcacgggagcugcgugaccacgauggccaagaacaagcccacccuggacuucgagcugaucaagaccgaggccaagcagcccgccacccuccgcaaguacugcaucgaggccaagcugacgaacaccaccaccgagucccggugcccgacgcagggcgagcccagccugaacgaggagcaggacaagcgcuucaucugcaagcacuccaugguggaccggggcugggggaacggcugcgggcuguucggcaagggcgggaucgugaccugcgcgauguucacgugcaagaagaacauggagggcaagaucgugcagcccgagaaccuggaguacaccaucgugaucacgccccacagcggggaggagcacgccgucggcaacgacaccgggaagcacggcaaggagaucaagaucaccccgcaguccagcaccaccgaggccgagcugacgggguacggcaccgugaccauggagugcagcccccggaccggccucgacuucaacgagauggugcugcugcagauggaggacaaggccuggcucguccaccggcagugguuccuggaccugccccuccccuggcugccgggggccgacacgcagggcagcaacuggauccagaaggagacccuggugaccuucaagaacccccacgcgaagaagcaggacguggucgugcucgggucccaggagggcgccaugcacaccgcccugacgggggccaccgagauccagaugagcagcggcaaccuccuguucaccggccaccugaagugccgccugcggauggacaagcuccagcugaaggggauguccuacagcaugugcaccggcaaguucaagaucgucaaggagaucgccgagacgcagcacgggaccaucgugauccgcgugcaguacgagggcgacggcucccccugcaagauccccuucgagaucaccgaccuggagaagcggcacguccucgggcgccugaucaccgugaacccgaucgugacggagaaggacagccccgucaacaucgaggcggagccgcccuucggcgacuccuacaucaucguggggguggagccgggccagcugaagcucaacugguucaagaaggggagcuccaucggccagauguucgagaccaccaugcgcggcgccaagcggauggccauccugggggacaccgccugggacuucggcagccucggcggggucuucacguccaucgggaaggcccuccaccagguguucggggcgaucuacggcgccgccuucagcgggguguccuggaccaugaagauccugaucggcgucaucaucaccuggaucgggaugaacagccgcuccaccagccuguccgugagccuggugcucgucggcguggugacgcuguaccugggggccaugguccaggcggacuccggcugcaucgugagcuggaagaacaaggagcucaagugcggcuccgggaucuucaucaccgacaacgugcacaccuggaccgagcaguacaaguuccagcccgagagccccagcaagcuggccuccgccauccagaaggcccacgaggagggcaucugcgggauccggagcgucacgcgccuggagaaccucauguggaagcagaucacccccgagcugaaccacauccuguccgagaacgaggugaagcucaccaucaugaccggcgacaucaaggggaucaugcaggccggcaagcggagccugcgcccgcagcccacggagcugaaguacuccuggaagaccuggggcaaggcgaagaugcucagcaccgagucccacaaccagaccuuccugaucgacgggcccgagacggccgagugcccgaacaccaaccgggccuggaacagccuggagguggaggacuacggcuucggggucuucaccaccaacaucuggcucaagcugcgcgagaagcaggacguguucugcgacuccaagcugaugagcgccgccaucaaggacaaccgggcggugcacgccgacaugggcuacuggaucgaguccgcccucaacgacaccuggaagauggagaaggccagcuucaucgaggucaaguccugccacuggcccaagagccacacgcugugguccaacggcgugcuggagagcgagaugaucauccccaagaacuucgccgggcccgugucccagcacaacuaccgcccgggcuaccacacccagaccgcggggcccuggcaccucggcaagcuggagauggacuucgacuucugcgaggggaccacggucguggugaccgaggacugcggcaaccggggccccagccugcgcaccaccacggccagcgggaagcucaucaccgaguggugcugccgguccugcacccugcccccgcugcgcuaccggggcgaggacgggugcugguacggcauggagauccgcccccucaaggagaaggaggagaaccuggucaacagccuggugaccgccgggcacggccagaucgacaacuucucccucggcgugcuggggauggcccuguuccucgaggagaugcugcggacgcgcgucggcaccaagcacgcgauccugcucguggcccugagcuucgugacccugaucaccgggaacauguccuuccgggaccucggccgcgucauggugauggugggggccacgaugaccgacgacaucggcaugggcgucaccuaccuggcccugcucgccgcguucaaggugcgccccaccuucgccgccgggcugcugcuccggaagcugacgagcaaggagcugaugauggccaccaucggcaucgcccuccugucccagagcacccugcccgagaccauccucgagcugacggacgcgcuggcccucgggaugauggcccugaagaucgugcgcaacauggagaaguaccagcuggccgucaccaucauggccaucuccugcgugccgaacgcggugauccuccagaacgccuggaaggucagcugcaccauccuggccgccguguccgugagcccccugcuccugaccuccagccagcagaaggcggacuggaucccccuggcccucacgaucaagggccugaaccccaccgccaucuuccugaccacccucucccggacgagcaagaagcgcuccuggccgcugaacgaggccaucauggccgucggcauggugagcauccuggcguccagccuccugaagaacgacauccccaugaccgggccccuggucgccggcgggcuccugaccgugugcuacgugcugaccggccggagcgccgaccucgagcuggagcgcgccgccgacgucaagugggaggaccaggcggagaucuccgggagcucccccauccugagcaucacgaucuccgaggacggcagcauguccaucaagaacgaggaggaggagcagacccucaccauccugauccggaccggccugcucgugaucagcgggguguucccggucuccauccccaucaccgccgccgccugguaccugugggaggugaagaagcagcgcgccggcgugcugugggacguccccagcccgccgcccguggggaaggcggagcucgaggacggcgccuaccggaucaagcagcgcgggaucuucggcuacucccagaucggcgccgggguguacaaggagggcacguuccacaccauguggcacgucacccgcggggccgugcugaugcaccgcggcaagcggaucgagcccagcugggccgacgugaagaaggaccugaucuccuacgggggcggcuggaagcucgagggggaguggaaggagggcgaggagguccaggugcuggcgcuggagcccgggaagaacccccgcgccgugcagaccaagcccggcaucuucaagacgaacaccgggaccaucggcgccgucagccucgacuucucccccggcaccagcgggucccccaucguggaccggaagggcaagguggucgggcuguacggcaacggcguggugacgcgcagcggggccuacgucuccgcgaucgcccagaccgagaaguccaucgaggacaaccccgagaucgaggacgacaucuuccggaagaagcgccugaccaucauggaccuccaccccggcgccgggaagaccaagcgguaccugcccgccaucgugcgcgaggccaucaagcggggccugcgcacgcugauccucgcgccgacccgcguggucgccgccgagauggaggaggcccugcgggggcugcccauccgcuaccagacccccgccauccgggcggagcacaccggccgcgagaucguggaccucaugugccacgccacguucaccaugcggcugcugagccccgugcgcgucccgaacuacaaccucaucaucauggacgaggcccacuucaccgaccccgccuccaucgccgcgcggggcuacaucagcacccgcguggagaugggggaggccgccggcaucuucaugacggccacgccgcccgggucccgggacccguucccccagagcaacgcgcccaucauggacgaggagcgcgagauccccgagcgguccuggaacagcggccacgagugggugaccgacuucaaggggaagaccgucugguucgugccguccaucaaggccggcaacgacaucgccgccugccugcgcaagaacggcaagaaggugauccagcugagccggaagacguucgacuccgaguacgucaagacccgcgccaacgacugggacuucguggugaccaccgacaucagcgagaugggggcgaacuucaaggccgagcgggucaucgacccccgccggugcaugaagcccgugauccucacggacggcgaggagcgcgugauccuggccgggcccaugccggucacccacuccagcgccgcccagcggcgcggccgcaucgggcggaaccccaagaacgagaacgaccaguacaucuacaugggcgagccccuggagaacgacgaggacugcgcgcacuggaaggaggccaagaugcuccuggacaacaucaacacccccgagggcaucaucccguccauguucgagcccgagcgcgagaagguggacgccaucgacggggaguaccggcugcgcggcgaggcccggaagaccuucguggaccucaugcgccgcggggaccugcccgucuggcuggccuacaagguggcggccgagggcaucaacuacgccgaccgcaaguggugcuucgacgggaucaagaacaaccagauccucgaggagaacguggaggucgagaucuggacgaaggagggcgagcggaagaagcugaagccgcgcuggcuggacgcccggaucuacagcgacccccucgcgcugaaggaguucaaggaguucgccgccggccgcaagucccugacccucaaccugaucaccgagauggggcggcugcccaccuucaugacgcagaaggcccgcaacgcccucgacaaccuggcggugcugcacaccgccgaggugggcgggaaggccuacacccacgcccucagcgagcugcccgagacccuggagacgcuccugcugcucacccugcuggccgcggucaccggcggcaucuuccucuuccugauguccgggaagggcaucgggaagaugacccugggcaugugcugcaucaucaccgccagcauccuccugugguacgcccagauccagccgcacuggaucgccgccuccaucauccuggaguucuuccucaucgugcugcugauccccgagcccgagaagcagcggacgccccaggacaaccagcucaccuacgucgugaucgcgauccugaccguggucgccgccaccauggccaacgagaugggguuccuggagaagacgaagaaggaccucggcuucggcagcaucaccacccaggagagcgaguccaacauccuggacaucgaccugcgcccggccagcgcguggacccucuacgccguggccacgaccuucgugacccccaugcugcggcacuccaucgagaacagcuccgucaacgugagccugaccgccaucgcgaaccaggccacggugcucauggggcugggcaagggguggccccuguccaagauggacaucggcgucccccuccuggccaucgggugcuacagccaggugaacccgaucacccugaccgccgcccuccugcugcucguggcgcacuacgccaucaucggccccggccugcaggccaaggccacccgcgaggcccagaagcgggcggccgccgggaucaugaagaaccccacggucgacggcaucaccgugaucgaccuggagcccaucccguacgaccccaaguucgagaagcagcucgggcaggucaugcugcugauccucugcgucacccaggugcugaugaugcgcaccacgugggcccugugcgaggcccucacccuggcgaccggccccaucuccacccugugggaggggaaccccggccgguucuggaacacgaccaucgccgugagcauggccaacaucuuccgcggcuccuaccucgccggggcgggccugcuguucagcaucaugaagaacaccaccaacacgcgccgggggaccggcaacgucggcgagacccucggggagaaguggaagucccgccugaacgcccugggcaagagcgaguuccagaucuacaagaaguccgggauccaggagguggaccggacccucgccaaggagggcaucaagcgcggggagacggaccaccacgccgugagccggggcuccgccaagcugcgcugguucgucgagcggaacauggugaccccggagggcaagguggucgaccuggggugcggccgcgggggcuggagcuacuacugcgggggccucaagaacgugcgggaggugaagggccugaccaagggcggccccgggcacgaggagcccauccccauguccaccuacggcuggaaccugguccgccuccagagcgggguggacguguucuucacgccgcccgagaagugcgacacccugcugugcgacaucggcgagagcucccccaaccccaccaucgaggcgggccggacccuccgcguccugaaccugguggagaacuggcucaacaacaacacccaguucugcaucaaggugcugaacccguacaugcccagcgucaucgagaagauggagacgcugcagcggaaguacgggggcgcccucgugcgcaacccccugucccggaacagcacccacgagauguacuggguguccaacgccaccgggaacaucgucagcuccgugaacaugaucagccgcaugcugaucaaccgguucaccaugaagcacaagaaggccacguacgagccggacguggaccugggcuccgggacccgcaacaucggcaucgagagcgagauccccaaccucgacaucaucggcaagcggaucgagaagaucaagcaggagcacgagaccuccuggcacuacgaccaggaccaccccuacaagaccugggccuaccacgggagcuacgagacgaagcagaccggcuccgcgagcuccauggucaacgggguggugcgccugcugaccaagcccugggacgucaucccgauggugacccagauggccaugacggacaccacccccuucggccagcagcgcguguucaaggagaaggucgacacccggacgcaggagcccaaggagggcaccaagaagcucaugaagaucaccgccgaguggcuguggaaggagcuggggaaggagaagacgccccggaugugcacgcgggaggaguucacccgcaaggugcggagcaacgccgcccucggcgcgguguucaccgacgagaacaaguggaaguccgcccgcgaggccgucgaggacgggcgguucugggagcugguggaccgcgagcggaaccugcaccucgagggcaagugcgagaccugcguguacaacaugauggggaagcgcgagaagaagcugggcgaguucggcaaggccaaggggagccgggcgaucugguacauguggcugggcgcccgcuuccucgaguucgaggcccugggguuccugaacgaggaccacugguucucccggggcaacagccucagcggggucgagggcgagggccugcaccgccugggguacauccuccgggaggugggcaagaaggagggcggcgccauguacgccgacgacacggcggggugggacacccgcaucacccuggaggaccugaagaacgaggagauggucaccaaccacaugaagggcgagcacaagaagcucgccgaggccaucuucaagcugacguaccagaacaagguggugcggguccagcgcccgacgccccggggcaccgugauggacaucaucucccgcaaggaccagcgggggagcggccagguggggaccuacggccugaacacguucaccaacauggaggcccagcucauccgccagauggagggcgaggggaucuucaaguccauccagcaccugaccgccaccgaggagaucgcgguccagaacuggcuggcccgcgugggccgggagcgccucagccggauggccaucuccggggacgacugcguggucaagcccaucgacgaccgcuucgccagcgcccugacggcgcugaacgacaugggcaaggugcggaaggacauccagcagugggagcccucccgcggguggaacgacuggacccaggugccguucugcagccaccacuuccacgagcucgucaugaaggacggccgggugcuggugguccccugccgcaaccaggacgagcugaucggccgggcccgcaucucccagggggccggcuggagccucaaggagaccgccugccuggggaaguccuacgcccagauguggacccugauguacuuccaccggcgcgaccuccggcuggcggccaacgccaucugcagcgccgugcccucccacugggugcccaccagccgcacgaccugguccauccacgcgaagcacgaguggaugaccaccgaggacaugcuggccgucuggaaccggguguggauccaggagaacccguggauggaggacaagacgcccguggagagcugggaggagguccccuaccucggcaagcgcgaggaccaguggugcgggucccugaucggccugaccagccgggccaccugggccaagaacauccagaccgccaucaaccaggugcgcagccucaucggcaacgagggguacaucgacuacaugcccuccaugaagcgguuccgccgcgaggaggaggaggcgggcgugcugugguga

SEQ ID NO: 9009 - RNA, 9876 nt, Artificial Sequence
  derived and/or modified CDS sequence (opt1) from DENV-2__JX669480__SS-prME
accgcgggcgugaucaucaugcugauccccaccgccauggcguuccaccucaccacccgcaacggggagccccacaugaucgugggccggcaggagaaggggaagucccugcuguucaagaccgaggacggcgugaacaugugcacccucauggccaucgaccugggggagcugugcgaggacaccaucaccuacaagugcccccuccugcgccagaacgagcccgaggacaucgacugcuggugcaacagcaccagcaccugggugaccuacgggaccugcaccaccacgggcgagcaccggcgcgagaagcgguccgucgcccuggugccccacguggggaugggccucgagacccgcaccgagaccuggaugagcuccgagggggccuggaagcacguccagcggaucgagacguggauccugcgccacccgggcuucgccaucauggcggccauccuggccuacaccaucgggaccacccacuuccagcgggcccucaucuucauccugcugacggcgguggcccccagcaugaccaugcgcugcaucggcaucuccaaccgggacuucguggagggcgucagcgggggcuccuggguggacaucgugcucgagcacgggagcugcgucaccaccauggccaagaacaagcccacgcuggacuucgagcugaucaagaccgaggccaagcagcccgccacccuccgcaaguacugcaucgaggcgaagcugaccaacacgaccaccgagucccggugcccgacccagggcgagcccagccugaacgaggagcaggacaagcgcuucaucugcaagcacuccaugguggaccggggcugggggaacggcugcggccucuucggcaagggcgggaucgugacgugcgccauguucacgugcaagaagaacauggagggcaaggucgugcugcccgagaaccuggaguacaccaucgugaucacgccccacagcggggaggagcacgccgucggcaacgacacggggaagcacggcgaggagaucaagaucaccccgcaguccagcaucaccgaggccgagcucaccggguacggcaccgugacgauggagugcagcccccggaccggccuggacuucaacgagauggugcugcuccagauggaggagaaggccuggcugguccaccggcagugguuccuggaccucccccugcccuggcugccgggggcggacacccagggcagcaacuggauccagaaggagacccucgugacguucaagaacccccacgccaagaagcaggacguggucgugcuggggucccaggagggcgccaugcacaccgcccugaccggggccaccgagauccagaugagcagcggcaaccuccuguucacgggccaccugaagugccgccuccggauggacaagcugcagcugaaggggauguccuacagcaugugcaccggcaaguucaagaucgucaaggagaucgcggagacccagcacgggaccaucgugauccgcgugcaguacgagggcgacggcucccccugcaagauccccuucgagaucauggaccucgagaagcggcacguccuggggcgccugaucacggugaacccgaucgugaccgagaaggacagccccgucaacaucgaggccgagccgcccuucggcgacuccuacaucaucaucgggguggagccgggccagcucaagcugaacugguucaagaaggggagcuccaucggccagauguucgagaccaccaugcgcggcgccaagcggauggccauccugggggacacggccugggacuucggcagccucgggggcguguucaccuccaucgggaaggcgcugcaccaggucuucggcgccaucuacggcgccgccuucagcgggguguccuggaccaugaagauccugaucggcgugaucaucaccuggaucgggaugaacagccgcuccacgagccuguccgucagccucgugcuggugggcgucgugacccuguaccucggggcgauggugcaggccgacuccggcugcgucgugagcuggaagaacaaggagcugaagugcggcuccgggaucuucaucaccgacaacgugcacaccuggacggagcaguacaaguuccagcccgagagccccagcaagcuggccuccgccauccagaaggcccacgaggagggcaucugcgggauccggagcgucacccgccucgagaaccugauguggaagcagaucacccccgagcugaaccacauccucuccgagaacgaggugaagcugaccaucaugacgggcgacaucaaggggaucaugcaggcgggcaagcggagccugcgcccgcagcccaccgagcucaaguacuccuggaagaccuggggcaaggccaagaugcugagcaccgagucccacaaccagacguuccugaucgacgggcccgagaccgccgagugcccgaacaccaaccgggccuggaacagccucgagguggaggacuacggcuucggggucuucaccacgaacaucuggcugaagcugcgcgagaagcaggacguguucugcgacuccaagcucaugagcgccgcgaucaaggacaaccgggccgugcacgccgacaugggcuacuggaucgaguccgcccugaacgacaccuggaagauggagaaggccagcuucaucgaggucaaguccugccacuggcccaagagccacacccugugguccaacggcgugcucgagagcgagaugaucauccccaagaacuucgcggggcccgugucccagcacaacuaccgcccgggcuaccacacccagaccgccgggcccuggcaccugggcaagcuggagauggacuucgacuucugcgaggggacgaccgucguggugaccgaggacugcggcaaccggggccccagccuccgcaccacgaccgccagcgggaagcugaucaccgaguggugcugccgguccugcacccugcccccgcuccgcuaccggggcgaggacgggugcugguacggcauggagauccgcccccugaaggagaaggaggagaaccuggucaacagccucgugacggccgggcacggccagaucgacaacuucucccugggcgugcuggggauggcccucuuccuggaggagaugcugcggacccgcgucggcaccaagcacgccauccuccugguggccgugagcuucgucacccugaucacggggaacauguccuuccgggaccucggccgcgugauggugauggucggggugaccaugaccgacgacaucggcaugggcgugaccuaccuggcccugcucgccgcguucaagguccgccccacguucgccgccgggcugcugcuccggaagcugaccagcaaggagcugaugauggccaccaucggcaucacccuccugucccagagcacgauccccgagaccauccuggagcucaccgacgcccuggcgcuggggaugauggugcucaagaucgugcgcaacauggagaaguaccagcuggccgucaccaucauggccaucuccugcgugccgaacgccgugauccugcucaacgccuggaaggucagcugcacgauccuggcggccguguccgucagcccccugcuccugaccuccagccagcagaagaccgacuggaucccccuggcccucaccaucaagggccugaaccccacggccaucuuccugaccacccucucccggaccagcaagaagcgcuccuggccgcugaacgaggcggugauggccgugggcauggucagcauccuggccuccagccuccugaagaacgacauccccaugacggggccccugguggccggcgggcuccugaccgugugcuacguccugaccggccggagcgccgaccucgagcuggagcgcgcggccgacgugaagugggaggaccaggccgagaucuccgggagcucccccauccugagcaucaccaucuccgaggacggcagcauguccaucaagaacgaggaggaggagcagacgcucaccauccugauccggaccggccugcucgugaucagcggggucuucccgguguccauccccaucaccgccgccgcgugguaccugugggaggugaagaagcagcgcgccggcguccugugggacgugcccagcccgccgcccguggggaaggccgagcucgaggacggcgccuaccggaucaagcagcgcgggauccugggcuacucccagaucggcgccggggucuacaaggagggcaccuuccacacgauguggcacgugacccgcggggcggugcugaugcaccgcggcaagcggaucgagcccagcugggccgacgucaagaaggaccucaucuccuacgggggcggcuggaagcuggagggggaguggaaggagggcgaggagguccaggugcuggcccucgagcccgggaagaacccccgcgccguccagaccaagcccggccuguucaagaccaacacggggaccaucggcgccgugagccuggacuucucccccggcaccagcgggucccccaucguggaccggaagggcaaggucguggggcucuacggcaacggcguggucacccgcagcggggcguacguguccgccaucgcccagacggagaaguccaucgaggacaaccccgagaucgaggacgacaucuuccggaagaagcgccugaccaucauggaccugcaccccggcgccgggaagaccaagcgguaccugcccgcgaucgugcgcgaggccaucaagcggggccuccgcacccugauccuggccccgacgcgcgucguggccgccgagauggaggaggcgcuccgggggcugcccauccgcuaccagacccccgccauccgggccgagcacaccggccgcgagaucguggaccugaugugccacgccaccuucacgaugcggcuccugagccccguccgcgugccgaacuacaaccugaucaucauggacgaggcccacuucaccgaccccgcguccaucgccgcccggggcuacaucagcacccgcguggagaugggggaggccgccggcaucuucaugaccgcgacgccgcccgggucccgggacccguucccccagagcaacgcccccaucauggacgaggagcgcgagauccccgagcgguccuggaacagcggccacgagugggucaccgacuucaaggggaagaccgugugguucgugccguccaucaaggccggcaacgacaucgccgcgugccuccgcaagaacggcaagaaggucauccagcugagccggaagaccuucgacuccgaguacgugaagacgcgcgccaacgacugggacuucguggucaccaccgacaucagcgagaugggggccaacuuccgggccgagcgcgugaucgacccccggcgcugcaugaagcccgugauccugaccgacggcgaggagcgggucauccucgccgggcccaugccggugacgcacuccagcgcggcccagcgccgcggccggguggggcgcaaccccaagaacgagaacgaccaguacaucuacaugggcgagccccuggagaacgacgaggacugcgcccacuggaaggaggccaagaugcugcucgacaacaucaacacccccgagggcaucaucccguccauguucgagcccgagcgggagaaggucgacgccaucgacggggaguaccgccugcggggcgaggcgcgcaagaccuucguggaccugaugcggcgcggggaccuccccguguggcuggccuaccgggucgccgccgagggcaucaacuacgccgaccgccgguggugcuucgacgggaucaagaacaaccagauccuggaggagaacguggaggucgagaucuggaccaaggagggcgagcgcaagaagcucaagccgcgguggcuggacgcgcgcaucuacagcgacccccuggcccucaaggaguucaaggaguucgccgccggccggaagucccugacgcugaaccucaucaccgagauggggcgccugcccaccuucaugacccagaagacgcgggacgcgcuggacaaccucgccgugcugcacaccgccgaggccggcgggcgcgccuacaaccacgcgcugagcgagcuccccgagacccuggagacccugcuccugcugacgcuccuggccaccgugaccggcggcaucuuccuguuccucauguccgggaagggcaucgggaagaugacccugggcaugugcugcaucaucaccgccagcauccugcucugguacgcccagauccagccgcacuggaucgccgcguccaucauccuggaguucuuccugaucguccuccugauccccgagcccgagaagcagcggacgccccaggacaaccagcugaccuacguggugaucgccauccucaccgucguggccgccaccauggccaacgagaugggguuccuggagaagacgaagaaggaccugggccucggcagcaucaccacccaggagagcgaguccaacauccuggacaucgaccugcgcccggcgagcgccuggacccucuacgccguggccacgaccuucgucacccccaugcugcggcacuccaucgagaacagcuccgugaacgugagccugaccgccaucgcgaaccaggccacgguccucauggggcugggcaagggguggccccuguccaagauggacaucggcgugccccuccuggccaucgggugcuacagccaggugaacccgaucacccugaccgccgcgcuccugcugcucgucgcccacuacaccaucaucggccccggccugcaggccaaggccacgcgcgaggcccagaagcgcgcggccgccgggaucaugaagaaccccaccguggacggcaucaccgugaucgaccuggagcccaucccguacgaccccaaguucgagaagcagcucgggcaggucaugcugcugauccucugcgugacccaggugcugaugaugcggacgaccugggcccugugcgaggcccucacccuggcgaccggccccaucuccacgcugugggaggggaaccccggccgcuucuggaacaccaccaucgccgucagcauggccaacaucuuccggggcuccuaccucgccggggccggccugcuguucagcaucaugaagaacaccacgaacacccgccgggggaccggcaacaucggcgagacccucggggagaaguggaagucccgccugaacgcgcugggcaagagcgaguuccagaucuacaagaaguccgggauccaggagguggaccggacgcucgccaaggagggcaucaagcgcggggagaccgaccaccacgccgugagccggggcuccgccaagcugcgcugguucgucgagcggaacauggugaccccggagggcaagguggucgaccuggggugcggccgcgggggcuggagcuacuacugcgggggccucaagaacgugcgggaggugaagggccugaccaagggcgggcccgggcacgaggagcccauccccauguccacguacggcuggaaccugguccgccuccagagcgggguggacguguucuucaccccgcccgagaagugcgacacccugcugugcgacaucggcgagagcucccccaaccccaccaucgaggcgggccggacccuccgcguccugaaccugguggagaacuggcucaacaacaacacgcaguucugcaucaaggugcugaacccguacaugcccagcgucaucgagaagauggagacccugcagcggaaguacgggggcgcccuggugcgcaacccccucucccggaacagcacccacgagauguacuggguguccaacgccaccgggaacaucgucagcuccgugaacaugaucagccgcaugcugaucaaccgcuucacgaugaagcacaagaaggccaccuacgagccggacguggaccugggcuccgggacccggaacaucggcaucgagagcgagauccccaaccucgacaucaucggcaagcgcaucgagaagaucaagcaggagcacgagaccuccuggcacuacgaccaggaccaccccuacaagacgugggccuaccacgggagcuacgagaccaagcagaccggcuccgcgagcuccauggucaacgggguggugcggcugcugaccaagcccugggacgucgugccgauggugacgcagauggccaugaccgacaccacccccuucggccagcagcgcgucuucaaggagaagguggacacgcggacccaggagcccaaggagggcaccaagaagcucaugcgcaucaccgccgaguggcuguggaaggagcuggggaagaagaagacgccccggaugugcacccgcgaggaguucacccggaaggugcgcagcaacgccgcccucggcgcgaucuucaccgacgagaacaaguggaaguccgcccgggaggccgucgaggacagccgcuucugggagcugguggaccgggagcgcaaccugcaccucgaggggaagugcgagacgugcgucuacaacaugaugggcaagcgggagaagaagcugggggaguucggcaaggccaagggcucccgcgccaucugguacauguggcugggggcgcgguuccucgaguucgaggcccugggcuuccugaacgaggaccacugguucagccgcgggaacagccucuccggcguggagggggagggccugcaccggcugggcuacauccuccgcgacgugagcaagaaggagggcggggccauguacgccgacgacaccgcggggugggacacccggaucacccuggaggaccugaagaacgaggagauggucacgaaccacaugaagggcgagcacaagaagcucgccgaggccaucuucaagcugaccuaccagaacaagguggugcgcguccagcgcccgacgccccgggggaccgugauggacaucaucucccgccgggaccagcgcggcagcggccagguggggacguacggccugaacaccuucaccaacauggaggcccagcucauccggcagauggagggggagggcaucuucaaguccauccagcaccugaccgucacggaggagaucgccgugcagaacuggcuggcgcgcgugggccgggagcgccucagccggauggccaucuccggggacgacugcgucgugaagccccuggacgaccgcuucgccagcgcccugaccgcccucaacgacaugggcaaggugcggaaggacauccagcagugggagcccucccgcggguggaacgacuggacccaggucccguucugcagccaccacuuccacgagcuggugaugaaggacggccgggugcuggucgugcccugccgcaaccaggacgagcucaucgggcgggcgcgcaucucccagggcgccggcuggagccugaaggagaccgccugccuggggaaguccuacgcccagauguggacccucauguacuuccaccggcgcgaccugcggcuggccgcgaacgccaucugcagcgccgugcccucccacuggguccccacgagccgcaccaccugguccauccacgccaagcacgaguggaugaccacggaggacaugcucgccguguggaaccgcguguggauccaggagaacccguggauggaggacaagacccccgucgagagcugggaggaggugcccuaccugggcaagcgggaggaccaguggugcgggagccugaucggccucaccucccgcgcgaccugggccaagaacauccagacggccaucaaccaggugcggagccugaucgggaacgaggaguacaccgacuacaugcccuccaugaagcgcuuccggcgcgaggaggaggaggccggcguccugugguga

SEQ ID NO: 9010 - RNA, 9876 nt, Artificial Sequence
  derived and/or modified CDS sequence (opt1) from DENV-2__JX669483__SS-prME
accgcgggcgugaucaucaugcugauccccaccgccauggcguuccaccucaccacccgcaacggggagccccacaugaucgugggccggcaggagaaggggaagucccugcuguucaagaccgaggacggcgugaacaugugcacccucauggccaucgaccugggggagcugugcgaggacaccaucaccuacaagugcccccuccugcggcagaacgagcccgaggacaucgacugcuggugcaacagcaccagcaccugggugaccuacgggaccugcaccaccacgggcgagcaccggcgcgagaagcgguccgucgcccuggugccccacguggggaugggccucgagacccgcaccgagaccuggaugagcuccgagggggccuggaagcacguccagcggaucgagacguggauccugcgccacccgggcuucgccaucauggcggccauccuggccuacaccaucgggaccacccacuuccagcgggcccucaucuucauccugcugacggcgguggcccccagcaugaccaugcgcugcaucggcaucuccaaccgggacuucguggagggcgucagcgggggcuccuggguggacaucgugcucgagcacgggagcugcgucaccaccauggccaagaacaagcccacgcuggacuucgagcugaucaagaccgaggccaagcagcccgccacccuccgcaaguacugcaucgaggcgaagcugaccaacacgaccaccgagucccggugcccgacccagggcgagcccagccugaacgaggagcaggacaagcgcuucaucugcaagcacuccaugguggaccggggcugggggaacggcugcggccucuucggcaagggcgggaucgugacgugcgccauguucacgugcaagaagaacauggagggcaaggucgugcugcccgagaaccuggaguacaccaucgugaucacgccccacagcggggaggagcacgccgucggcaacgacacggggaagcacggcgaggagaucaagaucaccccgcaguccagcaucaccgaggccgagcucaccggguacggcaccgugacgauggagugcagcccccggaccggccuggacuucaacgagauggugcugcuccagauggaggagaaggccuggcugguccaccggcagugguuccuggaccucccccugcccuggcugccgggggcggacacccagggcagcaacuggauccagaaggagacccucgugacguucaagaacccccacgccaagaagcaggacguggucgugcuggggucccaggagggcgccaugcacaccgcccugaccggggccaccgagauccagaugagcagcggcaaccuccuguucacgggccaccugaagugccgccuccggauggacaagcugcagcugaaggggauguccuacagcaugugcaccggcaaguucaagaucgucaaggagaucgcggagacccagcacgggaccaucgugaucaaggugcaguacgagggcgacggcucccccugcaagauccccuucgagaucauggaccucgagaagcgccacguccuggggcggcugaucacggugaacccgaucgugaccgagaaggacagccccgucaacaucgaggccgagccgcccuucggcgacuccuacaucaucaucgggguggagccgggccagcucaagcugaacugguucaagaaggggagcuccaucggccagauguucgagaccaccaugcgcggcgccaagcgcauggccauccugggggacacggccugggacuucggcagccucgggggcguguucaccuccaucgggaaggcgcugcaccaggucuucggcgccaucuacggcgccgccuucagcgggguguccuggaccaugaagauccugaucggcgugaucaucaccuggaucgggaugaacagccgguccacgagccuguccgucagccucgugcuggugggcgucgugacccuguaccucggggcgauggugcaggccgacuccggcugcgucgugagcuggaagaacaaggagcugaagugcggcuccgggaucuucaucaccgacaacgugcacaccuggacggagcaguacaaguuccagcccgagagccccagcaagcuggccuccgccauccagaaggcccacgaggagggcaucugcgggauccgcagcgucacccggcucgagaaccugauguggaagcagaucacccccgagcugaaccacauccucuccgagaacgaggugaagcugaccaucaugacgggcgacaucaaggggaucaugcaggcgggcaagcgcagccugcggccgcagcccaccgagcucaaguacuccuggaagaccuggggcaaggccaagaugcugagcaccgagucccacaaccagacguuccugaucgacgggcccgagaccgccgagugcccgaacaccaaccgcgccuggaacagccucgagguggaggacuacggcuucggggucuucaccacgaacaucuggcugaagcugcgggagaagcaggacguguucugcgacuccaagcucaugagcgccgcgaucaaggacaaccgcgccgugcacgccgacaugggcuacuggaucgaguccgcccugaacgacaccuggaagauggagaaggccagcuucaucgaggucaaguccugccacuggcccaagagccacacccugugguccaacggcgugcucgagagcgagaugaucauccccaagaacuucgcggggcccgugucccagcacaacuaccggccgggcuaccacacccagaccgccgggcccuggcaccugggcaagcuggagauggacuucgacuucugcgaggggacgaccgucguggugaccgaggacugcggcaaccgcggccccagccuccggaccacgaccgccagcgggaagcugaucaccgaguggugcugccgcuccugcacccugcccccgcuccgguaccgcggcgaggacgggugcugguacggcauggagauccggccccugaaggagaaggaggagaaccuggucaacagccucgugacggccgggcacggccagaucgacaacuucucccugggcgugcuggggauggcccucuuccuggaggagaugcugcgcacccgggucggcaccaagcacgccauccuccugguggccgugagcuucgucacccugaucacggggaacauguccuuccgcgaccucggccgggugauggugauggucggggugaccaugaccgacgacaucggcaugggcgugaccuaccuggcccugcucgccgcguucaagguccgccccacguucgccgccgggcugcugcuccgcaagcugaccagcaaggagcugaugauggccaccaucggcaucacccuccugucccagagcacgauccccgagaccauccuggagcucaccgacgcccuggcgcuggggaugauggugcucaagaucgugcggaacauggagaaguaccagcuggccgucaccaucauggccaucuccugcgugccgaacgccgugauccugcucaacgccuggaaggucagcugcacgauccuggcggccguguccgucagcccccugcuccugaccuccagccagcagaagaccgacuggaucccccuggcccucaccaucaagggccugaaccccacggccaucuuccugaccacccucucccgcaccagcaagaagcgguccuggccgcugaacgaggcggugauggccgugggcauggucagcauccuggccuccagccuccugaagaacgacauccccaugacggggccccugguggccggcgggcuccugaccgugugcuacguccugaccggccgcagcgccgaccucgagcuggagcgggcggccgacgugaagugggaggaccaggccgagaucuccgggagcucccccauccugagcaucaccaucuccgaggacggcagcauguccaucaagaacgaggaggaggagcagacgcucaccauccugauccgcaccggccugcucgugaucagcggggucuucccgguguccauccccaucaccgccgccgcgugguaccugugggaggugaagaagcagcgggccggcguccugugggacgugcccagcccgccgcccguggggaaggccgagcucgaggacggcgccuaccgcaucaagcagcgggggauccugggcuacucccagaucggcgccggggucuacaaggagggcaccuuccacacgauguggcacgugacccgcggggcggugcugaugcaccggggcaagcgcaucgagcccagcugggccgacgucaagaaggaccucaucuccuacgggggcggcuggaagcuggagggggaguggaaggagggcgaggagguccaggugcuggcccucgagcccgggaagaacccccgggccguccagaccaagcccggccuguucaagaccaacacggggaccaucggcgccgugagccuggacuucucccccggcaccagcgggucccccaucguggaccgcaagggcaaggucguggggcucuacggcaacggcguggucacccggagcggggcguacguguccgccaucgcccagacggagaaguccaucgaggacaaccccgagaucgaggacgacaucuuccgcaagaagcggcugaccaucauggaccugcaccccggcgccgggaagaccaagcgcuaccugcccgcgaucgugcgggaggccaucaagcgcggccuccggacccugauccuggccccgacgcgcgucguggccgccgagauggaggaggcgcuccgcgggcugcccauccgguaccagacccccgccauccgcgccgagcacaccggccgggagaucguggaccugaugugccacgccaccuucacgaugcgccuccugagccccguccgggugccgaacuacaaccugaucaucauggacgaggcccacuucaccgaccccgcguccaucgccgcccgcggcuacaucagcacccggguggagaugggggaggccgccggcaucuucaugaccgcgacgccgcccgggucccgcgacccguucccccagagcaacgcccccaucauggacgaggagcgggagauccccgagcgcuccuggaacagcggccacgagugggucaccgacuucaaggggaagaccgugugguucgugccguccaucaaggccggcaacgacaucgccgcgugccuccggaagaacggcaagaaggucauccagcugagccgcaagaccuucgacuccgaguacgugaagacgcgggccaacgacugggacuucguggucaccaccgacaucagcgagaugggggccaacuuccgcgccgagcgggugaucgacccccgccggugcaugaagcccgugauccugaccgacggcgaggagcgcgucauccucgccgggcccaugccggugacgcacuccagcgcggcccagcggcgcggccgcguggggcggaaccccaagaacgagaacgaccaguacaucuacaugggcgagccccuggagaacgacgaggacugcgcccacuggaaggaggccaagaugcugcucgacaacaucaacacccccgagggcaucaucccguccauguucgagcccgagcgcgagaaggucgacgccaucgacggggaguaccggcugcgcggcgaggcgcggaagaccuucguggaccugaugcgccgcggggaccuccccguguggcuggccuaccgcgucgccgccgagggcaucaacuacgccgaccggcgcuggugcuucgacgggaucaagaacaaccagauccuggaggagaacguggaggucgagaucuggaccaaggagggcgagcggaagaagcucaagccgcgcuggcuggacgcgcggaucuacagcgacccccuggcccucaaggaguucaaggaguucgccgccggccgcaagucccugacgcugaaccucaucaccgagauggggcggcugcccaccuucaugacccagaagacgcgcgacgcgcuggacaaccucgccgugcugcacaccgccgaggccggcgggcgggccuacaaccacgcgcugagcgagcuccccgagacccuggagacccugcuccugcugacgcuccuggccaccgugaccggcggcaucuuccuguuccucauguccgggaagggcaucgggaagaugacccugggcaugugcugcaucaucaccgccagcauccugcucugguacgcccagauccagccgcacuggaucgccgcguccaucauccuggaguucuuccugaucguccuccugauccccgagcccgagaagcagcgcacgccccaggacaaccagcugaccuacguggugaucgccauccucaccgucguggccgccaccauggccaacgagaugggguuccuggagaagacgaagaaggaccugggccucggcagcaucaccacccaggagagcgaguccaacauccuggacaucgaccugcggccggcgagcgccuggacccucuacgccguggccacgaccuucgucacccccaugcugcgccacuccaucgagaacagcuccgugaacgugagccugaccgccaucgcgaaccaggccacgguccucauggggcugggcaagggguggccccuguccaagauggacaucggcgugccccuccuggccaucgggugcuacagccaggugaacccgaucacccugaccgccgcgcuccugcugcucgucgcccacuacaccaucaucggccccggccugcaggccaaggccacgcgggaggcccagaagcgcgcggccgccgggaucaugaagaaccccaccguggacggcaucaccgugaucgaccuggagcccaucccguacgaccccaaguucgagaagcagcucgggcaggucaugcugcugauccucugcgugacccaggugcugaugaugcgcacgaccugggcccugugcgaggcccucacccuggcgaccggccccaucuccacgcugugggaggggaaccccggccgguucuggaacaccaccaucgccgucagcauggccaacaucuuccgcggcuccuaccucgccggggccggccugcuguucagcaucaugaagaacaccacgaacacccggcgcgggaccggcaacaucggcgagacccucggggagaaguggaagucccggcugaacgcgcugggcaagagcgaguuccagaucuacaagaaguccgggauccaggagguggaccgcacgcucgccaaggagggcaucaagcgcggggagaccgaccaccacgccgugagccgcggcuccgccaagcugcggugguucgucgagcgcaacauggugaccccggagggcaagguggucgaccuggggugcggccgcggcggguggagcuacuacugcggcgggcucaagaacgugcgcgaggugaaggggcugaccaagggcgggcccgggcacgaggagcccauccccauguccacguacggcuggaaccugguccggcuccagagcgggguggacguguucuucaccccgcccgagaagugcgacacccugcugugcgacaucggcgagagcucccccaaccccaccaucgaggcgggccgcacccuccggguccugaaccugguggagaacuggcucaacaacaacacgcaguucugcaucaaggugcugaacccguacaugcccagcgucaucgagaagauggagacccugcagcgcaaguacgggggcgcccuggugcggaacccccucucccgcaacagcacccacgagauguacuggguguccaacgccaccgggaacaucgucagcuccgugaacaugaucagccggaugcugaucaaccgcuucacgaugaagcacaagaaggccaccuacgagccggacguggaccugggcuccgggacccgcaacaucggcaucgagagcgagauccccaaccucgacaucaucggcaagcggaucgagaagaucaagcaggagcacgagaccuccuggcacuacgaccaggaccaccccuacaagacgugggccuaccacgggagcuacgagaccaagcagaccggcuccgcgagcuccauggucaacgggguggugcgccugcugaccaagcccugggacgucgugccgauggugacgcagauggccaugaccgacaccacccccuucggccagcagcgggucuucaaggagaagguggacacgcgcacccaggagcccaaggagggcaccaagaagcucaugcggaucaccgccgaguggcuguggaaggagcuggggaagaagaagacgccccgcaugugcacccgggaggaguucacccgcaaggugcggagcaacgccgcccucggcgcgaucuucaccgacgagaacaaguggaaguccgcccgcgaggccgucgaggacagccgguucugggagcugguggaccgcgagcggaaccugcaccucgaggggaagugcgagacgugcgucuacaacaugaugggcaagcgcgagaagaagcugggggaguucggcaaggccaagggcucccgggccaucugguacauguggcugggggcgcgcuaccucgaguucgaggcccugggcuuccugaacgaggaccacugguucagccgggggaacagccucuccggcguggagggggagggccugcaccgccugggcuacauccuccgggacgugagcaagaaggagggcggcgccauguacgccgacgacaccgcggggugggacacccgcaucacccuggaggaccugaagaacgaggagauggucacgaaccacaugaagggcgagcacaagaagcucgccgaggccaucuucaagcugaccuaccagaacaagguggugcggguccagcgcccgacgccccgggggaccgugauggacaucaucucccggcgcgaccagcggggcagcggccagguggggacguacggccugaacaccuucaccaacauggaggcccagcucauccgccagauggagggggagggcaucuucaaguccauccagcaccugaccgucacggaggagaucgccgugcagaacuggcuggcgcgggugggccgcgagcggcucagccgcauggccaucuccggggacgacugcgucgugaagccccuggacgaccgguucgccagcgcccugaccgcccucaacgacaugggcaaggugcgcaaggacauccagcagugggagcccucccggggguggaacgacuggacccaggucccguucugcagccaccacuuccacgagcuggugaugaaggacggccgcgugcuggucgugcccugccggaaccaggacgagcucaucgggcgcgcgcggaucucccagggcgccggcuggagccugaaggagaccgccugccuggggaaguccuacgcccagauguggacccucauguacuuccaccgccgggaccugcgccuggccgcgaacgccaucugcagcgccgugcccucccacuggguccccacgagccggaccaccugguccauccacgccaagcacgaguggaugaccacggaggacaugcucgccguguggaaccgcguguggauccaggagaacccguggauggaggacaagacccccgucgagagcugggaggaggugcccuaccugggcaagcgcgaggaccaguggugcgggagccugaucggccucaccucccgggcgaccugggccaagaacauccagacggccaucaaccaggugcgcagccugaucgggaacgaggaguacaccgacuacaugcccuccaugaagcgguuccgccgggaggaggaggaggccggcguccugugguga

SEQ ID NO: 9011 - RNA, 9876 nt, Artificial Sequence
  derived and/or modified CDS sequence (opt1) from DENV-2__JX669484__SS-prME
accgcgggggugaucaucaugcugauccccaccgccauggcguuccaccucaccacccgcaacggggagccccacaugaucgugggccggcaggagaaggggaagucccugcuguucaagaccgaggacggcgugaacaugugcacccucauggccaucgaccugggggagcugugcgaggacaccaucaccuacaagugcccccuccugcgccagaacgagcccgaggacaucgacugcuggugcaacagcaccagcaccugggugaccuacgggaccugcaccaccacgggcgagcaccggcgcgagaagcgguccgucgcccuggugccccacguggggaugggccucgagacccgcaccgagaccuggaugagcuccgagggggccuggaagcacguccagcggaucgagaccuggauccugcgccacccgggcuucgccaucauggcggccauccuggccuacaccaucgggaccacccacuuccagcgggcccucaucuucauccugcugaccgcgguggcccccagcaugaccaugcgcugcaucggcaucuccaaccgggacuucguggagggcgucagcgggggcuccuggguggacaucgugcucgagcacgggagcugcgucaccaccauggccaagaacaagcccacgcuggacuucgagcugaucaagaccgaggccaagcagcccgccacccuccgcaaguacugcaucgaggcgaagcugaccaacacgaccaccgagucccggugcccgacccagggcgagcccagccugaacgaggagcaggacaagcgcuucaucugcaagcacuccaugguggaccggggcugggggaacggcugcggccucuucggcaagggcgggaucgugacgugcgccauguucacgugcaagaagaacauggagggcaaggucgugcugcccgagaaccuggaguacaccaucgugaucacgccccacagcggggaggagcacgccgucggcaacgacacggggaagcacggcaaggagaucaagaucaccccgcaguccagcaucaccgaggccgagcucaccggguacggcaccgugacgauggagugcagcccccggaccggccuggacuucaacgagauggugcugcuccagauggaggagaaggccuggcugguccaccggcagugguuccuggaccucccccugcccuggcugccgggggcggacacccagggcagcaacuggauccagaaggagacccucgugacguucaagaacccccacgccaagaagcaggacguggucgugcuggggucccaggagggcgccaugcacaccgcccugaccggggccaccgagauccagaugagcagcggcaaccuccuguucacgggccaccugaagugccgccuccggauggacaagcugcagcugaaggggauguccuacagcaugugcaccggcaaguucaagaucgucaaggagaucgcggagacccagcacgggaccaucgugauccgcgugcaguacgagggcgacggcucccccugcaagauccccuucgagaucauggaccucgagaagcggcacguccuggggcgccugaucacggugaacccgaucgugaccgagaaggacagccccgucaacaucgaggccgagccgcccuucggcgacuccuacaucaucaucgggguggagccgggccagcucaagcugaacugguucaagaaggggagcuccaucggccagauguucgagaccaccaugcgcggcgccaagcggauggccauccugggggacacggccugggacuucggcagccucgggggcguguucaccuccaucgggaaggcgcugcaccaggucuucggcgccaucuacggcgccgccuucagcgggguguccuggaccaugaagauccugaucggcgugaucaucaccuggaucgggaugaacagccgcuccacgagccuguccgucagccucgugcuggugggcgucgugacccuguaccucggggcgauggugcaggccgacuccggcugcgucgugagcuggaagaacaaggagcugaagugcggcuccgggaucuucaucaccgacaacgugcacaccuggacggagcaguacaaguuccagcccgagagccccagcaagcuggccuccgccauccagaaggcccacgaggagggcaucugcgggauccggagcgucacccgccucgagaaccugauguggaagcagaucacccccgagcugaaccacauccucuccgagaacgaggugaagcugaccaucaugacgggcgacaucaaggggaucaugcaggcgggcaagcggagccugcgcccgcagcccaccgagcucaaguacuccuggaagaccuggggcaaggccaagaugcugagcaccgagucccacaaccagacguuccugaucgacgggcccgagaccgccgagugcccgaacaccaaccgggccuggaacagccucgagguggaggacuacggcuucggggucuucaccacgaacaucuggcugaagcugcgcgagaagcaggacguguucugcgacuccaagcucaugagcgccgcgaucaaggacaaccgggccgugcacgccgacaugggcuacuggaucgaguccgcccugaacggcaccuggaagauggagaaggccagcuucaucgaggucaaguccugccacuggcccaagagccacacccugugguccaacggggugcucgagagcgagaugaucauccccaagaacuucgcgggccccgugucccagcacaacuaccgcccgggguaccacacccagaccgccggccccuggcaccuggggaagcuggagauggacuucgacuucugcgagggcacgaccgucguggugaccgaggacugcggcaaccgggggcccagccuccgcaccacgaccgccagcggcaagcugaucaccgaguggugcugccgguccugcacccugcccccgcuccgcuaccgcggggaggacggcugcugguacgggauggagauccgcccccugaaggagaaggaggagaaccuggucaacagccucgugacggccggccacggccagaucgacaacuucucccugggggugcugggcauggcccucuuccuggaggagaugcugcggacccgcgucgggaccaagcacgccauccuccugguggccgugagcuucgucacccugaucacgggcaacauguccuucaaggaccucgggcgggugauggugauggucggcguggccaugaccgacgacaucggcaugggggugaccuaccuggcccugcucgcggccuucaagguccgccccaccuucgccgccggccugcugcuccgcaagcugacgagcaaggagcugaugauggccaccaucgggaucacccuccugucccagagcaccauccccgagacgauccuggagcucaccgacgcgcuggcccugggcaugauggugcucaagaucgugcggaacauggagaaguaccagcuggccgucaccaucaugaccaucuccugcgugccgaacgccgugauccugcucaacgccuggaaggucagcugcacgauccuggcggccguguccgucagcccccugcuccugaccuccagccagcagaagaccgacuggaucccccuggcccucaccaucaagggccugaaccccacggccaucuuccugaccacccucucccgcaccagcaagaagcgguccuggccgcugaacgaggcggugauggccguggggauggucagcauccuggccuccagccuccugaagaacgacauccccaugacgggcccccugguggccgggggccuccugaccgugugcuacguccugaccgggcgcagcgccgaccucgagcuggagcgggcggccgacgugaagugggaggaccaggccgagaucuccggcagcucccccauccugagcaucaccaucuccgaggacggcagcauguccaucaagaacgaggaggaggagcagacgcucaccauccugauccgcaccgggcugcucgugaucagcggcgucuucccgguguccauccccaucaccgccgccgcgugguaccugugggaggugaagaagcagcgggccgggguccugugggacgugcccagcccgccgcccgugggcaaggccgagcucgaggacggggccuaccgcaucaagcagcggggcauccugggcuacucccagaucggggccggcgucuacaaggaggggaccuuccacacgauguggcacgugacccgcggcgcggugcugaugcaccgggggaagcgcaucgagcccagcugggccgacgucaagaaggaccucaucuccuacggcggcggguggaagcuggagggcgaguggaaggagggggaggagguccaggugcuggcccucgagcccggcaagaacccccgggccguccagaccaagcccgggcuguucaagaccaacacgggcaccaucggcgccgugagccuggacuucucccccgggaccagcggcucccccaucguggaccgcaaggggaaggucgugggccucuacggcaacgggguggucacccggagcggcgcguacguguccgccaucgcccagacggagaaguccaucgaggacaaccccgagaucgaggacgacaucuuccgcaagaagcggcugaccaucauggaccugcaccccggggccggcaagaccaagcgcuaccugcccgcgaucgugcgggaggccaucaagcgcgggcuccggacccugauccuggccccgacgcgcgucguggccgccgagauggaggaggcgcuccgcggccugcccauccgguaccagacccccgccauccgcgccgagcacaccggccgggagaucguggaccugaugugccacgccaccuucacgaugcgccuccugagccccguccgggugccgaacuacaaccugaucaucauggacgaggcccacuucaccgaccccgcguccaucgccgcccgcggguacaucagcacccggguggagaugggcgaggccgccgggaucuucaugaccgcgacgccgcccggcucccgcgacccguucccccagagcaacgcccccaucauggacgaggagcgggagauccccgagcgcuccuggaacagcgggcacgagugggucaccgacuucaagggcaagaccgugugguucgugccguccaucaaggccggcaacgacaucgccgcgugccuccggaagaacgggaagaaggucauccagcugagccgcaagaccuucgacuccgaguacgugaagacgcgggccaacgacugggacuucguggucaccaccgacaucagcgagaugggcgccaacuuccgcgccgagcgggugaucgacccccgccggugcaugaagcccgugauccugaccgacggggaggagcgcgucauccucgccggccccaugccggugacgcacuccagcgcggcccagcggcgcgggcgcgugggccggaaccccaagaacgagaacgaccaguacaucuacaugggcgagccccuggagaacgacgaggacugcgcccacuggaaggaggccaagaugcugcucgacaacaucaacacccccgaggggaucaucccguccauguucgagcccgagcgcgagaaggucgacgccaucgacggcgaguaccggcugcgcggggaggcgcggaagaccuucguggaccugaugcgccggggcgaccuccccguguggcuggccuaccgcgucgccgccgaggggaucaacuacgccgaccggcgcuggugcuucgacggcaucaagaacaaccagauccuggaggagaacguggaggucgagaucuggaccaaggagggcgagcggaagaagcucaagccgcgcuggcuggacgcgcggaucuacagcgacccccuggcccucaaggaguucaaggaguucgccgccgggcgcaagucccugacgcugaaccucaucaccgagaugggccggcugcccaccuucaugacccagaaggcgcgcgacgcccuggacaaccucgccgugcugcacacggccgaggccgggggccgggcguacaaccacgcccugagcgagcuccccgagacccuggagacccugcuccugcugacccuccuggccacggugaccggcgggaucuuccuguuccucauguccggcaagggggucggcaagaugacccuggggaugugcugcaucaucaccgccagcauccugcucugguacgcccagauccagccgcacuggaucgcggccuccaucauccuggaguucuuccugaucgugcuccugauccccgagcccgagaagcagcgcacgccccaggacaaccagcugacguacguggucaucgccauccucaccgugguggccgccaccauggcgaacgagaugggcuuccuggagaagaccaagaaggaccugggccucgggagcaucacgacccaggagagcgaguccaacauccuggacaucgaccugcggccggccagcgccuggacccucuacgccgucgccaccacguucgugacccccaugcugcgccacuccaucgagaacagcuccgugaacgucagccugaccgcgaucgccaaccaggccaccgugcucaugggccuggggaagggcuggccccuguccaagauggacaucggggugccccuccuggccaucggcugcuacagccaggucaacccgaucacgcugaccgcggcccuccugcugcucguggcccacuacgccaucaucggccccgggcugcaggccaaggcgacccgggaggcccagaagcgcgccgccgccggcaucaugaagaaccccaccguggacgggaucacggucaucgaccuggagcccaucccguacgaccccaaguucgagaagcagcucggccaggugaugcugcugauccucugcgugacccagguccugaugaugcgcaccaccugggcgcugugcgaggcccucacgcuggccaccgggcccaucuccacccugugggagggcaaccccggccgguucuggaacaccacgaucgccgugagcauggccaacaucuuccgcggguccuaccucgcgggcgccgggcugcuguucagcaucaugaagaacaccaccaacacccggcgcggcacgggcaacaucggggagacccucggcgagaaguggaagucccggcugaacgcccugggcaagagcgaguuccagaucuacaagaaguccggcauccaggagguggaccgcacccucgccaaggaggggaucaagcggggcgagaccgaccaccacgcggucagccgcggcuccgccaagcugcggugguucguggagcgcaacauggugacgccggaggggaaggucguggaccugggcugcgggcggggcggguggagcuacuacugcggcggccucaagaacgugcgcgaggucaaggggcugaccaagggcgggcccggccacgaggagcccauccccauguccaccuacggguggaaccuggugcggcuccagagcggcguggacgucuucuucaccccgcccgagaagugcgacacgcugcugugcgacaucggcgagagcucccccaaccccaccaucgaggccgggcgcacccuccgggugcugaaccugguggagaacuggcucaacaacaacacccaguucugcaucaagguccugaacccguacaugcccagcgugaucgagaagauggagacccugcagcgcaaguacggcggggcccuggugcggaacccccucucccgcaacagcacgcacgagauguacugggucuccaacgccaccggcaacaucgugagcuccgugaacaugaucagccggaugcugaucaaccgcuucaccaugaagcacaagaaggcgaccuacgagccggacgucgaccugggguccggcacgcgcaacaucggcaucgagagcgagauccccaaccucgacaucaucgggaagcggaucgagaagaucaagcaggagcacgagaccuccuggcacuacgaccaggaccaccccuacaagaccugggccuaccacggcagcuacgagaccaagcagacgggguccgccagcuccauggugaacggcgugguccgccugcugaccaagcccugggacguggugccgauggucacccagauggccaugaccgacacgacccccuucggccagcagcggguguucaaggagaagguggacacccgcacccaggagcccaaggaggggacgaagaagcucaugcggaucaccgccgaguggcuguggaaggagcugggcaagaagaagacgccccgcaugugcacccgggaggaguucacgcgcaagguccggagcaacgcggcccucggggccaucuucaccgacgagaacaaguggaaguccgcccgcgaggccguggaggacagccgguucugggagcuggucgaccgcgagcggaaccugcaccucgagggcaagugcgagaccugcguguacaacaugauggggaagcgcgagaagaagcugggcgaguucggcaaggcgaaggggucccgggccaucugguacauguggcugggcgcccgcuuccucgaguucgaggcccugggguuccugaacgaggaccacugguucagccggggcaacagccucuccgggguggagggcgagggccugcaccgccugggguacauccuccgggacgucagcaagaaggagggcggggcgauguacgccgacgacaccgccggcugggacacgcgcaucacccuggaggaccugaagaacgaggagauggugaucaaccacaugaagggggagcacaagaagcucgccgaggccaucuucaagcugaccuaccagaacaaggugguccgggugcagcgcccgacgccccgcggcacggugauggacaucaucucccggcgcgaccagcggggcagcgggcaggucggcaccuacgggcugaacaccuucaccaacauggaggcgcagcucauccgccagauggagggcgagggcaucuucaaguccauccagcaccugacggugaccgaggagaucgccgugcagaacuggcuggcccgggucgggcgcgagcggcucagccgcauggccaucuccggcgacgacugcguggugaagccccuggacgaccgguucgccagcgcgcugaccgcccucaacgacauggggaagguccgcaaggacauccagcagugggagcccucccggggcuggaacgacuggacccaggugccguucugcagccaccacuuccacgagcuggugaugaaggacgggcgcguccugguggugcccugccggaaccaggacgagcucaucggccgcgcccggaucucccagggcgccggguggagccugaaggagacggccugccugggcaaguccuacgcgcagauguggacccucauguacuuccaccgccgggaccugcgccuggccgccaacgccaucugcagcgccguccccucccacugggugcccaccagccggaccaccugguccauccacgcgaagcacgaguggaugacgaccgaggacaugcucgccguguggaaccgcgucuggauccaggagaacccguggauggaggacaagacccccguggagagcugggaggaggugcccuaccuggggaagcgcgaggaccaguggugcggcagccugaucgggcucaccucccgggccacgugggccaagaacauccagaccgcgaucaaccagguccgcagccugaucggcaacgaggaguacaccgacuacaugcccuccaugaagcgguuccgccgggaggaggaggaggccggcgugcugugguga

SEQ ID NO: 9012 - RNA, 9876 nt, Artificial Sequence
  derived and/or modified CDS sequence (opt1) from DENV-2__JX669485__SS-prME
accgcgggggugaucaucaugcugauccccaccgccauggcguuccaccucaccacccgcaacggggagccccacaugaucgucggcaagcaggagaaggggaagucccugcuguucaagaccgaggacggcgugaacaugugcacccucauggccaucgaccugggggagcugugcgaggacaccaucaccuacaagugcccccuccugcggcagaacgagcccgaggacaucgacugcuggugcaacagcaccagcaccugggugaccuacgggaccugcaccaccacgggcgagcaccgccgggagaagcgcuccgucgcccuggugccccacguggggaugggccucgagacccggaccgagaccuggaugagcuccgagggggccuggaagcacguccagcgcaucgagaccuggauccugcggcacccgggcuucgccaucauggcggccauccuggccuacaccaucgggaccacccacuuccagcgcgcccucaucuucauccugcugacggcgguggcccccagcaugaccaugcggugcaucggcaucuccaaccgcgacuucguggagggcgucagcgggggcuccuggguggacaucgugcucgagcacgggagcugcgucaccaccauggccaagaacaagcccacgcuggacuucgagcugaucaagaccgaggccaagcagcccgccacccuccggaaguacugcaucgaggcgaagcugaccaacacgaccaccgagucccgcugcccgacccagggcgagcccagccugaacgaggagcaggacaagcgguucaucugcaagcacuccaugguggaccgcggcugggggaacggcugcggccucuucggcaagggcgggaucgugacgugcgccauguucacgugcaagaagaacauggagggcaaggucgugcugcccgagaaccuggaguacaccaucgugaucacgccccacagcggggaggagcacgccgucggcaacgacacggggaagcacggcaaggagaucaagaucaccccgcaguccagcaucaccgaggccgagcucaccggguacggcaccgugacgauggagugcagcccccggaccggccuggacuucaacgagauggugcugcuccagauggaggagaaggccuggcugguccaccgccagugguuccuggaccucccccugcccuggcugccgggggcggacacccagggcagcaacuggauccagaaggagacccucgugacguucaagaacccccacgccaagaagcaggacguggucgugcuggggucccaggagggcgccaugcacaccgcccugaccggggccaccgagauccagaugagcagcggcaaccuccuguucacgggccaccugaagugccggcuccgcauggacaagcugcagcugaaggggauguccuacagcaugugcaccggcaaguucaagaucgucaaggagaucgcggagacccagcacgggaccaucgugauccgggugcaguacgagggcgacggcucccccugcaagauccccuucgagaucauggaccucgagaagcgccacguccuggggcggcugaucacggugaacccgaucgugaccgagaaggacagccccgucaacaucgaggccgagccgcccuucggcgacuccuacaucaucaucgggguggagccgggccagcucaagcugaacugguucaagaaggggagcuccaucggccagauguucgagaccaccaugcgcggcgccaagcgcauggccauccugggggacacggccugggacuucggcagccucgggggcguguucaccuccaucgggaaggcgcugcaccaggucuucggcgccaucuacggcgccgccuucagcgggguguccuggaccaugaagauccugaucggcgugaucaucaccuggaucgggaugaacagccgguccacgagccuguccgucagccucgugcuggugggcgucgugacccuguaccucggggcgauggugcaggccgacuccggcugcgucgugagcuggaagaacaaggagcugaagugcggcuccgggaucuucaucaccgacaacgugcacaccuggacggagcaguacaaguuccagcccgagagccccagcaagcuggccuccgccauccagaaggcccacgaggagggcaucugcgggauccgcagcgucacccggcucgagaaccugauguggaagcagaucacccccgagcugaaccacauccucuccgagaacgaggugaagcugaccaucaugacgggcgacaucaaggggaucaugcaggcgggcaagcgcagccugcggccgcagcccaccgagcucaaguacuccuggaagaccuggggcaaggccaagaugcugagcaccgagucccacaaccagacguuccugaucgacgggcccgagaccgccgagugcccgaacaccaaccgcgccuggaacagccucgagguggaggacuacggcuucggggucuucaccacgaacaucuggcugaagcugcgggagaagcaggacguguucugcgacuccaagcucaugagcgccgcgaucaaggacaaccgcgccgugcacgccgacaugggcuacuggaucgaguccgcccugaacggcaccuggaagauggagaaggccagcuucaucgaggucaaguccugccacuggcccaagagccacacccugugguccaacggggugcucgagagcgagaugaucauccccaagaacuucgcgggccccgugucccagcacaacuaccggccgggguaccacacccagaccgccggccccuggcaccuggggaagcuggagauggacuucgacuucugcgagggcacgaccgucguggugaccgaggacugcggcaaccgcgggcccagccuccggaccacgaccgccagcggcaagcugaucaccgaguggugcugccgcuccugcacccugcccccgcuccgguaccgcggggaggacggcugcugguacgggauggagauccggccccugaaggagaaggaggagaaccuggucaacagccucgugacggccggccacggccagaucgacaacuucucccugggggugcugggcauggcccucuuccuggaggagaugcugcgcacccgggucgggaccaagcacgccauccuccugguggccgugagcuucgucacccugaucacgggcaacauguccuuccgcgaccucgggcgggugaucgugauggucggcgugaccaugaccgacgacaucggcaugggggugaccuaccuggcccugcucgccgcguucaagguccgccccacguucgccgccggccugcugcuccgcaagcugaccagcaaggagcugaugauggccaccaucgggaucacccuccugucccagagcacgauccccgagaccauccuggagcucaccgacgcccuggcgcugggcaugauggugcucaagaucgugcggaacauggagaaguaccagcuggccgucaccaucauggccaucuccugcgugccgaacgccgugauccugcucaacgccuggaaggucagcugcacgauccuggcgguggucuccgugagcccccugcuccugaccuccagccagcagaagaccgacuggaucccccuggcccucaccaucaagggccugaaccccacggccaucuuccugaccacccucucccgcaccagcaagaagcgguccuggccgcugaacgaggccgugauggcggucgggauggugagcauccuggccuccagccuccugaagaacgacauccccaugacgggcccccugguggccgggggccuccugaccgucugcuacgugcugaccgggcgcagcgccgaccucgagcuggagcgggccgcggacgugaagugggaggaccaggccgagaucuccggcagcucccccauccugagcaucaccaucuccgaggacggcagcauguccaucaagaacgaggaggaggagcagacgcucaccauccugauccgcaccgggcugcucgucaucagcggcguguucccgguguccauccccaucaccgccgccgccugguaccugugggaggucaagaagcagcgggcgggggugcugugggacgugcccagcccgccgcccgucgagaaggccgagcucgaggacggcgccuaccgcaucaagcagcgggggauccugggcuacucccagaucggcgccgggguguacaaggagggcaccuuccacacgauguggcacgugacccgcggggccguccugaugcaccggggcaagcgcaucgagcccagcugggcggacgugaagaaggaccucaucuccuacgggggcggcuggaagcuggagggggaguggaaggagggcgaggaggugcagguccuggcccucgagcccgggaagaacccccgggccgugcagaccaagcccggccuguucaagaccaacacggggaccaucggcgccgugagccuggacuucucccccggcaccagcgggucccccaucgucgaccgcaagggcaaggugguggggcucuacggcaacggcgucgugacccggagcggggccuacguguccgcgaucgcccagacggagaaguccaucgaggacaaccccgagaucgaggacgacaucuuccgcaagaagcggcugaccaucauggaccugcaccccggcgccgggaagaccaagcgcuaccugcccgccaucguccgggaggcgaucaagcgcggccuccggacccugauccuggccccgacgcgcgugguggccgccgagauggaggaggcccuccgcgggcugcccauccgguaccagacccccgcgauccgcgccgagcacaccggccgggagaucgucgaccugaugugccacgccaccuucacgaugcgccuccugagccccgugcgggugccgaacuacaaccugaucaucauggacgaggcccacuucaccgaccccgccuccaucgcggcccgcggcuacaucagcacccgggucgagaugggggaggccgccggcaucuucaugaccgccacgccgcccgggucccgcgacccguucccccagagcaacgcgcccaucauggacgaggagcgggagauccccgagcgcuccuggaacagcggccacgagugggugaccgacuucaaggggaagaccgugugguucgucccguccaucaaggccggcaacgacaucgccgccugccuccggaagaacggcaagaaggugauccagcugagccgcaagaccuucgacuccgaguacgugaagacgcgggcgaacgacugggacuucgucgugaccaccgacaucagcgagaugggggccaacuucaaggccgagcgcgugaucgacccccggcgcugcaugaagcccgucauccugaccgacggcgaggagcgggugauccucgccgggcccaugccggugacgcacuccagcgccgcgcagcgccggggccgcgucgggcgcaaccccaagaacgagaacgaccaguacaucuacaugggcgagccccuggagaacgacgaggacugcgcccacuggaaggaggccaagaugcugcucgacaacaucaacacccccgagggcaucaucccguccauguucgagcccgagcgggagaagguggacgccaucgacggggaguaccgccugcggggcgaggcccgcaagaccuucguggaccugaugcggcgcggggaccuccccgucuggcuggcguaccggguggccgccgagggcaucaacuacgccgaccgccgguggugcuucgacgggaucaagaacaaccagauccuggaggagaacgucgagguggagaucuggaccaaggagggcgagcgcaagaagcucaagccgcgguggcuggacgcccgcaucuacagcgacccccuggcgcucaaggaguucaaggaguucgccgccggccggaagucccugacgcugaaccucaucaccgagauggggcgccugcccaccuucaugacccagaaggcccgggacgcgcuggacaaccucgccgugcugcacacggccgaggccggcgggcgcgccuacaaccacgcgcugagcgagcuccccgagacccuggagacccugcuccugcugacccuccuggccacggucaccggcggcaucuuccuguuccucauguccgggaagggcaucgggaagaugacccugggcaugugcugcaucaucaccgccagcauccugcucugguacgcccagauccagccgcacuggaucgccgcguccaucauccuggaguucuuccugaucgugcuccugauccccgagcccgagaagcagcggacgccccaggacaaccagcugacguacguggucaucgccauccucaccgugguggccgccaccauggccaacgagaugggguuccuggagaagaccaagaaggaccugggccucggcagcaucacgacccaggagagcgaguccaacauccuggacaucgaccugcgcccggcgagcgccuggacccucuacgccgucgccaccacguucgugacccccaugcugcggcacuccaucgagaacagcuccgugaacgucagccugaccgccaucgcgaaccaggccaccgugcucauggggcugggcaagggguggccccuguccaagauggacaucggcgugccccuccuggccaucgggugcuacagccaggucaacccgaucacgcugaccgccgcgcuccugcugcucguggcccacuacgccaucaucggccccggccugcaggccaaggccacccgcgaggcgcagaagcgggccgccgccgggaucaugaagaaccccaccguggacggcaucacggucaucgaccuggagcccaucccguacgaccccaaguucgagaagcagcucggccaggugaugcugcugauccucugcgugacccagguccugaugaugcgcaccaccugggcccugugcgaggcgcucacgcuggccaccggccccaucuccacccugugggaggggaaccccggccgcuucuggaacaccacgaucgccgugagcauggccaacaucuuccggggcuccuaccucgccggggcgggccugcuguucagcaucaugaagaacaccaccaacacccgccgggggacgggcaacaucggcgagacccucggggagaaguggaagucccgccugaacgcccugggcaagagcgaguuccagaucuacaagaaguccgggauccaggagguggaccggacccucgccaaggagggcaucaagcgcggggagaccgaccaccacgccgucagccggggcuccgcgaagcugcgcugguucguggagcggaacauggugacgccggagggcaaggucguggaccuggggugcggccgcgggggcuggagcuacuacugcgggggccucaagaacgugcgggaggucaagggccugaccaagggcgggcccgggcacgaggagcccauccccauguccaccuacggcuggaaccuggugcgccuccagagcgggguggacgucuucuucaccccgcccgagaagugcgacacgcugcugugcgacaucggcgagagcucccccaaccccaccaucgaggccggccggacccuccgcgugcugaaccugguggagaacuggcucaacaacaacacccaguucugcaucaagguccugaacccguacaugcccagcgugaucgagaagauggagacccugcagcggaaguacgggggcgcccuggugcgcaacccccucucccggaacagcacgcacgagauguacugggucuccaacgccaccgggaacaucgugagcuccgugaacaugaucagccgcaugcugaucaaccgguucaccaugaagcacaagaaggccaccuacgagcuggacgucgaccucggcuccgggacgcgcaacaucggcaucgagagcgagaccccgaaccuggacaucaucggcaagcgcaucgagaagaucaagcaggagcacgagaccuccuggcacuacgaccaggaccaccccuacaagaccugggcguaccacgggagcuacgagacgaagcagaccggcuccgccagcuccauggugaacggggugguccggcugcucaccaagcccugggacguggugcccauggucacccagauggccaugacggacaccaccccguucggccagcagcgcguguucaaggagaagguggacacccggacgcaggagcccaaggagggcaccaagaagcugaugcgcaucaccgccgaguggcuguggaaggagcucgggaagaagaagacgccccggaugugcacgcgcgaggaguucacccggaagguccgcagcaacgccgcgcugggcgccaucuucaccgacgagaacaaguggaaguccgcccgggaggccguggaggacagccgcuucugggagcuggucgaccgggagcgcaaccuccaccuggaggggaagugcgagaccugcguguacaacaugaugggcaagcgggagaagaagcugggggaguucggcaaggccaagggcucccgcgcgaucugguacauguggcucggggcccgguuccuggaguucgaggcccugggcuuccucaacgaggaccacugguucagccgcgggaacagccuguccggcguggagggggagggccugcaccggcucggcuacauccugcgcgacgucagcaagaaggagggcggggccauguacgcggacgacacggccgggugggacacccggaucacccuggaggaccucaagaacgaggagauggugaccaaccacaugaagggcgagcacaagaagcuggccgaggccaucuucaagcugacguaccagaacaaggugguccgcgugcagcggcccaccccgcgcgggaccgugauggacaucaucucccgccgggaccagcgcggcagcggccaggucgggaccuacggccucaacacguucaccaacauggaggcccagcugauccggcagauggagggggagggcaucuucaaguccauccagcaccugaccgugaccgaggagaucgcggugcagaacuggcucgcccgcgucggccgggagcgccugagccggauggccaucuccggggacgacugcguggugaagccccuggacgaccgcuucgccagcgcccucacggcgcugaacgacaugggcaagguccggaaggacauccagcagugggagcccucccgcggguggaacgacuggacccaggugcccuucugcagccaccacuuccacgagcuggugaugaaggacggccggguccucguggugccgugccgcaaccaggacgagcugaucgggcgggcccgcaucucccagggcgccggcuggagccugaaggagaccgccugccucgggaaguccuacgcccagauguggacccugauguacuuccaccggcgcgaccugcggcucgcggccaacgccaucugcagcgccguccccucccacugggugcccaccagccgcacgaccugguccauccacgccaagcacgaguggaugaccaccgaggacaugcuggcgguguggaaccgggucuggauccaggagaaccccuggauggaggacaagacgccgguggagagcugggaggaggugcccuaccugggcaagcgcgaggaccaguggugcgggagccucaucggccugaccucccgcgccaccugggccaagaacauccagaccgccaucaaccagguccggagccugaucgggaacgaggaguacacggacuacaugcccuccaugaagcgcuuccggcgcgaggaggaggaggcgggcgugcucugguga

SEQ ID NO: 9013 - RNA, 9876 nt, Artificial Sequence
  derived and/or modified CDS sequence (opt1) from DENV-2__JX669486__SS-prME
accgcgggcgugaucaucaugcugauccccaccgccauggcguuccaccucaccacccgcaacggggagccccacaugaucgucggccggcaggagaaggggaagucccugcuguucaagaccgaggacggcgugaacaugugcacccucauggccaucgaccugggggagcugugcgaggacaccaucaccuacaagugcccccuccugcgccagaacgagcccgaggacaucgacugcuggugcaacagcaccagcaccugggugaccuacgggaccugcaccaccacgggcgagcaccggcgcgagaagcgguccgucgcccuggugccccacguggggaugggccucgagacccgcaccgagaccuggaugagcuccgagggggccuggaagcacguccagcggaucgagaccuggauccugcgccacccgggcuucgccaucauggcggccauccuggccuacaccaucgggaccacccacuuccagcgggcccucaucuucauccugcugaccgcgguggcccccagcaugaccaugcgcugcaucggcaucuccaaccgggacuucguggagggcgucagcgggggcuccuggguggacaucgugcucgagcacgggagcugcgucaccaccauggccaagaacaagcccacgcuggacuucgagcugaucaagaccgaggccaagcagcccgccacccuccgcaaguacugcaucgaggcgaagcugaccaacacgaccaccgagucccggugcccgacccagggcgagcccagccugaacgaggagcaggacaagcgcuucaucugcaagcacuccaugguggaccggggcugggggaacggcugcggccuguucggcaagggcgggaucgugacgugcgccauguucacgugcaagaagaacauggagggcaaggucgugcugcccgagaaccuggaguacaccaucgugaucacgccccacagcggggaggagcacgccgucggcaacgacacggggaagcacggcgaggagaucaagaucaccccgcaguccagcaucaccgaggccgagcucaccggguacggcaccgugacgauggagugcagcccccggaccggccuggacuucaacgagauggugcugcuccagauggaggagaaggccuggcugguccaccggcagugguuccuggaccucccccugcccuggcugccgggggcggacacccagggcagcaacuggauccagaaggagacccucgugacguucaagaacccccacgccaagaagcaggacguggucgugcuggggucccaggagggcgccaugcacaccgcccugaccggggccaccgagauccagaugagcagcggcaaccuccuguucacgggccaccugaagugccgccuccggauggacaagcugcagcugaaggggauguccuacagcaugugcaccggcaaguucaagaucgucaaggagaucgcggagacccagcacgggaccaucgugauccgcgugcaguacgagggcgacggcucccccugcaagauccccuucgagaucauggaccucgagaagcggcacguccuggggcgccugaucacggugaacccgaucgugaccgagaaggacagccccgucaacaucgaggccgagccgcccuucggcgacuccuacaucaucaucgggguggagccgggccagcucaagcugaacugguucaagaaggggagcuccaucggccagauguucgagaccaccaugcgcggcgccaagcggauggccauccugggggacacggccugggacuucggcagccucgggggcguguucaccuccaucgggaaggcgcugcaccaggucuucggcgccaucuacggcgccgccuucagcgggguguccuggaccaugaagauccugaucggcgugaucaucaccuggaucgggaugaacagccgcuccacgagccuguccgucagccucgugcuggugggcgucgugacccuguaccucggggcgauggugcaggccgacuccggcugcgucgugagcuggaagaacaaggagcugaagugcggcuccgggaucuucaucaccgacaacgugcacaccuggacggagcaguacaaguuccagcccgagagccccagcaagcuggccuccgccauccagaaggcccacgaggagggcaucugcgggauccggagcgucacccgccucgagaaccugauguggaagcagaucacccccgagcugaaccacauccucuccgagaacgaggugaagcugaccaucaugacgggcgacaucaaggggaucaugcaggcgggcaagcggagccugcgcccgcagcccaccgagcucaaguacuccuggaagaccuggggcaaggccaagaugcugagcaccgagucccacaaccagacguuccugaucgacgggcccgagaccgccgagugcccgaacaccaaccgggccuggaacagccucgagguggaggacuacggcuucggggucuucaccacgaacaucuggcugaagcugcgcgagaagcaggacguguucugcgacuccaagcucaugagcgccgcgaucaaggacaaccgggccgugcacgccgacaugggcuacuggaucgaguccgcccugaacgacaccuggaagauggagaaggccagcuucaucgaggucaaguccugccacuggcccaagagccacacccugugguccaacggcgugcucgagagcgagaugaucauccccaagaacuucgcggggcccgugucccagcacaacuaccgcccgggcuaccacacccagaccgccgggcccuggcaccugggcaagcuggagauggacuucgacuucugcgaggggacgaccgucguggugaccgaggacugcggcaaccggggccccagccuccgcaccacgaccgccagcgggaagcugaucaccgaguggugcugccgguccugcacccugcccccgcuccgcuaccggggcgaggacgggugcugguacggcauggagauccgcccccugaaggagaaggaggagaaccuggucaacagccucgugacggccgggcacggccagaucgacaacuucucccugggcgugcuggggauggcccucuuccuggaggagaugcugcggacccgcgucggcaccaagcacgccauccuccugguggccgugagcuucgucacccugaucacggggaacauguccuuccgggaccucggccgcgugauggugauggucggggugaccaugaccgacgacaucggcaugggcgugaccuaccuggcccugcucgccgcguucaagguccgccccacguucgccgccgggcugcugcuccggaagcugaccagcaaggagcugaugauggccaccaucggcaucacccuccugucccagagcacgacccccgagaccauccuggagcucaccgacgcccuggcgcuggggaugauggugcucaagaucgugcgcaacauggagaaguaccagcuggccgucacgaucaugaccauccugugcgugccgaacgccgugauccuccugaacgccuggaaggucuccugcaccauccuggccguggucagcgugagcccccuccugcugaccagcucccagcagaagacggacuggaucccccucgcgcugaccaucaagggccugaaccccaccgccaucuuccucaccacgcugagccggaccuccaagaagcgcagcuggccgcugaacgaggccgugauggccgucggcaugguguccauccucgcgagcucccugcugaagaacgacauccccaugaccgggccccucguggccggcgggcugcugaccgucugcuacgugcucacgggccggagcgccgaccuggagcuggagcgcgccgccgacgugaagugggaggaccaggcggagaucagcggguccagccccauccucuccaucaccaucagcgaggacggcuccaugagcaucaagaacgaggaggaggagcagacccugaccauccugauccggaccggccuccuggucaucuccgggguguucccggugagcauccccaucacggccgccgccugguaccugugggaggucaagaagcagcgcgccggcgugcucugggacgugcccagcccgccgcccgucgagaaggcggagcuggaggacggggccuaccggaucaagcagcgcggcauccugggguacagccagaucggcgccggcguguacaaggaggggaccuuccacaccauguggcacgugacccggggcgccguccucaugcaccgcgggaagcggaucgagcccuccugggccgacgugaagaaggaccugaucagcuacggcgggggcuggaagcuggagggcgaguggaaggagggggaggaggugcagguccucgcgcuggagcccggcaagaacccccgcgccgugcagacgaagcccgggcuguucaagaccaacaccggcaccaucggggccgugucccucgacuucagccccggcacguccggcagccccaucgucgaccggaaggggaagguggugggccuguacgggaacggcgucgugacccgcuccggcgccuacgugagcgccaucgcgcagaccgagaaguccaucgaggacaaccccgagaucgaggacgacaucuuccggaagaagcgccugaccaucauggaccugcaccccggggccggcaagacgaagcgguaccuccccgccaucguccgcgaggccaucaagcgggggcugcgcacccugauccucgcgccgacccgcgugguggccgccgagauggaggaggcccugcggggccugcccauccgcuaccagacccccgccauccgggcggagcacacggggcgcgagaucgucgaccucaugugccacgccaccuucaccaugcggcugcugagccccgugcgcgugccgaacuacaaccucaucaucauggacgaggcccacuucaccgaccccgccagcaucgccgcgcggggcuacaucuccacgcgcgucgagaugggcgaggccgccgggaucuucaugaccgccacgccgcccggcagccgggacccguucccccaguccaacgcccccaucauggacgaggagcgcgagauccccgagcggagcuggaacuccgggcacgagugggugaccgacuucaagggcaagacggugugguucgucccgagcaucaaggcggggaacgacaucgccgccugccugcgcaagaacggcaagaaggugauccagcugucccggaagaccuucgacagcgaguacgugaagacccgcgccaacgacugggacuucgucgugaccacggacaucuccgagaugggcgcgaacuuccgggccgagcgcgugaucgacccccggcgcugcaugaagcccgucauccucaccgacggggaggagcgggugauccuggccggccccaugccggugacccacagcuccgccgcccagcgccgcgggcgggucggccgcaaccccaagaacgagaacgaccaguacaucuacaugggggagccccuggagaacgacgaggacugcgcgcacuggaaggaggccaagaugcuccuggacaacaucaacacccccgagggcaucaucccgagcauguucgagcccgagcgggagaagguggacgccaucgacggcgaguaccgccugcgcggggaggcccgcaagacguucguggaccucaugcggcgcggcgaccugcccgucuggcuggccuaccggguggcggccgaggggaucaacuacgccgaccgccgguggugcuucgacggcaucaagaacaaccagauccucgaggagaacgucgagguggagaucuggaccaaggagggggagcgcaagaagcugaagccgcgguggcuggacgcccgcaucuacuccgacccccucgcccugaaggaguucaaggaguucgcggccggccggaagucccugacccucaaccugaucaccgagaugggccgccugcccacguucaugacccagaaggcccggaacgcccucgacaaccuggcggugcugcacaccgccgaggccgggggccgcgccuacaaccacgcccucuccgagcugcccgagacccuggagacgcuccugcugcucacccugcuggcgaccgucaccgggggcaucuuccucuuccugaugagcggcaaggggaucggcaagaugacccuggggaugugcugcaucaucacggccuccgugcuccugugguacgcccagauccagccgcacuggaucgccgccagcaucauccuggaguucuuccucaucgugcugcugauccccgagcccgagaagcagcggacgccccaggacaaccagcucaccuacgucgugaucgcgauccugaccguggucgccgccacgauggccaacgagaugggcuuccuggagaagaccaagaaggaccucgggcugggcuccaucaccacccaggagagcgagagcaacauccuggacaucgaccuccgcccggccuccgcguggacgcuguacgccguggccaccaccuucgugacccccaugcugcggcacagcaucgagaacuccagcgucaacgugucccucacggccaucgccaaccaggcgaccgugcugaugggccuggggaagggcuggccccucagcaagauggacaucggggucccccugcuggccaucggcugcuacucccaggugaacccgaucacccucaccgccgcccugcugcuccugguggcgcacuacgccaucaucgggcccggccugcaggccaaggccacgcgcgaggcccagaagcgcgcggccgccggcaucaugaagaaccccaccgucgacgggaucaccgugguggaccucgagcccaucccguacgaccccaaguucgagaagcagcugggccaggucaugcugcucauccugugcgugacccaggugcugaugaugcggacgaccugggcccucugcgaggcccugacccuggcgaccgggcccaucagcacgcucugggagggcaaccccgggcgcuucuggaacaccaccaucgccgucuccauggccaacaucuuccggggcagcuaccuggccggcgccgggcuccucuucuccaucaugaagaacaccacgaacacccgccggggcaccgggaacaucggcgagacccugggcgagaaguggaagucccgccugaacgcgcucgggaaguccgaguuccagaucuacaagcggagcggcauccaggagguggaccgcacgcuggccaaggaggggaucaagcggggcgagaccgaccaccacgccgugucccgcgggagcgccaagcugcggugguucgucgagcgcaacauggugaccccggagggcaagguggucgaccucggcugcgggcggggcgggugguccuacuacugcggcgggcugaagaacgugcgcgaggugaagggccugaccaagggcgggcccggccacgaggagcccauccccaugagcacguacggguggaaccucguccggcugcaguccggcguggacguguucuucaccccgcccgagaagugcgacacccugcucugcgacaucggggagagcagccccaaccccaccaucgaggcgggccgcacccugcggguccugaaccucguggagaacuggcugaacaacaacacgcaguucugcaucaaggugcugaacccguacaugcccuccgucaucgagaagauggagacccugcagcgcaaguacggcggggcccucgugcggaacccccugagccgcaacuccacccacgagauguacugggugagcaacgccaccggcaacaucgucuccagcgugaacaugaucucccgcaugcugaucaaccgguucacgaugaagcacaagaaggccaccuacgagccggacguggaccucgggagcggcacccgcaacaucgggaucgaguccgagauccccaaccuggacaucaucggcaagcggaucgagaagaucaagcaggagcacgagaccagcuggcacuacgaccaggaccaccccuacaagacgugggccuaccacggcuccuacgagaccaagcagaccgggagcgcguccagcauggucaacggcguggugcgccugcucaccaagcccugggacgucgugccgauggugacgcagauggccaugaccgacaccacccccuucgggcagcagcgggucuucaaggagaagguggacacgcgcacccaggagcccaaggagggcaccaagaagcugaugcggaucaccgccgaguggcuguggaaggagcucggcaagaagaagacgccccgcaugugcacccgggaggaguucacccgcaagguccgguccaacgccgcccugggggcgaucuucaccgacgagaacaaguggaaguccgcccgcgaggccguggaggacucccgguucugggagcugguggaccgcgagcggaaccuccaccuggagggcaagugcgagacgugcgucuacaacaugauggggaagcgcgagaagaagcugggcgaguucgggaaggccaagggcagccgggccaucugguacauguggcucggcgcgcgcuuccuggaguucgaggcccugggguuccucaacgaggaccacugguucucccggggcaacagccugagcgggguggagggcgaggggcugcaccgccucggcuacauccugcgggacguguccaagaaggagggcggggccauguacgccgacgacaccgcgggcugggacacccgcaucacccuggaggaccucaagaacgaggagauggucacgaaccacaugaagggggagcacaagaagcuggccgaggccguguucaagcugaccuaccagaacaaggugguccgcgugcagcggccgacgccccgcggcaccgugauggacaucaucagccggcgcgaccagcggggguccggccaggucggcacguacgggcucaacaccuucaccaacauggaggcccagcugauccgccagauggagggcgaggggaucuucaagagcauccagcaccugaccgugacggaggagaucgccgugcagaacuggcucgcgcgggucggccgcgagcggcugucccgcauggccaucagcggcgacgacugcguggugaagccccuggacgaccgguucgccuccgcccucaccgcccugaacgacauggggaagguccgcaaggacauccagcagugggagcccagccggggcuggaacgacuggacccaggugccguucugcucccaccacuuccacgagcuggugaugaaggacgggcgcguccucguggugcccugccggaaccaggacgagcugaucggccgcgcgcggaucagccagggggccggcuggucccugaaggagaccgccugccucggcaagagcuacgcccagauguggacccugauguacuuccaccgccgggaccugcgccucgccgcgaacgccaucugcuccgccguccccagccacugggugcccacgucccgcaccaccuggagcauccacgccaagcacgaguggaugaccacggaggacaugcuggccguguggaaccgggucuggauccaggagaacccguggauggaggacaagacccccguggaguccugggaggaggugcccuaccuggggaagcgcgaggaccaguggugcggcagccucaucgggcugaccagccgggcgaccugggccaagaacauccagacggccaucaaccagguccgcucccugaucggcaacgaggaguacaccgacuacaugcccagcaugaagcgguuccgccgggaggaggaggaggccggggugcucugguga

SEQ ID NO: 9014 - RNA, 9876 nt, Artificial Sequence
  derived and/or modified CDS sequence (opt1) from DENV-2__JX669487__SS-prME
accgcgggcgugaucaucaugcugauccccaccgcgauggcguuccaccucaccacccgcaacggggagccccacaugaucgucggccggcaggagaaggggaagucccugcuguucaagaccgaggacggcgugaacaugugcacccucauggccaucgaccugggggagcugugcgaggacaccaucaccuacaagugcccccuccugcgccagaacgagcccgaggacaucgacugcuggugcaacagcaccagcaccugggugaccuacgggaccugcaccaccacgggcgagcaccggcgcgagaagcgguccgucgcccuggugccccacguggggaugggccucgagacccgcaccgagaccuggaugagcuccgagggggccuggaagcacguccagcggaucgagaccuggauccugcgccacccgggcuucgccaucauggcggccauccuggccuacaccaucgggaccacccacuuccagcgggcccucaucuucauccugcugacggcgguggcccccagcaugaccaugcgcugcaucggcaucuccaaccgggacuucguggagggcgucagcgggggcuccuggguggacaucgugcucgagcacgggagcugcgucaccaccauggccaagaacaagcccacgcuggacuucgagcugaucaagaccgaggccaagcagcccgccacccuccgcaaguacugcaucgaggcgaagcugaccaacacgaccaccgagucccggugcccgacccagggcgagcccagccugaacgaggagcaggacaagcgcuucaucugcaagcacuccaugguggaccggggcugggggaacggcugcggccucuucggcaagggcgggaucgugacgugcgccauguucacgugcaagaagaacauggagggcaaggucgugcugcccgagaaccuggaguacaccaucaugaucacgccccacagcggggaggagcacgccgugggcaacgacacggggaagcacggcaaggagaucaagaucaccccgcaguccagcaucaccgaggccgagcucaccggguacggcaccgucacgauggagugcagcccccgcaccggccuggacuucaacgagauggugcugcuccagauggaggagaaggccuggcuggugcaccggcagugguuccuggaccucccccugcccuggcugccgggggcggacacccagggcagcaacuggauccagaaggagacccucgucacguucaagaacccccacgccaagaagcaggacguggugguccuggggucccaggagggcgccaugcacaccgcccugaccggggccaccgagauccagaugagcagcggcaaccuccuguucacgggccaccugaagugccgccuccggauggacaagcugcagcugaaggggauguccuacagcaugugcaccggcaaguucaagaucgugaaggagaucgcggagacccagcacgggaccaucgucauccgcgugcaguacgagggcgacggcucccccugcaagauccccuucgagaucauggaccucgagaagcggcacgugcuggggcgccugaucacggucaacccgaucgugaccgagaaggacagccccgugaacaucgaggccgagccgcccuucggcgacuccuacaucaucaucggggucgagccgggccagcucaagcugaacugguucaagaaggggagcuccaucggccagauguucgagaccaccaugcgcggcgccaagcggauggccauccugggggacacggccugggacuucggcagccucgggggcguguucaccuccaucgggaaggcgcugcaccagguguucggcgccaucuacggcgccgccuucagcggggucuccuggaccaugaagauccugaucggcgugaucaucaccuggaucgggaugaacagccgcuccacgagccuguccgugagccucguccuggugggcguggucacccuguaccucggggcgauggugcaggccgacuccggcugcguggucagcuggaagaacaaggagcugaagugcggcuccgggaucuucaucaccgacaacgugcacaccuggacggagcaguacaaguuccagcccgagagccccagcaagcuggccuccgccauccagaaggcccacgaggagggcaucugcgggauccggagcgugacccgccucgagaaccugauguggaagcagaucacccccgagcugaaccacauccucuccgagaacgaggucaagcugaccaucaugacgggcgacaucaaggggaucaugcaggcgggcaagcggagccugcgcccgcagcccaccgagcucaaguacuccuggaagaccuggggcaaggccaagaugcugagcaccgagucccacaaccagacguuccugaucgacgggcccgagaccgccgagugcccgaacaccaaccgggccuggaacagccucgagguggaggacuacggcuucgggguguucaccacgaacaucuggcugaagcugcgcgagaagcaggacgucuucugcgacuccaagcucaugagcgccgcgaucaaggacaaccgggccgugcacgccgacaugggcuacuggaucgaguccgcccugaacgacaccuggaagauggagaaggccagcuucaucgaggugaaguccugccacuggcccaagagccacacccugugguccaacggcguccucgagagcgagaugaucauccccaagaacuucgcggggcccgugucccagcacaacuaccgcccgggcuaccacacccagaccgccgggcccuggcaccugggcaagcuggagauggacuucgacuucugcgaggggacgaccguggucgugaccgaggacugcggcaaccggggccccagccuccgcaccacgaccgccagcgggaagcugaucaccgaguggugcugccgguccugcacccugcccccgcuccgcuaccggggcgaggacgggugcugguacggcauggagauccgcccccugaaggagaaggaggagaaccuggugaacagccucgucacggccgggcacggccagaucgacaacuucucccugggcgugcuggggauggcccucuuccuggaggagaugcugcggacccgcgugggcaccaagcacgccauccuccuggucgccgugagcuucgugacccugaucacggggaacauguccuuccgggaccucggccgcgucauggugauggugggggucaccaugaccgacgacaucggcaugggcgugaccuaccuggcccugcucgccgcguucaaggugcgccccacguucgccgccgggcugcugcuccggaagcugaccagcaaggagcugaugauggccaccaucggcaucgcccuccugucccagagcaccauccccgagacgauccuggagcucaccgacgcgcuggcccuggggaugaugguccuccgcaucgugcggaacauggagaaguaccagcuggccgugaccaucauggccaucuccugcgucccgaacgccgugauccugcucaacgcguggaaggugagcugcaccauccuggccgccgucuccgugagcccccugcuccugacguccagccagcagaagaccgacuggaucccccuggcccucaccaucaagggccugaaccccaccgcgaucuuccugacgacccucucccgcaccagcaagaagcgguccuggccgcugaacgaggccgucauggccgugggcauggugagcauccuggccuccagccuccugaagaacgacauccccaugaccgggccccuggucgccggcgggcuccugacggugugcuacgugcugaccggccgcagcgcggaccucgagcuggagcgggccgccgacgucaagugggaggaccaggccgagaucuccgggagcucccccauccugagcaucaccaucuccgaggacggcagcauguccaucaagaacgaggaggaggagcagacccucacgauccugauccgcaccggccugcucgugaucagcgggguguucccggucuccauccccaucaccgccgcggccugguaccugugggaggugaagaagcagcgggccggcgugcugugggacguccccagcccgccgcccguggagaaggccgagcucgaggacggggccuaccgcaucaagcagcggggcauccugggguacucccagaucggcgcgggcguguacaaggaggggaccuuccacaccauguggcacgucacgcgcggcgccgugcugaugcaccgggggaagcgcaucgagcccagcugggccgacgugaagaaggaccucaucuccuacggcgggggcuggaagcuggagggcgaguggaaggagggggaggagguccaggugcuggcccucgagcccggcaagaacccccgggccgugcagaccaagcccgggcuguucaagaccaacaccggcacgaucggggcgaucagccuggacuucucccccggcaccagcggcucccccaucgucgaccgcaaggggaagguggugggccucuacgggaacggcgucgugacccggagcggcgccuacguguccgccaucgcccagaccgagaaguccaucgaggacaaccccgagaucgaggacgacaucuuccgcaagaagcggcugacgaucauggaccugcaccccggggcgggcaagaccaagcgcuaccugcccgccaucguccgggaggccaucaagcgcgggcuccgcacccugauccuggccccgacccgggugguggccgcggagauggaggaggcccuccgcggccugcccauccgguaccagacgcccgccauccgcgccgagcacaccgggcgggagaucgucgaccugaugugccacgccaccuucaccaugcgccuccugagccccgugcgggugccgaacuacaaccugaucaucauggacgaggcgcacuucacggaccccgccuccaucgccgcccgcggcuacaucagcacccgggucgagaugggcgaggccgcggggaucuucaugaccgccacgccgcccggcucccgcgacccguucccccagagcaacgcccccaucauggacgaggagcgggagauccccgagcgcuccuggaacagcgggcacgagugggugacggacuucaagggcaagaccgugugguucgucccguccaucaaggccgggaacgacaucgcggccugccuccggaagaacggcaagaaggugauccagcugagccgcaagaccuucgacuccgaguacgugaagacccgggccaacgacugggacuucgucgugacgaccgacaucagcgagaugggcgccaacuuccgcgccgagcgggugaucgacccccgccggugcaugaagcccgucauccugaccgacggggaggagcgcgugauccucgcgggccccaugccggugacccacuccagcgccgcccagcgccgggggcgcaucggccggaaccccaagaacgagaacgaccaguacaucuacaugggggagccccuggagaacgacgaggacugcgcccacuggaaggaggccaagaugcugcucgacaacaucaacacgcccgagggcaucaucccguccauguucgagcccgagcgcgagaaggucgacgcgaucgacggcgaguaccggcugcgcggggaggcccggaagaccuucguggaccugaugcgccggggcgaccuccccguguggcuggccuaccgcgucgccgccgaggggaucaacuacgcggaccggcgcuggugcuucgacggcaucaagaacaaccagauccuggaggagaacguggagguggagaucuggaccaaggagggggagcggaagaagcucaagccgcgcuggcuggacgcccggaucuacagcgacccccuggcccucaaggaguucaaggaguucgccgcgggccgcaagucccugacccugaaccucaucacggagaugggccggcugcccaccuucaugacccagaaggcccgcgacgcccuggacaaccucgccguccugcacaccgccgaggccggcgggcgggccuacaagcacgcccugagcgagcuccccgagacgcuggagacccugcuccugcugacccuccuggccaccgugaccggcgggaucuuccuguuccucauguccgggaaggggaucggcaagaugacccuggggaugugcugcaucaucaccgccagcauccugcucugguacgcgcagauccagccgcacuggaucgccgccuccaucauccuggaguucuuccugaucguccuccugauccccgagcccgagaagcagcgcacgccccaggacaaccagcugaccuacguggugaucgccauccucacggucguggccgcgaccauggccaacgagaugggcuuccuggagaagaccaagaaggaccuggggcucggcagcaucaccacgcaggagagcgaguccaacauccuggacaucgaccugcggccggccagcgccuggacccucuacgccguggcgaccaccuucgucacgcccaugcugcgccacuccaucgagaacagcuccgugaacgugagccugaccgccaucgccaaccaggccaccguccucaugggccuggggaagggcuggccccuguccaagauggacaucggggugccccuccuggcgaucggcugcuacagccaggugaacccgaucacccugacggccgcccuccugcugcucgucgcccacuacgccaucaucgggcccggccugcaggcgaaggccacccgcgaggcccagaagcgggccgccgcgggcaucaugaagaaccccaccguggacgggaucaccgugaucgaccuggagcccaucccguacgaccccaaguucgagaagcagcucggccaggucaugcugcugauccucugcgugacccaggugcugaugaugcgcaccaccugggcccugugcgaggcccucacccuggccacggggcccaucuccacccugugggagggcaaccccgggcgguucuggaacaccaccaucgccgucagcauggcgaacaucuuccgcggcuccuaccucgccggcgccgggcugcuguucagcaucaugaagaacacgaccaacacccggcgcggcaccgggaacaucggcgagacgcucggcgagaaguggaagucccggcugaacgcccugggcaagagcgaguuccagaucuacaagaaguccggcauccaggagguggaccgcacccucgcgaaggaggggaucaagcggggcgagaccgaccaccacgccgugagccgcggguccgccaagcugcggugguucgucgagcgcaacauggugaccccggagggcaagguggucgaccugggcugcgggcggggcggguggagcuacuacugcggcgggcucaagaacgugcgcgaggugaagggccugacgaagggcgggcccggccacgaggagcccauccccauguccaccuacggguggaaccugguccggcuccagagcggcguggacguguucuucaccccgcccgagaagugcgacacccugcugugcgacaucggggagagcucccccaaccccacgaucgaggccggccgcacccuccggguccugaaccuggccgagaacuggcucaacaacaacacccaguucugcaucaaggugcugaacccguacaugcccagcgugaucgagaagauggagacccugcagcgcaaguacggcggggcgcugguccggaacccccucucccgcaacagcacccacgagauguacuggguguccaacgccacgggcaacaucgugagcuccgucaacaugaucagccgcaugcugaucaaccgguucaccaugaagcacaagaaggccaccuacgagccggacguggaccugggguccggcacccgcaacaucgggaucgagagcgagauccccaaccucgacaucaucggcaagcggaucgagaagaucaagcaggagcacgagacguccuggcacuacgaccaggaccaccccuacaagaccugggccuaccacggcagcuacgagaccaagcagaccggguccgccagcuccauggugaacggcgucgugcgccugcugacgaagcccugggacguggucccgauggugacccagauggcgaugaccgacaccacgcccuucgggcagcagcggguguucaaggagaaggucgacacccgcacccaggagcccaaggagggcaccaagaagcucaugcggaucacggccgaguggcuguggaaggagcugggcaagaagaagacgccccgcaugugcacccgggaggaguucacccgcaaggugcggagcaacgccgcccucggggccaucuucacggacgagaacaaguggaaguccgcgcgcgaggccguggaggacagccgguucugggagcuggucgaccgcgagcggaaccugcaccucgagggcaagugcgagaccugcguguacaacaugauggggaagcgcgagaagaagcugggcgaguucgggaaggccaagggcucccgggccaucugguacauguggcugggcgcgcgcuuccucgaguucgaggcccugggguuccugaacgaggaccacugguucagccggggcaacagccucuccgggguggagggcgaggggcugcaccgccugggcuacauccuccgggacgucagcaagaaggagggcggggccauguacgccgacgacaccgccggcugggacacccgcaucacgcuggaggaccugaagaacgaggagauggugaccaaccacaugaagggggagcacaagaagcucgcggaggccaucuucaagcugaccuaccagaacaaggucgugcgcgugcagcggccgacgccccgcggcacggucauggacaucaucucccggaaggaccagcgcgggagcggccaggugggcaccuacgggcugaacaccuucaccaacauggaggcccagcucauccggcagauggagggcgaggggaucuucaaguccauccagcaccugacggugaccgaggagaucgccguccagaacuggcuggcccgcgugggccgggagcgccucagccggauggcgaucuccggcgacgacugcguggucaagccccuggacgaccgcuucgccagcgcccugaccgcccucaacgacauggggaaggugcggaaggacauccagcagugggagcccucccgcggcuggaacgacuggacccaggugccguucugcagccaccacuuccacgagcuggucaugaaggacgggcgggugcuggugguccccugccgcaaccaggacgagcucaucggccgggcccgcaucucccagggggcgggcuggagccugaaggagacggccugccugggcaaguccuacgcccagauguggacccucauguacuuccaccggcgcgaccugcggcuggccgccaacgcgaucugcagcgccgugcccucccacugggugcccaccagccgcaccaccugguccauccacgccaagcacgaguggaugacgaccgaggacaugcucgccgucuggaaccgcguguggauccaggagaacccguggauggaggacaagacccccguggagagcugggaggagguccccuaccuggggaagcgggaggaccaguggugcggcagccugaucgggcucaccucccgcgcgacgugggccaagaacauccagaccgccaucaaccaggugcggagccugaucggcaacgaggaguacaccgacuacaugcccuccaugaagcgcuuccggcgcgaggaggaggaggccggggugcugugguga

SEQ ID NO: 9015 - RNA, 9876 nt, Artificial Sequence
  derived and/or modified CDS sequence (opt1) from DENV-2__JX669488__SS-prME
accgcgggcgugaucaucaugcugauccccaccgccauggcguuccaccucaccacccgcaacggggagccccacaugaucgucggccggcaggagaaggggaagucccugcuguucaagaccgaggacggcgugaacaugugcacccucauggccaucgaccugggggagcugugcgaggacaccaucaccuacaagugcccccuccugcgccagaacgagcccgaggacaucgacugcuggugcaacagcaccagcaccugggugaccuacgggaccugcaccaccacgggcgagcaccggcgcgagaagcgguccgucgcccuggugccccacguggggaugggccucgagacccgcaccgagaccuggaugagcuccgagggggccuggaagcacguccagcggaucgagacguggauccugcgccacccgggcuucgccaucauggcggccauccuggccuacaccaucgggaccacccacuuccagcgggcccucaucuucauccugcugacggcgguggcccccagcaugaccaugcgcugcaucggcaucuccaaccgggacuucguggagggcgucagcgggggcuccuggguggacaucgugcucgagcacgggagcugcgucaccaccauggccaagaacaagcccacgcuggacuucgagcugaucaagaccgaggccaagcagcccgccacccuccgcaaguacugcaucgaggcgaagcugaccaacacgaccaccgagucccggugcccgacccagggcgagcccagccugaacgaggagcaggacaagcgcuucaucugcaagcacuccaugguggaccggggcugggggaacggcugcggccucuucggcaagggcgggaucgugacgugcgccauguucacgugcaagaagaacauggagggcaaggucgugcugcccgagaaccuggaguacaccaucgugaucacgccccacagcggggaggagcacgccgucggcaacgacacggggaagcacggcaaggagaucaagaucaccccgcaguccagcaucaccgaggccgagcucaccggguacggcaccgugacgauggagugcagcccccgcaccggccuggacuucaacgagauggugcugcuccagauggaggagaaggccuggcugguccaccggcagugguuccuggaccucccccugcccuggcugccgggggcggacacccagggcagcaacuggauccagaaggagacccucgugacguucaagaacccccacgccaagaagcaggacguggucgugcuggggucccaggagggcgccaugcacaccgcccugaccggggccaccgagauccagaugagcagcggcaaccuccuguucacgggccaccugaagugccgccuccggauggacaagcugcagcugaaggggauguccuacagcaugugcaccggcaaguucaagaucgucaaggagaucgcggagacccagcacgggaccaucgugauccgcgugcaguacgagggcgacggcucccccugcaagauccccuucgagaucauggaccucgagaagcggcacguccuggggcgccugaucacggugaacccgaucgugaccgagaaggacagccccgucaacaucgaggccgagccgcccuucggcgacuccuacaucaucaucgggguggagccgggccagcucaagcugaacugguucaagaaggggagcuccaucggccagauguucgagaccaccaugcgcggcgccaagcggauggccauccugggggacacggccugggacuucggcagccucgggggcguguucaccuccaucgggaaggcgcugcaccaggucuucggcgccaucuacggcgccgccuucagcgggguguccuggaccaugaagauccugaucggcgugaucaucaccuggaucgggaugaacagccgcuccacgagccuguccgucagccucgugcuggugggcgucgugacccuguaccucggggcgauggugcaggccgacuccggcugcgucgugagcuggaagaacaaggagcugaagugcggcuccgggaucuucaucaccgacaacgugcacaccuggacggagcaguacaaguuccagcccgagagccccagcaagcuggccuccgccauccagaaggcccacgaggagggcaucugcgggauccggagcgucacccgccucgagaaccugauguggaagcagaucacccccgagcugaaccacauccucuccgagaacgaggugaagcugaccaucaugacgggcgacaucaaggggaucaugcaggcgggcaagcggagccugcgcccgcagcccaccgagcucaaguacuccuggaagaccuggggcaaggccaagaugcugagcaccgagucccacaaccagacguuccugaucgacgggcccgagaccgccgagugcccgaacaccaaccgggccuggaacagccucgagguggaggacuacggcuucggggucuucaccacgaacaucuggcugaagcugcgcgagaagcaggacguguucugcgacuccaagcucaugagcgccgcgaucaaggacaaccgggccgugcacgccgacaugggcuacuggaucgaguccgcccugaacgacaccuggaagauggagaaggccagcuucaucgaggucaaguccugccacuggcccaagagccacacccugugguccaacggcgugcucgagagcgagaugaucauccccaagaacuucgcggggcccgugucccagcacaacuaccgcccgggcuaccacacccagaccgccgggcccuggcaccugggcaagcuggagauggacuucgacuucugcgaggggacgaccgucguggugaccgaggacugcggcaaccggggccccagccuccgcaccacgaccgccagcgggaagcugaucaccgaguggugcugccgguccugcacccugcccccgcuccgcuaccggggcgaggacgggugcugguacggcauggagauccgcccccugaaggagaaggaggagaaccuggucaacagccucgugacggccgggcacggccagaucgacaacuucucccugggcgugcuggggauggcccucuuccuggaggagaugcugcggacccgcgucggcaccaagcacgccauccuccugguggccgccagcuucgugacccugaucacggggaacauguccuuccgggaccucggccgcgucauggugauggugggggccaccaugaccgacgacaucggcaugggcgucaccuaccuggcgcugcucgccgccuucaaggugcgccccacguucgccgccgggcugcugcuccggaagcugaccagcaaggagcugaugauggcgaccaucggcaucgcccuccugucccagagcaccauccccgagacgauccuggagcucaccgacgcccuggcccuggggaugauggugcuccgcaucguccggaacauggagaaguaccagcuggccgugaccaucauggcgaucuccugcgugccgaacgccgucauccugcucaacgccuggaaggugagcugcaccauccuggccgcgguguccgucagcccccugcuccugacguccagccagcagaagaccgacuggaucccccuggcccucaccaucaagggccugaaccccaccgccaucuuccugacgacccucucccgcaccagcaagaagcgguccuggccgcugaacgaggccgugauggccgucggcauggugagcauccuggcguccagccuccugaagaacgacauccccaugaccgggccccugguggccggcgggcuccugacggucugcuacgugcugaccggccgcagcgccgaccucgagcuggagcgggccgccgacgugaagugggaggaccaggcggagaucuccgggagcucccccauccugagcaucaccaucuccgaggacggcagcauguccaucaagaacgaggaggaggagcagacccucacgauccugauccgcaccggccugcucgucaucagcgggguguucccgguguccauccccaucaccgccgccgccugguaccugugggaggucaagaagcagcgggccggcgugcugugggacgugcccagcccgccgcccgucgagaaggcggagcucgaggacggggccuaccgcaucaagcagcggggcauccugggguacucccagaucggcgccggcguguacaaggaggggaccuuccacaccauguggcacgugacgcgcggcgccguccugaugcaccgggggaagcgcaucgagcccagcugggccgacgugaagaaggaccucaucuccuacggcgggggcuggaagcuggagggcgaguggaaggagggggaggaggugcagguccuggcgcucgagcccggcaagaacccccgggccgugcagaccaagcccgggcuguucaagaccaacaccggcacgaucggggccaucagccuggacuucucccccggcaccagcggcucccccaucguggaccgcaaggggaaggucgugggccucuacgggaacggcguggucacccggagcggcgccuacguguccgcgaucgcccagaccgagaaguccaucgaggacaaccccgagaucgaggacgacaucuuccgcaagaagcggcugacgaucauggaccugcaccccggggccggcaagaccaagcgcuaccugcccgccaucgugcgggaggccaucaagcgcgggcuccgcacccugauccuggcgccgacccgggucguggccgccgagauggaggaggcccuccgcggccugcccauccgguaccagacgcccgccauccgcgcggagcacaccgggcgggagaucguggaccugaugugccacgccaccuucaccaugcgccuccugagccccguccgggugccgaacuacaaccugaucaucauggacgaggcccacuucacggaccccgccuccaucgccgcgcgcggcuacaucagcacccggguggagaugggcgaggccgccgggaucuucaugaccgccacgccgcccggcucccgcgacccguucccccagagcaacgcgcccaucauggacgaggagcgggagauccccgagcgcuccuggaacagcgggcacgagugggucacggacuucaagggcaagaccgugugguucgugccguccaucaaggccgggaacgacaucgccgccugccuccggaagaacggcaagaaggucauccagcugagccgcaagaccuucgacuccgaguacgugaagacccgggccaacgacugggacuucguggucacgaccgacaucagcgagaugggcgcgaacuuccgcgccgagcgggugaucgacccccgccggugcaugaagcccgugauccugaccgacggggaggagcgcgucauccucgccggccccaugccggugacccacuccagcgccgcccagcgccgggggcgcaucggccggaaccccaagaacgagaacgaccaguacaucuacaugggggagccccuggagaacgacgaggacugcgcgcacuggaaggaggccaagaugcugcucgacaacaucaacacgcccgagggcaucaucccguccauguucgagcccgagcgcgagaagguggacgccaucgacggcgaguaccggcugcgcggggaggcccggaagaccuucgucgaccugaugcgccggggcgaccuccccguguggcuggccuacaagguggcggccgaggggaucaacuacgccgaccgccgguggugcuucgacggcaucaagaacaaccagauccuggaggagaacgucgagguggagaucuggaccaaggagggggagcgcaagaagcucaagccgcgguggcuggacgcccgcaucuacagcgacccccuggcgcucaaggaguucaaggaguucgccgccggccggaagucccugacccugaaccucaucacggagaugggccgccugcccaccuucaugacccagaaggcccgggacgcccuggacaaccucgcggugcugcacaccgccgaggccgggggccgcgccuacaagcacgcccugagcgagcuccccgagacgcuggagacccugcuccugcugacccuccuggcgaccgucaccggcgggaucuuccuguuccucauguccgggaaggggaucggcaagaugacccuggggaugugcugcaucaucaccgccagcauccugcucugguacgcccagauccagccgcacuggaucgccgccuccaucauccuggaguucuuccugaucgugcuccugauccccgagcccgagaagcagcggacgccccaggacaaccagcugaccuacgucgugaucgcgauccucacgguggucgccgccaccauggccaacgagaugggcuuccuggagaagaccaagaaggaccuggggcucggcagcaucaccacgcaggagagcgaguccaacauccuggacaucgaccugcgcccggccagcgcguggacccucuacgccguggccaccaccuucgugacgcccaugcugcggcacuccaucgagaacagcuccgucaacgugagccugaccgccaucgcgaaccaggccaccgugcucaugggccuggggaagggcuggccccuguccaagauggacaucggggucccccuccuggccaucggcugcuacagccaggugaacccgaucacccugacggccgcccuccugcugcucguggcgcacuacgccaucaucgggcccggccugcaggccaaggccacccgcgaggcccagaagcgcgcggccgccggcaucaugaagaaccccaccgucgacgggaucaccgugaucgaccuggagcccaucccguacgaccccaaguucgagaagcagcucggccaggugaugcugcugauccucugcgucacccaggugcugaugaugcggaccaccugggcccugugcgaggcccucacccuggcgacggggcccaucuccacccugugggagggcaaccccgggcgcuucuggaacaccaccaucgccgugagcauggccaacaucuuccggggcuccuaccucgccggcgcggggcugcuguucagcaucaugaagaacacggccaacacccgccggggcaccgggaacaucggcgagacccucggcgagaaguggaagucccgccugaacgcccugggcaagagcgaguuccagaucuacaagaaguccggcauccaggaggucgaccggacgcucgccaaggaggggaucaagcgcggcgagaccgaccaccacgccgugagccggggguccgcgaagcugcgcugguucguggagcggaacauggucaccccggagggcaaggugguggaccugggcugcgggcgcggcggguggagcuacuacugcggcgggcucaagaacguccgggaggugaagggccugaccaagggcgggcccggccacgaggagcccauccccauguccacguacggguggaaccuggugcgccuccagagcggcgucgacguguucuucaccccgcccgagaagugcgacacccugcugugcgacaucggggagagcucccccaaccccaccaucgaggccggccggacgcuccgcgugcugaaccuggccgagaacuggcucaacaacaacacccaguucugcaucaagguccugaacccguacaugcccagcgugaucgagaagauggagacccugcagcggaaguacggcggggcccuggugcgcaacccccucucccggaacagcacccacgagauguacugggucuccaacgccaccggcaacaucgugagcuccgugaacaugaucagccgcaugcugaucaaccgcuucacgaugaagcacaagaaggcgaccuacgagccggacgucgaccugggguccggcacccggaacaucgggaucgagagcgagauccccaaccucgacaucaucggcaagcgcaucgagaagaucaagcaggagcacgagaccuccuggcacuacgaccaggaccaccccuacaagacgugggccuaccacggcagcuacgagaccaagcagaccggguccgccagcuccauggugaacggcgugguccggcugcugaccaagcccugggacguggugccgauggucacgcagauggccaugaccgacaccacccccuucgggcagcagcgcguguucaaggagaagguggacacgcggacccaggagcccaaggagggcaccaagaagcucaugcgcaucaccgccgaguggcuguggaaggagcugggcaagaagaagacgccccggaugugcacccgcgaggaguucacccggaagguccgcagcaacgcggcccucggggccaucuucaccgacgagaacaaguggaaguccgcccgggaggcgguggaggacagccgcuucugggagcugguggaccgggagcgcaaccugcaccucgagggcaagugcgagacgugcgucuacaacaugauggggaagcgggagaagaagcugggcgaguucgggaaggccaagggcucccgcgccaucugguacauguggcugggcgcccgguuccucgaguucgaggcccugggguuccugaacgaggaccacugguucagccgcggcaacagccucuccgggguggagggcgaggggcugcaccggcugggcuacauccuccgcgacgugagcaagaaggagggcggggcgauguacgccgacgacaccgccggcugggacacccggaucacccuggaggaccugaagaacgaggagauggucacgaaccacauggagggggagcacaagaagcucgccgaggccaucuucaagcugaccuaccagaacaaggugguccgcgugcagcgcccgacgccccggggcaccgugauggacaucaucucccgcaaggaccagcgggggagcggccaggucggcacguacgggcugaacaccuucaccaacauggaggcgcagcucauccgccagauggagggcgaggggaucuucaaguccauccagcaccugaccgugacggaggagaucgccgugcagaacuggcuggcccgggucggccgcgagcggcucagccgcauggccaucuccggcgacgacugcguggugaagccccuggacgaccgguucgccagcgcgcugaccgcccucaacgacauggggaagguccgcaaggacauccagcagugggagcccucccggggcuggaacgacuggacccaggugccguucugcagccaccacuuccacgagcuggugaugaaggacgggcgcguccugguggugcccugccggaaccaggacgagcucaucggccgcgcccggaucucccagggggccggcuggagccugaaggagaccgccugccugggcaaguccuacgcgcagauguggacgcucauguacuuccaccgccgggaccugcgccuggccgccaacgccaucugcagcgcgguccccucccacugggugcccaccagccggaccaccugguccauccacgccaagcacgaguggaugaccacggaggacaugcucgccguguggaaccgcgucuggauccaggagaacccguggauggaggacaagacccccguggagagcugggaggaggugcccuaccuggggaagcgcgaggaccaguggugcggcagccugaucgggcucaccucccgggccaccugggccaagaacauccagacggcgaucaaccagguccgcagccugaucggcaacgaggaguacaccgacuacaugcccuccaugaagcgguuccgccgggaggaggaggaggccggggugcugugguga

SEQ ID NO: 9016 - RNA, 9876 nt, Artificial Sequence
  derived and/or modified CDS sequence (opt1) from DENV-2__JX669479__SS-prME
accgccggcgugaucgucaugcugauccccaccgccauggcguuccaccucaccacccgcaacggggagccccacaugaucgugggccggcaggagaagggcaagagccugcuguucaagaccgaggacggggugaacaugugcacccucauggccaucgaccugggggagcugugcgaggacaccaucaccuacaagugcccccuccugcgccagaacgagcccgaggacaucgacugcuggugcaacagcaccagcaccugggucaccuacgggaccugcaccaccacgggcgagcaccggcgcgagaagcgguccguggcccuggugccccacgucgggaugggccucgagacccgcaccgagaccuggaugagcagcgagggggccuggaagcacgugcagcggaucgagaccuggauccugcgccaccccggcuucaccaucauggccgcgauccuggccuacaccaucgggaccacgcacuuccagcgggcccucaucuucauccugcugaccgccguggcgcccagcaugaccaugcgcugcaucggcaucagcaaccgggacuucgucgagggcgugagcgggggcuccuggguggacaucguccucgagcacgggagcugcgugaccacgauggccaagaacaagcccacccuggacuucgagcugaucaagaccgaggccaagcagcccgccacccuccgcaaguacugcaucgaggccaagcugacgaacaccaccaccgagucccggugccccacgcagggcgagcccagccugaacgaggagcaggacaagcgcuucaucugcaagcacuccaugguggaccggggcugggggaacggcugcgggcuguucggcaagggcggcaucgugaccugcgcgauguucacgugcaagaagaacauggagggcaagaucgugcagagcgagaaccuggaguacaccaucgugaucacgccccacuccggggaggagcacgccgucggcaacgacaccgggaagcacggcaaggagaucaagaucacgccccagagcuccaccaccgaggccgagcugacgggguacggcaccgugaccauggagugcagcccgcgcaccggccucgacuucaacgagauggugcugcugcagauggaggacaaggccuggcucguccaccggcagugguuccuggaccugccccuccccuggcugcccggggccgacacgcagggcuccaacuggauccagaaggagacccuggugaccuucaagaacccgcacgcgaagaagcaggacguggucgugcucgggagccaggagggcgccaugcacaccgcccugacgggggccaccgagauccagaugagcuccggcaaccuccuguucaccggccaccugaagugccgccugcggauggacaagcuccagcugaaggggaugagcuacuccaugugcaccggcaaguucaagaucgucaaggagaucgccgagacgcagcacgggaccaucgugauccgcgugcaguacgagggcgacggcagccccugcaagauccccuucgagaucaccgaccuggagaagcggcacguccucgggcgccugaucaccgugaaccccaucgugacggagaaggacuccccggucaacaucgaggcggagccgcccuucggcgacagcuacaucaucguggggguggagcccggccagcugaagcucaacugguucaagaagggguccagcaucggccagauguucgagaccaccaugcgcggcgccaagcggauggccauccugggggacaccgccugggacuucggcucccucgggggcgucuucacgagcaucgggaaggcccuccaccagguguucggcgcgaucuacggcgccgccuucuccggggugagcuggaccaugaagauccugaucggcgucaucaucaccuggaucgggaugaacucccgcagcaccucccugagcgugucccuggugcucgucggcguggugacgcuguaccugggggccaugguccaggcggacagcggcugcaucguguccuggaagaacaaggagcucaagugcggcagcgggaucuucaucaccgacaacgugcacaccuggaccgagcaguacaaguuccagccggagagccccuccaagcuggccagcgccauccagaaggcccacgaggagggcaucugcgggauccgguccgucacgcgccuggagaaccucauguggaagcagaucacccccgagcugaaccacauccugagcgagaacgaggugaagcucaccaucaugaccggcgacaucaaggggaucaugcaggccggcaagcggucccugcgcccccagccgacggagcugaaguacagcuggaagaccuggggcaaggcgaagaugcucuccaccgagagccacaaccagaccuuccugaucgacgggcccgagacggccgagugccccaacaccaaccgggccuggaacucccuggagguggaggacuacggcuucggggucuucaccaccaacaucuggcucaagcugcgcgagaagcaggacguguucugcgacagcaagcugauguccgccgccaucaaggacaaccgggcggugcacgccgacaugggcuacuggaucgagagcgcccucaacgacaccuggaagauggagaaggccuccuucaucgaggucaagagcugccacuggccgaagucccacacgcuguggagcaacggcgugcuggaguccgagaugaucauccccaagaacuucgccgggcccgugagccagcacaacuaccgccccggcuaccacacccagaccgcggggccguggcaccucggcaagcuggagauggacuucgacuucugcgaggggaccacggucguggugaccgaggacugcggcaaccggggccccagccugcgcaccaccacggccuccgggaagcucaucaccgaguggugcugccggagcugcacccugccgccccugcgcuaccggggcgaggacgggugcugguacggcauggagauccgcccgcucaaggagaaggaggagaaccuggucaacucccuggugaccgccgggcacggccagaucgacaacuucagccucggcgugcuggggauggcccuguuccucgaggagaugcugcggacgcgcgucggcaccaagcacgcgauccugcucguggcccuguccuucgugacccugaucaccgggaacaugagcuuccgggaccucggccgcgucauggugauggugggggccacgaugaccgacgacaucggcaugggcgucaccuaccuggcccugcucgccgcguucaaggugcgccccaccuucgccgccgggcugcugcuccggaagcugacguccaaggagcugaugauggccaccaucggcaucgcccuccugagccaguccacccugcccgagaccauccucgagcugacggacgcgcuggcccucgggaugauggcccugaagaucgugcgcaacauggagaaguaccagcuggccgucaccaucauggccaucagcugcgugcccaacgcggugauccuccagaacgccuggaaggucuccugcaccauccuggccgccgugagcguguccccgcugcuccugaccagcucccagcagaaggcggacuggaucccccuggcccucacgaucaagggccugaaccccaccgccaucuuccugaccacccucagccggacguccaagaagcgcagcuggccccugaacgaggccaucauggccgucggcaugguguccauccuggcgagcagccuccugaagaacgacaucccgaugaccgggccccuggucgccggcgggcuccugaccgugugcuacgugcugaccggccgguccgccgaccucgagcuggagcgcgccgccgacgucaagugggaggaccaggcggagaucagcggguccagccccauccuguccaucacgaucagcgaggacggcuccaugagcaucaagaacgaggaggaggagcagacccucaccauccugauccggaccggccugcucgugaucuccgggguguuccccgucagcaucccgaucaccgccgccgccugguaccugugggaggugaagaagcagcgcgccggcgugcugugggacguccccagcccgccgcccguggagaaggcggagcucgaggacggggccuaccggaucaagcagcgcggcauccugggguacagccagaucggcgccggcguguacaaggaggggacguuccacaccauguggcacgucacccggggcgccgugcugaugcaccgcgggaagcggaucgagcccuccugggccgacgugaagaaggaccucaucagcuacggcgggggcuggaagcuggagggcgaguggaaggagggggaggagguccaggugcuggcgcucgagcccggcaagaacccccgcgccgugcagaccaagcccgggaucuucaagacgaacaccggcaccaucggggccgucucccuggacuucagccccggcaccuccggcagccccaucguggaccggaaggggaagguggucggccuguacgggaacggcguggugacgcgcuccggcgccuacgucagcgcgaucgcccagaccgagaaguccaucgaggacaacccggagaucgaggacgacaucuuccggaagaagcgccucaccaucauggaccugcaccccggggccggcaagaccaagcgguaccugcccgccaucgugcgcgaggccaucaagcgggggcugcgcacgcucauccuggcgcccacccgcguggucgccgccgagauggaggaggcccugcggggccucccgauccgcuaccagacccccgccauccgggcggagcacaccgggcgcgagaucguggaccugaugugccacgccacguucaccaugcggcugcucucccccgugcgcguccccaacuacaaccugaucaucauggacgaggcccacuucaccgacccggccagcaucgccgcgcggggcuacaucuccacccgcguggagaugggcgaggccgccgggaucuucaugacggccacgccgcccggcagccgggaccccuucccgcaguccaacgcgcccaucauggacgaggagcgcgagauccccgagcggagcuggaacuccgggcacgagugggugaccgacuucaagggcaagaccgucugguucgugcccagcaucaaggccgggaacgacaucgccgccugccugcgcaagaacggcaagaaggugauccagcucucccggaagacguucgacagcgaguacgucaagacccgcgccaacgacugggacuucguggugaccaccgacaucuccgagaugggcgcgaacuucaaggccgagcgggucaucgacccgcgccggugcaugaagcccgugauccugacggacggggaggagcgcgugauccuggccggccccaugcccgucacccacagcuccgccgcccagcggcgcgggcgcaucggccggaacccgaagaacgagaacgaccaguacaucuacaugggggagccccucgagaacgacgaggacugcgcgcacuggaaggaggccaagaugcugcuggacaacaucaacacccccgagggcaucauccccagcauguucgagccggagcgcgagaagguggacgccaucgacggcgaguaccggcuccgcggggaggcccggaagaccuucguggaccugaugcgccggggcgaccugcccgucuggcucgccuacaagguggcggccgaggggaucaacuacgccgaccgcaaguggugcuucgacggcaucaagaacaaccagauccuggaggagaacguggaggucgagaucuggacgaaggagggggagcggaagaagcugaagccccgcuggcucgacgcccggaucuacuccgacccgcuggcgcugaaggaguucaaggaguucgccgccggccgcaagagccucacccugaaccugaucaccgagaugggccggcuccccaccuucaugacgcagaaggcccgcaacgcccuggacaaccuggcggugcuccacaccgccgaggucgggggccgggccuacacccacgcccuguccgagcugcccgagacccucgagacgcugcugcuccugacccugcucgccgcggucaccgggggcaucuuccuguuccugaugagcggcaaggggaucggcaagaugacccucgggaugugcugcaucaucaccgccuccauccugcugugguacgcccagauccagccccacuggaucgccgccagcaucauccucgaguucuuccugaucgugcugcucaucccggagcccgagaagcagcgcacgccccaggacaaccagcugaccuacgucgugaucgcgauccugaccguggucgccgccaccauggccaacgagaugggcuuccucgagaagacgaagaaggaccugggguucggcagcaucaccacccaggaguccgagagcaacauccuggacaucgaccuccggcccgccuccgcguggacccuguacgccguggccacgaccuucgugaccccgaugcugcgccacagcaucgagaacuccagcgucaacgugucccucaccgccaucgcgaaccaggccacggugcugaugggccuggggaagggcuggccccucagcaagauggacaucggggucccccugcuggccaucggcugcuacucccaggugaaccccaucacccucaccgccgcccugcugcuccugguggcgcacuacgccaucaucgggccgggccugcaggccaaggccacccgggaggcccagaagcgcgcggccgccggcaucaugaagaaccccacggucgacgggaucaccgugaucgaccucgagcccauccccuacgacccgaaguucgagaagcagcugggccaggugaugcugcucauccugugcgucacccaggugcugaugaugcggaccacgugggcccucugcgaggcccugacccuggcgaccgggcccaucagcacccucugggagggcaaccccgggcgcuucuggaacacgaccaucgccguguccauggccaacaucuuccgcggcagcuaccuggccggcgcggggcuccuguucuccaucaugaagaacaccaccaacacgcggcgcggcaccgggaacgucggcgagacccugggcgagaaguggaagucccggcugaaggcccucgggaaguccgaguuccagaucuacaagaaguccggcauccaggagguggaccgcacccuggccaaggaggggaucaagcggggcgagacggaccaccacgccgugucccgcgggagcgccaagcugcggugguucgucgagcgcaacauggugacccccgagggcaagguggucgaccucggcugcgggcggggcgggugguccuacuacugcggcgggcugaagaacgugcgcgaggugaagggccugaccaagggcgggccgggccacgaggagcccauccccaugagcaccuacggguggaaccucguccggcugcagagcggcguggacguguucuucacgcccccggagaagugcgacacccugcucugcgacaucggggaguccagccccaaccccaccaucgaggcgggccgcacccugcggguccugaaccucguggagaacuggcugaacaacaacacccaguucugcaucaaggugcugaaccccuacaugccguccgucaucgagaagauggagacgcuccagcgcaaguacggcggggcccuggugcggaacccccugagccgcaacuccacccacgagauguacugggugagcaacgccaccggcaacaucgucuccagcgugaacaugaucucccggaugcugaucaaccgcuucaccaugaagcacaagaaggccacguacgagcccgacguggaccucgggagcggcacccggaacaucgggaucgaguccgagaucccgaaccuggacaucaucggcaagcgcaucgagaagaucaagcaggagcacgagaccagcuggcacuacgaccaggaccaccccuacaagaccugggccuaccacggcuccuacgagacgaagcagaccgggagcgcguccagcauggucaacggcguggugcgccugcucaccaagcccugggacgucgugcccauggugacccagauggccaugacggacaccaccccguucgggcagcagcgggucuucaaggagaagguggacacccgcacgcaggagcccaaggagggcaccaagaagcugaugaagaucaccgccgaguggcuguggaaggagcucggcaaggagaagacgccccggaugugcacgcgcgaggaguucacccggaaggugcgcuccaacgccgcccugggggcggucuucaccgacgagaacaaguggaaguccgcccgggaggccguggaggacggccgcuucugggagcugguggaccgggagcgcaaccuccaccuggaggggaagugcgagaccugcgucuacaacaugaugggcaagcgggagaagaagcugggggaguucggcaaggccaagggcucccgcgcgaucugguacauguggcucggggcccgguuccuggaguucgaggcccugggcuuccucaacgaggaccacugguucagccgcgggaacagccuguccggcguggagggggagggccugcaccggcucggcuacauccugcgcgaggucgggaagaaggagggcggggccauguacgccgacgacacggcgggcugggacacccggaucacccuggaggaccucaagaacgaggagauggugaccaaccacaugaagggggagcacaagaagcuggccgaggccaucuucaagcugacguaccagaacaaggugguccgcgugcagcggcccaccccgcgcggcaccgugauggacaucaucagccggaaggaccagcgcggcuccgggcaggucggcaccuacgggcucaacacguucaccaacauggaggcccagcugauccgccagauggagggcgagggcaucuucaagagcauccagcaccugaccgccaccgaggagaucgcggugcagaacuggcucgcccggguggggcgcgagcggcugucccgcauggccaucagcggcgacgacugcgucgugaagcccaucgacgaccgguucgccuccgcccugacggcgcucaacgacauggggaaggugcgcaaggacauccagcagugggagcccagccggggcuggaacgacuggacccagguccccuucugcucccaccacuuccacgagcuggugaugaaggacgggcgcgugcuggucgugccgugccggaaccaggacgagcucaucggccgcgcccggaucagccagggcgccggguggucccugaaggagaccgccugccugggcaagagcuacgcccagauguggacccucauguacuuccaccgccgggaccugcgccuggcggccaacgccaucugcuccgccgugcccagccacuggguccccaccucccggacgaccuggagcauccacgcgaagcacgaguggaugaccaccgaggacaugcucgccguguggaaccgcguguggauccaggagaaccccuggauggaggacaagacgccggucgaguccugggaggaggugcccuaccuggggaagcgggaggaccaguggugcggcagccugaucgggcucaccagccgcgccaccugggccaagaacauccagaccgccaucaaccaggugcggucccugaucggcaacgagggcuacacggacuacaugcccagcaugaagcgcuuccgccgggaggaggaggaggcggggguccugugguga

SEQ ID NO: 9017 - RNA, 9876 nt, Artificial Sequence
  derived and/or modified CDS sequence (opt1) from DENV-2__KF744403__SS-prME
accgccgggaugaucaucaugcugauccccaccgugauggccuuccaccucaccacccggaacggggagccccacaugaucgucagccggcaggagaagggcaagagccugcuguucaagaccgaggacggggugaacaugugcacccucauggcgauggaccugggggagcugugcgaggacaccaucaccuacaagugcccccuccugcgccagaacgagcccgaggacaucgacugcuggugcaacagcaccuccaccugggugaccuacgggaccugcaccaccacgggcgagcaccggcgcgagaagcggagcgucgcccuggugccccacgugggcauggggcucgagacccgcaccgagaccuggauguccagcgagggcgccuggaagcacgcccagcggaucgagacguggauccugcgccaccccggguucacccugauggccgcgauccucgccuacaccaucggcaccacgaacuuccagcgggcccugaucuucauccugcucaccgccgucgcgcccuccaugaccaugcgcugcaucgggaucagcaaccgggacuucguggagggcguguccggcgggagcugggucgacaucgugcuggagcacggcuccugcgugaccacgauggccaagaacaagcccacccuggacuucgagcucaucaagaccgaggccaagcagcccgccacccugcgcaaguacugcaucgaggccaagcugacgaacaccaccaccgagagccggugcccgacgcagggggagcccucccucaacgaggagcaggacaagcgcuucgucugcaagcacagcaugguggaccggggcuggggcaacgggugcggccuguucgggaagggcgggaucgugaccugcgcgauguucacgugcaagaagaacauggagggcaagaucguccagcccgagaaccuggaguacaccaucgugaucacgccccacuccggcgaggagcacgccguggggaacgacaccggcaagcacgggaaggagaucaagaucaccccgcagagcuccaucaccgaggccgagcucaccggcuacgggacggucaccauggagugcagcccccgcaccggccuggacuucaacgagauggugcugcuccagauggagaacaaggccuggcuggugcaccggcagugguuccuggaccucccccugcccuggcugccgggcgccgacacccagggguccaacuggauccagaaggagacgcucgucaccuucaagaacccccacgcgaagaagcaggacguggugguccugggcagccaggagggggccaugcacaccgcccugaccggcgccacggagauccagaugagcuccgggaaccuccuguucaccggccaccugaagugccgccuccggauggacaagcugcagcugaagggcaugagcuacuccaugugcaccgggaaguucaagguggucaaggagaucgccgagacccagcacggcacgaucguggugcgcguccaguacgagggggacggcagccccugcaagauccccuucgagaucauggaccucgagaagcggcacgugcugggccgccugaucaccgugaacccgaucgucaccgagaaggacucccccgugaacaucgaggcggagccgcccuucggggacagcuacgugaucaucggcgucgagccggggcagcucaagcugaacugguucaagaagggcuccagcaucgggcagauguucgagaccacgaugcgcggcgccaagcggauggccauccugggcgacaccgccugggacuucgggucccucggcgggguguucaccagcaucggcaaggcccugcaccagguguucggggcgaucuacggcgccgccuucuccggcgucagcuggaccaugaagauccugaucggggugaucaucacguggaucggcaugaacucccgcagcaccucccugagcgugucccucguccugguggggguggucacccuguaccucggcguggugguccaggccgacagcgggugcgugguguccuggcggaacaaggagcugaagugcggcagcggcaucuucaucaccgacaacguccacacguggaccgagcaguacaaguuccagcccgagagccccuccaagcuggcgagcgccauccagaaggcccaccaggaggggaucugcggcauccgcuccgugacccggcucgagaaccugauguggaagcagaucacccccgagcugaaccacauccucagcgagaacgaggugaagcugacgaucaugaccggggacaucaagggcaucaugcacgccgggaagcgcucccugcggccgcagcccaccgagcuccgcuacagcuggaagaccuggggcaaggccaagauccuguccacggagagccacaaccagaccuuccugaucgacggccccgagaccgcggagugcccgaacaccaaccgggccuggaacucccucgaggucgaggacuacggguucggcguguucacgaccaacaucuggcugcgccugcgggagaagcaggacgccuucugcgacagcaagcucauguccgccgccaucaaggacaaccgcgcggugcacgccgacaugggguacuggaucgagagcgcccugaacgacaccuggaagaucgagaaggccuccuucaucgaggucaagagcugccacuggcccaagucccacacccuguggagcaacggcgugcucgaguccgagaugaucauccccaagaacuucgccggccccgugagccagcacaacuaccggccgggguaccacacccagacggcgggccccuggcaccuggggaagcuggagauggacuucgacuucugcaagggcaccaccgucguggugaccgaggacugcgggaaccgcggccccagccuccggacgaccaccgccuccggcaagcugaucaccgaguggugcugccgcagcugcacgcugcccccgcuccgguaccgcggggaggacggcugcugguacgggauggagauccggccccugaaggagaaggaggagaaccuggucuccagccucgugaccgccggccacgggcagaucgacaacuucucccugggcgugcugggcauggcccucuuccuggaggagaugcugcgcacccgcgucgggaccaagcacgcgauccuccugguggccgugagcuucgucacgcugaucaccggcaacauguccuuccgggaccucgggcgcgugauggugauggucggcgccaccaugaccgacgacaucgggaugggcgugacguaccuggcccugcucgccgcguucaaggugcggcccaccuucgccgccggccugcugcuccgcaagcugaccagcaaggagcugaugaugaccacgaucgggaucguccuccugucccagagcaccauccccgagaccauccuggagcucaccgacgcccuggcccugggcaugauggugcucaagaucgugcggaagauggagcgcuaccagcuggcggucacgaucauggccauccugugcgugccgaacgccgucauccuccagaacgccuggaagguguccugcaccauccuggccguggucagcgugagcccccugcuccugaccagcucccagcagaaggcggacuggaucccccuggcccucaccaucaaggggcugaaccccacggccaucuuccugaccacccucagccggaccuccaagaagcgcagcuggccgcugaacgaggccaucauggcggugggcauggucuccauccuggccagcagccuccugaagaacgacauccccaugacgggcccccugguggccgggggccuccugaccgugugcuacguccugaccgggcgguccgccgaccucgagcuggagaaggccgcggacgugcgcugggaggaccaggccgagaucagcggcuccagccccauccuguccaucaucaucagcgaggacggguccaugagcaucaagaacgaggaggaggagcagacccucacgauccugauccggaccggccugcucgugaucuccggccuguucccggucagcauccccaucaccgccgccgccugguaccugugggaggugaagaagcagcgcgcgggggugcucugggacguccccagcccgccgcccgugggcaaggccgagcuggaggacggggccuaccggaucaagcagaagggcauccugggguacagccagaucggcgccggcguguacaaggaggggaccuuccacaccauguggcacgucacgcgcggcgccgugcucaugcacaaggggaagcggaucgagcccuccugggcggacgugaagaaggaccugaucagcuacggcgggggcuggaagcuggagggcgaguggaaggagggggaggagguccaggugcucgcccuggagcccggcaagaacccccgcgccgugcagaccaagcccgggcuguucaagaccaacgccggcaccaucggggccgucucccucgacuucagccccggcacguccggcagccccaucaucgacaagaaggggaagguggugggccuguacgggaacggcgucgugacccggaacggcuccuacgugagcgcgaucgcccagaccgagaaguccaucgaggacaaccccgagaucgaggacgacaucuuccgcaagaagcggcugaccaucauggaccugcaccccggggccggcaagacgaagcgcuaccuccccgccaucguccgggaggcgaucaagcgcgggcugcgcacccugauccucgccccgacccgggugguggccgccgagauggaggaggcccugcgcggccugcccauccgguaccagacccccgcgauccgcgccgagcacacggggcgggagaucgucgaccucaugugccacgccaccuucaccaugcgccugcugucccccauccgggugccgaacuacaaccucaucaucauggacgaggcccacuucaccgaccccgccagcaucgcggcccgcggcuacaucuccacgcggguggagaugggcgaggccgccgggaucuucaugaccgccacgccgcccggcagccgcgacccguucccccaguccaacgcgcccaucauggacgaggagcgggagauccccgagcgcagcuggaacuccgggcacgagugggucaccgacuucaagggcaagacggugugguucgugccgagcaucaaggccgggaacgacaucgccgccugccugcggaagaacggcaagaaggucauccagcugucccgcaagaccuucgacagcgaguacgugaagacccggaccaacgacugggacuucguggucacgaccgacaucuccgagaugggcgcgaacuucaaggccgagcgcgugaucgacccccggcgcugcaugaagcccgugauccucaccgacggggaggagcgggucauccuggccggccccaugccggugacccacagcuccgccgcccagcgccgcgggcggaucggccgcaaccccaagaacgagaacgaccaguacaucuacaugggggagccccuggagaacgacgaggacugcgcgcacuggaaggaggccaagaugcuccuggacaacaucaacacgcccgagggcaucaucccgagcauguucgagcccgagcgggagaagguggacgccaucgacggcgaguaccgccugcgcggggaggcccgcaagaccuucgucgaccucaugcggcgcggcgaccugcccguguggcuggccuacaagguggcggccgaggggaucaacuacgccgaccggcgcuggugcuucgacggcauccggaacaaccagauccucgaggagaacgucgagguggagaucuggaccaaggagggggagcgcaagaagcugaagccgcgguggcuggacgcccgcaucuacuccgacccccucgcccugaaggaguucaaggaguucgcggccggccggaagucccugacccucaaccugaucacggagaugggccgccugcccaccuucaugacccagaaggcccgggacgcccucgacaaccuggcgguccugcacaccgccgaggccgggggccgcgccuacaaccacgcccucuccgagcugcccgagacgcuggagauccuccugcugcucacccugcuggcgaccgugaccgggggcaucuuccucuuccugaugagcggccgggggaucggcaagaugacgcuggggaugugcugcaucaucaccgccuccauccuccugugguacgcccagauccagccgcacuggaucgccgccagcaucauccuggaguucuuccucaucgugcugcugauccccgagcccgagaagcagcgcacgccccaggacaaccagcucaccuacgucgugaucgcgauccugaccguggucgccgccacgauggccaacgagaugggcuuccuggagaagaccaagaaggaccucgggcugggcagcaucaccacccagcagccggaguccaacauccuggacaucgaccuccggcccgccagcgcguggacgcuguacgccguggccaccaccuucaucacccccaugcugcgccacuccaucgagaacagcuccgugaacgucagccucacggccaucgccaaccaggcgaccgugcugaugggccuggggaagggcuggccccucuccaagauggacaucggggugccgcugcuggccaucggcugcuacagccaggucaaccccaucacccucaccgccgcccugcugcuccugguggcgcacuacgccaucaucgggcccggccugcaggccaaggccacgcgcgaggcccagaagcgggcggccgccggcaucaugaagaaccccaccguggacgggaucaccgucaucgaccucgacccgauccccuacgaccccaaguucgagaagcagcugggccaggugaugcugcucgugcugugcgucacccaggugcugaugaugcgcacgaccugggcccucugcgaggcccugacccuggcgaccgggcccaucuccacgcucugggagggcaacccggggcgguucuggaacaccaccaucgccgugagcauggccaacaucuuccgcggcuccuaccuggccggcgccgggcuccuguucagcaucaugaagaacaccacgaacacccggcgcggcaccgggaacaucggcgagacccugggcgagaaguggaagucccggcugaacgcgcucggcaagagcgaguuccagaucuacaagaaguccggcauccaggaggucgaccgcacgcuggccaaggaggggaucaagcggggcgagaccgaccaccacgccgugagccgcggguccgccaagcugcggugguucguggagcgcaacaugaucacccccgagggcaaggucguggaccucggcugcgggcggggcggguggagcuacuacugcggcgggcugaagaacgugcgcgaggucaagggccugaccaagggcgggcccggccacgaggagcccaucccgauguccacguacggguggaaccucgugcggcugcagagcggcguggacgucuucuucacgccgcccgagaagugcgacacccugcucugcgacaucggggagagcucccccaacccgaccguggaggcgggccgcacgcugcgggugcugaaccucgucgagaacuggcugaacaacaacacccaguucugcaucaaggugcugaaccccuacaugcccagcgugaucgagaagauggaggcccugcagcgcaaguacggcggggcccucguccggaacccgcugucccgcaacagcacccacgagauguacuggguguccaacgccagcggcaacaucguguccagcgucaacaugaucucccgcaugcugaucaaccgguucaccaugaagcacaagaaggccaccuacgagcccgacguggaccucgggagcggcacgcgcaacaucgggaucgaguccgaggugcccaaccuggacaucaucggcaagcggaucgagaagaucaagcaggagcacgagaccagcuggcacuacgaccaggaccaccccuacaagaccugggcguaccacggcuccuacgagaccaagcagacggggagcgccuccagcauggucaacggcguggugcgccugcucaccaagccgugggacgucauccccauggugacccagauggccaugaccgacacgacccccuucgggcagcagcggguguucaaggagaaggucgacacccgcacccaggagcccaaggagggcacgaagaagcugaugaagaucaccgccgaguggcuguggaaggagcucggcaagaagaagaccccgcggaugugcacccgcgaggaguucacgcggaaggugcgcuccaacgccgcgcugggggccaucuucaccgacgagaacaaguggaaguccgcccgggaggccguggaggacucccgcuucugggagcuggucgacaaggagcggaaccuccaccuggagggcaagugcgagaccugcguguacaacaugauggggaagcgcgagaagaagcugggcgaguucgggaaggccaagggcagccgggcgaucugguacauguggcucggcgcccgcuuccuggaguucgaggcccugggguuccucaacgaggaccacugguucagccgggagaacucccugagcggcgucgagggggagggccugcacaagcucggguacauccugcgcgacguguccaagaaggagggcggcgccauguacgcggacgacaccgccgggugggacacgcggaucacccuggaggaccucaagaacgaggagauggugaccaaccacauggagggcgagcacaagaagcuggccgaggccaucuucaagcugaccuaccagaacaaggucgugcgcgugcagcggcccacgccccgcgggaccgucauggacaucaucagccgccgggaccagcgcggcuccggccaggugggcaccuacggccucaacaccuucacgaacauggaggcccagcugauccggcagauggagggggagggcguguucaagagcauccagcaccugaccgcgaccgaggagaucgccguccagaacuggcucgcccgcguggggcgggagcgccugucccggauggccaucagcggcgacgacugcguggucaagccccuggacgaccgcuucgccuccgcgcucaccgcccugaacgacaugggcaaggugcggaaggacauccagcagugggagccgagcaagggguggaacgacuggacccaggugcccuucugcucccaccacuuccacgagcugaucaugaaggacggccgcguccucguggugcccugccggaaccaggacgagcugaucgggcgcgcccggaucagccagggcgccggguggucccugcgcgagaccgccugccucggcaagagcuacgcgcagauguggucccugauguacuuccaccggcgcgaccugcggcucgccgccaacgccaucugcagcgccguccccucccacugggugccgaccagccgcaccacguggagcauccacgcgaagcacgaguggaugaccaccgaggacaugcugaccguguggaaccgggucuggauccaggagaaccccuggauggaggacaagacccccguggaguccugggaggagauccccuaccugggcaagcgcgaggaccaguggugcgggagccucaucggccugacgucccgcgccaccugggccaagaacauccagaccgccaucaaccaggugcggagccugaucgggaacgaggaguacaccgacuacaugccguccaugaagcgcuuccggcgcgaggaggaggaggcgggcguccucugguga

SEQ ID NO: 9018 - RNA, 9876 nt, Artificial Sequence
  derived and/or modified CDS sequence (opt1) from DENV-2__KF744406__SS-prME
accgccgggaugaucaucaugcugauccccaccgugauggccuuccaccucaccacccggaacggggagccccacaugaucgucagccggcaggagaagggcaagagccugcuguucaagaccgaggacggggugaacaugugcacccucauggcgauggaccugggcgagcugugcgaggacaccaucaccuacaagugcccccuccugcgccagaacgagcccgaggacaucgacugcuggugcaacagcaccagcaccugggugaccuacgggaccugcaccaccacgggcgagcaccggcgcgagaagcggagcgucgcccuggugccccacgugggcauggggcucgagacccgcaccgagaccuggauguccagcgagggcgccuggaagcacgcccagcggaucgagacguggauccugcgccaccccggguucacccugauggccgcgauccucgccuacaccaucggcaccacgaacuuccagcgggcccugaucuucauccugcucaccgccgucgcgcccuccaugaccaugcgcugcaucgggaucagcaaccgggacuucguggagggcguguccggcgggagcugggucgacaucgugcuggagcacggcuccugcgugaccacgauggccaagaacaagcccacccuggacuucgagcucaucaagaccgaggccaagcagcccgccacccugcgcaaguacugcaucgaggccaagcugacgaacaccaccaccgagagccggugcccgacgcagggggagcccucccucaacgaggagcaggacaagcgcuucgucugcaagcacagcaugguggaccggggcuggggcaacgggugcggccuguucgggaagggcgggaucgugaccugcgcgauguucacgugcaagaagaacauggagggcaagaucguccagcccgagaaccuggaguacaccaucgugaucacgccccacuccggcgaggagcacgccguggggaacgacaccggcaagcacgggaaggagaucaagaucaccccgcagagcuccaucaccgaggccgagcucaccggcuacgggacggucaccauggagugcagcccccgcaccggccuggacuucaacgagauggugcugcuccagauggagaacaaggccuggcuggugcaccggcagugguuccuggaccucccccugcccuggcugccgggcgccgacacccagggguccaacuggauccagaaggagacgcucgucaccuucaagaacccccacgcgaagaagcaggacguggugguccugggcagccaggagggggccaugcacaccgcccugaccggcgccacggagauccagaugagcuccgggaaccuccuguucaccggccaccugaagugccgccuccggauggacaagcugcagcugaagggcaugagcuacuccaugugcaccgggaaguucaagguggucaaggagaucgccgagacccagcacggcacgaucguggugcgcguccaguacgagggggacggcagccccugcaagauccccuucgagaucauggaccucgagaagcggcacgugcugggccgccugaucaccgugaacccgaucgucaccgagaaggacucccccgugaacaucgaggcggagccgcccuucggggacagcuacgugaucaucggcgucgagccggggcagcucaagcugaacugguucaagaagggcuccagcaucgggcagauguucgagaccacgaugcgcggcgccaagcggauggccauccugggcgacaccgccugggacuucgggucccucggcgggguguucaccagcaucggcaaggcccugcaccagguguucggggcgaucuacggcgccgccuucuccggcgucagcuggaccaugaagauccugaucggggugaucaucacguggaucggcaugaacucccgcagcaccucccugagcgugucccucguccugguggggguggucacccuguaccucggcguggugguccaggccgacagcgggugcgugguguccuggcggaacaaggagcugaagugcggcagcggcaucuucaucaccgacaacguccacacguggaccgagcaguacaaguuccagcccgagagccccuccaagcuggcgagcgccauccagaaggcccaccaggaggggaucugcggcauccgcuccgugacccggcucgagaaccugauguggaagcagaucacccccgagcugaaccacauccucagcgagaacgaggugaagcugacgaucaugaccggggacaucaagggcaucaugcacgccgggaagcgcucccugcggccgcagcccaccgagcuccgcuacagcuggaagaccuggggcaaggccaagauccuguccacggagagccacaaccagaccuuccugaucgacggccccgagaccgcggagugcccgaacaccaaccgggccuggaacucccucgaggucgaggacuacggguucggcguguucacgaccaacaucuggcugcgccugcgggagaagcaggacgccuucugcgacagcaagcucauguccgccgccaucaaggacaaccgcgcggugcacgccgacaugggguacuggaucgagagcgcccugaacgacaccuggaagaucgagaaggccuccuucaucgaggucaagagcugccacuggcccaagucccacacccuguggagcaacggcgugcucgaguccgagaugaucauccccaagaacuucgccggccccgugagccagcacaacuaccggccgggguaccacacccagacggcgggccccuggcaccuggggaagcuggagauggacuucgacuucugcaagggcaccaccgucguggugaccgaggacugcgggaaccgcggccccagccuccggacgaccaccgccuccggcaagcugaucaccgaguggugcugccgcagcugcacgcugcccccgcuccgguaccgcggggaggacggcugcugguacgggauggagauccggccccugaaggagaaggaggagaaccuggucuccagccucgugaccgccggccacgggcagaucgacaacuucucccugggcgugcugggcauggcccucuuccuggaggagaugcugcgcacccgcgucgggaccaagcacgcgauccuccugguggccgugagcuucgucacgcugaucaccggcaacauguccuuccgggaccucgggcgcgugauggugauggucggcgccaccaugaccgacgacaucgggaugggcgugacguaccuggcccugcucgccgcguucaaggugcggcccaccuucgccgccggccugcugcuccgcaagcugaccagcaaggagcugaugaugaccacgaucgggaucguccuccugucccagagcaccauccccgagaccauccuggagcucaccgacgcccuggcccugggcaugauggugcucaagaucgugcggaagauggagcgcuaccagcuggcggucacgaucauggccauccugugcgugccgaacgccgucauccuccagaacgccuggaagguguccugcaccauccuggccguggucagcgugagcccccugcuccugaccagcucccagcagaaggcggacuggaucccccuggcccucaccaucaaggggcugaaccccacggccaucuuccugaccacccucagccggaccuccaagaagcgcagcuggccgcugaacgaggccaucauggcggugggcauggucuccauccuggccagcagccuccugaagaacgacauccccaugacgggcccccugguggccgggggccuccugaccgugugcuacguccugaccgggcgguccgccgaccucgagcuggagaaggccgcggacgugcgcugggaggaccaggccgagaucagcggcuccagccccauccuguccaucaucaucagcgaggacggguccaugagcaucaagaacgaggaggaggagcagacccucacgauccugauccggaccggccugcucgugaucuccggccuguucccggucagcauccccaucaccgccgccgccugguaccugugggaggugaagaagcagcgcgcgggggugcucugggacguccccagcccgccgcccgugggcaaggccgagcuggaggacggggccuaccggaucaagcagaagggcauccugggguacagccagaucggcgccggcguguacaaggaggggaccuuccacaccauguggcacgucacgcgcggcgccgugcucaugcacaaggggaagcggaucgagcccuccugggcggacgugaagaaggaccugaucagcuacggcgggggcuggaagcuggagggcgaguggaaggagggggaggagguccaggugcucgcccuggagcccggcaagaacccccgcgccgugcagaccaagcccgggcuguucaagaccaacgccggcaccaucggggccgucucccucgacuucagccccggcacguccggcagccccaucaucgacaagaaggggaagguggugggccuguacgggaacggcgucgugacccggaacggcuccuacgugagcgcgaucgcccagaccgagaaguccaucgaggacaaccccgagaucgaggacgacaucuuccgcaagaagcggcugaccaucauggaccugcaccccggggccggcaagacgaagcgcuaccuccccgccaucguccgggaggcgaucaagcgcgggcugcgcacccugauccucgccccgacccgggugguggccgccgagauggaggaggcccugcgcggccugcccauccgguaccagacccccgcgauccgcgccgagcacacggggcgggagaucgucgaccucaugugccacgccaccuucaccaugcgccugcugucccccauccgggugccgaacuacaaccucaucaucauggacgaggcccacuucaccgaccccgccagcaucgcggcccgcggcuacaucuccacgcggguggagaugggcgaggccgccgggaucuucaugaccgccacgccgcccggcagccgcgacccguucccccaguccaacgcgcccaucauggacgaggagcgggagauccccgagcgcagcuggaacuccgggcacgagugggucaccgacuucaagggcaagacggugugguucgugccgagcaucaaggccgggaacgacaucgccgccugccugcggaagaacggcaagaaggucauccagcugucccgcaagaccuucgacagcgaguacgugaagacccggaccaacgacugggacuucguggucacgaccgacaucuccgagaugggcgcgaacuucaaggccgagcgcgugaucgacccccggcgcugcaugaagcccgugauccucaccgacggggaggagcgggucauccuggccggccccaugccggugacccacagcuccgccgcccagcgccgcgggcggaucggccgcaaccccaagaacgagaacgaccaguacaucuacaugggggagccccuggagaacgacgaggacugcgcgcacuggaaggaggccaagaugcuccuggacaacaucaacacgcccgagggcaucaucccgagcauguucgagcccgagcgggagaagguggacgccaucgacggcgaguaccgccugcgcggggaggcccgcaagaccuucgucgaccucaugcggcgcggcgaccugcccguguggcuggccuacaagguggcggccgaggggaucaacuacgccgaccggcgcuggugcuucgacggcauccggaacaaccagauccucgaggagaacgucgagguggagaucuggaccaaggagggggagcgcaagaagcugaagccgcgguggcuggacgcccgcaucuacuccgacccccucgcccugaaggaguucaaggaguucgcggccggccggaagucccugacccucaaccugaucacggagaugggccgccugcccaccuucaugacccagaaggcccgggacgcccucgacaaccuggcgguccugcacaccgccgaggccgggggccgcgccuacaaccacgcccucuccgagcugcccgagacgcuggagaucagccuccugcugacccuccuggcgaccgugaccgggggcaucuuccuguuccucauguccggccgggggaucggcaagaugacgcuggggaugugcugcaucaucaccgccagcauccugcucugguacgcccagauccagccgcacuggaucgccgccagcaucauccuggaguucuuccugaucgugcuccugauccccgagcccgagaagcagcgcacgccccaggacaaccagcugaccuacgucgugaucgcgauccucaccguggucgccgccacgauggccaacgagaugggcuuccuggagaagaccaagaaggaccuggggcucggcuccaucaccacccagcagccggagagcaacauccuggacaucgaccugcggcccgccuccgcguggacgcucuacgccguggccaccaccuucaucacccccaugcugcgccacagcaucgagaacuccagcgugaacgucucccugacggccaucgccaaccaggcgaccgugcucaugggccuggggaagggcuggccccugagcaagauggacaucggggugccgcuccuggccaucggcugcuacucccaggucaaccccaucacccugaccgccgcccuccugcugcucguggcgcacuacgccaucaucgggcccggccugcaggccaaggccacgcgcgaggcccagaagcgggcggccgccggcaucaugaagaaccccaccguggacgggaucaccgucaucgaccuggacccgauccccuacgaccccaaguucgagaagcagcucggccaggugaugcugcuggugcucugcgucacccaggugcugaugaugcgcacgaccugggcccugugcgaggcccucacccuggcgaccgggcccaucagcacgcugugggagggcaacccggggcgguucuggaacaccaccaucgccguguccauggccaacaucuuccgcggcagcuaccucgccggcgccgggcugcuguucuccaucaugaagaacaccacgaacacccggcgcggcaccgggaacaucggcgagacccucggcgagaaguggaagucccggcugaacgcgcuggggaaguccgaguuccagaucuacaagaaguccggcauccaggaggucgaccgcacgcucgccaaggaggggaucaagcggggcgagaccgaccaccacgccgugucccgcgggagcgccaagcugcggugguucguggagcgcaacaugaucacccccgagggcaaggucguggaccugggcugcgggcggggcgggugguccuacuacugcggcgggcucaagaacgugcgcgaggucaagggccugaccaagggcgggcccggccacgaggagcccaucccgaugagcacguacggguggaaccuggugcggcuccagagcggcguggacgucuucuucacgccgcccgagaagugcgacacccugcugugcgacaucggggaguccagccccaacccgaccguggaggcgggccgcacgcuccgggugcugaaccuggucgagaacuggcucaacaacaacacccaguucugcaucaaggugcugaaccccuacaugcccuccgugaucgagaagauggaggcccugcagcgcaaguacggcggggcccugguccggaacccgcucagccgcaacuccacccacgagauguacugggugagcaacgccuccggcaacaucgugagcuccgucaacaugaucagccgcaugcugaucaaccgguucaccaugaagcacaagaaggccaccuacgagcccgacguggaccugggguccggcacgcgcaacaucgggaucgagagcgaggugcccaaccucgacaucaucggcaagcggaucgagaagaucaagcaggagcacgagaccuccuggcacuacgaccaggaccaccccuacaagaccugggcguaccacggcagcuacgagaccaagcagacgggguccgccagcuccauggucaacggcguggugcgccugcugaccaagccgugggacgucauccccauggugacccagauggccaugaccgacacgacccccuucgggcagcagcggguguucaaggagaaggucgacacccgcacccaggagcccaaggagggcacgaagaagcucaugaagaucaccgccgaguggcuguggaaggagcugggcaagaagaagaccccgcggaugugcacccgcgaggaguucacgcggaaggugcgcagcaacgccgcgcucggggccaucuucaccgacgagaacaaguggaaguccgcccgggaggccguggaggacagccgcuucugggagcuggucgacaaggagcggaaccugcaccucgagggcaagugcgagaccugcguguacaacaugauggggaagcgcgagaagaagcugggcgaguucgggaaggccaagggcagccgggcgaucugguacauguggcugggcgcccgcuuccucgaguucgaggcccugggguuccugaacgaggaccacugguucucccgggagaacagccucuccggcgucgagggggagggccugcacaagcugggguacauccuccgcgacgugagcaagaaggagggcggcgccauguacgcggacgacaccgccgggugggacacgcggaucacccuggaggaccugaagaacgaggagauggugaccaaccacauggagggcgagcacaagaagcucgccgaggccaucuucaagcugaccuaccagaacaaggucgugcgcgugcagcggcccacgccccgcgggaccgucauggacaucaucucccgccgggaccagcgcggcagcggccaggugggcaccuacggccugaacaccuucacgaacauggaggcccagcucauccggcagauggagggggagggcguguucaaguccauccagcaccugaccgcgaccgaggagaucgccguccagaacuggcuggcccgcguggggcgggagcgccucagccggauggccaucuccggcgacgacugcguggucaagccccuggacgaccgcuucgccagcgcgcugaccgcccucaacgacaugggcaaggugcggaaggacauccagcagugggagccguccaagggguggaacgacuggacccaggugcccuucugcagccaccacuuccacgagcugaucaugaaggacggccgcguccugguggugcccugccggaaccaggacgagcucaucgggcgcgcccggaucucccagggcgccggguggagccugcgcgagaccgccugccugggcaaguccuacgcgcagauguggagccucauguacuuccaccggcgcgaccugcggcuggccgccaacgccaucugcuccgccguccccagccacugggugccgaccagccgcaccacgugguccauccacgcgaagcacgaguggaugaccaccgaggacaugcucaccguguggaaccgggucuggauccaggagaaccccuggauggaggacaagacccccguggagagcugggaggagauccccuaccugggcaagcgcgaggaccaguggugcgggucccugaucggccucacgagccgcgccaccugggccaagaacauccagaccgccaucaaccaggugcggucccugaucgggaacgaggaguacaccgacuacaugccgagcaugaagcgcuuccggcgcgaggaggaggaggcgggcguccugugguga

SEQ ID NO: 9019 - RNA, 9876 nt, Artificial Sequence
  derived and/or modified CDS sequence (opt1) from DENV-2__KF744404__SS-prME
accgccgggaugaucaucaugcugauccccaccgugauggccuuccaccucaccacccggaacggggagccccacaugaucgucagccggcaggagaagggcaagagccugcuguucaagaccgaggacggggugaacaugugcacccucauggcgauggaccugggcgagcugugcgaggacaccaucaccuacaagugcccccuccugcgccagaacgagcccgaggacaucgacugcuggugcaacagcaccagcaccugggugaccuacgggaccugcaccaccacgggcgagcaccggcgcgagaagcggagcgucgcccuggugccccacgugggcauggggcucgagacccgcaccgagaccuggauguccagcgagggcgccuggaagcacgcccagcggaucgagacguggauccugcgccaccccggguucacccugauggccgcgauccucgccuacaccaucggcaccacgaacuuccagcgggcccugaucuucauccugcucaccgccgucgcgcccuccaugaccaugcgcugcaucgggaucagcaaccgggacuucguggagggcguguccggcgggagcugggucgacaucgugcuggagcacggcuccugcgugaccacgauggccaagaacaagcccacccuggacuucgagcucaucaagaccgaggccaagcagcccgccacccugcgcaaguacugcaucgaggccaagcugacgaacaccaccaccgagagccggugcccgacgcagggggagcccucccucaacgaggagcaggacaagcgcuucgucugcaagcacagcaugguggaccggggcuggggcaacgggugcggccuguucgggaagggcgggaucgugaccugcgcgauguucacgugcaagaagaacauggagggcaagaucguccagcccgagaaccuggaguacaccaucgugaucacgccccacuccggcgaggagcacgccguggggaacgacaccggcaagcacgggaaggagaucaagaucaccccgcagagcuccaucaccgaggccgagcucaccggcuacgggacggucaccauggagugcagcccccgcaccggccuggacuucaacgagauggugcugcuccagauggagaacaaggccuggcuggugcaccggcagugguuccuggaccucccccugcccuggcugccgggcgccgacacccagggguccaacuggauccagaaggagacgcucgucaccuucaagaacccccacgcgaagaagcaggacguggugguccugggcagccaggagggggccaugcacaccgcccugaccggcgccacggagauccagaugagcuccgggaaccuccuguucaccggccaccugaagugccgccuccggauggacaagcugcagcugaagggcaugagcuacuccaugugcaccgggaaguucaagguggucaaggagaucgccgagacccagcacggcacgaucguggugcgcguccaguacgagggggacggcagccccugcaagauccccuucgagaucauggaccucgagaagcggcacgugcugggccgccugaucaccgugaacccgaucgucaccgagaaggacucccccgugaacaucgaggcggagccgcccuucggggacagcuacgugaucaucggcgucgagccggggcagcucaagcugaacugguucaagaagggcuccagcaucgggcagauguucgagaccacgaugcgcggcgccaagcggauggccauccugggcgacaccgccugggacuucgggucccucggcgggguguucaccagcaucggcaaggcccugcaccagguguucggggcgaucuacggcgccgccuucuccggcgucagcuggaccaugaagauccugaucggggugaucaucacguggaucggcaugaacucccgcagcaccucccugagcgugucccucguccugguggggguggucacccuguaccucggcguggugguccaggccgacagcgggugcgugguguccuggcggaacaaggagcugaagugcggcagcggcaucuucaucaccgacaacguccacacguggaccgagcaguacaaguuccagcccgagagccccuccaagcuggcgagcgccauccagaaggcccaccaggaggggaucugcggcauccgcuccgugacccggcucgagaaccugauguggaagcagaucacccccgagcugaaccacauccucagcgagaacgaggugaagcugacgaucaugaccggggacaucaagggcaucaugcacgccgggaagcgcucccugcggccgcagcccaccgagcuccgcuacagcuggaagaccuggggcaaggccaagauccuguccacggagagccacaaccagaccuuccugaucgacggccccgagaccgcggagugcccgaacaccaaccgggccuggaacucccucgaggucgaggacuacggguucggcguguucacgaccaacaucuggcugcgccugcgggagaagcaggacgccuucugcgacagcaagcucauguccgccgccaucaaggacaaccgcgcggugcacgccgacaugggguacuggaucgagagcgcccugaacgacaccuggaagaucgagaaggccuccuucaucgaggucaagagcugccacuggcccaagucccacacccuguggagcaacggcgugcucgaguccgagaugaucauccccaagaacuucgccggccccgugagccagcacaacuaccggccgggguaccacacccagacggcgggccccuggcaccuggggaagcuggagauggacuucgacuucugcaagggcaccaccgucguggugaccgaggacugcgggaaccgcggccccagccuccggacgaccaccgccuccggcaagcugaucaccgaguggugcugccgcagcugcacgcugcccccgcuccgguaccgcggggaggacggcugcugguacgggauggagauccggccccugaaggagaaggaggagaaccuggucuccagccucgugaccgccggccacgggcagaucgacaacuucucccugggcgugcugggcauggcccucuuccuggaggagaugcugcgcacccgcgucgggaccaagcacgcgauccuccugguggccgugagcuucgucacgcugaucaccggcaacauguccuuccgggaccucgggcgcgugauggugauggucggcgccaccaugaccgacgacaucgggaugggcgugacguaccuggcccugcucgccgcguucaaggugcggcccaccuucgccgccggccugcugcuccgcaagcugaccagcaaggagcugaugaugaccacgaucgggaucguccuccugucccagagcaccauccccgagaccauccuggagcucaccgacgcccuggcccugggcaugauggugcucaagaucgugcggaagauggagcgcuaccagcuggcggucacgaucauggccauccugugcgugccgaacgccgucauccuccagaacgccuggaagguguccugcaccauccuggccguggucagcgugagcccccugcuccugaccagcucccagcagaaggcggacuggaucccccuggcccucaccaucaaggggcugaaccccacggccaucuuccugaccacccucagccggaccuccaagaagcgcagcuggccgcugaacgaggccaucauggcggugggcauggucuccauccuggccagcagccuccugaagaacgacauccccaugacgggcccccugguggccgggggccuccugaccgugugcuacguccugaccgggcgguccgccgaccucgagcuggagaaggccgcggacgugcgcugggaggaccaggccgagaucagcggcuccagccccauccuguccaucaucaucagcgaggacggguccaugagcaucaagaacgaggaggaggagcagacccucacgauccugauccggaccggccugcucgugaucuccggccuguucccggucagcauccccaucaccgccgccgccugguaccugugggaggugaagaagcagcgcgcgggggugcucugggacguccccagcccgccgcccgugggcaaggccgagcuggaggacggggccuaccggaucaagcagaagggcauccugggguacagccagaucggcgccggcguguacaaggaggggaccuuccacaccauguggcacgucacgcgcggcgccgugcucaugcacaaggggaagcggaucgagcccuccugggcggacgugaagaaggaccugaucagcuacggcgggggcuggaagcuggagggcgaguggaaggagggggaggagguccaggugcucgcccuggagcccggcaagaacccccgcgccgugcagaccaagcccgggcuguucaagaccaacgccggcaccaucggggccgucucccucgacuucagccccggcacguccggcagccccaucaucgacaagaaggggaagguggugggccuguacgggaacggcgucgugacccggaacggcuccuacgugagcgcgaucgcccagaccgagaaguccaucgaggacaaccccgagaucgaggacgacaucuuccgcaagaagcggcugaccaucauggaccugcaccccggggccggcaagacgaagcgcuaccuccccgccaucguccgggaggcgaucaagcgcgggcugcgcacccugauccucgccccgacccgggugguggccgccgagauggaggaggcccugcgcggccugcccauccgguaccagacccccgcgauccgcgccgagcacacggggcgggagaucgucgaccucaugugccacgccaccuucaccaugcgccugcugucccccauccgggugccgaacuacaaccucaucaucauggacgaggcccacuucaccgaccccgccagcaucgcggcccgcggcuacaucuccacgcggguggagaugggcgaggccgccgggaucuucaugaccgccacgccgcccggcagccgcgacccguucccccaguccaacgcgcccaucauggacgaggagcgggagauccccgagcgcagcuggaacuccgggcacgagugggucaccgacuucaagggcaagacggugugguucgugccgagcaucaaggccgggaacgacaucgccgccugccugcggaagaacggcaagaaggucauccagcugucccgcaagaccuucgacagcgaguacgugaagacccggaccaacgacugggacuucguggucacgaccgacaucuccgagaugggcgcgaacuucaaggccgagcgcgugaucgacccccggcgcugcaugaagcccgugauccucaccgacggggaggagcgggucauccuggccggccccaugccggugacccacagcuccgccgcccagcgccgcgggcggaucggccgcaaccccaagaacgagaacgaccaguacaucuacaugggggagccccuggagaacgacgaggacugcgcgcacuggaaggaggccaagaugcuccuggacaacaucaacacgcccgagggcaucaucccgagcauguucgagcccgagcgggagaagguggacgccaucgacggcgaguaccgccugcgcggggaggcccgcaagaccuucgucgaccucaugcggcgcggcgaccugcccguguggcuggccuacaagguggcggccgaggggaucaacuacgccgaccggcgcuggugcuucgacggcauccggaacaaccagauccucgaggagaacgucgagguggagaucuggaccaaggagggggagcgcaagaagcugaagccgcgguggcuggacgcccgcaucuacuccgacccccucgcccugaaggaguucaaggaguucgcggccggccggaagucccugacccucaaccugaucacggagaugggccgccugcccaccuucaugacccagaaggcccgggacgcccucgacaaccuggcgguccugcacaccgccgaggccgggggccgcgccuacaaccacgcccucuccgagcugcccgagacgcugcagaucagccuccugcugacccuccuggcgaccgugaccgggggcaucuuccuguuccucauguccggccgggggaucggcaagaugacgcuggggaugugcugcaucaucaccgccagcauccugcucugguacgcccagauccagccgcacuggaucgccgccagcaucauccuggaguucuuccugaucgugcuccugauccccgagcccgagaagcagcgcacgccccaggacaaccagcugaccuacgucgugaucgcgauccucaccguggucgccgccacgauggccaacgagaugggcuuccuggagaagaccaagaaggaccuggggcucggcuccaucaccacccagcagccggagagcaacauccuggacaucgaccugcggcccgccuccgcguggacgcucuacgccguggccaccaccuucaucacccccaugcugcgccacagcaucgagaacuccagcgugaacgucucccugacggccaucgccaaccaggcgaccgugcucaugggccuggggaagggcuggccccugagcaagauggacaucggggugccgcuccuggccaucggcugcuacucccaggucaaccccaucacccugaccgccgcccuccugcugcucguggcgcacuacgccaucaucgggcccggccugcaggccaaggccacgcgcgaggcccagaagcgggcggccgccggcaucaugaagaaccccaccguggacgggaucaccgucaucgaccuggacccgauccccuacgaccccaaguucgagaagcagcucggccaggugaugcugcuggugcucugcgucacccaggugcugaugaugcgcacgaccugggcccugugcgaggcccucacccuggcgaccgggcccaucagcacgcugugggagggcaacccggggcgguucuggaacaccaccaucgccguguccauggccaacaucuuccgcggcagcuaccucgccggcgccgggcugcuguucuccaucaugaagaacaccacgaacacccggcgcggcaccgggaacaucggcgagacccucggcgagaaguggaagucccggcugaacgcgcuggggaaguccgaguuccagaucuacaagaaguccggcauccaggaggucgaccgcacgcucgccaaggaggggaucaagcggggcgagaccgaccaccacgccgugucccgcgggagcgccaagcugcggugguucguggagcgcaacaugaucacccccgagggcaaggucguggaccugggcugcgggcggggcgggugguccuacuacugcggcgggcucaagaacgugcgcgaggucaagggccugaccaagggcgggcccggccacgaggagcccaucccgaugagcacguacggguggaaccuggugcggcuccagagcggcguggacgucuucuucacgccgcccgagaagugcgacacccugcugugcgacaucggggaguccagccccaacccgaccguggaggcgggccgcacgcuccgggugcugaaccuggucgagaacuggcucaacaacaacacccaguucugcaucaaggugcugaaccccuacaugcccuccgugaucgagaagauggaggcccugcagcgcaaguacggcggggcccugguccggaacccgcucagccgcaacuccacccacgagauguacugggugagcaacgccuccggcaacaucgugagcuccgucaacaugaucagccgcaugcugaucaaccgguucaccaugaagcacaagaaggccaccuacgagcccgacguggaccugggguccggcacgcgcaacaucgggaucgagagcgaggugcccaaccucgacaucaucggcaagcggaucgagaagaucaagcaggagcacgagaccuccuggcacuacgaccaggaccaccccuacaagaccugggcguaccacggcagcuacgagaccaagcagacgggguccgccagcuccauggucaacggcguggugcgccugcugaccaagccgugggacgucauccccauggugacccagauggccaugaccgacacgacccccuucgggcagcagcggguguucaaggagaaggucgacacccgcacccaggagcccaaggagggcacgaagaagcucaugaagaucaccgccgaguggcuguggaaggagcugggcaagaagaagaccccgcggaugugcacccgcgaggaguucacgcggaaggugcgcagcaacgccgcgcucggggccaucuucaccgacgagaacaaguggaaguccgcccgggaggccguggaggacagccgcuucugggagcuggucgacaaggagcggaaccugcaccucgagggcaagugcgagaccugcguguacaacaugauggggaagcgcgagaagaagcugggcgaguucgggaaggccaagggcagccgggcgaucugguacauguggcugggcgcccgcuuccucgaguucgaggcccugggguuccugaacgaggaccacugguucucccgggagaacagccucuccggcgucgagggggagggccugcacaagcugggguacauccuccgcgacgugagcaagaaggagggcggcgccauguacgcggacgacaccgccgggugggacacgcggaucacccuggaggaccugaagaacgaggagauggugaccaaccacauggagggcgagcacaagaagcucgccgaggccaucuucaagcugaccuaccagaacaaggucgugcgcgugcagcggcccacgccccgcgggaccgucauggacaucaucucccgccgggaccagcgcggcagcggccaggugggcaccuacggccugaacaccuucacgaacauggaggcccagcucauccggcagauggagggggagggcguguucaaguccauccagcaccugaccgcgaccgaggagaucgccguccagaacuggcuggcccgcguggggcgggagcgccucagccggauggccaucuccggcgacgacugcguggucaagccccuggacgaccgcuucgccagcgcgcugaccgcccucaacgacaugggcaaggugcggaaggacauccagcagugggagccguccaagggguggaacgacuggacccaggugcccuucugcagccaccacuuccacgagcugaucaugaaggacggccgcguccugguggugcccugccggaaccaggacgagcucaucgggcgcgcccggaucucccagggcgccggguggagccugcgcgagaccgccugccugggcaaguccuacgcgcagauguggagccucauguacuuccaccggcgcgaccugcggcuggccgccaacgccaucugcuccgccguccccagccacugggugccgaccagccgcaccacgugguccauccacgcgaagcacgaguggaugaccaccgaggacaugcucaccguguggaaccgggucuggauccaggagaaccccuggauggaggacaagacccccguggagagcugggaggagauccccuaccugggcaagcgcgaggaccaguggugcgggucccugaucggccucacgagccgcgccaccugggccaagaacauccagaccgccaucaaccaggugcggucccugaucgggaacgaggaguacaccgacuacaugccgagcaugaagcgcuuccggcgcgaggaggaggaggcgggcguccugugguga

SEQ ID NO: 9020 - RNA, 9876 nt, Artificial Sequence
  derived and/or modified CDS sequence (opt1) from DENV-2__KF744407__SS-prME
accgccggcaugaucaucaugcugauccccaccgugauggccuuccaccucaccacccggaacggggagccccacaugaucgucagccggcaggagaagggcaagagccugcuguucaagaccgaggacggggugaacaugugcacccucauggcgauggaccugggcgagcugugcgaggacaccaucaccuacaagugcccccuccugcggcagaacgagcccgaggacaucgacugcuggugcaacagcaccuccaccugggugaccuacgggaccugcaccaccacgggcgagcaccggcgcgagaagcggagcgucgcccuggugccccacgugggcauggggcucgagacccgcaccgagaccuggauguccagcgagggcgccuggaagcacgcccagcggaucgagacguggauccugcgccaccccggguucacccugauggccgcgauccucgccuacaccaucggcaccacgaacuuccagcgggcccugaucuucauccugcucaccgccgucgcgcccuccaugaccaugcgcugcaucgggaucagcaaccgggacuucguggagggcguguccggcgggagcugggucgacaucgugcuggagcacggcuccugcgugaccacgauggccaagaacaagcccacccuggacuucgagcucaucaagaccgaggccaagcaccccgccacccugcgcaaguacugcaucgaggccaagcugacgaacaccaccaccgcgagccggugcccgacgcagggggagcccucccucaacgaggagcaggacaagcgcuucgucugcaagcacagcaugguggaccggggcuggggcaacgggugcggccuguucgggaagggcgggaucgugaccugcgccauguucacgugcaagaagaacauggagggcaaggucgugcagcccgagaaccuggaguacaccaucgugaucacgccccacuccggcgaggagcacgccgucgggaacgacaccggcaagcacgggaaggagaucaagaucaccccgcagagcuccaucaccgaggccgagcucaccggcuacgggacggugaccauggagugcagcccccgcaccggccuggacuucaacgagauggugcugcuccagauggagaacaaggccuggcugguccaccggcagugguuccuggaccucccccugcccuggcugccgggcgcggacacccagggguccaacuggauccagaaggagacgcucgugaccuucaagaacccccacgccaagaagcaggacguggucgugcugggcagccaggagggggccaugcacaccgcccugaccggcgccacggagauccagaugagcuccgggaaccuccuguucaccggccaccugaagugccgccuccggauggacaagcugcagcugaagggcaugagcuacuccaugugcaccgggaaguucaaggucgugaaggagaucgcggagacccagcacggcacgaucgugguccgcgugcaguacgagggggacggcagccccugcaagauccccuucgagaucauggaccucgagaagcggcacgugcugggccgccugaucaccgucaacccgaucgugaccgagaaggacucccccgugaacaucgaggccgagccgcccuucggggacagcuacgucaucaucggcguggagccggggcagcucaagcugaacugguucaagaagggcuccagcaucgggcagauguucgagaccacgaugcgcggcgccaagcggauggccauccugggcgacaccgccugggacuucgggucccucggcgggguguucaccagcaucggcaaggcgcugcaccaggucuucggggccaucuacggcgccgccuucuccggcgugagcuggaccaugaagauccugaucggggugaucaucacguggaucggcaugaacucccgcagcaccucccugagcgucucccucgugcuggugggggucgugacccuguaccucggcgugaugguccaggcggacagcgggugcguggccuccuggaagaacaaggagcugaagugcggcagcggcaucuucaucaccgacaacgugcacacguggaccgagcaguacaaguuccagcccgagagccccuccaagcuggccagcgccauccagaaggcccaccaggaggggaucugcggcauccgguccgucacccgccucgagaaccugauguggaagcagaucacccccgagcugaaccacauccucagcgagaacgaggugaagcugacgaucaugaccggggacaucaagggcaucaugcacgcggggaagcggucccugcgcccgcagcccaccgagcuccgguacagcuggaagaccuggggcaaggccaagauccuguccacggagagccacaaccagaccuuccugaucgacggccccgagaccgccgagugcccgaacaccaaccgcgccuggaacucccucgagguggaggacuacggguucggcgucuucacgaccaacaucuggcugcggcugcgcgagaagcaggacgccuucugcgacagcaagcucauguccgcggccaucaaggacaaccgggccgugcacgccgacaugggguacuggaucgagagcgcccugaacgacaccuggaagaucgagaaggcguccuucaucgaggucaagagcugccacuggcccaagucccacacccuguggagcaacggcgugcucgaguccgagaugaucauccccaagaacuucgccggccccgugagccagcacaacuaccgcccgggguaccacacccagacggccggccccuggcaccuggggaagcuggagauggacuucgacuucugcgagggcaccaccguggucgugaccgaggacugcgggaaccggggccccagccuccgcacgaccaccgccuccggcaagcugaucaccgaguggugcugccggagcugcacgcugcccccgcuccgcuaccgcggggaggacggcugcugguacgggauggagauccgcccccugaaggagaaggaggagaaccugguguccagccucgucaccgcgggccacgggcagaucgacaacuucucccugggcgugcugggcauggcccucuuccuggaggagaugcugcggacccgcguggggaccaagcacgccauccuccuggucgccgugagcuucgugacgcugaucaccggcaacauguccuuccgcgaccucgggcgggucauggugauggugggcgccaccaugaccgacgacaucgggaugggcgucacguaccuggcgcugcucgccgccuucaaggugcgccccaccuucgccgccggccugcugcuccggaagcugaccagcaaggagcugaugaugaccacgaucgggaucgugcuccugucccagagcaccauccccgagaccauccuggagcucaccgacgcgcuggcccugggcaugaugguccucaagaucgugcgcaacauggagaaguaccagcuggccgugacgaucauggccauccugugcgucccgaacgccgugauccuccagaacgcguggaaggucuccugcaccauccuggccguggugagcgucagcccccugcuccugaccagcucccagcagaaggccgacuggaucccccuggcccucaccaucaaggggcugaaccccacggcgaucuuccugaccacccucagccggaccuccaagaagcgcagcuggccgcugaacgaggccaucauggccgugggcaugguguccauccuggccagcagccuccugaagaacgacauccccaugacgggcccccuggucgccgggggccuccugaccgugugcuacgugcugaccgggcgguccgcggaccucgagcuggagaaggccgccgacguccgcugggaggagcaggccgagaucagcggcuccagccccauccuguccaucaucaucagcgaggacggguccaugagcaucaagaacgaggaggaggagcagacccucacgauccugauccggaccggccugcucgugaucuccggccuguucccggugagcauccccaucaccgccgcggccugguaccugugggaggucaagaagcagcgcgccggggugcucugggacgugcccagcccgccgcccgucggcaaggccgagcuggaggacggggccuaccggaucaagcagaagggcauccugggguacagccagaucggcgcgggcguguacaaggaggggaccuuccacaccauguggcacgugacgcgcggcgccguccucaugcacaaggggaagcggaucgagcccuccugggccgacgugaagaaggaccugaucagcuacggcgggggcuggaagcuggagggcgaguggaaggagggggaggaggugcagguccucgcccuggagcccggcaagaacccccgcgccgugcagaccaagcccgggcuguucaagaccaacgcgggcaccaucggggccgugucccucgacuucagccccggcacguccggcagccccaucaucgacaagaaggggaaggucgugggccuguacgggaacggcguggucacccggaacggcuccuacgugagcgccaucgcccagaccgagaaguccaucgaggacaaccccgagaucgaggacgacaucuuccgcaagaagcggcugaccaucauggaccugcaccccggggcgggcaagacgaagcgcuaccuccccgccaucgugcgggaggccaucaagcgcgggcugcggacccugauccucgccccgacccgcgucguggccgcggagauggaggaggcccugcgcggccugcccauccgguaccagacccccgccauccgcgccgagcacacggggcgggagaucguggaccucaugugccacgccaccuucaccaugcgccugcugucccccauccgggucccgaacuacaaccucaucaucauggacgaggcgcacuucaccgaccccgccagcaucgccgcccgcggcuacaucuccacgcggguggagaugggcgaggccgcggggaucuucaugaccgccacgccgcccggcagccgcgacccguucccccaguccaacgcccccaucauggacgaggagcgggagauccccgagcgcagcuggaacuccgggcacgagugggugaccgacuucaagggcaagacggucugguucgugccgagcaucaaggccgggaacgacaucgcggccugccugcggaagaacggcaagaaggugauccagcugucccgcaagaccuucgacagcgaguacgucaagacccggaccaacgacugggacuucguggugacgaccgacaucuccgagaugggcgccaacuucaaggccgagcgcgucaucgacccccggcgcugcaugaagcccgugauccucaccgacggggaggagcgggugauccuggccggccccaugccggucacccacagcuccgcggcccagcgccgggggcgcaucggccgcaaccccaagaacgagaacgaccaguacaucuacaugggggagccccuggagaacgacgaggacugcgcccacuggaaggaggccaagaugcuccuggacaacaucaacacgcccgagggcaucaucccgagcauguucgagcccgagcgggagaagguggacgccaucgacggcgaguaccgccugcgcggggaggcgcgcaagaccuucguggaccucaugcggcgcggcgaccugcccgucuggcuggccuacaagguggccgccgaggggaucaacuacgccgaccggcgcuggugcuucgacggcauccggaacaaccagauccucgaggagaacguggaggucgagaucuggaccaaggagggggagcgcaagaagcugaagccgcgguggcuggacgcgcgcaucuacuccgacccccucgcccugaaggaguucaaggaguucgccgccggccggaagucccugacccucaaccugaucacggagaugggccgccugcccaccuucaugacccagaaggcgcgggacgcccucgacaaccuggccgugcugcacaccgccgaggccgggggccgcgcguacaaccacgcccucuccgagcugcccgagacgcuggagacccuccugcugcucacccugcuggccaccgucaccggcgggaucuuccucuuccugaugagcgggaaggggaucggcaagaugacccuggggaugugcugcaucaucaccgccuccgugcuccugugguacgcccagauccagccgcacuggaucgcggccagcaucauccuggaguucuuccucaucgugcugcugauccccgagcccgagaagcagcggacgccccaggacaaccagcucaccuacgucgugaucgccauccugacgguggucgccgccaccauggcgaacgagaugggcuuccuggagaagaccaagaaggacuucgggcucggcagcaucgccacccagcagccggaguccaacauccuggacaucgaccugcgccccgccagcgccuggacgcucuacgccguggcgaccaccuucaucacccccaugcugcggcacuccaucgagaacagcuccgugaacgucagccugacggccaucgccaaccaggccaccgugcucaugggccuggggaagggcuggccccuguccaagauggacaucggggugccgcuccuggcgaucggcugcuacagccaggucaaccccaucacccugaccgccgcccuccugcugcucguggcccacuacgccaucaucgggcccggccugcaggcgaaggccacgcgcgaggcccagaagcgggccgccgcgggcaucaugaagaaccccaccguggacgggaucaccgucaucgaccuggacccgauccccuacgaccccaaguucgagaagcagcucggccaggugaugcugcuggugcucugcgucacccaggugcugaugaugcgcacgaccugggcccugugcgaggcccucacccuggccaccgggcccaucuccacgcugugggagggcaacccggggcgcuucuggaacaccaccaucgccgugagcauggcgaacaucuuccggggcuccuaccucgccggcgccgggcugcuguucagcaucaugaagaacaccacgaacacccgccggggcaccgggaacaucggcgagacccucggcgagaaguggaagucccgccugaacgcccugggcaagagcgaguuccagaucuacaagaaguccggcauccaggaggucgaccggacgcucgcgaaggaggggaucaagcgcggcgagaccgaccaccacgccgugagccggggguccgccaagcugcgcugguucguggagcggaacaugaucacccccgagggcaaggucguggaccugggcugcgggcgcggcggguggagcuacuacugcggcgggcucaagaacgugcgggaggucaagggccugaccaagggcgggcccggccacgaggagcccaucccgauguccacguacggguggaaccuggugcgccuccagagcggcguggacgucuucuucacgccgcccgagaagugcgacacccugcugugcgacaucggggagagcucccccaacccgaccguggaggccggccggacgcuccgcgugcugaaccuggucgagaacuggcucaacaacaacacccaguucugcaucaaggugcugaaccccuacaugcccagcgugaucgagaagauggaggcccugcagcggaaguacggcggggcgcugguccgcaacccgcucucccggaacagcacccacgagauguacuggguguccaacgccagcggcaacaucguguccagcgucaacaugaucucccgcaugcugaucaaccgguucaccaugaagcacaagaaggccaccuacgagcccgacguggaccuggggagcggcacgcgcaacaucgggaucgaguccgaggugcccaaccucgacaucaucggcaagcgcaucgagaagaucaagcaggagcacgagaccagcuggcacuacgaccaggaccaccccuacaagaccugggccuaccacggcuccuacgagaccaagcagacggggagcgccuccagcauggucaacggcguggugcggcugcugaccaagccgugggacgucauccccauggugacccagauggcgaugaccgacacgacccccuucgggcagcagcgcguguucaaggagaaggucgacacccggacccaggagcccaaggagggcacgaagaagcucaugaagaucaccgccgaguggcuguggaaggagcugggcaagaagaagaccccgcgcaugugcacccgggaggaguucacgcgcaaggugcgguccaacgccgcccucggggccaucuucaccgacgagaacaaguggaaguccgcgcgcgaggccguggaggacucccgguucugggagcuggucgacaaggagcgcaaccugcaccucgagggcaagugcgagaccugcguguacaacaugauggggaagcgggagaagaagcugggcgaguucgggaaggccaagggcagccgcgccaucugguacauguggcugggcgcgcgguuccucgaguucgaggcccugggguuccugaacgaggaccacugguucagccgcgagaacucccucagcggcgucgagggggagggccugcacaagcugggguacauccuccgggacguguccaagaaggagggcggcgccauguacgccgacgacaccgccgggugggacacgcgcaucacccuggaggaccugaagaacgaggagauggugaccaaccacauggagggcgagcacaagaagcucgcggaggccaucuucaagcugaccuaccagaacaaggucgugcgggugcagcgccccacgccccgggggaccgucauggacaucaucagccgccgggaccagcgcggcuccggccagguggggaccuacggccugaacaccuucacgaacauggaggcccagcucauccgccagauggagggggagggcguguucaagagcauccagcaccugaccgccaccgaggagaucgccguccagaacuggcugacccggguggggcgcgagcggcucucccgcauggcgaucagcggcgacgacugcguggucaagccccuggacgaccgguucgccuccgcccugacggcccucaacgacaugggcaaggugcgcaaggacauccagcagugggagccgagcaagggguggaacgacuggacccaggugcccuucugcucccaccacuuccacgagcugaucaugaaggacggccggguccugguggugcccugccgcaaccaggacgagcucaucgggcgggcccgcaucagccagggcgcgggguggucccugcgggagaccgccugccugggcaagagcuacgcccagauguggucccucauguacuuccaccgccgggaccugcgccuggccgccaacgcgaucugcagcgccguccccucccacugggugccgaccagccggacgaccuggagcauccacgccaagcacgaguggaugaccaccgaggacaugcucaccguguggaaccgcgucuggauccaggagaaccccuggauggaggacaagacgcccguggaguccugggaggagauccccuaccugggcaagcgggaggaccaguggugcgggagccugaucggccucaccucccgcgccaccugggcgaagaacauccagaccgccaucaaccaggugcggagccugaucgggaacgaggaguacacggacuacaugccguccaugaagcgcuuccgccgggaggaggaggaggccggcguccugugguga

SEQ ID NO: 9021 - RNA, 9876 nt, Artificial Sequence
  derived and/or modified CDS sequence (opt1) from DENV-2__KF744399__SS-prME
accgccggcaugaucaucaugcugauccccaccgugauggccuuccaccucaccacccgcaacggggagccccacaugaucgugagccggcaggagaagggcaagagccugcuguucaagaccgaggacggggugaacaugugcacccucauggcgauggaccugggcgagcugugcgaggacaccaucaccuacaagugcccccuccugcgccagaacgagcccgaggacaucgacugcuggugcaacagcaccagcaccugggugaccuacgggaccugcaccaccacgggcgagcaccggcgcgagaagcggagcgucgcccuggugccccacgugggcauggggcucgagacccgcaccgagaccuggaugagcagcgagggcgccuggaagcacgcccagcggaucgagacguggauccugcgccacccgggguucacccugauggccgcgauccucgccuacaccaucggcaccacgaacuuccagcgggcccugaucuucauccugcucaccgccgucgcgcccagcaugaccaugcgcugcaucgggaucagcaaccgggacuucguggagggcguguccggcgggagcugggucgacaucgugcuggagcacggcuccugcgugaccacgauggccaagaacaagcccacccuggacuucgagcucaucaagaccgaggccaagcaccccgccacccugcgcaaguacugcaucgaggccaagcugacgaacaccaccaccgagagccggugcccgacgcagggggagcccucccucaacgaggagcaggacaagcgcuucgucugcaagcacagcaugguggaccggggcuggggcaacgggugcggccuguucgggaagggcgggaucgugaccugcgcgauguucacgugcaagaagaacauggagggcaagaucguccagcccgagaaccuggaguacaccaucgugaucacgccccacuccggcgaggagaacgccguggggaacgacaccggcaagcacgggaaggagaucaaggucaccccgcagagcuccaucaccgaggccgagcucaccggcuacgggacggugaccauggagugcagcccccgcaccggccugggcuucaacgagauggugcugcuccagauggagaacaaggccuggcugguccaccggcagugguuccuggaccucccccugcccuggcugccgggggccgacacccagggcuccaacuggauccagaaggagacgcucgugaccuucaagaacccccacgcgaagaagcaggacguggucgugcuggggagccaggagggcgccaugcacaccgcccugaccggggccacggagauccagaugagcuccggcaaccuccuguucaccggccaccugaagugccgccuccggauggacaagcugcagcugaaggggaugagcuacuccaugugcaccggcaaguucaaggucgugaaggagaucgccgagacccagcacgggacgaucgugguccgcgugcaguacgagggcgacggcagccccugcaagauccccuucgagaucauggaccucgagaagcggcacgugcuggggcgccugaucaccgucaacccgaucgugaccgagaaggacucccccgugaacaucgaggcggagccgcccuucggcgacagcuacgucaucaucgggguggagccgggccagcucaagcuguccugguucaagaaggggagcuccaucggccagauguucgagaccacgaugcgcggcgccaagcggauggccauccugggggacaccgccugggacuucggcagccucgggggcguguucaccuccaucgggaaggcccugcaccaggucuucggcgcgaucuacggcgccgccuucagcgggguguccuggaccaugaagauccugaucggcguggucaucacguggaucgggaugaacagccgcuccaccagccuguccgugagccucgugcuggucggcguggugacccuguaccucggggucauggugcaggccgacuccggcugcguggucagcuggaagaacaaggagcugaagugcggcagcgggaucuucaucaccgacaacgugcacacguggaccgagcaguacaaguuccagcccgagucccccagcaagcuggcguccgccauccagaaggcccaccaggagggcaucugcgggauccggagcgugacccgccucgagaaccugauguggaagcagaucacccccgagcugaaccacauccucuccgagaacgaggucaagcugacgaucaugaccggcgacaucaaggggaucaugcacgccggcaagcggagccugcgcccgcagcccaccgagcuccgguacuccuggaaggccuggggcaaggcgaagauccugagcaccgagcugcacaaccagacguuccucaucgacgggcccgagaccgccgagugcccgaacaccaaccgcgccuggaacucccuggagguggaggacuacggcuucgggguguucaccacgaacaucuggcugaagcuccgggagaagcaggacgccuucugcgacagcaagcugauguccgccgcgaucaaggacaaccgcgccguccacgccgacaugggcuacuggaucgagagcgcccugaacgacaccuggaagaucgagaaggccuccuucaucgaggucaagagcugccacuggcccaagucccacacccucuggagcaacggcgugcuggaguccgagaugaucauccccaagaacuucgcggggcccgugagccagcacaacuaccggccgggcuaccacacccagaccgccgggcccuggcaccugggcaagcucgagauggacuucgacuucugcaaggggacgaccgugguggucaccgaggacugcggcaaccgcggccccagccugcggaccacgaccgccuccgggaagcugaucaccgaguggugcugccgcagcugcacccucccgccccugcgguaccgcggcgaggacgggugcugguacggcauggagauccggccccugaaggagaaggaggagaaccucgugaacucccuggugacggccgggcacggccagaucgacaacuucagccugggcguccucgggauggcgcuguuccuggaggagaugcuccgcacccgggugggcaccaagcacgccauccugcugguggccgucuccuucgugacccucaucacggggaacaugagcuuccgcgaccugggccgcgugauggucauggugggggccaccaugaccgacgacaucggcaugggcgugaccuaccuggcccuccuggcggccuucaagguccggcccacguucgccgccgggcugcuccugcgcaagcugaccuccaaggagcucaugaugaccaccaucggcaucgugcugcugagccaguccacgauccccgagaccauccucgagcugaccgacgcccuggcgcucgggaugauggugcugaagaucguccggaagauggagcgcuaccagcuggccgugaccaucauggccauccucugcguccccaacgccgugauccugcagaacgccuggaaggugagcugcacgauccuggcggucguguccgugagcccccuccugcugaccuccagccagcagaaggccgacuggaucccccucgcccugaccaucaagggccugaaccccaccgccaucuuccucacgacccugucccggaccagcaagaagcgcuccuggccgcugaacgaggcgaucauggccgucggcauggugagcauccucgccuccagccugcugaagaacgacauccccaugaccgggccccucguggccggcgggcugcugacggucugcuacgugcucaccggccggagcgccgaccuggagcuggagaaggcggccgacgugcgcugggaggagcaggccgagaucuccgggagcucccccauccucagcaucaucaucuccgaggacggcagcauguccaucaagaacgaggaggaggagcagacccugaccauccugauccggacgggccuccuggucaucagcgggcuguucccgguguccauccccaucaccgccgccgcgugguaccucugggaggugaagaagcagcgcgccggcguccugugggacgugcccuccccgccgcccguggggaaggccgagcuggaggacggcgccuaccggaucaagcagaaggggauccucggcuacucccagaucggcgccggggucuacaaggagggcaccuuccacaccauguggcacgugacccgcggggcggugcugaugcacaagggcaagcggcuggagcccagcugggccgacgucaagaaggaccucaucuccuacgggggcggcuggaagcuggagggggaguggaaggagggcgaggagguccaggugcuggcccucgagcccgggaagaacccccgcgccguccagacgaagcccggccuguucaagaccaacaccgggaccaucggcgccgugagccuggacuucucccccggcacgagcgggucccccaucaucgacaagaagggcaagguggucgggcuguacggcaacggcguggugacccggaacgggagcuacgucuccgcgaucgcccagaccgagaaguccaucgaggacaaccccgagaucgaggacgacaucuuccgcaagaagcggcucaccaucauggaccugcaccccggcgccgggaagacgaagcgcuaccugcccgccaucgugcgggaggcgaucaagcgcggccuccggacccugauccuggccccgacccgcguggucgccgccgagauggaggaggcccuccgcgggcugcccauccgguaccagacccccgcgauccgcgccgagcacacgggccgggagaucguggaccugaugugccacgccaccuucaccaugcgccuccugagccccauccgggugccgaacuacaaccugaucaucauggacgaggcccacuucaccgaccccgccuccaucgcggcccgcggcuacaucagcacgcgggucgagaugggggaggccgccggcaucuucaugaccgccacgccgcccgggucccgcgacccguucccccagagcaacgcgcccaucauggacgaggagcgggagauccccgagcgcuccuggaacagcggccacgagugggugaccgacuucaaggggaagacggugugguucgucccguccaucaaggccggcaacgacaucgccgccugccuccggaagaacggcaagaaggugauccagcugagccgcaagaccuucgacuccgaguacgugaagacccggaccaacgacugggacuucgucgugacgaccgacaucagcgagaugggggcgaacuucaaggccgagcgcgugaucgacccccggcgcugcaugaagcccgucauccugaccgacggcgaggagcgggugauccucgccgggcccaugccggugacccacuccagcgccgcccagcgccggggccgcaucgggcgcaaccccaagaacgagaacgaccaguacaucuacaugggcgagccccuggagaacgacgaggacugcgcgcacuggaaggaggccaagaugcugcucgacaacaucaacacgcccgagggcaucaucccguccauguucgagcccgagcgggagaaggucgacgccaucgacggggaguaccgccugcggggcgaggcccgcaagaccuucguggaccugaugcggcgcggggaccuccccguguggcuggccuacaaggucgcggccgagggcaucaacuacgccgaccggcgcuggugcuucgacgggauccggaacaaccagauccuggaggagaacguggaggucgagaucuggaccaaggagggcgagcgcaagaagcucaagccgcgguggcuggacgcccgcaucuacagcgacccccuggcccucaaggaguucaaggaguucgcggccggccggaagucccugacccugaaccucaucacggagauggggcgccugcccaccuucaugacccagaaggcccgggacgcccuggacaaccucgcggugcugcacaccgccgaggccggcgggcgcgccuacaaccacgcccugagcgagcuccccgagacgcuggagacccugcuccugcugacccuccuggcgaccgugacgggcggcaucuuccuguuccucauguccgggaagggcaucgggaagaugacccugggcaugugcugcaucaucaccgccagcguccugcucugguacgcccagauccagccgcacuggaucgccgccuccaucauccuggaguucuuccugaucgugcuccugauccccgagcccgagaagcagcggacgccccaggacaaccagcugaccuacguggucaucgcgauccucacggugguggccgccaccauggccaacgagaugggguuccuggagaagaccaagaaggacuucggccugggcagcaucgccacccagcagccggagagcaacauccucgacaucgaccugcgccccgcguccgccuggacgcuguacgccgucgccaccaccuucaucacccccaugcuccggcacagcaucgagaacuccagcgugaacgugucccugacggccaucgcgaaccaggccaccguccugauggggcucggcaagggguggccccugagcaagauggacaucggcgugccgcugcucgccaucgggugcuacucccaggugaaccccaucacccugaccgccgcgcugcuccugcuggucgcccacuacgccaucaucggccccggccuccaggccaaggccacgcgcgaggcgcagaagcgggccgccgccgggaucaugaagaaccccaccguggacggcaucaccgugaucgaccuggacccgauccccuacgaccccaaguucgagaagcagcuggggcaggucaugcuccuggugcugugcgugacccagguccucaugaugcgcacgaccugggcccugugcgaggcgcugacccucgccaccggccccaucagcacgcugugggaggggaacccgggccgcuucuggaacaccaccaucgccguguccauggccaacaucuuccggggcagcuaccuggccggggcgggccuccuguucuccaucaugaagaacaccacgaacacccgccgggggaccggcaacaucggcgagacccugggggagaaguggaagucccgccucaacgcccugggcaaguccgaguuccagaucuacaagaaguccgggauccaggagguggaccggacgcuggccaaggagggcaucaagcgcggggagaccgaccaccacgccgucucccggggcagcgcgaagcuccgcugguucguggagcggaacauggugacccccgagggcaaggucguggaccuggggugcggccgcgggggcugguccuacuacugcgggggccugaagaacgugcgggaggucaagggccucaccaagggcgggcccgggcacgaggagcccaucccgaugagcacguacggcuggaaccuggugcgccugcaguccgggguggacgucuucuucacgccgcccgagaagugcgacacccuccugugcgacaucggcgagagcagccccaacccgaccguggaggccggccggacgcugcgcgugcucaaccuggucgagaacuggcugaacaacaacacccaguucugcaucaaggugcugaaccccuacaugcccuccgugaucgagaagauggaggcccuccagcggaaguacgggggcgcccugguccgcaacccgcugagccggaacuccacccacgagauguacugggugagcaacgccuccgggaacaucgugagcuccgucaacaugaucagccgcaugcucaucaaccgguucaccaugcgccacaagaaggcgaccuacgagcccgacguggaccugggcuccgggacgcgcaacaucggcaucgagagcgagauccccaaccuggacaucaucggcaagcggaucgagaagaucaagcaggagcacgagaccuccuggcacuacgaccaggaccaccccuacaagaccugggccuaccacgggagcuacgagaccaagcagacgggcuccgccagcuccauggugaacggggucgugcgccuccugaccaagccgugggacgugauccccauggucacccagauggccaugaccgacacgacccccuucggccagcagcggguguucaaggagaagguggacacccgcacccaggagcccaaggagggcacgaagaagcugaugaagaucaccgccgaguggcucuggaaggagcuggggaagaagaagaccccgcggaugugcacccgcgaggaguucacgcggaagguccgcagcaacgcggcccugggcgccaucuucaccgacgagaacaaguggaaguccgcccgggaggccguggaggacagccgcuucugggagcucgucgacaaggagcggaaccugcaccuggaggggaagugcgagaccugcguguacaacaugaugggcaagcgcgagaagaagcucggggaguucggcaaggcgaagggcucccgggccaucugguacauguggcugggggcccgcuuccuggaguucgaggcccucggcuuccugaacgaggaccacugguucagccgggagaacagccuguccgggguggagggcgaggggcuccacaagcugggcuacauccugcgcgaggucagcaagaaggagggcggggcgauguacgccgacgacaccgccggcugggacacgcggaucacccucgaggaccugaagaacgaggagauggugaccaaccacauggagggggagcacaagaagcuggccgaggccaucuucaagcucaccuaccagaacaaggugguccgcgugcagcggcccacgccccgcggcaccgugauggacaucaucucccggcgcgaccagcgcgggagcggccaggucggcaccuacgggcugaacaccuucacgaacauggaggcgcagcugauccggcagauggagggcgaggggguguucaaguccauccagcaccucaccgccaccgaggagaacgccgugcagaacuggcuggcccgcgucggccgggagcgccugagccggauggccaucuccggcgacgacugcguggugaagccccucgacgaccgcuucgcgagcgcccugaccgcccugaacgacauggggaagguccggaaggacauccagcagugggagccgucccgcggcuggaacgacuggacccaggugcccuucugcagccaccacuuccacgagcucaucaugaaggacgggcgggugcuggucgugcccugccgcaaccaggacgagcugaucggccgggcccgcaucucccagggggccggcuggagccuccgggagaccgcgugccugggcaaguccuacgcccagauguggagccugauguacuuccaccgccgggaccuccgccuggccgccaacgccaucugcuccgcggugcccagccacugggucccgaccucccggaccacguggagcauccacgccaagaacgaguggaugaccaccgaggacaugcugaccguguggaaccgcguguggauccaggagaaccccuggauggaggacaagacccccgucgagagcugggaggagauccccuaccucgggaagcgggaggaccaguggugcggcucccugaucgggcugacgagccgcgccaccugggccaagaacauccagaccgcgaucaaccaggugcgcucccucaucggcaacgaggaguacaccgacuacaugccgagcaugaagcgguuccgccgggaggaggaggaggccggggugcugugguga

SEQ ID NO: 9022 - RNA, 9876 nt, Artificial Sequence
  derived and/or modified CDS sequence (opt1) from DENV-2__JX286516__SS-prME
accgccggcgugaucgucaugcugauccccaccgccauggcguuccaccucaccacccgcaacggggagccccacaugaucgugggccggcaggagaaggggaagucccugcuguucaagaccgaggacggcgugaacaugugcacccucauggccaucgaccugggggagcugugcgaggacaccaucaccuacaagugcccccuccugcgccagaacgagcccgaggacaucgacugcuggugcaacagcaccagcaccugggucaccuacgggaccugcaccaccacgggcgagcaccggcgcgagaagcgguccguggcccuggugccccacgucgggaugggccucgagacccgcaccgagaccuggaugagcuccgagggggccuggaagcacgugcagcggaucgagacguggauccugcgccacccgggcuucaccaucauggccgcgauccuggccuacaccaucgggaccacgcacuuccagcgggcccucaucuucauccugcugaccgccguggcgcccagcaugaccaugcgcugcaucggcaucuccaaccgggacuucgucgagggcgugagcgggggcuccuggguggacaucguccucgagcacgggagcugcgugaccacgauggccaagaacaagcccacccuggacuucgagcugaucaagaccgaggccaagcagcccgccacccuccgcaaguacugcaucgaggccaagcugacgaacaccaccaccgagucccggugcccgacgcagggcgagcccagccugaacgaggagcaggacaagcgcuucaucugcaagcacuccaugguggaccggggcugggggaacggcugcgggcuguucggcaagggcgggaucgugaccugcgcgauguucacgugcaagaagaacauggagggcaagaucgugcagcccgagaaccuggaguacaccaucgugaucacgccccacagcggggaggagcacgccgucggcaacgacaccgggaagcacggcaaggagaucaagaucaccccgcaguccagcaccaccgaggccgagcugacgggguacggcaucgugaccauggagugcagcccccggaccggccucgacuucaacgagauggugcugcugcagauggaggacaaggccuggcucguccaccggcagugguuccuggaccugccccuccccuggcugccgggggccgacacccagggcagcaacuggauccagaaggagacgcuggugaccuucaagaacccccacgcgaagaagcaggacguggucgugcucgggucccaggagggcgccaugcacaccgcccugaccggggccacggagauccagaugagcagcggcaaccuccuguucaccggccaccugaagugccgccugcggauggacaagcuccagcugaaggggauguccuacagcaugugcaccggcaaguucaagaucgucaaggagaucgccgagacccagcacgggacgaucgugauccgcgugcaguacgagggcgacggcucccccugcaagauccccuucgagaucaccgaccuggagaagcggcacguccucgggcgccugaucaccgugaacccgaucgugaccgagaaggacagccccgucaacaucgaggcggagccgcccuucggcgacuccuacaucaucguggggguggagccgggccagcugaagcucaacugguucaagaaggggagcuccaucggccagauguucgagacgaccaugcgcggcgccaagcggauggccauccugggggacaccgccugggacuucggcagccucgggggcgucuucaccuccaucgggaaggcccuccaccagguguucggcgcgaucuacggcgccgccuucagcgggguguccuggacgaugaagauccugaucggcgucaucaucaccuggaucgggaugaacagccgcuccaccagccuguccgugagccuggugcucgucggcguggugacccuguaccugggggccaugguccaggcggacuccggcugcaucgugagcuggaagaacaaggagcucaagugcggcuccgggaucuucaucacggacaacgugcacaccuggaccgagcaguacaaguuccagcccgagagccccagcaagcuggccuccgccauccagaaggcccacgaggagggcaucugcgggauccggagcgucacccgccuggagaaccucauguggaagcagaucacgcccgagcugaaccacauccuguccgagaacgaggugaagcucaccaucaugaccggcgacaucaaggggaucaugcaggccggcaagcggagccugcgcccgcagcccaccgagcugaaguacuccuggaagacguggggcaaggcgaagaugcucagcaccgagucccacaaccagaccuuccugaucgacgggcccgagaccgccgagugcccgaacacgaaccgggccuggaacagccuggagguggaggacuacggcuucggggucuucaccaccaacaucuggcucaagcugcgcgagaagcaggacguguucugcgacuccaagcugaugagcgccgccaucaaggacaaccgggcggugcacgccgacaugggcuacuggaucgaguccgcccucaacgacaccuggaagauggagaaggccagcuucaucgaggucaaguccugccacuggcccaagagccacacccugugguccaacggcgugcuggagagcgagaugaucauccccaagaacuucgccgggcccgugucccagcacaacuaccgcccgggcuaccacacgcagaccgcggggcccuggcaccucggcaagcuggagauggacuucgacuucugcgaggggaccaccgucguggugacggaggacugcggcaaccggggccccagccugcgcaccaccaccgccagcgggaagcucaucacggaguggugcugccgguccugcacccugcccccgcugcgcuaccggggcgaggacgggugcugguacggcauggagauccgcccccucaaggagaaggaggagaaccuggucaacagccuggugaccgccgggcacggccagaucgacaacuucucccucggcgugcuggggauggcccuguuccucgaggagaugcugcggacccgcgucggcacgaagcacgcgauccugcucguggcccugagcuucgugacccugaucaccgggaacauguccuuccgggaccucggccgcgucauggugauggugggggccaccaugacggacgacaucggcaugggcgucaccuaccuggcccugcucgccgcguucaaggugcgccccaccuucgccgccgggcugcugcuccggaagcugaccagcaaggagcugaugauggccacgaucggcaucgcccuccugucccagagcacccugcccgagaccauccucgagcugaccgacgcgcuggcccucgggaugauggcccugaagaucgugcgcaacauggagaaguaccagcuggccgucacgaucauggccaucuccugcgugccgaacgcggugauccuccagaacgccuggaaggucagcugcaccauccuggccgccguguccgugagcccccugcuccugaccuccagccagcagaaggcggacuggaucccccuggcccucaccaucaagggccugaaccccacggccaucuuccugaccacccucucccggaccagcaagaagcgcuccuggccgcugaacgaggccaucauggccgucggcauggugagcauccuggcguccagccuccugaagaacgacauccccaugacggggccccuggucgccggcgggcuccugaccgugugcuacgugcugaccggccggagcgccgaccucgagcuggagcgcgccgccgacgucaagugggaggaccaggcggagaucuccgggagcucccccauccugagcaucaccaucuccgaggacggcagcauguccaucaagaacgaggaggaggagcagacgcucaccauccugauccggaccggccugcucgugaucagcgggguguucccggucuccauccccaucaccgccgccgccugguaccugugggaggugaagaagcagcgcgccggcgugcugugggacguccccagcccgccgcccguggggaaggcggagcucgaggacggcgccuaccggaucaagcagcgcgggauccugggcuacucccagaucggcgccgggguguacaaggagggcaccuuccacacgauguggcacgucacccgcggggccgugcugaugcaccgcggcaagcggaucgagcccagcugggccgacgugaagaaggaccucaucuccuacgggggcggcuggaagcuggagggggaguggaaggagggcgaggagguccaggugcuggcgcucgagcccgggaagaacccccgcgccgugcagaccaagcccggcaucuucaagaccaacacggggaccaucggcgccgucagccuggacuucucccccggcaccagcgggucccccaucguggaccggaagggcaagguggucgggcuguacggcaacggcguggugacccgcagcggggccuacgucuccgcgaucgcccagacggagaaguccaucgaggacaaccccgagaucgaggacgacaucuuccggaagaagcgccucaccaucauggaccugcaccccggcgccgggaagaccaagcgguaccugcccgccaucgugcgcgaggccaucaagcggggccugcgcacccucauccuggcgccgacgcgcguggucgccgccgagauggaggaggcccugcgggggcuccccauccgcuaccagacccccgccauccgggcggagcacaccggccgcgagaucguggaccugaugugccacgccaccuucacgaugcggcugcucagccccgugcgcgucccgaacuacaaccugaucaucauggacgaggcccacuucaccgaccccgccuccaucgccgcgcggggcuacaucagcacccgcguggagaugggggaggccgccggcaucuucaugaccgccacgccgcccgggucccgggacccguucccccagagcaacgcgcccaucauggacgaggagcgcgagauccccgagcgguccuggaacagcggccacgagugggugaccgacuucaaggggaagaccgucugguucgugccguccaucaaggccggcaacgacaucgccgccugccugcgcaagaacggcaagaaggugauccagcucagccggaagaccuucgacuccgaguacgucaagacgcgcgccaacgacugggacuucguggugaccaccgacaucagcgagaugggggcgaacuucaaggccgagcgggucaucgacccccgccggugcaugaagcccgugauccugaccgacggcgaggagcgcgugauccuggccgggcccaugccggucacgcacuccagcgccgcccagcggcgcggccgcaucgggcggaaccccaagaacgagaacgaccaguacaucuacaugggcgagccccucgagaacgacgaggacugcgcgcacuggaaggaggccaagaugcugcuggacaacaucaacacccccgagggcaucaucccguccauguucgagcccgagcgcgagaagguggacgccaucgacggggaguaccggcuccgcggcgaggcccggaagaccuucguggaccugaugcgccgcggggaccugcccgucuggcucgccuacaagguggcggccgagggcaucaacuacgccgaccgcaaguggugcuucgacgggaucaagaacaaccagauccuggaggagaacguggaggucgagaucuggaccaaggagggcgagcggaagaagcugaagccgcgcuggcucgacgcccggaucuacagcgacccccuggcgcugaagggcuucaaggaguucgccgccgggcgcaagucccucacgcugaaccugaucaccgagaugggccggcuccccaccuucaugacccagaaggcccgcaacgcccuggacaaccuggcggugcuccacacggccgaggucgggggcaaggccuacacccacgcccugagcgagcugcccgagacccucgagacccugcugcuccugacgcugcucgccgcggucaccggcgggaucuuccuguuccugauguccggcaaggggaucggcaagaugacccucgggaugugcugcaucaucaccgccagcauccugcugugguacgcccagauccagccgcacuggaucgccgccuccaucauccucgaguucuuccugaucgugcugcucauccccgagcccgagaagcagcggacgccccaggacaaccagcugacguacgucgugaucgcgauccugaccguggucgccgccaccauggccaacgagaugggcuuccucgagaagaccaagaaggaccugggcuucgggagcaucacgacccaggagagcgaguccaacauccuggacaucgaccuccgcccggccagcgcguggacccuguacgccguggccaccacguucgugacccccaugcugcggcacuccaucgagaacagcuccgucaacgugagccucaccgccaucgcgaaccaggccaccgugcugaugggccuggggaagggcuggccccucuccaagauggacaucggggucccccugcuggccaucggcugcuacagccaggugaacccgaucacgcucaccgccgcccugcugcuccugguggcgcacuacgccaucaucggccccgggcugcaggccaaggccacccgcgaggcccagaagcgggcggccgccggcaucaugaagaaccccaccgucgacgggaucacggugaucgaccucgagcccaucccguacgaccccaaguucgagaagcagcugggccaggugaugcugcucauccugugcgucacccaggugcugaugaugcgcaccaccugggcccucugcgaggcccugacgcuggcgaccgggcccaucuccacccucugggagggcaaccccggccgguucuggaacaccacgaucgccgugagcauggccaacaucuuccgcggguccuaccuggccggcgcggggcuccuguucagcaucaugaagaacaccaccaacacccgccggggcacgggcaacgucggggagacccugggcgagaaguggaagucccgccugaacgcccucggcaagagcgaguuccagaucuacaagaaguccggcauccaggagguggaccggacccuggccaaggaggggaucaagcgcggcgagaccgaccaccacgccgugagccggggcuccgccaagcugcgcugguucgucgagcggaacauggugacgccggaggggaagguggucgaccucggcugcgggcgcggcggguggagcuacuacugcggcggccugaagaacgugcgggaggugaaggggcugaccaagggcgggcccggccacgaggagcccauccccauguccaccuacggguggaaccucguccgccugcagagcggcguggacguguucuucaccccgcccgagaagugcgacacgcugcucugcgacaucggcgagagcucccccaaccccaccaucgaggcggggcggacccugcgcguccugaaccucguggagaacuggcugaacaacaacacccaguucugcaucaaggugcugaacccguacaugcccagcgucaucgagaagauggagacccuccagcggaaguacggcggggcccuggugcgcaacccccugucccggaacagcacgcacgagauguacuggguguccaacgccaccggcaacaucgucagcuccgugaacaugaucagccgcaugcugaucaaccgguucaccaugaagcacaagaaggccaccuacgagccggacguggaccucggguccggcacgcgcaacaucggcaucgagagcgagauccccaaccuggacaucaucgggaagcggaucgagaagaucaagcaggagcacgagaccuccuggcacuacgaccaggaccaccccuacaagaccugggccuaccacggcagcuacgagaccaagcagacgggguccgcgagcuccauggucaacggcguggugcgccugcucaccaagcccugggacgucgugccgauggugacccagauggccaugaccgacacgacccccuucggccagcagcgcgucuucaaggagaagguggacacccggacccaggagcccaaggaggggacgaagaagcugaugaagaucaccgccgaguggcuguggaaggagcucggcaaggagaagacgccccggaugugcacccgggaggaguucacgcgcaaggugcggagcaacgccgcccugggggcggucuucaccgacgagaacaaguggaaguccgcccgcgaggccguggaggacggccgguucugggagcugguggaccgcgagcggaaccuccaccuggaggggaagugcgagaccugcgucuacaacaugaugggcaagcgcgagaagaagcugggcgaguucgggaaggccaagggcagccgggcgaucugguacauguggcucggggcccgcuuccuggaguucgaggcccugggcuuccucaacgaggaccacugguucucccgggggaacagccugagcggcguggagggcgaggggcugcaccgccucggcuacauccugcgggaggucgggaagaaggagggcggggccauguacgccgacgacaccgcgggcugggacacgcgcaucacccuggaggaccucaagaacgaggagauggugaccaaccacaugaagggcgagcacaagaagcuggccgaggccaucuucaagcugaccuaccagaacaaggugguccgggugcagcgcccgacgccccgggggaccgugauggacaucaucucccgcaaggaccagcggggcagcgggcaggucggcaccuacggccucaacaccuucacgaacauggaggcccagcugauccgccagauggagggggagggcaucuucaaguccauccagcaccugaccgccaccgaggagaucgcggugcagaacuggcucgcccgcguggggcgggagcgccugagccggauggccaucuccggcgacgacugcgucgugaagcccaucgacgaccgcuucgccagcgcccugaccgcgcucaacgacauggggaaggugcggaaggacauccagcagugggagcccucccgcggcuggaacgacuggacgcaggucccguucugcagccaccacuuccacgagcuggugaugaaggacggccgggugcuggucgugcccugccgcaaccaggacgagcucaucgggcgggcccgcaucucccagggcgccggguggagccugaaggagaccgccugccugggcaaguccuacgcccagauguggacccucauguacuuccaccggcgcgaccugcggcuggcggccaacgccaucugcagcgccgugcccucccacuggguccccaccagccgcaccacgugguccauccacgcgaagcacgaguggaugaccaccgaggacaugcucgccguguggaaccggguguggauccaggagaacccguggauggaggacaagacccccgucgagagcugggaggaggugcccuaccuggggaagcgcgaggaccaguggugcggcucccugaucggccucacgagccgggccaccugggccaagaacauccagaccgccaucaaccaggugcgcagccugaucgggaacgagggcuacaccgacuacaugcccuccaugaagcgguuccgccgcgaggaggaggaggcggggguccugugguga

SEQ ID NO: 9023 - RNA, 9876 nt, Artificial Sequence
  derived and/or modified CDS sequence (opt1) from DENV-2__JX286518__SS-prME
accgccggcgugaucgucaugcugauccccaccgccauggcguuccaccucaccacccggaacggggagccccacaugaucgugggccggcaggagaaggggaagucccugcuguucaagaccgaggacggcgugaacaugugcacccucauggccaucgaccugggggagcugugcgaggacaccaucaccuacaagugcccccuccugcgccagaacgagcccgaggacaucgacugcuggugcaacagcaccagcaccugggucaccuacgggaccugcaccaccacgggcgagcaccggcgcgagaagcgguccguggcccuggugccccacgucgggaugggccucgagacccggaccgagaccuggaugagcuccgagggggccuggaagcacgugcagcggaucgagaccuggauccugcgccacccgggcuucaccaucauggccgcgauccuggccuacaccaucgggaccacgcacuuccagcgggcccucaucuucauccugcugaccgccguggcgcccagcaugaccaugcgcugcaucggcaucuccaaccgggacuucgucgagggcgugagcgggggcuccuggguggacaucguccucgagcacgggagcugcgugaccacgauggccaagaacaagcccacccuggacuucgagcugaucaagaccgaggccaagcagcccgccacccuccgcaaguacugcaucgaggccaagcugacgaacaccaccaccgagucccggugcccgacgcagggcgagcccagccugaacgaggagcaggacaagcgcuucaucugcaagcacuccaugguggaccggggcugggggaacggcugcgggcuguucggcaagggcgggaucgugaccugcgcgauguucacgugcaagaagaacauggagggcaagaucgugcagcccgagaaccuggaguacaccaucgugaucacgccccacagcggggaggagcacgccgucggcaacgacaccgggaagcacggcaaggagaucaagaucaccccgcaguccagcaccaccgaggccgagcugacgggguacggcaccgugaccauggagugcagcccccggaccggccucgacuucaacgagauggugcugcugcagauggaggacaaggccuggcucguccaccggcagugguuccuggaccugccccuccccuggcugccgggggccgacacgcagggcagcaacuggauccagaaggagacccuggugaccuucaagaacccccacgcgaagaagcaggacguggucgugcucgggucccaggagggcgccaugcacaccgcccugacgggggccaccgagauccagaugagcagcggcaaccuccuguucaccggccaccugaagugccgccugcggauggacaagcuccagcugaaggggauguccuacagcaugugcaccggcaaguucaagaucgucaaggagaucgccgagacgcagcacgggaccaucgugauccgcgugcaguacgagggcgacggcucccccugcaagauccccuucgagaucaccgaccuggagaagcggcacguccucgggcgccugaucaccgugaacccgaucgugacggagaaggacagccccgucaacaucgaggcggagccgcccuucggcgacuccuacaucaucguggggguggagccgggccagcugaagcucaacugguucaagaaggggagcuccaucggccagauguucgagaccaccaugcgcggcgccaagcggauggccauccugggggacaccgccugggacuucggcagccucggcggggucuucacguccaucgggaaggcccuccaccagguguucggggcgaucuacggcgccgccuucagcgggguguccuggaccaugaagauccugaucggcgucaucaucaccuggaucgggaugaacagccgcuccaccagccuguccgugagccuggugcucgucggcguggugacgcuguaccugggggccaugguccaggcggacuccggcugcaucgugagcuggaagaacaaggagcucaagugcggcuccgggaucuucaucaccgacaacgugcacaccuggaccgagcaguacaaguuccagcccgagagccccagcaagcuggccuccgccauccagaaggcccacgaggagggcaucugcgggauccggagcgucacgcgccuggagaaccucauguggaagcagaucacccccgagcugaaccacauccuguccgagaacgaggugaagcucaccaucaugaccggcgacaucaaggggaucaugcaggccggcaagcggagccugcgcccgcagcccacggagcugaaguacuccuggaagaccuggggcaaggcgaagaugcucagcaccgagucccacaaccagaccuuccugaucgacgggcccgagacggccgagugcccgaacaccaaccgggccuggaacagccuggagguggaggacuacggcuucggggucuucaccaccaacaucuggcucaagcugcgcgagaagcaggacguguucugcgacuccaagcugaugagcgccgccaucaaggacaaccgggcggugcacgccgacaugggcuacuggaucgaguccgcccucaacgacaccuggaagauggagaaggccagcuucaucgaggucaaguccugccacuggcccaagagccacacgcugugguccaacggcgugcuggagagcgagaugaucauccccaagaacuucgccgggcccgugucccagcacaacuaccgcccgggcuaccacacccagaccgcggggcccuggcaccucggcaagcuggagauggacuucgacuucugcgaggggaccacggucguggugaccgaggacugcggcaaccggggccccagccugcgcaccaccacggccagcgggaagcucaucaccgaguggugcugccgguccugcacccugcccccgcugcgcuaccggggcgaggacgggugcugguacggcauggagauccgcccccucaaggagaaggaggagaaccuggucaacagccuggugaccgccgggcacggccagaucgacaacuucucccucggcgugcuggggauggcccuguuccucgaggagaugcugcggacgcgcgucggcaccaagcacgcgauccugcucguggcccugagcuucgugacccugaucaccgggaacauguccuuccgggaccucggccgcgucauggugauggugggggccacgaugaccgacgacaucggcaugggcgucaccuaccuggcccugcucgccgcguucaaggugcgccccaccuucgccgccgggcugcugcuccggaagcugacgagcaaggagcugaugauggccaccaucggcaucgcccuccugucccagagcacccugcccgagaccauccucgagcugacggacgcgcuggcccucgggaugauggcccugaagaucgugcgcaacauggagaaguaccagcuggccgucaccaucauggccaucuccugcgugccgaacgcggugauccuccagaacgccuggaaggucagcugcaccauccuggccgccguguccgugagcccccugcuccugaccuccagccagcagaaggcggacuggaucccccuggcccucacgaucaagggccugaaccccaccgccaucuuccugaccacccucucccggacgagcaagaagcgcuccuggccgcugaacgaggccaucauggccgucggcauggugagcauccuggcguccagccuccugaagaacgacauccccaugaccgggccccuggucgccggcgggcuccugaccgugugcuacgugcugaccggccggagcgccgaccucgagcuggagcgcgccgccgacgucaagugggaggaccaggcggagaucuccgggagcucccccauccugagcaucacgaucuccgaggacggcagcauguccaucaagaacgaggaggaggagcagacccucaccauccugauccggaccggccugcucgugaucagcgggguguucccggucuccauccccaucaccgccgccgccugguaccugugggaggugaagaagcagcgcgccggcgugcugugggacguccccagcccgccgcccguggggaaggcggagcucgaggacggcgccuaccggaucaagcagcgcgggauccugggcuacucccagaucggcgccgggguguacaaggagggcacguuccacaccauguggcacgucacccgcggggccgugcugaugcaccgcggcaagcggaucgagcccagcugggccgacgugaagaaggaccucaucuccuacgggggcggcuggaagcuggagggggaguggaaggagggcgaggagguccaggugcuggcgcucgagcccgggaagaacccccgcgccgugcagaccaagcccggcaucuucaagacgaacaccgggaccaucggcgccgucagccuggacuucucccccggcaccagcgggucccccaucguggaccggaagggcaagguggucgggcuguacggcaacggcguggugacgcgcagcggggccuacgucuccgcgaucgcccagaccgagaaguccaucgaggacaaccccgagaucgaggacgacaucuuccggaagaagcgccucaccaucauggaccugcaccccggcgccgggaagaccaagcgguaccugcccgccaucgugcgcgaggccaucaagcggggccugcgcacgcucauccuggcgccgacccgcguggucgccgccgagauggaggaggcccugcgggggcuccccauccgcuaccagacccccgccauccgggcggagcacaccggccgcgagaucguggaccugaugugccacgccacguucaccaugcggcugcucagccccgugcgcgucccgaacuacaaccugaucaucauggacgaggcccacuucaccgaccccgccuccaucgccgcgcggggcuacaucagcacccgcguggagaugggggaggccgccggcaucuucaugacggccacgccgcccgggucccgggacccguucccccagagcaacgcgcccaucauggacgaggagcgcgagauccccgagcgguccuggaacagcggccacgagugggugaccgacuucaaggggaagaccgucugguucgugccguccaucaaggccggcaacgacaucgccgccugccugcgcaagaacggcaagaaggugauccagcucagccggaagacguucgacuccgaguacgucaagacccgcgccaacgacugggacuucguggugaccaccgacaucagcgagaugggggcgaacuucaaggccgagcgggucaucgacccccgccggugcaugaagcccgugauccugacggacggcgaggagcgcgugauccuggccgggcccaugccggucacccacuccagcgccgcccagcggcgcggccgcaucgggcggaaccccaagaacgagaacgaccaguacaucuacaugggcgagccccucgagaacgacgaggacugcgcgcacuggaaggaggccaagaugcugcuggacaacaucaacacccccgagggcaucaucccguccauguucgagcccgagcgcgagaagguggacgccaucgacggggaguaccggcuccgcggcgaggcccggaagaccuucguggaccugaugcgccgcggggaccugcccgucuggcucgccuaccgcguggcggccgagggcaucaacuacgccgaccggaaguggugcuucgacgggaucaagaacaaccagauccuggaggagaacguggaggucgagaucuggacgaaggagggcgagcgcaagaagcugaagccgcgguggcucgacgcccgcaucuacagcgacccccuggcgcugaaggaguucaaggaguucgccgccggccggaagucccucacccugaaccugaucaccgagauggggcgccuccccaccuucaugacgcagaaggcccggaacgcccuggacaaccuggcggugcuccacaccgccgaggugggcgggaaggccuacacccacgcccugagcgagcugcccgagacccucgagacgcugcugcuccugacccugcucgccgcggucaccggcggcaucuuccuguuccugauguccgggaagggcaucgggaagaugacccucggcaugugcugcaucaucaccgccagcauccugcugugguacgcccagauccagccgcacuggaucgccgccuccaucauccucgaguucuuccugaucgugcugcucauccccgagcccgagaagcagcgcacgccccaggacaaccagcugaccuacgucgugaucgcgauccugaccguggucgccgccaccauggccaacgagaugggguuccucgagaagacgaagaaggaccugggcuucggcagcaucaccacccaggagagcgaguccaacauccuggacaucgaccuccggccggccagcgcguggacccuguacgccguggccacgaccuucgugacccccaugcugcgccacuccaucgagaacagcuccgucaacgugagccucaccgccaucgcgaaccaggccacggugcugauggggcugggcaagggguggccccucuccaagauggacaucggcgucccccugcuggccaucgggugcuacagccaggugaacccgaucacccucaccgccgcccugcugcuccugguggcgcacuacgccaucaucggccccggccugcaggccaaggccacccgggaggcccagaagcgcgcggccgccgggaucaugaagaaccccacggucgacggcaucaccgugaucgaccucgagcccaucccguacgaccccaaguucgagaagcagcuggggcaggucaugcugcucauccugugcgucacccaggugcugaugaugcggaccacgugggcccucugcgaggcccugacccuggcgaccggccccaucuccacccucugggaggggaaccccggccgcuucuggaacacgaccaucgccgugagcauggccaacaucuuccgcggcuccuaccuggccggggcgggccuccuguucagcaucaugaagaacaccaccaacacgcggcgcgggaccggcaacgucggcgagacccugggggagaaguggaagucccggcugaacgcccucggcaagagcgaguuccagaucuacaagaaguccgggauccaggagguggaccgcacccuggccaaggagggcaucaagcgcggggagacggaccaccacgccgugagccgcggcuccgccaagcugcggugguucgucgagcgcaacauggugaccccggagggcaagguggucgaccucgggugcggccgcgggggcuggagcuacuacugcgggggccugaagaacgugcgcgaggugaagggccugaccaagggcggccccgggcacgaggagcccauccccauguccaccuacggcuggaaccucguccggcugcagagcgggguggacguguucuucacgccgcccgagaagugcgacacccugcucugcgacaucggcgagagcucccccaaccccaccaucgaggcgggccgcacccugcggguccugaaccucguggagaacuggcugaacaacaacacccaguucugcaucaaggugcugaacccguacaugcccagcgucaucgagaagauggagacgcuccagcgcaaguacgggggcgcccuggugcggaacccccugucccgcaacagcacccacgagauguacuggguguccaacgccaccgggaacaucgucagcuccgugaacaugaucagccggaugcugaucaaccgcuucaccaugaagcacaagaaggccacguacgagccggacguggaccucggcuccgggacccggaacaucggcaucgagagcgagauccccaaccuggacaucaucggcaagcgcaucgagaagaucaagcaggagcacgagaccuccuggcacuacgaccaggaccaccccuacaagaccugggccuaccacgggagcuacgagacgaagcagaccggcuccgcgagcuccauggucaacgggguggugcgccugcucaccaagcccugggacgucgugccgauggugacccagauggccaugacggacaccacccccuucggccagcagcgggucuucaaggagaagguggacacccgcacgcaggagcccaaggagggcaccaagaagcugaugaagaucaccgccgaguggcuguggaaggagcucgggaaggagaagacgccccggaugugcacgcgcgaggaguucacccggaaggugcgcagcaacgccgcccugggcgcggucuucaccgacgagaacaaguggaaguccgcccgggaggccguggaggacgggcgcuucugggagcugguggaccgggagcgcaaccuccaccuggagggcaagugcgagaccugcgucuacaacaugauggggaagcgggagaagaagcugggcgaguucggcaaggccaaggggagccgcgcgaucugguacauguggcucggcgcccgguuccuggaguucgaggcccugggguuccucaacgaggaccacugguucucccgcggcaacagccugagcgggguggagggcgagggccugcaccggcucggguacauccugcgcgaggucggcaagaaggagggcggcgccauguacgccgacgacacggcggggugggacacccggaucacccuggaggaccucaagaacgaggagauggugaccaaccacaugaagggcgagcacaagaagcuggccgaggccaucuucaagcugacguaccagaacaaggugguccgcgugcagcggccgacgccccggggcaccgugauggacaucaucucccggaaggaccagcgcgggagcggccaggucgggaccuacggccucaacacguucaccaacauggaggcccagcugauccgccagauggagggcgaggggaucuucaaguccauccagcaccugaccgccaccgaggagaucgcggugcagaacuggcucgcccgggugggccgcgagcggcugagccgcauggccaucuccggggacgacugcgucgugaagcccaucgacgaccgguucgccagcgcccugacggcgcucaacgacaugggcaaggugcgcaaggacauccagcagugggagcccucccggggguggaacgacuggacccaggucccguucugcagccaccacuuccacgagcuggugaugaaggacggccgcgugcuggucgugcccugccggaaccaggacgagcucaucggccgcgcccggaucucccagggggccggcuggagccugaaggagaccgccugccuggggaaguccuacgcccagauguggacccucauguacuuccaccgccgggaccugcgccuggcggccaacgccaucugcagcgccgugcccucccacuggguccccaccagccggacgaccugguccauccacgcgaagcacgaguggaugaccaccgaggacaugcucgccguguggaaccgcguguggauccaggagaacccguggauggaggacaagacgcccgucgagagcugggaggaggugcccuaccugggcaagcgggaggaccaguggugcgggucccugaucggccucaccagccgcgccaccugggccaagaacauccagaccgccaucaaccaggugcggagccugaucggcaacgagggguacacggacuacaugcccuccaugaagcgcuuccgccgggaggaggaggaggcgggcguccugugguga

SEQ ID NO: 9024 - RNA, 9876 nt, Artificial Sequence
  derived and/or modified CDS sequence (opt1) from DENV-2__JX286519__SS-prME
accgccggcgugaucgucaugcugauccccaccgccauggcguuccaccucaccacccgcaacggggagccccacaugaucgugggccggcaggagaaggggaagucccugcuguucaagaccgaggacggcaucaacaugugcacccucauggccaucgaccugggggagcugugcgaggacaccaucaccuacaagugcccccuccugcgccagaacgagcccgaggacaucgacugcuggugcaacagcaccagcaccugggugaccuacgggaccugcaccaccacgggcgagcaccggcgcgagaagcgguccgucgcccuggugccccacguggggaugggccucgagacccgcaccgagaccuggaugagcagcgagggggccuggaagcacguccagcggaucgagaccuggauccugcgccacccgggcuucaccaucauggccgcgauccuggccuacaccaucgggaccacgcacuuccagcgggcccucaucuucauccugcugaccgccguggcgcccagcaugaccaugcgcugcaucggcaucagcaaccgggacuucguggagggcgucagcgggggcagcuggguggacaucgugcucgagcacgggagcugcgucaccacgauggccaagaacaagcccacccuggacuucgagcugaucaagaccgaggccaagcagcccgccacccuccgcaaguacugcaucgaggccaagcugacgaacaccaccaccgagucccggugcccgacgcagggcgagcccagccugaacgaggagcaggacaagcgcuucaucugcaagcacuccaugguggaccggggcugggggaacggcugcgggcuguucggcaagggcgggaucgugaccugcgcgauguucacgugcaagaagaacauggagggcaagaucguccagcccgagaaccuggaguacaccaucgugaucacgccccacagcggggaggagcacgccgugggcaacgacaccgggaagcacggcaaggagaucaagaucaccccgcaguccagcaccaccgaggccgagcugacgggguacggcaccgucaccauggagugcagcccccggaccggccucgacuucaacgagauggugcugcugcagauggaggacaaggccuggcucgugcaccggcagugguuccuggaccugccccuccccuggcugccgggggccgacacgcagggcagcaacuggauccagaaggagacccuggucaccuucaagaacccccacgcgaagaagcaggacguggugguccucgggucccaggagggcgccaugcacaccgcccugacgggggccaccgagauccagaugagcagcggcaaccuccuguucaccggccaccugaagugccgccugcggauggacaagcuccagcugaaggggauguccuacagcaugugcaccggcaaguucaagaucgugaaggagaucgccgagacgcagcacgggaccaucgucauccgcgugcaguacgagggcgacggcucccccugcaagauccccuucgagaucaccgaccuggagaagcggcacgugcucgggcgccugaucaccgucaacccgaucgugacggagaaggacagccccgugaacaucgaggcggagccgcccuucggcgacuccuacaucaucgucgggguggagccgggccagcugaagcucaacugguucaagaaggggagcuccaucggccagauguucgagaccaccaugcgcggcgccaagcggauggccauccugggggacaccgccugggacuucggcagccucggcgggguguucacguccaucgggaaggcccuccaccaggucuucggggcgaucuacggcgccgccuucagcgggguguccuggaccaugaagauccugaucggcgugaucaucaccuggaucgggaugaacagccgcuccaccagccuguccgucagccuggugcucgugggcgucgugacgcuguaccugggggccauggugcaggcggacuccggcugcaucgucagcuggaagaacaaggagcucaagugcggcuccgggaucuucaucaccgacaacgugcacaccuggaccgagcaguacaaguuccagcccgagagccccagcaagcuggccuccgccauccagaaggcccacgaggagggcaucugcgggauccggagcgugacgcgccuggagaaccucauguggaagcagaucacccccgagcugaaccacauccuguccgagaacgaggucaagcucaccaucaugaccggcgacaucaaggggaucaugcaggccggcaagcggagccugcgcccgcagcccacggagcugaaguacuccuggaagaccuggggcaaggcgaagaugcucagcaccgagucccacaaccagaccuuccugaucgacgggcccgagacggccgagugcccgaacaccaaccgggccuggaacagccuggagguggaggacuacggcuucgggguguucaccaccaacaucuggcucaagcugcgcgagaagcaggacgucuucugcgacuccaagcugaugagcgccgccaucaaggacaaccgggcggugcacgccgacaugggcuacuggaucgaguccgcccucaacgacaccuggaagauggagaaggccagcuucaucgaggugaaguccugccacuggcccaagagccacacgcugugguccaacggcguccuggagagcgagaugaucauccccaagaacuucgccgggcccgugucccagcacaacuaccgcccgggcuaccacacccagaccgcggggcccuggcaccucggcaagcuggagauggacuucgacuucugcgaggggaccacgguggucgugaccgaggacugcggcaaccggggccccagccugcgcaccaccacggccagcgggaagcucaucaccgaguggugcugccgguccugcacccugcccccgcugcgcuaccggggcgaggacgggugcugguacggcauggagauccgcccccucaaggagaaggaggagaaccuggugaacagccuggucaccgccgggcacggccagaucgacaacuucucccucggcgugcuggggauggcccuguuccucgaggagaugcugcggacgcgcgugggcaccaagcacgcgauccugcucgucgcccugagcuucgugacccugaucaccgggaacauguccuuccgggaccucggccgcgugauggucauggugggggccacgaugaccgacgacaucggcaugggcgugaccuaccuggcccugcucgccgcguucaagguccgccccaccuucgccgccgggcugcugcuccggaagcugacgagcaaggagcugaugauggccaccaucggcaucgcccuccugucccagagcacccugcccgagaccauccucgagcugacggacgcgcuggcccucgggaugauggcccugaagaucgugcgcaacauggagaaguaccagcuggccgugaccaucauggccaucuccugcgucccgaacgcggugauccuccagaacgccuggaaggugagcugcaccauccuggccgccgucuccgugagcccccugcuccugaccuccagccagcagaaggcggacuggaucccccuggcccucacgaucaagggccugaaccccaccgccaucuuccugaccacccucucccggacgagcaagaagcgcuccuggccgcugaacgaggccaucauggccgugggcauggucagcauccuggcguccagccuccugaagaacgacauccccaugaccgggccccugguggccggcgggcuccugaccgucugcuacgugcugaccggccggagcgccgaccucgagcuggagcgcgccgccgacgugaagugggaggaccaggcggagaucuccgggagcucccccauccugagcaucacgaucuccgaggacggcagcauguccaucaagaacgaggaggaggagcagacccucaccauccugauccggaccggccugcucgucaucagcgggguguucccgguguccauccccaucaccgccgccgccugguaccugugggaggucaagaagcagcgcgccggcgugcugugggacgugcccagcccgccgcccgucgggaaggcggagcucgaggacggcgccuaccggaucaagcagcgcgggauccugggcuacucccagaucggcgccgggguguacaaggagggcacguuccacaccauguggcacgugacccgcggggccguccugaugcaccgcggcaagcggaucgagcccagcugggccgacgugaagaaggaccucaucuccuacgggggcggcuggaagcuggagggggaguggaaggagggcgaggaggugcagguccuggcgcucgagcccgggaagaacccccgcgccgugcagaccaagcccggcaucuucaagacgaacaccgggaccaucggcgccgugagccuggacuucucccccggcaccagcgggucccccaucgucgaccggaagggcaaggugguggggcuguacggcaacggcgucgugacgcgcagcggggccuacguguccgcgaucgcccagaccgagaaguccaucgaggacaaccccgagaucgaggacgacaucuuccggaagaagcgccucaccaucauggaccugcaccccggcgccgggaagaccaagcgguaccugcccgccaucguccgcgaggccaucaagcggggccugcgcacgcucauccuggcgccgacccgcgugguggccgccgagauggaggaggcccugcgggggcuccccauccgcuaccagacccccgccauccgggcggagcacaccggccgcgagaucgucgaccugaugugccacgccacguucaccaugcggcugcucagccccgugcgcgugccgaacuacaaccugaucaucauggacgaggcccacuucaccgaccccgccuccaucgccgcgcggggcuacaucagcacccgcgucgagaugggggaggccgccggcaucuucaugacggccacgccgcccgggucccgggacccguucccccagagcaacgcgcccaucauggacgaggagcgcgagauccccgagcgguccuggaacagcggccacgagugggugaccgacuucaaggggaagaccgugugguucgucccguccaucaaggccggcaacgacaucgccgccugccugcgcaagaacggcaagaaggugauccagcucagccggaagacguucgacuccgaguacgugaagacccgcgccaacgacugggacuucgucgugaccaccgacaucagcgagaugggggcgaacuucaaggccgagcgggugaucgacccccgccggugcaugaagcccgucauccugacggacggcgaggagcgcgugauccuggccgggcccaugccggugacccacuccagcgccgcccagcggcgcggccgcaucgggcggaaccccaagaacgagaacgaccaguacaucuacaugggcgagccccucgagaacgacgaggacugcgcgcacuggaaggaggccaagaugcugcuggacaacaucaacacccccgagggcaucgucccguccauguucgagcccgagcgcgagaagguggacgccaucgacggggaguaccggcuccgcggcgaggcccggaagaccuucguggaccugaugcgccgcggggaccugcccgucuggcucgccuacaagguggcggccgagggcaucaacuacgccgaccgcaaguggugcuucgacgggaucaagaacaaccagauccuggaggagaacguggaggucgagaucuggacgaaggagggcgagcggaagaagcugaagccgcgcuggcucgacgcccggaucuacagcgacccccuggcgcugaaggaguucaaggaguucgccgccggccgcaagucccucacccugaaccugaucaccgagauggggcggcuccccaccuucaugacgcagaaggcccgcagcgcccuggacaaccuggcggugcuccacaccgccgaggugggcgggaaggccuacacccacgcccuguccgagcugcccgagacccucgagacgcugcugcuccugacccugcucgccgcggucaccggcggcaucuuccuguuccugaugagcgggaagggcaucgggaagaugacccucggcaugugcugcaucaucaccgccuccauccugcugugguacgcccagauccagccgcacuggaucgccgccagcaucauccucgaguucuuccugaucgugcugcucauccccgagcccgagaagcagcggacgccccaggacaaccagcugaccuacgucgugaucgcgauccugaccguggucgccgccaccauggccaacgagaugggguuccucgagaagacgaagaaggaccugggcuucggcagcaucaccacccaggaguccgagagcaacauccuggacaucgaccuccgcccggccuccgcguggacccuguacgccguggccacgaccuucgugacccccaugcugcggcacagcaucgagaacuccagcgucaacgugucccucaccgccaucgcgaaccaggccacggugcugauggggcugggcaagggguggccccucagcaagauggacaucggcgucccccugcuggccaucgggugcuacucccaggugaacccgaucacccucaccgccgcccugcugcuccugguggcgcacuacgccaucaucggccccggccugcaggccaaggccacccgcgaggcccagaagcgggcggccgccgggaucaugaagaaccccacggucgacggcaucaccgugaucgaccucgagcccaucccguacgaccccaaguucgagaagcagcugggccaggugaugcugcucauccugugcgucacccaggugcugaugaugcgcaccacgugggcccucugcgaggcccugacccuggcgaccggccccaucagcacccucugggaggggaaccccggccgguucuggaacacgaccaucgccguguccauggccaacaucuuccgcggcagcuaccuggccggggcgggccuccuguucuccaucaugaagaacaccaccaacacgcgccgggggaccggcaacgucggcgagacccugggggagaaguggaagucccgccugaacgcccucggcaaguccgaguuccagaucuacaagaaguccgggauccaggagguggaccggacccuggccaaggagggcaucaagcgcggggagacggaccaccacgccgugucccggggcagcgccaagcugcgcugguucgucgagcggaacauggugaccccggagggcaagguggucgaccucgggugcggccgcgggggcugguccuacuacugcgggggccugaagaacgugcgggaggugaagggccugaccaagggcgggcccgggcacgaggagcccauccccaugagcaccuacggcuggaaccucguccgccugcagagcgggguggacguguucuucacgccgcccgagaagugcgacacccugcucugcgacaucggcgaguccagccccaaccccaccaucgaggcgggccggacccugcgcguccugaaccucguggagaacuggcugaacaacaacacccaguucugcaucaaggugcugaacccguacaugcccuccgucaucgagaagauggagacgcuccagcggaaguacgggggcgcccuggugcgcaacccccugagccggaacuccacccacgagauguacugggugagcaacgccaccgggaacaucgucuccagcgugaacaugaucucccgcaugcugaucaaccgguucaccaugaagcacaagaaggccacguacgagccggacguggaccucggcagcgggacccgcaacaucggcaucgaguccgagauccccaaccuggacaucaucggcaagcggaucgagaagaucaagcaggagcacgagaccagcuggcacuacgaccaggaccaccccuacaagaccugggccuaccacggguccuacgagacgaagcagaccggcagcgcguccagcauggucaacgggguggugcgccugcucaccaagcccugggacgucgugccgauggugacccagauggccaugacggacaccacccccuucggccagcagcgcgucuucaaggagaagguggacacccggacgcaggagcccaaggagggcaccaagaagcugaugaagaucaccgccgaguggcuguggaaggagcucgggaaggagaagacgccccggaugugcacgcgggaggaguucacccgcaaggugcgguccaacgccgcccugggcgcggucuucaccgacgagaacaaguggaaguccgcccgcgaggccguggaggacgggcgguucugggagcugguggaccgcgagcggaaccuccaccuggagggcaagugcgagaccugcgucuacaacaugauggggaagcgcgagaagaagcugggcgaguucggcaaggccaaggggucccgggcgaucugguacauguggcucggcgcccgcuuccuggaguucgaggcccugggguuccucaacgaggaccacugguucagccggggcaacagccuguccgggguggagggcgagggccugcaccgccucggguacauccugcgggaggucggcaagaaggagggcggggccauguacgccgacgacacggcggggugggacacccgcaucacccuggaggaccucaagaacgaggagauggugaccaaccacaugaagggcgagcacaagaagcuggccgaggccaucuucaagcugacguaccagaacaaggugguccgggugcagcgcccgacgccccggggcaccgugauggacaucaucagccgcaaggaccagcggggguccggccaggucgggaccuacggccucaacacguucaccaacauggaggcccagcugauccgccagauggagggcgaggggaucuucaagagcauccagcaccugaccgccaccgaggagaucgcggugcagaacuggcucgcccgcgugggccgggagcgccugucccggauggccaucagcggggacgacugcgucgugaagcccaucgacgaccgcuucgccuccgcccugacggcgcucaacgacaugggcaaggugcggaaggacauccagcagugggagcccagccgcggguggaacgacuggacccaggucccguucugcucccaccacuuccacgagcuggugaugaaggacggccgggugcuggucgugcccugccgcaaccaggacgagcucaucggccgggcccgcaucagccagggggccggcuggucccugaaggagaccgccugccugggcaagagcuacgcccagauguggacccucauguacuuccaccggcgcgaccugcggcuggcggccaacgccaucugcuccgccgugcccagccacuggguccccaccucccgcacgaccuggagcauccacgcgaagcacgaguggaugaccaccgaggacaugcucgccguguggaaccggguguggauccaggagaacccguggauggaggacaagacgcccgucgaguccugggaggaggugcccuaccugggcaagcgcgaggaccaguggugcgggagccugaucggccucaccagccgggccaccugggccaagaacauccagaccgccaucaaccaggugcgcucccugaucggcaacgagggguacacggacuacaugcccagcaugaagcgguuccgccgcgaggaggaggaggcgggcguccugugguga

SEQ ID NO: 9025 - RNA, 9876 nt, Artificial Sequence
  derived and/or modified CDS sequence (opt1) from DENV-2__KP188549__SS-prME
accgccggcgugaucgucaugcugauccccaccgccauggcguuccaccucaccacccgcaacggggagccccacaugaucgugggccggcaggagaaggggaagucccugcuguucaagaccgaggacggcgugaacaugugcacccucauggccaucgaccugggggagcugugcgaggacaccaucaccuacaagugcccccuccugcgccagaacgagcccgaggacaucgacugcuggugcaacagcaccagcaccugggucaccuacgggaccugcaccaccacgggcgagcaccggcgcgagaagcgguccguggcccuggugccccacgucgggaugggccucgagacccgcaccgagaccuggaugagcuccgagggggccuggaagcacgugcagcggaucgagacguggauccugcgccacccgggcuucaccaucauggccgcgauccuggccuacaccaucgggaccacgcacuuccagcgggcccucaucuucauccugcugaccgccguggcgcccagcaugaccaugcgcugcaucggcaucuccaaccgggacuucgucgagggcgugagcgggggcuccuggguggacaucguccucgagcacgggagcugcgugaccacgauggccaagaacaagcccacccuggacuucgagcugaucaagaccgaggccaagcagcccgccacccuccgcaaguacugcaucgaggccaagcugacgaacaccaccaccgagucccggugcccgacgcagggcgagcccagccugaacgaggagcaggacaagcgcuucaucugcaagcacuccaugguggaccggggcugggggaacggcugcgggcuguucggcaagggcgggaucgugaccugcgcgauguucacgugcaagaagaacauggagggcaagaucgugcagcccgagaaccuggaguacaccaucgugaucacgccccacagcggggaggagcacgccgucggcaacgacaccgggaagcacggcaaggagaucaagaucaccccgcaguccagcaccaccgaggccgagcugacgggguacggcaccgugaccauggagugcagcccccggaccggccucgacuucaacgagauggugcugcugcagauggaggacaaggccuggcucguccaccggcagugguuccuggaccugccccuccccuggcugccgggggccgacacgcagggcagcaacuggauccagaaggagacccuggugaccuucaagaacccccacgcgaagaagcaggacguggucgugcucgggucccaggagggcgccaugcacaccgcccugacgggggccaccgagauccagaugagcagcggcaaccuccuguucaccggccaccugaagugccgccugcggauggacaagcuccagcugaaggggauguccuacagcaugugcaccggcaaguucaagaucgucaaggagaucgccgagacgcagcacgggaccaucgugauccgcgugcaguacgagggcgacggcucccccugcaagauccccuucgagaucaccgaccuggagaagcggcacguccucgggcgccugaucaccgugaacccgaucgugacggagaaggacagccccgucaacaucgaggcggagccgcccuucggcgacuccuacaucaucguggggguggagccgggccagcugaagcucaacugguucaagaaggggagcuccaucggccagauguucgagaccaccaugcgcggcgccaagcggauggccauccugggggacaccgccugggacuucggcagccucgggggcgucuucacguccaucgggaaggcccuccaccagguguucggcgcgaucuacggcgccgccuucagcgggguguccuggaccaugaagauccugaucggcgucaucaucaccuggaucgggaugaacagccgcuccaccagccuguccgugagccuggugcucgucggcguggugacgcuguaccugggggccaugguccaggcggacuccggcugcaucgugagcuggaagaacaaggagcucaagugcggcuccgggaucuucaucaccgacaacgugcacaccuggaccgagcaguacaaguuccagcccgagagccccagcaagcuggccuccgccauccagaaggcccacgaggagggcaucugcgggauccggagcgucacgcgccuggagaaccucauguggaagcagaucacccccgagcugaaccacauccuguccgagaacgaggugaagcucaccaucaugaccggcgacaucaaggggaucaugcaggccggcaagcggagccugcgcccgcagcccacggagcugaaguacuccuggaagaccuggggcaaggcgaagaugcucagcaccgagucccacaaccagaccuuccugaucgacgggcccgagacggccgagugcccgaacaccaaccgggccuggaacagccuggagguggaggacuacggcuucggggucuucaccaccaacaucuggcucaagcugcgcgagaagcaggacguguucugcgacuccaagcugaugagcgccgccaucaaggacaaccgggcggugcacgccgacaugggcuacuggaucgaguccgcccucaacgacaccuggaagauggagaaggccagcuucaucgaggucaaguccugccacuggcccaagagccacacgcugugguccaacggcgugcuggagagcgagauggugauccccaagaacuucgccgggcccgucucccagcacaacuaccgcccgggcuaccacacccagaccgcggggcccuggcaccucggcaagcuggagauggacuucgacuucugcgaggggaccacggugguggucaccgaggacugcgagaagcggggccccagccugcgcaccaccacggccagcggcaagcucaucaccgaguggugcugccgguccugcacccugcccccgcugcgcuaccgcggggaggacggcugcugguacgggauggagauccgcccccucaaggagaaggaggagaaccuggugaacagccuggugaccgccggccacgggcagaucgacaacuucucccucggcguccugggcauggcccuguuccucgaggagaugcugcggacgcgcguggggaccaagcacgcgauccugcucguggcccugagcuucgucacccugaucaccggcaacauguccuuccgggaccucgggcgcgugauggugauggucggcgccacgaugaccgacgacaucgggaugggcgugaccuaccuggcccugcucgccgcguucaaggugcgccccaccuucgccgccggccugcugcuccggaagcugacgagcaaggagcugaugauggccaccaucgggaucgcccuccugucccagagcacccugcccgagaccauccucgagcugacggacgcgcuggcccucggcaugauggcccugaagaucguccgcaacauggagaaguaccagcuggccgugaccaucauggccaucuccugcgugccgaacgcggucauccuccagaacgccuggaaggugagcugcaccauccuggccgccguguccgucagcccccugcuccugaccuccagccagcagaaggcggacuggaucccccuggcccucacgaucaaggggcugaaccccaccgccaucuuccugaccacccucucccggacgagcaagaagcgcuccuggccgcugaacgaggccaucauggccgugggcauggucagcauccuggcguccagccuccugaagaacgacauccccaugaccggcccccugguggccgggggccuccugaccgugugcuacguccugaccgggcggagcgccgaccucgagcuggagcgcgccgccgacgugaagugggaggaccaggcggagaucuccggcagcucccccauccugagcaucacgaucuccgaggacgggagcauguccaucaagaacgaggaggaggagcagacccucaccauccugauccggaccggccugcucgugaucagcggcgucuucccgguguccauccccaucaccgccgccgccugguaccugugggaggugaagaagcagcgcgccgggguccugugggacgugcccagcccgccgcccgugggcaaggcggagcucgaggacggggccuaccggaucaagcagcgcggcauccugggguacucccagaucggcgccggcgucuacaaggaggggacguuccacaccauguggcacgugacccggggcgccgugcugaugcaccgcgggaagcggaucgagcccagcugggccgacgucaagaaggaccucaucuccuacggcgggggcuggaagcuggagggcgaguggaaggagggggaggagguccaggugcuggcgcucgagcccggcaagaacccccgcgccguccagaccaagcccgggaucuucaagacgaacaccggcaccaucggggccgugagccuggacuucucccccggcaccagcggcucccccaucguggaccggaaggggaaggucgugggccuguacgggaacggcguggucacgcgcagcggcgccuacguguccgcgaucgcccagaccgagaaguccaucgaggacaaccccgagaucgaggacgacaucuuccggaagaagcgccucaccaucauggaccugcaccccggggccggcaagaccaagcgguaccugcccgccaucgugcgcgaggccaucaagcgggggcugcgcacgcucauccuggcgccgacccgcgucguggccgccgagauggaggaggcccugcggggccuccccauccgcuaccagacccccgccauccgggcggagcacaccgggcgcgagaucguggaccugaugugccacgccacguucaccaugcggcugcucagccccguccgcgugccgaacuacaaccugaucaucauggacgaggcccacuucaccgaccccgccuccaucgccgcgcggggcuacaucagcacccgcguggagaugggcgaggccgccgggaucuucaugacggccacgccgcccggcucccgggacccguucccccagagcaacgcgcccaucauggacgaggagcgcgagauccccgagcgguccuggaacagcgggcacgagugggucaccgacuucaagggcaagaccgugugguucgugccguccaucaaggccgggaacgacaucgccgccugccugcgcaagaacggcaagaaggucauccagcucagccggaagacguucgacuccgaguacgugaagacccgcgccaacgacugggacuucguggucaccaccgacaucagcgagaugggcgcgaacuucaaggccgagcgggugaucgacccccgccggugcaugaagcccgugauccugacggacggggaggagcgcgucauccuggccggccccaugccggugacccacuccagcgccgcccagcggcgcgggcgcaucggccggaaccccaagaacgagaacgaccaguacaucuacaugggggagccccucgagaacgacgaggacugcgcgcacuggaaggaggccaagaugcugcuggacaacaucaacacccccgagggcaucaucccguccauguucgagcccgagcgcgagaagguggacgccaucgacggcgaguaccggcuccgcggggaggcccggaagaccuucgucgaccugaugcgccggggcgaccugcccguguggcucgccuacaagguggcggccgaggggaucaacuacgccgaccgcaaguggugcuucgacggcaucaagaacaaccagauccuggaggagaacgucgagguggagaucuggacgaaggagggggagcggaagaagcugaagccgcgcuggcucgacgcccggaucuacagcgacccccuggcgcugaaggaguucaaggaguucgccgccggccgcaagucccucacccugaaccugaucaccgagaugggccggcuccccaccuucaugacgcagaaggcccgcaacgcccuggacaaccuggcggugcuccacaccgccgaggucgggggcaaggccuacacccacgcccugagcgagcugcccgagacccucgagacgcugcugcuccugacccugcucgccgcggugaccgggggcaucuuccuguuccugauguccggcaaggggaucggcaagaugacccucgggaugugcugcaucaucaccgccagcauccugcugugguacgcccagauccagccgcacuggaucgccgccuccaucauccucgaguucuuccugaucguccugcucauccccgagcccgagaagcagcggacgccccaggacaaccagcugaccuacguggugaucgcgauccugaccgucguggccgccaccauggccaacgagaugggcuuccucgagaagacgaagaaggaccugggguucggcagcaucaccacccaggagagcgaguccaacauccuggacaucgaccuccgcccggccagcgcguggacccuguacgccguggccacgaccuucgucacccccaugcugcggcacuccaucgagaacagcuccgugaacgugagccucaccgccaucgcgaaccaggccacgguccugaugggccuggggaagggcuggccccucuccaagauggacaucggggugccccugcuggccaucggcugcuacagccaggugaacccgaucacccucaccgccgcccugcugcuccuggucgcgcacuacgccaucaucgggcccggccugcaggccaaggccacccgcgaggcccagaagcgggcggccgccggcaucaugaagaaccccacgguggacgggaucaccgugaucgaccucgagcccaucccguacgaccccaaguucgagaagcagcugggccaggucaugcugcucauccugugcgugacccaggugcugaugaugcgcaccacgugggcccucugcgaggcccugacccuggcgaccgggcccaucuccacccucugggagggcaaccccgggcgguucuggaacacgaccaucgccgucagcauggccaacaucuuccgcggcuccuaccuggccggcgcggggcuccuguucagcaucaugaagaacaccaccaacacgcgccggggcaccgggaacgugggcgagacccugggcgagaaguggaagucccgccugaacgcccucggcaagagcgaguuccagaucuacaagaaguccggcauccaggagguggaccggacccuggccaaggaggggaucaagcgcggcgagacggaccaccacgccgucagccggggguccgccaagcugcgcugguucguggagcggaacauggugaccccggagggcaaggucguggaccucggcugcgggcgcggcggguggagcuacuacugcggcgggcugaagaacgugcgggaggucaagggccugaccaagggcgggcccggccacgaggagcccauccccauguccaccuacggguggaaccucgugcgccugcagagcggcguggacgucuucuucacgccgcccgagaagugcgacacccugcucugcgacaucggggagagcucccccaaccccaccaucgaggcgggccggacccugcgcgugcugaaccucguggagaacuggcugaacaacaacacccaguucugcaucaagguccugaacccguacaugcccagcgugaucgagaagauggagacgcuccagcggaaguacggcggggcccuggugcgcaacccccugucccggaacagcacccacgagauguacugggucuccaacgccaccggcaacaucgugagcuccgugaacaugaucagccgcaugcugaucaaccgguucaccaugaagcacaagaaggccacguacgagccggacgucgaccucggguccggcacccgcaacaucgggaucgagagcgagacccccaaccuggacaucaucggcaagcggaucgagaagaucaagcaggagcacgagaccuccuggcacuacgaccaggaccaccccuacaagacgugggccuaccacggcagcuacgagaccaagcagaccggguccgcgagcuccauggugaacggcgugguccgccugcucaccaagcccugggacguggugccgauggucacgcagauggccaugaccgacaccacccccuucgggcagcagcgcguguucaaggagaagguggacacgcggacccaggagcccaaggagggcaccaagaagcugaugaagaucaccgccgaguggcuguggaaggagcucggcaaggagaagacgccccgcaugugcacccgggaggaguucacccgcaagguccggagcaacgccgcccugggggcgguguucaccgacgagaacaaguggaaguccgcccgcgaggccguggaggacggccgguucugggagcuggucgaccgcgagcggaaccuccaccuggaggggaagugcgagacgugcguguacaacaugaugggcaagcgcgagaagaagcugggggaguucggcaaggccaagggcagccgggcgaucugguacauguggcucggggcccgcuuccuggaguucgaggcccugggcuuccucaacgaggaccacugguucucccgggggaacagccugagcggcgucgagggggagggccugcaccgccucggcuacauccugcgggagguggggaagaaggagggcggggccauguacgccgacgacaccgcgggcugggacacccgcaucacccuggaggaccucaagaacgaggagauggugacgaaccacaugaagggggagcacaagaagcuggccgaggccaucuucaagcugaccuaccagaacaaggucgugcgggugcagcgcccgacgccccggggcaccgucauggacaucaucucccgcaaggaccagcggggcagcggccagguggggacguacgggcucaacaccuucaccaacauggaggcccagcugauccgccagauggagggcgagggcaucuucaaguccauccagcaccugaccgccacggaggagaccgcggugcagaacuggcucgcccgcgucgggcgggagcgccugagccggauggccaucuccggcgacgacugcguggugaagcccaucgacgaccgcuucgccagcgcccugaccgcgcucaacgacauggggaagguccggaaggacauccagcagugggagcccucccgcggcuggaacgacuggacccaggugccguucugcagccaccacuuccacgagcuggugaugaaggacgggcggguccugguggugcccugccgcaaccaggacgagcucaucggccgggcccgcaucucccagggcgccggguggagccugaaggagaccgccugccugggcaaguccuacgcccagauguggacgcucauguacuuccaccggcgcgaccugcggcuggcggccaacgccaucugcagcgccguccccucccacugggugcccaccagccgcaccaccugguccauccacgcgaagcacgaguggaugacgaccgaggacaugcucgccguguggaaccgggucuggauccaggagaacccguggauggaggacaagacccccguggagagcugggaggaggugcccuaccuggggaagcgcgaggaccaguggugcggcucccugaucgggcucaccagccgggccacgugggccaagaacauccagaccgccaucaaccagguccgcagccugaucggcaacgagggcuacaccgacuacaugcccuccaugaagcgguuccgccgcgaggaggaggaggcgggggugcugugguga

SEQ ID NO: 9026 - RNA, 9876 nt, Artificial Sequence
  derived and/or modified CDS sequence (opt1) from DENV-2__KP188550__SS-prME
accgccggcgugaucgugaugcugauccccaccgugauggccuuccaccucaccacccggaacggggagccccacaugaucgugggccggcaggagaaggggaagucccugcuguucaagaccgaggacggcgucaacaugugcacccucauggcgaucgaccugggggagcugugcgaggacaccaucaccuacaagugcccccuccugcgccagaacgagcccgaggacaucgacugcuggugcaacagcaccagcaccugggugaccuacgggaccugcaccaccacgggcgagcaccggcgcgagaagcgguccguggcccuggucccccacguggggaugggccucgagacccggaccgagaccuggaugagcagcgagggggccuggaagcacgugcagcggaucgagaccuggauccugcgccacccgggcuucaccaucauggccgccauccuggcguacaccaucgggaccacgcacuuccagcgggcccucaucuucauccugcugaccgccgucgcccccagcaugaccaugcgcugcaucggcaucagcaaccgggacuucguggagggcgugagcgggggcagcugggucgacaucgugcucgagcacgggagcugcgugaccacgauggcgaagaacaagcccacccuggacuucgagcugaucaagaccgaggccaagcagcccgccacccuccgcaaguacugcaucgaggccaagcugacgaacaccaccaccgagucccggugcccgacgcagggcgagcccagccugaacgaggagcaggacaagcgcuucaucugcaagcacuccauggucgaccggggcugggggaacggcugcgggcuguucggcaagggcgggaucgugaccugcgccauguucacgugcaagaagaacauggagggcaagaucgugcagcccgagaaccuggaguacaccaucgucaucacgccccacagcggggaggagcacgcggugggcaacgacaccgggaagcacggcaaggagaucaagaucaccccgcaguccagcaccaccgaggccgagcugacgggguacggcaccgugaccauggagugcagcccccggaccggccucgacuucaacgagaugguccugcugcagauggaggacaaggccuggcucgugcaccggcagugguuccuggaccugccccuccccuggcugccgggggccgacacgcagggcagcaacuggauccagaaggagacccuggugaccuucaagaacccccacgccaagaagcaggacgucgugguccucgggucccaggagggcgcgaugcacaccgcccugacgggggccaccgagauccagaugagcagcggcaaccuccuguucaccggccaccugaagugccgccugcggauggacaagcuccagcugaaggggauguccuacagcaugugcaccggcaaguucaagaucgugaaggagaucgccgagacgcagcacgggaccaucgugauccgcguccaguacgagggcgacggcucccccugcaagauccccuucgagaucaccgaccuggagaagcggcacgugcucgggcgccugaucaccgugaacccgaucgucacggagaaggacagccccgugaacaucgaggccgagccgcccuucggcgacuccuacaucaucgugggggucgagccgggccagcugaagcucaacugguucaagaaggggagcuccaucggccagauguucgagaccaccaugcgcggcgcgaagcggauggccauccugggggacaccgccugggacuucggcagccucggcgggguguucacguccaucgggaaggcccuccaccagguguucggggccaucuacggcgcggccuucagcggggucuccuggaccaugaagauccugaucggcgugaucaucaccuggaucgggaugaacagccgcuccaccagccuguccgugagccugguccucgugggcguggucacgcuguaccugggggccauggugcaggccgacuccggcugcaucgugagcuggaagaacaaggagcucaagugcggcuccgggaucuucaucaccgacaacguccacaccuggaccgagcaguacaaguuccagcccgagagccccagcaagcuggcguccgccauccagaaggcccacgaggagggcaucugcgggauccggagcgugacgcgccuggagaaccucauguggaagcagaucacccccgagcugaaccacauccuguccgagaacgaggugaagcucaccaucaugaccggcgacaucaaggggaucaugcaggccggcaagcggagccugcgcccgcagcccacggagcugaaguacuccuggaagaccuggggcaaggccaagaugcucagcaccgagucccacaaccagaccuuccugaucgacgggcccgagacggcggagugcccgaacaccaaccgggccuggaacagccuggaggucgaggacuacggcuucgggguguucaccaccaacaucuggcucaagcugcgcgagaagcaggacguguucugcgacuccaagcugaugagcgccgccaucaaggacaaccgggccguccacgcggacaugggcuacuggaucgaguccgcccucaacgacaccuggaagauggagaaggccagcuucaucgaggugaaguccugccacuggcccaagagccacacgcugugguccaacggcgugcuggagagcgagaugaucauccccaagaacuucgccgggcccgucucccagcacaacuaccgcccgggcuaccacacccagaccgccgggcccuggcaccucggcaagcuggagauggacuucgacuucugcgaggggaccacggugguggucaccgaggacugcggcaaccggggccccagccugcgcaccaccacggcgagcgggaagcucaucaccgaguggugcugccgguccugcacccugcccccgcugcgcuaccggggcgaggacgggugcugguacggcauggagauccgcccccucaaggagaaggaggagaaccuggugaacagccuggugaccgccgggcacggccagaucgacaacuucucccucggcguccuggggauggcccuguuccucgaggagaugcugcggacgcgcgugggcaccaagcacgccauccugcucguggcgcugagcuucgucacccugaucaccgggaacauguccuuccgggaccucggccgcgugauggugauggucggggccacgaugaccgacgacaucggcaugggcgugaccuaccuggcccugcucgccgccuucaaggugcgccccaccuucgcggccgggcugcugcuccggaagcugacgagcaaggagcugaugauggccaccaucggcaucgcccuccugucccagagcacccugcccgagaccauccucgagcugacggacgcccuggcgcucgggaugauggcccugaagaucguccgcaacauggagaaguaccagcuggccgugaccaucauggccaucuccugcgugccgaacgccgucauccuccagaacgcguggaaggugagcugcaccauccuggccgccguguccgucagcccccugcuccugaccuccagccagcagaaggccgacuggaucccccuggcgcucacgaucaagggccugaaccccaccgccaucuuccugaccacccucucccggacgagcaagaagcgcuccuggccgcugaacgaggccaucauggccgugggcauggucagcauccuggccuccagccuccugaagaacgacauccccaugaccgggccccugguggcgggcgggcuccugaccgugugcuacguccugaccggccggagcgccgaccucgagcuggagcgcgccgccgacgugaagugggaggaccaggccgagaucuccgggagcucccccauccugagcaucacgaucuccgaggacggcagcauguccaucaagaacgaggaggaggagcagacccucaccauccugauccggaccggccugcucgugaucagcggggucuucccgguguccauccccaucaccgcggccgccugguaccugugggaggugaagaagcagcgcgccggcguccugugggacgugcccagcccgccgcccguggggaaggccgagcucgaggacggcgcguaccggaucaagcagcgcgggauccugggcuacucccagaucggcgccggggucuacaaggagggcacguuccacaccauguggcacgugacccgcggggccgugcugaugcaccgcggcaagcggaucgagcccagcugggccgacgucaagaaggaccucaucuccuacgggggcggcuggaagcuggagggggaguggaaggagggcgaggagguccaggugcuggcccucgagcccgggaagaacccccgcgcgguccagaccaagcccggcaucuucaagacgaacaccgggaccaucggcgccgugagccuggacuucucccccggcaccagcgggucccccaucguggaccggaagggcaaggucguggggcuguacggcaacggcguggucacgcgcagcggggccuacguguccgccaucgcgcagaccgagaaguccaucgaggacaaccccgagaucgaggacgacaucuuccggaagaagcgccucaccaucauggaccugcaccccggcgccgggaagaccaagcgguaccugcccgccaucgugcgcgaggccaucaagcggggccugcgcacgcucauccuggccccgacccgcgucguggcggccgagauggaggaggcccugcgggggcuccccauccgcuaccagacccccgccauccgggccgagcacaccggccgcgagaucguggaccugaugugccacgcgacguucaccaugcggcugcucagccccguccgcgugccgaacuacaaccugaucaucauggacgaggcccacuucaccgaccccgccuccaucgccgcccggggcuacaucagcacccgcguggagaugggggaggcggccggcaucuucaugacggccacgccgcccgggucccgggacccguucccccagagcaacgcccccaucauggacgaggagcgcgagauccccgagcgguccuggaacagcggccacgagugggucaccgacuucaaggggaagaccgugugguucgugccguccaucaaggcgggcaacgacaucgccgccugccugcgcaagaacggcaagaaggucauccagcucagccggaagacguucgacuccgaguacgugaagacccgcgccaacgacugggacuucguggucaccaccgacaucagcgagaugggggccaacuucaaggcggagcgggugaucgacccccgccggugcaugaagcccgugauccugacggacggcgaggagcgcgucauccuggccgggcccaugccggugacccacuccagcgccgcccagcggcgcggccgcaucgggcggaaccccaagaacgagaacgaccaguacaucuacaugggcgagccccucgagaacgacgaggacugcgcccacuggaaggaggcgaagaugcugcuggacaacaucaacacccccgagggcaucaucccguccauguucgagcccgagcgcgagaagguggacgccaucgacggggaguaccggcuccgcggcgaggcccggaagaccuucgucgaccugaugcgccgcggggaccugcccguguggcucgccuacaagguggccgcggagggcaucaacuacgccgaccgcaaguggugcuucgacgggaucaagaacaaccagauccuggaggagaacgucgagguggagaucuggacgaaggagggcgagcggaagaagcugaagccgcgcuggcucgacgcccggaucuacagcgacccccuggcccugaaggaguucaaggaguucgcggccggccgcaagucccucacccugaaccugaucaccgagauggggcggcuccccaccuucaugacgcagaaggcccgcaacgcccuggacaaccuggccgugcuccacaccgcggaggucggcgggcgggcccacacccacgcccugagcgagcugcccgagacccucgagacgcugcugcuccugacccugcucgccaccgugaccggcggcaucuuccuguuccugauguccgggaagggcaucgggaagaugacccucggcaugugcugcaucaucacggccagcauccugcugugguacgcgcagauccagccgcacuggaucgccgccuccaucauccucgaguucuuccugaucguccugcucauccccgagcccgagaagcagcgcacgccccaggacaaccagcugaccuacguggugaucgccauccugaccgucguggccgcgacgauggccaacgagaugggguuccucgagaagaccaagaaggaccugggcuucggcaccaucaccacgcaggagagcgagagcaacauccuggacaucgaccuccggccggccuccgccuggacccuguacgccguggcgaccaccuucgucacgcccaugcugcgccacagcaucgagaacuccagcgugaacgugucccucaccgccaucgccaaccaggccaccguccugauggggcugggcaagggguggccccucagcaagauggacaucggcgugccccugcuggcgaucgggugcuacucccaggugaacccgaucacccucacggccgcccugcugcuccuggucgcccacuacgccaucaucggccccggccugcaggcgaaggccacccgggaggcccagaagcgcgccgccgcggggaucaugaagaaccccaccguggacggcaucaccgugaucgaccucgagcccaucccguacgaccccaaguucgagaagcagcuggggcaggucaugcugcucauccugugcgugacccaggugcugaugaugcggaccaccugggcccucugcgaggcccugacccuggccacgggccccaucagcacccucugggaggggaaccccggccgcuucuggaacaccaccaucgccgucuccauggcgaacaucuuccgcggcagcuaccuggccggggccggccuccuguucuccaucaugaagaacacgaccaacacccggcgcgggaccggcaacgugggcgagacgcugggggagaaguggaagucccggcugaacgcccucggcaaguccgaguuccagaucuacaagaaguccgggauccaggagguggaccgcacccuggcgaaggagggcaucaagcgcggggagaccgaccaccacgccgucucccgcggcagcgccaagcugcggugguucguggagcgcaacauggugaccccggagggcaaggucguggaccucgggugcggccgcgggggcugguccuacuacugcgggggccugaagaacgugcgcgaggucaagggccugacgaagggcggccccgggcacgaggagcccauccccaugagcaccuacggcuggaaccucgugcggcugcaguccgggguggacgucuucuucaccccgcccgagaagugcgacacccugcucugcgacaucggcgagagcagccccaaccccaccaucgaggccggccgcacgcugcgggugcugaaccucguggagaacuggcugaacaacaacacccaguucugcaucaagguccugaacccguacaugcccuccgugaucgagaagauggagacccuccagcgcaaguacgggggcgcccuggugcggaacccccugagccgcaacuccacccacgagauguacugggucagcaacgcgacggggaacaucguguccagcgugaacaugaucucccggaugcugaucaaccgcuucaccaugaagcacaagaaggccaccuacgagccggacgucgaccucggcagcgggacccggaacaucggcaucgaguccgagauccccaaccuggacaucaucggcaagcgcaucgagaagaucaagcaggagcacgagacgagcuggcacuacgaccaggaccaccccuacaagaccugggccuaccacggguccuacgagaccaagcagaccggcagcgccuccagcauggugaacggggugguccgccugcucacgaagcccugggacguggugccgauggucacccagauggccaugaccgacaccacgcccuucggccagcagcggguguucaaggagaagguggacacccgcacccaggagcccaaggagggcaccaagaagcugaugaagaucacggcgaaguggcuguggaaggagcucgggaaggagaagacgccccggaugugcacccgcgaggaguucacccggaagguccgcuccaacgccgcccugggcgccaucuucacggacgagaacaaguggaaguccgcccgggaggcgguggaggacgggcgcuucugggagcugguggaccgggagcgcaaccuccaccuggagggcaagugcgagaccugcgucuacaacaugauggggaagcgggagaagaagcugggcgaguucggcaaggccaaggggucccgcgccaucugguacauguggcucggcgcccgguuccuggaguucgaggcgcugggguuccucaacgaggaccacugguucagccgcggcaacucccugagcgggguggagggcgagggccugcaccggcucggguacauccugcgcgaggucggcaagaaggagggcggcgccauguacgccgacgacaccgccgggugggacacccggaucacgcuggaggaccucaagaacgaggagauggugaccaaccacaugaagggcgagcacaagaagcuggccgaggcgaucuucaagcugaccuaccagaacaaggugguccgcgugcagcggccgacgccccggggcacggugauggacaucaucagccggaaggaccagcgcggguccggccaggucgggaccuacggccucaacaccuucaccaacauggaggcccagcugauccgccagauggagggcgaggggaucuucaagaacauccagcaccugacggccaccgaggagaucgccgugcagaacuggcucgcccgggugggccgcgagcggcugagccgcauggcgaucuccggggacgacugcgucgugaagcccaucgacgaccgguucgccagcgcccugaccgcccucaacgacaugggcaaggugcgcaaggacauccagcagugggagcccucccggggguggaacgacuggacccaggucccguucugcagccaccacuuccacgagcuggugaugaaggacggccgcgugcuggucgugcccugccggaaccaggacgagcucaucggccgcgcccggaucucccagggggcgggcuggagccugaaggagaccgccugccuggggaaguccuacgcccagauguggacgcucauguacuuccaccgccgggaccugcgccuggccgccaacgcgaucugcagcgccgugcccucccacuggguccccaccagccggaccaccugguccauccacgccaagcacgaguggaugacgaccgaggacaugcucgccguguggaaccgcguguggauccaggagaacccguggauggaggacaagacccccgucgagagcugggaggaggugcccuaccugggcaagcgggaggaccaguggugcgggucccugaucggccucaccagccgcgcgacgugggccaagaacauccagaccgccaucaaccaggugcggucccugaucggcaacgagggguacaccgacuacaugcccagcaugaagcgcuuccgccgggaggaggaggaggccggcguccugugguga

SEQ ID NO: 9027 - RNA, 9876 nt, Artificial Sequence
  derived and/or modified CDS sequence (opt1) from DENV-2__KP188553__SS-prME
accgccggcgugaucgucaugcugauccccaccgccauggcguuccaccucaccacccgcaacggggagccccacaugaucgugggccggcaggagaaggggaagucccugcuguucaagaccgaggacggcgugaacaugugcacccucauggccaucgaccugggggagcugugcgaggacaccaucaccuacaagugcccccuccugcgccagaacgagcccgaggacaucgacugcuggugcaacagcaccagcaccugggucaccuacgggaccugcaccaccacgggcgagcaccggcgcgagaagcgguccguggcccuggugccccacgucgggaugggccucgagacccgcaccgagaccuggaugagcuccgagggggccuggaagcacgugcagcggaucgagacguggauccugcgccaccccggcuucaccaucauggccgcgauccuggccuacaccaucgggaccacgcacuuccagcgggcccucaucuucauccugcugaccgccguggcgcccagcaugaccaugcgcugcaucggcaucuccaaccgggacuucgucgagggcgugagcgggggcuccuggguggacaucguccucgagcacgggagcugcgugaccacgauggccaagaacaagcccacccuggacuucgagcugaucaagaccgaggccaagcagcccgccacccuccgcaaguacugcaucgaggccaagcugacgaacaccaccaccgagucccggugcccgacgcagggcgagcccagccugaacgaggagcaggacaagcgcuucaucugcaagcacuccaugguggaccggggcugggggaacggcugcgggcuguucggcaagggcgggaucgugaccugcgcgauguucacgugcaagaagaacauggagggcaagaucgugcagcccgagaaccuggaguacaccaucgugaucacgccccacagcggggaggagcacgccgucggcaacgacaccgggaagcacggcaaggagaucaagaucaccccgcaguccagcaccaccgaggccgagcugacgggguacggcaccgugaccauggagugcagcccccggaccggccucgacuucaacgagauggugcugcugcagauggaggacaaggccuggcucguccaccggcagugguuccuggaccugccccuccccuggcugccgggggccgacacgcagggcagcaacuggauccagaaggagacccuggugaccuucaagaacccccacgcgaagaagcaggacguggucgugcucgggucccaggagggcgccaugcacaccgcccugacgggggccaccgagauccagaugagcagcggcaaccuccuguucaccggccaccugaagugccgccugcggauggacaagcuccagcugaaggggauguccuacagcaugugcaccggcaaguucaagaucgucaaggagaucgccgagacgcagcacgggaccaucgugauccgcgugcaguacgagggcgacggcucccccugcaagauccccuucgagaucaccgaccuggagaagcggcacguccucgggcgccugaucaccgugaacccgaucgugacggagaaggacagccccgucaacaucgaggcggagccgcccuucggcgacuccuacaucaucguggggguggagccgggccagcugaagcucaacugguucaagaaggggagcuccaucggccagauguucgagaccaccaugcgcggcgccaagcggauggccauccugggggacaccgccugggacuucggcagccucgggggcgucuucacguccaucgggaaggcccuccaccagguguucggcgcgaucuacggcgccgccuucagcgggguguccuggaccaugaagauccugaucggcgucaucaucaccuggaucgggaugaacagccgcuccaccagccuguccgugagccuggugcucgucggcguggugacgcuguaccugggggccaugguccaggcggacuccggcugcaucgugagcuggaagaacaaggagcucaagugcggcuccgggaucuucaucaccgacaacgugcacaccuggaccgagcaguacaaguuccagcccgagagccccagcaagcuggccuccgccauccagaaggcccacgaggagggcaucugcgggauccggagcgucacgcgccuggagaaccucauguggaagcagaucacccccgagcugaaccacauccuguccgagaacgaggugaagcucaccaucaugaccggcgacaucaaggggaucaugcaggccggcaagcggagccugcgcccgcagcccacggagcugaaguacuccuggaagaccuggggcaaggcgaagaugcucagcaccgagucccacaaccagaccuuccugaucgacgggcccgagacggccgagugcccgaacaccaaccgggccuggaacagccuggagguggaggacuacggcuucggggucuucaccaccaacaucuggcucaagcugcgcgagaagcaggacguguucugcgacuccaagcugaugagcgccgccaucaaggacaaccgggcggugcacgccgacaugggcuacuggaucgaguccgcccucaacgacaccuggaagauggagaaggccagcuucaucgaggucaaguccugccacuggcccaagagccacacgcugugguccaacggcgugcuggagagcgagauggugauccccaagaacuucgccgggcccgucucccagcacaacuaccgcccgggcuaccacacccagaccgcggggcccuggcaccucggcaagcuggagauggacuucgacuucugcgaggggaccacggugguggucaccgaggacugcgagaagcggggccccagccugcgcaccaccacggccagcggcaagcucaucaccgaguggugcugccgguccugcacccugcccccgcugcgcuaccgcggggaggacggcugcugguacgggauggagauccgcccccucaaggagaaggaggagaaccuggugaacagccuggugaccgccggccacgggcagaucgacaacuucucccucggcguccugggcauggcccuguuccucgaggagaugcugcggacgcgcguggggaccaagcacgcgauccugcucguggcccugagcuucgucacccugaucaccggcaacauguccuuccgggaccucgggcgcgugauggugauggucggcgccacgaugaccgacgacaucgggaugggcgugaccuaccuggcccugcucgccgcguucaaggugcgccccaccuucgccgccggccugcugcuccggaagcugacgagcaaggagcugaugauggccaccaucgggaucgcccuccugucccagagcacccugcccgagaccauccucgagcugacggacgcgcuggcccucggcaugauggcccugaagaucguccgcaacauggagaaguaccagcuggccgugaccaucauggccaucuccugcgugccgaacgcggucauccuccagaacgccuggaaggugagcugcaccauccuggccgccguguccgucagcccccugcuccugaccuccagccagcagaaggcggacuggaucccccuggcccucacgaucaaggggcugaaccccaccgccaucuuccugaccacccucucccggacgagcaagaagcgcuccuggccgcugaacgaggccaucauggccgugggcauggucagcauccuggcguccagccuccugaagaacgacauccccaugaccggcccccugguggccgggggccuccugaccgugugcuacguccugaccgggcggagcgccgaccucgagcuggagcgcgccgccgacgugaagugggaggaccaggcggagaucuccggcagcucccccauccugagcaucacgaucuccgaggacgggagcauguccaucaagaacgaggaggaggagcagacccucaccauccugauccggaccggccugcucgugaucagcggcgucuucccgguguccauccccaucaccgccgccgccugguaccugugggaggugaagaagcagcgcgccgggguccugugggacgugcccagcccgccgcccgugggcaaggcggagcucgaggacggggccuaccggaucaagcagcgcggcauccugggguacucccagaucggcgccggcgucuacaaggaggggacguuccacaccauguggcacgugacccggggcgccgugcugaugcaccgcgggaagcggaucgagcccagcugggccgacgucaagaaggaccucaucuccuacggcgggggcuggaagcuggagggcgaguggaaggagggggaggagguccaggugcuggcgcucgagcccggcaagaacccccgcgccguccagaccaagcccgggaucuucaagacgaacaccggcaccaucggggccgugagccuggacuucucccccggcaccagcggcucccccaucguggaccggaaggggaaggucgugggccuguacgggaacggcguggucacgcgcagcggcgccuacguguccgcgaucgcccagaccgagaaguccaucgaggacaaccccgagaucgaggacgacaucuuccggaagaagcgccucaccaucauggaccugcaccccggggccggcaagaccaagcgguaccugcccgccaucgugcgcgaggccaucaagcgggggcugcgcacgcucauccuggcgccgacccgcgucguggccgccgagauggaggaggcccugcggggccuccccauccgcuaccagacccccgccauccgggcggagcacaccgggcgcgagaucguggaccugaugugccacgccacguucaccaugcggcugcucagccccguccgcgugccgaacuacaaccugaucaucauggacgaggcccacuucaccgaccccgccuccaucgccgcgcggggcuacaucagcacccgcguggagaugggcgaggccgccgggaucuucaugacggccacgccgcccggcucccgggacccguucccccagagcaacgcgcccaucauggacgaggagcgcgagauccccgagcgguccuggaacagcgggcacgagugggucaccgacuucaagggcaagaccgugugguucgugccguccaucaaggccgggaacgacaucgccgccugccugcgcaagaacggcaagaaggucauccccuacagccggaagacguucgacuccgaguacgugaagacccgcgccaacgacugggacuucguggucaccaccgacaucagcgagaugggcgcgaacuucaaggccgagcgggugaucgacccccgccggugcaugaagcccgugauccucacggacggggaggagcgcgucauccuggccggcccgaugcccgugacccacuccagcgccgcccagcggcgcgggcgcaucggccggaaccccaagaacgagaacgaccaguacaucuacaugggggagccccuggagaacgacgaggacugcgcgcacuggaaggaggccaagaugcuccuggacaacaucaacaccccggagggcaucauccccuccauguucgagcccgagcgcgagaagguggacgccaucgacggcgaguaccggcugcgcggggaggcccggaagaccuucgucgaccucaugcgccggggcgaccugccgguguggcuggccuacaagguggcggccgaggggaucaacuacgccgaccgcaaguggugcuucgacggcaucaagaacaaccagauccucgaggagaacgucgagguggagaucuggacgaaggagggggagcggaagaagcugaagccccgcuggcuggacgcccggaucuacagcgacccccucgcgcugaaggaguucaaggaguucgccgccggccgcaagucccugacccucaaccugaucaccgagaugggccggcugcccaccuucaugacgcagaaggcccgcaacgcccucgacaaccuggcggugcugcacaccgccgaggucgggggcaaggccuacacccacgcccucagcgagcugccggagacccuggagacgcuccugcugcucacccugcuggccgcggugaccgggggcaucuuccucuuccugauguccggcaaggggaucggcaagaugacccuggggaugugcugcaucaucaccgccagcauccuccugugguacgcccagauccagccccacuggaucgccgccuccaucauccuggaguucuuccucaucguccugcugauccccgagcccgagaagcagcggacgccgcaggacaaccagcucaccuacguggugaucgcgauccugaccgucguggccgccaccauggccaacgagaugggcuuccuggagaagacgaagaaggaccucggguucggcagcaucaccacccaggagagcgaguccaacauccuggacaucgaccugcgccccgccagcgcguggacccucuacgccguggccacgaccuucgucacccccaugcugcggcacuccaucgagaacagcuccgugaacgugagccugaccgccaucgcgaaccaggccacgguccucaugggccuggggaagggcuggccccuguccaagauggacaucggggugccgcuccuggccaucggcugcuacagccaggugaaccccaucacccugaccgccgcccuccugcugcucgucgcgcacuacgccaucaucgggcccggccugcaggccaaggccacccgcgaggcccagaagcgggcggccgccggcaucaugaagaaccccacgguggacgggaucaccgugaucgaccuggagccgauccccuacgaccccaaguucgagaagcagcucggccaggucaugcugcugauccucugcgugacccaggugcugaugaugcgcaccacgugggcccugugcgaggcccucacccuggcgaccgggcccaucuccacccugugggagggcaacccggggcgguucuggaacacgaccaucgccgucagcauggccaacaucuuccgcggcuccuaccucgccggcgcggggcugcuguucagcaucaugaagaacaccaccaacacgcgccggggcaccgggaacgugggcgagacccucggcgagaaguggaagucccgccugaacgcccugggcaagagcgaguuccagaucuacaagaaguccggcauccaggagguggaccggacccucgccaaggaggggaucaagcgcggcgagacggaccaccacgccgucagccggggguccgccaagcugcgcugguucguggagcggaacauggugacccccgagggcaaggucguggaccugggcugcgggcgcggcggguggagcuacuacugcggcgggcucaagaacgugcgggaggucaagggccugaccaagggcgggcccggccacgaggagcccaucccgauguccaccuacggguggaaccuggugcgccuccagagcggcguggacgucuucuucacgccgcccgagaagugcgacacccugcugugcgacaucggggagagcucccccaacccgaccaucgaggcgggccggacccuccgcgugcugaaccugguggagaacuggcucaacaacaacacccaguucugcaucaagguccugaaccccuacaugcccagcgugaucgagaagauggagacgcugcagcggaaguacggcggggcccucgugcgcaacccgcugucccggaacagcacccacgagauguacugggucuccaacgccaccggcaacaucgugagcuccgugaacaugaucagccgcaugcugaucaaccgguucaccaugaagcacaagaaggccacguacgagcccgacgucgaccugggguccggcacccgcaacaucgggaucgagagcgagacccccaaccucgacaucaucggcaagcggaucgagaagaucaagcaggagcacgagaccuccuggcacuacgaccaggaccaccccuacaagacgugggccuaccacggcagcuacgagaccaagcagaccggguccgcgagcuccauggugaacggcgugguccgccugcugaccaagccgugggacguggugcccauggucacgcagauggccaugaccgacaccacccccuucgggcagcagcgcguguucaaggagaagguggacacgcggacccaggagcccaaggagggcaccaagaagcucaugaagaucaccgccgaguggcuguggaaggagcugggcaaggagaagacgccgcgcaugugcacccgggaggaguucacccgcaagguccggagcaacgccgcccucggggcgguguucaccgacgagaacaaguggaaguccgcccgcgaggccguggaggacggccgguucugggagcuggucgaccgcgagcggaaccugcaccucgaggggaagugcgagacgugcguguacaacaugaugggcaagcgcgagaagaagcugggggaguucggcaaggccaagggcagccgggcgaucugguacauguggcugggggcccgcuuccucgaguucgaggcccugggcuuccugaacgaggaccacugguucucccgggggaacagccucagcggcgucgagggggagggccugcaccgccugggcuacauccuccgggagguggggaagaaggagggcggggccauguacgccgacgacaccgcgggcugggacacccgcaucacccuggaggaccugaagaacgaggagauggugacgaaccacaugaagggggagcacaagaagcucgccgaggccaucuucaagcugaccuaccagaacaaggucgugcgggugcagcgccccacgccccggggcaccgucauggacaucaucucccgcaaggaccagcggggcagcggccagguggggacguacgggcugaacaccuucaccaacauggaggcccagcucauccgccagauggagggcgagggcaucuucaaguccauccagcaccugaccgccacggaggagaccgcggugcagaacuggcuggcccgcgucgggcgggagcgccucagccggauggccaucuccggcgacgacugcguggugaagcccaucgacgaccgcuucgccagcgcccugaccgcgcugaacgacauggggaagguccggaaggacauccagcagugggagccgucccgcggcuggaacgacuggacccaggugcccuucugcagccaccacuuccacgagcucgugaugaaggacgggcggguccugguggugcccugccgcaaccaggacgagcugaucggccgggcccgcaucucccagggcgccggguggagccucaaggagaccgccugccugggcaaguccuacgcccagauguggacgcugauguacuuccaccggcgcgaccuccggcuggcggccaacgccaucugcagcgccguccccucccacugggugccgaccagccgcaccaccugguccauccacgcgaagcacgaguggaugacgaccgaggacaugcuggccguguggaaccgggucuggauccaggagaaccccuggauggaggacaagacccccguggagagcugggaggaggugcccuaccucgggaagcgcgaggaccaguggugcggcucccugaucgggcugaccagccgggccacgugggccaagaacauccagaccgccaucaaccagguccgcagccucaucggcaacgagggcuacaccgacuacaugccguccaugaagcgguuccgccgcgaggaggaggaggcgggggugcugugguga

SEQ ID NO: 9028 - RNA, 9876 nt, Artificial Sequence
  derived and/or modified CDS sequence (opt1) from DENV-2__KP188556__SS-prME
accgccggcgugaucgucaugcugauccccaccgccauggcguuccaccucaccacccgcaacggggagccccacaugaucgugggccggcaggagaaggggaagucccugcuguucaagaccgaggacggcgugaacaugugcacccucauggccaucgaccugggggagcugugcgaggacaccaucaccuacaagugcccccuccugcgccagaacgagcccgaggacaucgacugcuggugcaacagcaccagcaccugggucaccuacgggaccugcaccaccacgggcgagcaccggcgcgagaagcgguccguggcccuggugccccacgucgggaugggccucgagacccgcaccgagaccuggaugagcuccgagggggccuggaagcacgugcagcggaucgagacguggauccugcgccacccgggcuucaccaucauggccgcgauccuggccuacaccaucgggaccacgcacuuccagcgggcccucaucuucauccugcugaccgccguggcgcccagcaugaccaugcgcugcaucggcaucuccaaccgggacuucgucgagggcgugagcgggggcuccuggguggacaucguccucgagcacgggagcugcgugaccacgauggccaagaacaagcccacccuggacuucgagcugaucaagaccgaggccaagcagcccgccacccuccgcaaguacugcaucgaggccaagcugacgaacaccaccaccgagucccggugcccgacgcagggcgagcccagccugaacgaggagcaggacaagcgcuucaucugcaagcacuccaugguggaccggggcugggggaacggcugcgggcuguucggcaagggcgggaucgugaccugcgcgauguucacgugcaagaagaacauggagggcaagaucgugcagcccgagaaccuggaguacaccaucgugaucacgccccacagcggggaggagcacgccgucggcaacgacaccgggaagcacggcaaggagaucaagaucaccccgcaguccagcaccaccgaggccgagcugacgggguacggcaccgugaccauggagugcagcccccggaccggccucgacuucaacgagauggugcugcugcagauggaggacaaggccuggcucguccaccggcagugguuccuggaccugccccuccccuggcugccgggggccgacacgcagggcagcaacuggauccagaaggagacccuggugaccuucaagaacccccacgcgaagaagcaggacguggucgugcucgggucccaggagggcgccaugcacaccgcccugacgggggccaccgagauccagaugagcagcggcaaccuccuguucaccggccaccugaagugccgccugcggauggacaagcuccagcugaaggggauguccuacagcaugugcaccggcaaguucaagaucgucaaggagaucgccgagacgcagcacgggaccaucgugauccgcgugcaguacgagggcgacggcucccccugcaagauccccuucgagaucaccgaccuggagaagcggcacguccucgggcgccugaucaccgugaacccgaucgugacggagaaggacagccccgucaacaucgaggcggagccgcccuucggcgacuccuacaucaucguggggguggagccgggccagcugaagcucaacugguucaagaaggggagcuccaucggccagauguucgagaccaccaugcgcggcgccaagcggauggccauccugggggacaccgccugggacuucggcagccucgggggcgucuucacguccaucgggaaggcccuccaccagguguucggcgcgaucuacggcgccgccuucagcgggguguccuggaccaugaagauccugaucggcgucaucaucaccuggaucgggaugaacagccgcuccaccagccuguccgugagccuggugcucgucggcguggugacgcuguaccugggggccaugguccaggcggacuccggcugcaucgugagcuggaagaacaaggagcucaagugcggcuccgggaucuucaucaccgacaacgugcacaccuggaccgagcaguacaaguuccagcccgagagccccagcaagcuggccuccgccauccagaaggcccacgaggagggcaucugcgggauccggagcgucacgcgccuggagaaccucauguggaagcagaucacccccgagcugaaccacauccuguccgagaacgaggugaagcucaccaucaugaccggcgacaucaaggggaucaugcaggccggcaagcggagccugcgcccgcagcccacggagcugaaguacuccuggaagaccuggggcaaggcgaagaugcucagcaccgagucccacaaccagaccuuccugaucgacgggcccgagacggccgagugcccgaacaccaaccgggccuggaacagccuggagguggaggacuacggcuucggggucuucaccaccaacaucuggcucaagcugcgcgagaagcaggacguguucugcgacuccaagcugaugagcgccgccaucaaggacaaccgggcggugcacgccgacaugggcuacuggaucgaguccgcccucaacgacaccuggaagauggagaaggccagcuucaucgaggucaaguccugccacuggcccaagagccacacgcugugguccaacggcgugcuggagagcgagauggugauccccaagaacuucgccgggcccgucucccagcacaacuaccgcccgggcuaccacacccagaccgcggggcccuggcaccucggcaagcuggagauggacuucgacuucugcgaggggaccacggugguggucaccgaggacugcgagaagcggggccccagccugcgcaccaccacggccagcggcaagcucaucaccgaguggugcugccgguccugcacccugcccccgcugcgcuaccgcggggaggacggcugcugguacgggauggagauccgcccccucaaggagaaggaggagaaccuggugaacagccuggugaccgccggccacgggcagaucgacaacuucucccucggcguccugggcauggcccuguuccucgaggagaugcugcggacgcgcguggggaccaagcacgcgauccugcucguggcccugagcuucgucacccugaucaccggcaacauguccuuccgggaccucgggcgcgugauggugauggucggcgccacgaugaccgacgacaucgggaugggcgugaccuaccuggcccugcucgccgcguucaaggugcgccccaccuucgccgccggccugcugcuccggaagcugacgagcaaggagcugaugauggccaccaucgggaucgcccuccugucccagagcacccugcccgagaccauccucgagcugacggacgcgcuggcccucggcaugauggcccugaagaucguccgcaacauggagaaguaccagcuggccgugaccaucauggccaucuccugcgugccgaacgcggucauccuccagaacgccuggaaggugagcugcaccauccuggccgccguguccgucagcccccugcuccugaccuccagccagcagaaggcggacuggaucccccuggcccucacgaucaaggggcugaaccccaccgccaucuuccugaccacccucucccggacgagcaagaagcgcuccuggccgcugaacgaggccaucauggccgugggcauggucagcauccuggcguccagccuccugaagaacgacauccccaugaccggcccccugguggccgggggccuccugaccgugugcuacguccugaccgggcggagcgccgaccucgagcuggagcgcgccgccgacgugaagugggaggaccaggcggagaucuccggcagcucccccauccugagcaucacgaucuccgaggacgggagcauguccaucaagaacgaggaggaggagcagacccucaccauccugauccggaccggccugcucgugaucagcggcgucuucccgguguccauccccaucaccgccgccgccugguaccugugggaggugaagaagcagcgcgccgggguccugugggacgugcccagcccgccgcccgugggcaaggcggagcucgaggacggggccuaccggaucaagcagcgcggcauccugggguacucccagaucggcgccggcgucuacaaggaggggacguuccacaccauguggcacgugacccggggcgccgugcugaugcaccgcgggaagcggaucgagcccagcugggccgacgucaagaaggaccucaucuccuacggcgggggcuggaagcuggagggcgaguggaaggagggggaggagguccaggugcuggcgcucgagcccggcaagaacccccgcgccguccagaccaagcccgggaucuucaagacgaacaccggcaccaucggggccgugagccuggacuucucccccggcaccagcggcucccccaucguggaccggaaggggaaggucgugggccuguacgggaacggcguggucacgcgcagcggcgccuacguguccgcgaucgcccagaccgagaaguccaucgaggacaaccccgagaucgaggacgacaucuuccggaagaagcgccucaccaucauggaccugcaccccggggccggcaagaccaagcgguaccugcccgccaucgugcgcgaggccaucaagcgggggcugcgcacgcucauccuggcgccgacccgcgucguggccgccgagauggaggaggcccugcggggccuccccauccgcuaccagacccccgccauccgggcggagcacaccgggcgcgagaucguggaccugaugugccacgccacguucaccaugcggcugcucagccccguccgcgugccgaacuacaaccugaucaucauggacgaggcccacuucaccgaccccgccuccaucgccgcgcggggcuacaucagcacccgcguggagaugggcgaggccgccgggaucuucaugacggccacgccgcccggcucccgggacccguucccccagagcaacgcgcccaucauggacgaggagcgcgagauccccgagcgguccuggaacagcgggcacgagugggucaccgacuucaagggcaagaccgugugguucgugccguccaucaaggccgggaacgacaucgccgccugccugcgcaagaacggcaagaaggucauccagcucagccggaagacguucgacuccgaguacgugaagacccgcgccaacgacugggacuucguggucaccaccgacaucagcgagaugggcgcgaacuucaaggccgagcgggugaucgacccccgccggugcaugaagcccgugauccugacggacggggaggagcgcgucauccuggccggccccaugccggugacccacuccagcgccgcccagcggcgcgggcgcaucggccggaaccccaagaacgagaacgaccaguacaucuacaugggggagccccucgagaacgacgaggacugcgcgcacuggaaggaggccaagaugcugcuggacaacaucaacacccccgagggcaucaucccguccauguucgagcccgagcgcgagaagguggacgccaucgacggcgaguaccggcuccgcggggaggcccggaagaccuucgucgaccugaugcgccggggcgaccugcccguguggcucgccuacaagguggcggccgaggggaucaacuacgccgaccgcaaguggugcuucgacggcaucaagaacaaccagauccuggaggagaacgucgagguggagaucuggacgaaggagggggagcggaagaagcugaagccgcgcuggcucgacgcccggaucuacagcgacccccuggcgcugaaggaguucaaggaguucgccgccggccgcaagucccucacccugaaccugaucaccgagaugggccggcuccccaccuucaugacgcagaaggcccgcaacgcccuggacaaccuggcggugcuccacaccgccgaggucgggggcaaggccuacacccacgcccugagcgagcugcccgagacccucgagacgcugcugcuccugacccugcucgccgcggugaccgggggcaucuuccuguuccugauguccggcaaggggaucggcaagaugacccucgggaugugcugcaucaucaccgccagcauccugcugugguacgcccagauccagccgcacuggaucgccgccuccaucauccucgaguucuuccugaucguccugcucauccccgagcccgagaagcagcggacgccccaggacaaccagcugaccuacguggugaucgcgauccugaccgucguggccgccaccauggccaacgagaugggcuuccucgagaagacgaagaaggaccugggguucggcagcaucaccacccaggagagcgaguccaacauccuggacaucgaccuccgcccggccagcgcguggacccuguacgccguggccacgaccuucgucacccccaugcugcggcacuccaucgagaacagcuccgugaacgugagccucaccgccaucgcgaaccaggccacgguccugaugggccuggggaagggcuggccccucuccaagauggacaucggggugccccugcuggccaucggcugcuacagccaggugaacccgaucacccucaccgccgcccugcugcuccuggucgcgcacuacgccaucaucgggcccggccugcaggccaaggccacccgcgaggcccagaagcgggcggccgccggcaucaugaagaaccccacgguggacgggaucaccgugaucgaccucgagcccaucccgcacgaccccaaguucgagaagcagcugggccaggucaugcugcucauccugugcgugacccaggugcugaugaugcgcaccacgugggcccucugcgaggcccugacccuggcgaccgggcccaucuccacccucugggagggcaaccccgggcgguucuggaacacgaccaucgccgucagcauggccaacaucuuccgcggcuccuaccuggccggcgcggggcuccuguucagcaucaugaagaacaccaccaacacgcgccggggcaccgggaacgugggcgagacccugggcgagaaguggaagucccgccugaacgcccucggcaagagcgaguuccagaucuacaagaaguccggcauccaggagguggaccggacccuggccaaggaggggaucaagcgcggcgagacggaccaccacgccgucagccggggguccgccaagcugcgcugguucguggagcggaacauggugaccccggagggcaaggucguggaccucggcugcgggcgcggcggguggagcuacuacugcggcgggcugaagaacgugcgggaggucaagggccugaccaagggcgggcccggccacgaggagcccauccccauguccaccuacggguggaaccucgugcgccugcagagcggcguggacgucuucuucacgccgcccgagaagugcgacacccugcucugcgacaucggggagagcucccccaaccccaccaucgaggcgggccggacccugcgcgugcugaaccucguggagaacuggcugaacaacaacacccaguucugcaucaagguccugaacccguacaugcccagcgugaucgagaagauggagacgcuccagcggaaguacggcggggcccuggugcgcaacccccugucccggaacagcacccacgagauguacugggucuccaacgccaccggcaacaucgugagcuccgugaacaugaucagccgcaugcugaucaaccgguucaccaugaagcacaagaaggccacguacgagccggacgucgaccucggguccggcacccgcaacaucgggaucgagagcgagacccccaaccuggacaucaucggcaagcggaucgagaagaucaagcaggagcacgagaccuccuggcacuacgaccaggaccaccccuacaagacgugggccuaccacggcagcuacgagaccaagcagaccggguccgcgagcuccauggugaacggcgugguccgccugcucaccaagcccugggacguggugccgauggucacgcagauggccaugaccgacaccacccccuucgggcagcagcgcguguucaaggagaagguggacacgcggacccaggagcccaaggagggcaccaagaagcugaugaagaucaccgccgaguggcuguggaaggagcucggcaaggagaagacgccccgcaugugcacccgggaggaguucacccgcaagguccggagcaacgccgcccugggggcgguguucaccgacgagaacaaguggaaguccgcccgcgaggccguggaggacggccgguucugggagcuggucgaccgcgagcggaaccuccaccuggaggggaagugcgagacgugcguguacaacaugaugggcaagcgcgagaagaagcugggggaguucggcaaggccaagggcagccgggcgaucugguacauguggcucggggcccgcuuccuggaguucgaggcccugggcuuccucaacgaggaccacugguucucccgggggaacagccugagcggcgucgagggggagggccugcaccgccucggcuacauccugcgggagguggggaagaaggagggcggggccauguacgccgacgacaccgcgggcugggacacccgcaucacccuggaggaccucaagaacgaggagauggugacgaaccacaugaagggggagcacaagaagcuggccgaggccaucuucaagcugaccuaccagaacaaggucgugcgggugcagcgcccgacgccccggggcaccgucauggacaucaucucccgcaaggaccagcggggcagcggccagguggggacguacgggcucaacaccuucaccaacauggaggcccagcugauccgccagauggagggcgagggcaucuucaaguccauccagcaccugaccgccacggaggagaccgcggugcagaacuggcucgcccgcgucgggcgggagcgccugagccggauggccaucuccggcgacgacugcguggugaagcccaucgacgaccgcuucgccagcgcccugaccgcgcucaacgacauggggaagguccggaaggacauccagcagugggagcccucccgcggcuggaacgacuggacccaggugccguucugcagccaccacuuccacgagcuggugaugaaggacgggcggguccugguggugcccugccgcaaccaggacgagcucaucggccgggcccgcaucucccagggcgccggguggagccugaaggagaccgccugccugggcaaguccuacgcccagauguggacgcucauguacuuccaccggcgcgaccugcggcuggcggccaacgccaucugcagcgccguccccucccacugggugcccaccagccgcaccaccugguccauccacgcgaagcacgaguggaugacgaccgaggacaugcucgccguguggaaccgggucuggauccaggagaacccguggauggaggacaagacccccguggagagcugggaggaggugcccuaccuggggaagcgcgaggaccaguggugcggcucccugaucgggcucaccagccgggccacgugggccaagaacauccagaccgccaucaaccagguccgcagccugaucggcaacgagggcuacaccgacuacaugcccuccaugaagcgguuccgccgcgaggaggaggaggcgggggugcugugguga

SEQ ID NO: 9029 - RNA, 9876 nt, Artificial Sequence
  derived and/or modified CDS sequence (opt1) from DENV-2__GU369819__SS-prME
accgccggcgugaucgucaugcugauccccaccgccauggcguuccaccucaccacccggaacggggagccccacaugaucgugggccggcaggagaaggggaagucccugcuguucaagaccgaggacggcgugaacaugugcacccucauggccaucgaccugggggagcugugcgaggacaccaucaccuacaagugcccccuccugcgccagaacgagcccgaggacaucgacugcuggugcaacagcaccagcaccugggucacguacgggaccugcaccaccacgggcgagcaccggcgcgagaagcgguccguggcccuggugccccacgucgggaugggccucgagacccggaccgagaccuggaugagcuccgagggggccuggaagcacgugcagcggaucgagacguggauccugcgccacccgggcuucaccaucauggccgcgauccuggccuacaccaucgggaccacgcacuuccagcgggcccucaucuucauccugcugaccgccguggcgcccagcaugaccaugcgcugcaucggcaucuccaaccgggacuucgucgagggcgugagcgggggcuccuggguggacaucguccucgagcacgggagcugcgugaccacgauggccaagaacaagcccacccuggacuucgagcugaucaagaccgaggccaagcagcccgccacccuccgcaaguacugcaucgaggccaagcugacgaacaccaccaccgagucccggugccccacgcagggcgagcccagccugaacgaggagcaggacaagcgcuucaucugcaagcacuccaugguggaccggggcugggggaacggcugcgggcuguucggcaagggcgggaucgugaccugcgcgauguucacgugcaagaagaacauggagggcaagguggugcagcccgagaaccuggaguacaccaucgucaucacgccccacagcggggaggagcacgccgugggcaacgacaccgggaagcacggcaaggagaucaagaucaccccgcaguccagcaucaccgaggccgagcugaccggguacggcacggugaccauggagugcagcccccggaccggccucgacuucaacgagaugguccugcugcagauggagaacaaggccuggcucgugcaccggcagugguuccuggaccugccccuccccuggcugccgggggccgacacccagggcagcaacuggauccagaaggagacgcuggugaccuucaagaacccccacgcgaagaagcaggacgucgugguccucgggucccaggagggcgccaugcacaccgcccugaccggggccacggagauccagaugagcagcggcaaccuccuguucaccggccaccugaagugccgccugcggauggacaagcuccagcugaaggggauguccuacagcaugugcaccggcaaguucaagaucgugaaggagaucgccgagacccagcacgggacgaucgugauccgcguccaguacgagggcgacggcucccccugcaagauccccuucgagaucaccgaccuggagaagcggcacgugcucgggcgccugaucaccgugaacccgaucgucaccgagaaggacagccccgugaacaucgaggcggagccgcccuucggcgacuccuacaucaucaucgggguggagccgggccagcugaagcucaacugguucaagaaggggagcuccaucggccagauguucgagacgaccaugcgcggcgccaagcggauggccauccugggggacaccgccugggacuucggcagccucggcggggucuucaccuccaucgggaaggcccuccaccagguguucggggcgaucuacggcgccgccuucagcgggguguccuggacgaugaagauccugaucggcgucaucaucaccuggaucgggaugaacagccgcuccaccagccuguccgugagccuggugcucgucggcguggugacccuguaccugggggccaugguccgggcggacuccggcugcguggugagcuggaagaacaaggagcucaagugcggcuccgggaucuucaucacggacaacguccacaccuggaccgagcaguacaaguuccagcccgagagccccagcaagcuggccuccgccauccagaaggcccacgaggagggcaucugcgggauccgcagcgugacccggcuggagaaccucauguggaagcagaucacgcccgagcugaaccacauccuguccgagaacgaggugaagcucaccaucaugaccggcgacaucaaggggaucaugcaggccggcaagcgcagccugcggccgcagcccaccgagcugaaguacuccuggaagacguggggcaaggcgaagaugcucagcaccgagucccacaaccagaccuuccugaucgacgggcccgagaccgccgagugcccgaacacgaaccgcgccuggaacagccuggaggucgaggacuacggcuucgggguguucaccaccaacaucuggcucaagcugcgggagaagcaggacguguucugcgacuccaagcugaugagcgccgccaucaaggacaaccgcgcgguccacgccgacaugggcuacuggaucgaguccgcccucaacgacaccuggaagauggagaaggccagcuucaucgaggugaaguccugccacuggcccaagagccacacccugugguccaacggcgugcuggagagcgagaugaucauccccaagaacuucgccgggcccgucucccagcacaacuaccggccgggcuaccacacgcagaccgcggggcccuggcaccucggcaagcuggagauggacuucgaccugugcgaggggaccaccgugguggucacggaggacugcggcaaccgcggccccagccuccggaccaccaccgccagcgggaagcugaucacggaguggugcugccgcuccugcacccugcccccgcuccgguaccgcggcgaggacgggugcugguacggcauggagauccggccccugaaggagaaggaggagaaccuggugaacagccucgugaccgccgggcacggccagaucgacaacuucucccugggcguccuggggauggcccucuuccuggaggagaugcugcgcacccggaucggcacgaagcacgcgauccuccugguggccgugagcuucgucacccugaucaccgggaacauguccuuccgcgaccucggccgcgugauggugauggucggggccaccaugacggacgacaucggcaugggcgugaccuaccuggcccugcucgccgcguucaaggugcggcccaccuucgccgccgggcugcugcuccgcaagcugaccagcaaggagcugaugauggccacgaucggcaucgcccuccugucccagagcaccauccccgagaccauccuggagcucaccgacgcgcuggcccuggggaugaugguccucaagaucgugcggaacauggagaaguaccagcuggccgugacgaucauggccaucuccugcgucccgaacgccgugauccugcagaacgcguggaaggugagcugcaccauccucgccgccgucuccgugagcccccugcugcucaccuccagccagcagaaggccgacuggaucccccuggcgcugaccaucaagggccucaaccccacggccaucuuccugaccacccugucccgcaccagcaagaagcgguccuggccgcucaacgaggccaucauggccgucggcauggugagcauccuggccuccagccugcucaagaacgacauccccaugacggggccccugguggcgggcgggcugcucaccgucugcuacgugcugaccggccgcagcgccgaccuggagcucgagcgggccgccgacgugaagugggaggaccaggccgagaucuccgggagcucccccauccugagcaucaccaucuccgaggacggcagcauguccaucaagaacgaggaggaggagcagacgcugaccauccucauccgcaccggccugcuggucaucagcgggguguucccgguguccauccccaucaccgcggccgccugguaccucugggaggucaagaagcagcgggccggcgugcugugggacgugcccagcccgccgcccgucgggaaggccgagcuggaggacggcgcguaccgcaucaagcagaaggggauccucggcuacucccagaucggcgccgggguguacaaggagggcaccuuccacacgauguggcacgugacccgcggggccguccugaugcaccgcggcaagcggaucgagcccagcugggccgacgugaagaaggaccugaucuccuacgggggcggcuggaagcucgagggggaguggaaggagggcgaggaggugcagguccuggcccuggagcccgggaagaacccccgcgcggugcagaccaagcccggcaucuucaagaccaacacggggaccaucggcgccgugagccucgacuucucccccggcaccagcgggucccccaucgucgaccggaagggcaaggugguggggcuguacggcaacggcgucgugacccgcagcggggccuacguguccgccaucgcgcagacggagaaguccaucgaggacaaccccgagaucgaggacgacaucuuccggaagaagcgccugaccaucauggaccuccaccccggcgccgggaagaccaagcgguaccugcccgccaucguccgcgaggccaucaagcggggccugcgcacccugauccucgccccgacgcgcgugguggcggccgagauggaggaggcccugcgggggcugcccauccgcuaccagacccccgccaucaagaccgagcacaccggccgggagaucgucgaccucaugugccacgccacguucaccaugcgccugcugagccccgugcgggugccgaacuacaaccucaucaucauggacgaggcgcacuucaccgaccccgccuccaucgccgcccgcggcuacaucagcacccgggucgagaugggggaggccgcgggcaucuucaugacggccacgccgcccgggucccgcgacccguucccccagagcaacgcccccaucauggacgaggagcgggagauccccgagcgcuccuggaacagcggccacgagugggugaccgacuucaaggggaagaccgugugguucgucccguccaucaaggccggcaacgacaucgcggccugccugcggaagaacggcaagaaggugauccagcugagccgcaagacguucgacuccgaguacgugaagacccgggccaacgacugggacuucgucgugaccaccgacaucagcgagaugggggccaacuucaaggccgagcgcgugaucgacccccggcgcugcaugaagcccgucauccucacggacggcgaggagcgggugauccuggcggggcccaugccggugacccacuccagcgccgcccagcgccggggccgcaucgggcgcaaccccaagaacgagaacgaccaguacaucuacaugggcgagccccuggagaacgacgaggacugcgcccacuggaaggaggccaagaugcuccuggacaacaucaacacccccgagggcaucaucccguccauguucgagcccgagcgggagaaggucgacgcgaucgacggggaguaccgccugcggggcgaggcccgcaagaccuucguggaccucaugcggcgcggggaccugcccguguggcuggccuacaaggucgccgccgagggcaucaacuacgcggaccggaaguggugcuucgacgggaucaagaacaaccagauccucgaggagaacaucgagguggagaucuggacgaaggagggcgagcgcaagaagcugaagccgcgguggcuggacgcccgcaucuacagcgacccccucgcccugaaggaguucaaggaguucgccgcgggccggaagucccugacccucaaccugaucaccgagauggggcgccugcccaccuucaugacgcagaaggcccggaacgcccucgacaaccuggccgugcugcacaccgccgaggcgggcgggcgcgccuacaaccacgcccucagcgagcugcccgagacccuggagacccuccugcugcucacgcugcuggccaccgucaccggcggcaucuuccucuuccugauguccgggcggggcaucgggaagaugacccugggcaugugcugcaucaucaccgccagcauccuccugugguacgcgcagauccagccgcacuggaucgccgccuccaucauccuggaguucuuccucaucgugcugcugauccccgagcccgagaagcagcgcacgccccaggacaaccagcucaccuacgucgugaucgccauccugaccguggucgccgcgaccauggccaacgagaugggguuccuggagaagacgaagaaggaccucggccugggcagcaucaccacccaggagagcgaguccaacauccuggacaucgaccuccggccggccagcgccuggacccuguacgccguggcgacgaccuucgugacccccaugcugcgccacuccaucgagaacagcuccgucaacgugagccucaccgccaucgccaaccaggccacggugcugauggggcugggcaagggguggccccucuccaagauggacaucggcgucccccugcuggcgaucgggugcuacagccaggugaacccgaucacccucaccgccgcccugcugcuccugguggcccacuacgccaucaucggccccggccugcaggcgaaggccacccgggaggcccagaagcgcgccgccgcggggaucaugaagaaccccacggucgacggcaucaccgugaucgaccucgagcccaucccguacgaccccaaguucgagaagcagcuggggcaggucaugcugcucauccugugcgucacccaggugcugaugaugcggaccacgugggcccucugcgaggcccugacccuggccaccggccccaucuccacccucugggaggggaaccccggccgcuucuggaacacgaccaucgccgugagcauggcgaacaucuuccgcggcuccuaccuggccggggccggccuccuguucagcaucaugaagaacaccaccaacacgcggcgcgggaccggcaacaucggcgagacccugggggagaaguggaagucccggcugaacgcccucggcaagagcgaguuccaggucuacaagaaguccgggauccaggagguggaccgcacccuggcgaaggagggcaucaagcgcggggagacggaccaccacgccgugagccgcggcuccgccaagcugcggugguucgucgagcgcaacauggugaccccggagggcaagguggucgaccucgggugcggccgcgggggcuggagcuacuacugcgggggccugaagaacgugcgcgaggugaagggccugaccaagggcggccccgggcacgaggagcccauccccauguccaccuacggcuggaaccucguccggcugcagagcgggguggacguguucuucacgccgcccgagaagugcgacacccugcucugcgacaucggcgagagcucccccaaccccaccaucgaggccggccgcacccugcggguccugaaccucguggagaacuggcugaacaacaacacccaguucugcaucaaggugcugaacccguacaugcccagcgucaucgagaagauggaggcccuccagcgcaaguacgggggcgcgcuggugcggaacccccugucccgcaacagcacgcacgagauguacuggguguccaacgccaccgggaacaucgucagcuccgugaacaugaucagccggaugcugaucaaccgcuucaccaugaagcacaagaaggccaccuacgagccggacguggaccucggcuccgggacgcggaacaucggcaucgagagcgagauccccaaccuggacaucaucggcaagcgcaucgagaagaucaagcaggagcacgagaccuccuggcacuacgaccaggaccaccccuacaagaccugggccuaccacgggagcuacgagaccaagcagacgggcuccgccagcuccauggucaacgggguggugcgccugcucaccaagcccugggacguccugccgauggugacccagauggcgaugaccgacacgacccccuucggccagcagcggguguucaaggagaaggucgacacccgcacccaggagcccaaggagggcacgaagaagcugaugaagaucaccgccgaguggcucuggaaggagcuggggaagaagaagacgccccggaugugcacccgcgaggaguucacgcggaaggugcgcagcaacgccgcccugggcgccaucuucaccgacgagaacaaguggaaguccgcgcgggaggccguggaggacgggcgcuucugggagcucgucgaccgggagcgcaaccugcaccuggagggcaagugcgagaccugcguguacaacaugauggggaagcgggagaagaagcucggcgaguucggcaaggccaaggggagccgcgccaucugguacauguggcugggcgcgcgguuccuggaguucgaggcccucggguuccugaacgaggaccacugguucucccgcggcaacagccugagcgggguggagggcgagggccuccaccggcugggguacauccugcgcgacgucggcaagaaggagggcggcgccauguacgccgacgacaccgccgggugggacacgcggaucacccucgaggaccugaagaacgaggagauggugaccaaccacaugaagggcgagcacaagaagcuggcggaggccaucuucaagcucaccuaccagaacaaggucgugcgcgugcagcggccgacgccccgcggcaccgucauggacaucaucucccggcgcgaccagcgcgggagcggccagguggggaccuacggccugaacaccuucacgaacauggaggcccagcugauccggcagauggagggcgaggggaucuucaaguccauccagcaccucaccgccaccgaggagaucgccgugcagaacuggcuggcgcgcgucggccgggagcgccugagccggauggccaucuccggggacgacugcguggugaagcccaucgacgaccgcuucgccagcgcccucaccgcccugaacgacaugggcaagguccggaaggacauccagcagugggagcccucccgcggguggaacgacuggacccaggucccguucugcagccaccacuuccacgagcuggugaugaaggacggccggguccucguggugcccugccgcaaccaggacgagcugaucggccgggcgcgcaucucccagggggccggcuggagccugaaggagaccgccugccucgggaaguccuacgcccagauguggacccugauguacuuccaccggcgcgaccugcggcucgccgcgaacgccaucugcagcgccgugccgccccacugggugccgaccucccgcaccacguggagcauccacgccaagcacgaguggaugaccaccgaggacaugcuggcgguguggaaccgggucuggauccaggagaaccccuggauggaggacaagacccccguggaguccugggaggaggugcccuaccugggcaagcgcgaggaccaguggugcgggagccucaucggccugacgucccgggccaccugggccaagaacauccagaccgccaucaaccagguccgcagccugaucggcaacgaggaguacaccgacuacaugccgagcaugaagcgcuuccggcgcgaggaggaggaggccggggugcucugguga

SEQ ID NO: 9030 - RNA, 9876 nt, Artificial Sequence
  derived and/or modified CDS sequence (opt1) from DENV-2__JX649147__SS-prME
accgccggcgugaucaucaugcugauccccaccgccauggcguuccaccucaccacccgcaacggggagccccacaugaucgugggccggcaggagaagggcaagagccugcuguucaagaccgaggacggcgugaacaugugcacccucauggccaucgaccugggggagcugugcgaggacaccaucaccuacaagugcccccuccugcgccagagcgagcccgaggacaucgacugcuggugcaacagcaccagcaccugggugaccuacgggaccugcaccaccacgggcgagcaccggcgcgagaagcggagcgucgcccuggugccccacguggggaugggccucgagacccgcaccgagaccuggauguccagcgagggggccuggaagcacgcccagcggaucgagaccuggauccugcgccaccccggcuucaccaucauggcggccauccuggccuacaccaucgggaccacgcacuuccagaaggcccucaucuucauccugcugaccgcggucgcccccuccaugaccaugcggugcaucggcaucagcaaccgcgacuucguggagggcguguccgggggcagcugggucgacaucgugcucgagcacggguccugcgugaccacgauggccaagaacaagcccacccuggacuucgagcugaucaagaccgaggccaaggagcccgccacccuccggaaguacugcaucgaggcgaagcugacgaacaccaccaccgagagccgcugcccgacgcagggcgagcccucccugaacgaggagcaggacaagcgguucgucugcaagcacagcaugguggaccgcggcugggggaacggcugcgggcuguucggcaagggcgggaucgugaccugcgccauguucacgugcaagaagaacauggagggcaagaucguccagcccgagaaccuggaguacaccaucgugaucacgccccacuccggggaggagcacgccgugggcaacgacaccgggaagcacggcaaggagaucaagaucaccccgcagagcuccaucaccgaggccgagcugaccggguacggcacggucaccauggagugcagcccccggaccggccucgacuucaacgagauggugcugcugcagauggaggacaaggccuggcucgugcaccgccagugguuccuggaccugccccuccccuggcugccgggggcggacacccagggcuccaacuggauccagaaggagacgcuggucaccuucaagaacccccacgccaagaagcaggacguggugguccucgggagccaggagggcgccaugcacaccgcccugaccggggccacggagauccagaugagcuccggcaaccuccuguucaccggccaccugaagugccggcugcgcauggacaagcuccagcugaaggggaugagcuacuccaugugcaccggcaaguucaagaucgugaaggagaucgcggagacccagcacgggacgaucgucauccgggugcaguacgagggcgacggcagccccugcaagauccccuucgagaucauggaccuggagaagcgccacgugcucgggcggcugaucaccgucaacccgaucgugaccgagaaggacucccccgugaacaucgaggccgagccgcccuucggcgacagcuacaucaucaucggggucgagccgggccagcugaagcucaacugguucaagaagggguccagcaucggccagauguucgagaccacgaugcgcggcgccaagcgcauggccauccugggggacaccgccugggacuucggcucccucggcgggguguucaccagcaucgggaaggcgcuccaccagguguucggggccaucuacggcgccgccuucuccggggucagcuggaccaugaagauccugaucggcgugaucaucacguggaucgggaugaacucccggagcaccucccugagcgugucccugguccucgugggcgugaucacccuguaccugggggcgaugguccaggccgacagcggcugcgugguguccuggaagaacaaggagcucaagugcggcagcgggaucuucaucaccgacaacguccacacguggaccgagcaguacaaguuccagcccgagagccccuccaagcuggccagcgccauccagaaggcccacgaggagggcaucugcgggauccgcuccgugacccggcuggagaaccucauguggaagcagaucacccccgagcugaaccacauccugagcgagaacgaggugaagcucacgaucaugaccggcgacaucaaggggaucaugcaggcgggcaagcgcucccugcggccgcagcccaccgagcugaaguacagcuggaagaccuggggcaaggccaagaugcucuccacggagagccacaaccagaccuuccugaucgacgggcccgagaccgccgagugcccgaacaagaaccgcgccuggaacucccuggaggucgaggacuacggcuucgggguguucaccacgaacaucuggcucaagcugcgggagaagcaggacguguucugcgacagcaagcugauguccgccgcgaucaaggacaaccgcgccguccacgccgacaugggcuacuggaucgagagcgcccucaacgacaccuggaagauggagaaggccuccuucaucgaggucaagagcugccacuggcccaagucccacacccuguggagcaacggcgugcuggaguccgagaugaucauccccaagagcuucgcggggcccgugagccagcacaacuaccggccgggcuacuacacccagaccgccgggcccuggcaccucggcaagcuggagauggacuucgacuucugcgaggggacgaccgugguggucaccgaggacugcggcaaccgcggccccucccugcggaccacgaccgccagcgggaagcucaucaccgaguggugcugccgcuccugcacccugcccccgcugcgguaccgcggcgaggacgggugcugguacggcauggagauccggccccucaaggagaaggaggagaaccuggugaacagccuggugacggccgggcacggccagaucgacaacuucucccucggcguccuggggauggcgcuguuccucgaggagaugcugcgcacccgggugggcaccaagcacgccauccugcucguggccgucagcuucgugacccugaucacggggaacauguccuuccgcgaccugggccgggugauggucauggugggggccaccaugaccgacgacaucggcaugggcgugaccuaccucgcccugcuggcggccuucaagguccgccccacguucgccgccgggcuccugcugaagaagcucaccagcaaggagcugaugauggccaccaucggcaucgcgcugcucucccagagcaccauccccgagacgauccuggagcugaccgacgcccucgcccuggggaugauggugcugaagaucgugcgcaacauggagaaguaccagcucgccgucaccaucauggccaucuccugcgugccgaacgcggugauccugcagaacgccuggaaggucagcugcaccauccuggccgccguguccgugagcccccuccugcugacguccagccagcagaaggcggacuggaucccccucgcccugaccaucaagggccugaaccccaccgccaucuuccucaccacgcugucccggaccagcaagaagcgcuccuggccgcugaacgaggccaucauggccgucggcauggugagcauccucgcgagcucccugcugaagaacgacauccccaugaccgggccccucgucgccggcgggcugcugaccgugugcuacgugcucacgggccggagcgccgaccuggagcuggagcgcgccaccgacgucaagugggaggaccaggccgagaucuccgggagcucccccauccucagcaucaccaucuccgaggacggcagcauguccaucaagaacgaggaggaggagcagacccugacgauccugauccggaccggccuccuggugaucagcgggcuguucccgauguccauccccaucaccgcggccgccugguaccucugggaggugaagaagcagcgcgccggcguccugugggacgugcccagcccgccgcccguggggaaggccgagcuggaggacggcgcguaccggaucaagcagaaggggauccucggcuacucccagaucggcgccggggucuacaaggagggcaccuuccacaccauguggcacgugacgcgcggggccgugcugaugcaccggggcaagcgcaucgagcccagcugggccgacgucaagaaggaccugaucuccuacgggggcggcuggaagcucgagggggaguggaaggagggcgaggagguccaggugcuggcccuggagcccgggaagaacccccgggcgguccagaccaagcccggccucuucaagaccaacaccgggacgaucggcgccgugagccuggacuucucccccggcaccagcgggucccccaucguggaccgcaagggcaaggucguggggcuguacggcaacggcguggucacccggagcggggccuacgugagcgccaucgcgcagaccgagaaguccaucgaggacaaccccgagaucgaggacgacaucuuccgcaagaagcggcucacgaucauggaccugcaccccggcgccgggaagaccaagcgcuaccugcccgccaucgugcgggaggccaucaagcgcggccugcggacccucauccuggccccgacccgcgucguggcggccgagauggaggaggcccugcgggggcuccccauccgcuaccagacgcccgccauccgcgccgagcacaccggccgggagaucguggaccugaugugccacgcgaccuucaccaugcgccugcucagccccguccgggugccgaacuacaaccugaucaucauggacgaggcccacuucacggaccccgccuccaucgccgcccgcggcuacaucagcacccggguggagaugggggaggcggccggcaucuucaugaccgccacgccgcccgggucccgcgacccguucccccagagcaacgcccccaucauggacgaggagcgggagauccccgagcgcuccuggaacagcggccacgagugggucacggacuucaaggggaagaccgugugguucgugccguccaucaaggcgggcaacgacaucgccgccugccugcggaagaacggcaagaaggucauccagcucagccgcaagaccuucgacuccgaguacgugaagacccggacgaacgacugggacuucguggucaccaccgacaucagcgagaugggggccaacuucaaggccgagcgcgugaucgacccccggcgcugcaugaagcccgugauccugaccgacggcgaggagcgggucauccuggcggggcccaugccggugacgcacuccagcgccgcccagcgccggggccgcaucgggcggaaccccaagaacgagaacgaccaguacaucuacaugggcgagccccucgagaacgacgaggacugcgcccacuggaaggaggccaagaugcugcuggacaacaucaacacccccgagggcaucaucccguccauguucgagcccgagcgcgagaagguggacgcgaucgacggggaguaccgccuccggggcgaggcccgcaagaccuucgucgaccugaugcggcgcggggaccugcccguguggcucgccuaccggguggccgccgagggcaucaacuacgcggaccgccgguggugcuucgacggggucaagaacaaccagauccuggaggagaacguggagguggagaucuggaccaaggagggcgagcgcaagaagcugaagccgcgguggcucgacgcccgcaucuacagcgacccccuggcccugaaggaguucaaggaguucgccgcgggccggaagucccucacgcugaaccugaucaccgagauggggcgccuccccaccuucaugacccagaaggcccgggacgcccuggacaaccuggccguccuccacacggccgaggcgggcgggcgcgccuacaaccacgcccugagcgagcugcccgagacccucgagacccugcugcuccugacccugcucgccacggugaccggcggcaucuuccuguuccugauguccgggaagggcguggggaagaugacccucggcaugugcugcaucaucaccgccagcauccugcugugguacgcgcagauccagccgcacuggaucgccgccagcaucauccucgaguucuuccugaucguccugcucauccccgagcccgagaagcagcggacgccccaggacaaccagcugacguacguggucaucgccauccugaccgugguggccgcgaccauggccaacgagaugggguuccucgagaagaccaagaaggaccugggccugggcuccaucgccacgcaggagccggagagcaacauccucgacaucgaccugcgccccgccuccgccuggacccuguacgcggucgccaccaccuucgugacgcccaugcuccggcacagcaucgagaacuccagcgugaacgucucccugaccgccaucgccaaccaggcgaccgugcugauggggcucggcaagggguggccccugagcaagauggacaucggcgugccgcugcucgccaucgggugcuacucccaggucaaccccaucacccugacggccgcccugcuccugcugaucgcccacuacgcgaucaucggccccggccuccaggccaaggccacccgcgaggcccagaagcgggccgcggccgggaucaugaagaaccccaccguggacggcaucaccgugaucgaccuggacccgauccccuacgaccccaaguucgagaagcagcuggggcaggucaugcuccugauccugugcgugacccaggugcucaugaugcgcaccaccugggcccugugcgaggcccugacccucgccacgggccccaucagcacccugugggaggggaacccgggccgguucuggaacaccaccaucgcggucuccauggccaacaucuuccgcggcagcuaccuggccggggccggccuccuguucuccaucaugaagaacacgaccaacacccgccgggggaccggcaacaucggcgagacgcugggggagaaguggaagucccgccucaacgcgcugggcaaguccgaguuccagaucuacaagaaguccgggauccaggagguggaccggacccuggccaaggagggcaucaagcgcggggagaccgaccaccacgccgugucccggggcagcgccaagcuccgcugguucgucgagcggaacauggugacccccgagggcaagguggucgaccuggggugcggccgcgggggcugguccuacuacugcgggggccugaagaacgugcgggaggugaagggccucacgaagggcggccccgggcacgaggagcccaucccgaugagcaccuacggcuggaaccugguccgccugcagagcgggguggacguguucuucacgccgcccgagaagugcgacacccuccugugcgacaucggcgaguccagccccaacccgacgaucgaggccggccggacccugcgcguccucucccugguggagaacuggcugaacaacgacacccaguucugcaucaaggugcucaaccccuacaugcccagcgucaucgagaagauggagacccugcagcggaaguacgggggcgcgcuggugcgcaacccgcugucccggaacagcacccacgagauguacuggguguccaacgccacggggaacaucgucagcuccgugaacaugaucagccgcaugcucaucaaccgguucaccaugaagcacaagaaggccaccuacgagcccgacguggaccugggcuccgggacccgcaacaucggcaucgagagcgagauccccaaccuggacaucaucggcaagcggaucgagaagaucaagcaggagcacgagacguccuggcacuacgaccaggaccaccccuacaagaccugggccuaccacgggagcuacgagaccaagcagaccggcuccgccagcuccauggucaacgggguggugcgccuccugacgaagccgugggacgucgugcccauggugacccagauggcgaugaccgacaccacgcccuucggccagcagcgcgucuucaaggagaagguggacacccggacccaggagcccaaggagggcaccaagaagcugaugaagaucacggccgaguggcucuggaaggagcuggggaagaagaagaccccgcgcaugugcacccgggaggaguucacccgcaaggugcggagcaacgccgcccugggcgccaucuucacggacgagaacaaguggaaguccgcgcgcgaggccgucgaggacagccgguucugggagcucguggacaaggagcgcaaccugcaccuggaggggaagugcgagaccugcguguacaacaugaugggcaagcgggagaagaagcucggggaguucggcaaggccaagggcagccgcgccaucugguacauguggcugggggcgcgguuccuggaguucgaggcccucggcuuccugaacgaggaccacugguucucccgcgagaacagccuguccggggucgagggcgaggggcuccacaagcugggcuacauccugcgggacgugagcaagaaggagggcggggccauguacgccgacgacaccgccggcugggacacccgcaucacgcucgaggaccugaagaacgaggagauggugaccaaccacauggagggggagcacaagaagcuggcggaggccaucuucaagcucaccuaccagaacaaggucgugcggguccagcgccccacgccccggggcacggugauggacaucaucucccgccgggaccagcgcgggagcggccaggugggcaccuacgggcugaacaccuucaccaacauggaggcccagcugauccggcagauggagggcgaggggaucuucaaguccauccagcaccucacggucaccgaggagaucgccgugcaggacuggcuggcccgcgugggccgcgagcggcugagccgcauggcgaucuccggcgacgacugcgucgugaagccccucgacgaccgguucgccagcgcccugaccgcccugaacgacauggggaaggugcgcaaggacauccagcagugggagccgucccggggcuggaacgacuggacccagguccccuucugcagccaccacuuccacgagcucaucaugaaggacgggcgcgugcuggugguccccugccggaaccaggacgagcugaucggccgcgcccggaucucccagggggcgggcuggagccucaaggagacggccugccugggcaaguccuacgcccagauguggagccugauguacuuccaccgccgggaccuccgccuggccgccaacgcgaucugcuccgccgugcccagccacugggugccgaccagccggaccaccugguccauccacgccaagcacgaguggaugaccacggaggacaugcugaccgucuggaaccgcguguggauccaggagaaccccuggauggaggacaagacccccguggagagcugggaggagguccccuaccucgggaagcgggaggaccaguggugcggcucccugaucgggcugaccagccgcgccacgugggcgaagaacauccagaccgccaucaaccaggugcggucccucaucggcaacgaggaguacaccgacuacaugccgagcaugaagcgcuuccggcgcgaggaggaggaggccggggugcugugguga

SEQ ID NO: 9031 - RNA, 9876 nt, Artificial Sequence
  derived and/or modified CDS sequence (opt1) from DENV-2__KF704356__SS-prME
accgccggcaugaucaucaugcugauccccaccgugauggccuuccaccucaccacccggaacggggagccccacaugaucgucagccggcaggagaagggcaagagccugcuguucaacaccggggacggcgugcacaugugcacccucauggcgaugcaccugggggagcugugcgaggacaccaucaccuacaagugcccccuccugcggcagaacgagcccgaggacaucgacugcuggugcaacagcaccuccaccugggugacguacgggaccugcaccaccacgggcgagcaccggcgcgagaagcggagcgucgcccuggugccccacguggggaugggccucgagacccgcaccgagaccuggauguccagcgagggggccuggaagcacgcccagcggaucgagacguggauccugcgccaccccggcuucaccaucauggccgcgauccuggccuacaccaucgggaccacgcacuuccagcgggcccucaucuucauccugcugaccgccgucgcgcccuccaugaccaugcgcugcaucggcaucagcaaccgggacuucguggagggcguguccgggggcagcugggucgacaucgugcucgagcacggguccugcgugaccacgauggccaagaacaagcccacccuggaccuggagcucaucaagaccgaggccaagcagcccgccacccugcgcaaguacugcaucgaggccaagcugacgaacaccaccaccgagagccggugcccgacgcagggcgagcccucccucaacgaggagcaggacaagcgcuucgucugcaagcacagcaugguggaccggggcugggggaacggcugcgggcuguucggcaagggguccaucgugaccugcgcgauguucacgugcaagaagaucaugaagggcaaggucgugcagcccgagaaccuggaguacaccaucgugaucacgccccacagcggcgaggagcacgccgucgggaacgacaccggcaagcacgggaaggagaucaagaucaccccgcaguccagcaucaccgaggccgagcucaccggcuacgggacggugaccauggagugcagcccccggaccggccuggacuucaacgagauggugcugcuccagauggaggacaaggccuggcugguccaccggcagugguuccuggaccucccccugcccuggcugccgggcgccgacacccaggggagcaacuggauccagaaggagacgcucgugaccuucaagaacccccacgcgaagaagcaggacguggucgugcugggcagccaggagggggccaugcacaccgcccugaccggcgccacggagauccagauguccagcgggaacguccucuucaccggccaccugaagugccgccugcggauggacaagcuccagcugaagggcauguccuacagcaugugcaccgggaaguucaagguggugaaggagaucgccgagacccagcacggcacgaucgucauccgcgugcaguacgagggggacggcucccccugcaagauccccuucgagaucauggaccuggagaagcggcacgugcucggccgccugaucaccgucaacccgaucgugaccgggaaggacagccccgugaacaucgaggcggagccgcccuucggcgacuccuacaucaucaucggggucgagccgggccagcugaagcucaacugguucaagaaggggagcuccaucggccagauguucgccaccacgaugcgcggcgccaagcggauggccauccugggggacaccgccugggacuucggcagccucgggggcguguucaccuccaucgggaaggcgcuccaccagguguucggcgccaucuacggcgccgccuucagcggggucuccuggaccaugaagauccugaucggcgugaucaucacguggaucgggaugaacagccgcuccaccagccuguccgugagccugguccucgugggcguggucacccuguaccugggggugauggugcaggcggacuccggcugcgucgugagcuggaagaacaaggagcucaagugcggcagcgggaucuucaucaccgacaacgugcacacguggaccgagcaguacaaguuccagcccgagucccccagcaagcuggccuccgccauccagaaggcccacgaggagggcaucugcgggauccggagcgucacccgccuggagaaccucauguggaagcagaucacccccgagcugaaccacauccuguccgagaacgaggugaagcucacgaucaugaccggcgacaucaaggggaucaugcaggccggcaagcggagccugcgcccgcagcccaccgagcugaaguacuccuggaagaccuggggcaaggcgaagaugcucagcacggagucccacaaccagaccuuccugaucgacgggcccgagaccgccgagugcccgaacaccaaccgggccuggaacagccuggagguggaggacuacggcuucggggucuucacgaccaacaucuggcucaagcugcgcgaggagcaggacguguucugcgacuccaagcugaugagcgccgccaucaaggacaaccgggcggugcacgccgacaugggcuacuggaucgaguccgcccucaacgacaccuggaagaucgagaaggccagcuucaucgaggucaaguccugccacuggcccaagagccacacccugugguccaacggcgugcuggagagcgagaugaucauccccaagaacuucgccgggcccgugagccagcacaacuaccgcccgggcuaccacacccagacggcggggcccuggcaccucggcaagcuggagauggacuucgacuucugcgaggggaccaccgucguggugaccgaggacugcggcaaccggggccccucccugcgcacgaccaccgccagcgggaagcucaucaccgaguggugcugccgguccugcacgcugcccccgcugcgcuaccggggcgaggacgggugcugguacggcauggagauccgcccccucaaggagaaggaggagaaccuggucaacagccuggugaccgccgggcacggccagaucgacaacuucucccucggcgugcuggggauggcccuguuccucgaggagaugcugcggacccgcgucggcaccaagcacgcgauccugcucguggccgugagcuucgucacgcugaucaccgggaacauguccuuccgggaccugggccgcgugauggugauggucggggccaccaugaccgacgacaucggcaugggcgugacguaccucgcccugcuggccgcguucaaggugcgccccaccuucgccgccgggcuccugcugcggaagcucaccagcaaggagcugaugaugaccacgaucggcaucguccugcucucccagagcaccauccccgagaccauccuggagcugaccgacgcccucgcccuggggaugauggugcugaagauggugcgcaagauggagaaguaccagcucgcggucacgaucauggccauccugugcgugccgaacgccgucauccugcagaacaccuggaagguguccugcaccauccucgccguggucagcgugagcccccuguuccugaccagcucccagcagaaggccgacuggaucccccucgcgcugacgaucaagggccugaaccccaccgccaucuuccucaccacccugagccggacgaacaagaagcgcuccuggccgcugaacgaggccaucauggccgugggcauggucagcauccucgcguccagccugcugaagaacgacauccccaugaccgggccccucguggccggcgggcugcugaccgugugcuacguccucaccggccggagcgccgaccuggagcuggagcgcgccgccgacgugaagugggaggaccaggcggagaucuccgggagcucccccauccucagcaucacgaucuccgaggacggcagcauguccaucaagaacgaggaggaggagcagacccugaccauccugauccggaccggccuccuggugaucagcgggcuguucccggucuccauccccaucaccgccgccgccugguaccucugggaggugaagaagcagcgcgccggcgugcugugggacguccccuccccgccgcccguggggaaggcggagcuggaggacggcgccuaccggaucaagcagaaggggauccucggcuacucccagaucggcgccgggguguacaaggagggcacguuccacaccauguggcacgucacccgcggggccgugcugaugcacaagggcaagcggaucgagcccagcugggccgacgugaagaaggaccugaucuccuacgggggcggcuggaagcucgagggggaguggaaggagggcgaggagguccaggugcuggcgcuggagcccgggaagaacccccgcgccgugcagaccaagcccggccucuucaagacgaacgccgggaccaucggcgccgucagccuggacuucucccccggcaccagcgggucccccaucaucgaccggaagggcaaggugguggggcuguacggcaacggcgucgugacccgcagcggggccuacguguccgcgaucgcccagacggagaaguccaucgaggacaaccccgagaucgaggacgacaucuuccggaagcgcaagcucaccaucauggaccugcaccccggcgccgggaagaccaagcgguaccugcccgccaucguccgcgaggcgaucaagcggggccugcgcacccucauccuggccccgacgcgggugguggccgccgagauggaggaggcccugcgcgggcuccccauccgcuaccagacccccgcgauccgggccgagcacaccggccgcgagaucgucgaccugaugugccacgccaccuucacgaugcggcugcucagccccgugcgcgugccgaacuacaaccugaucaucauggacgaggcccacuucaccgaccccgccuccaucgcggcccggggcuacaucagcacccgcgucgagaugggggaggccgccggcaucuucaugaccgccacgccgcccgggucccgggacccguucccccagagcaacgcgcccaucauggacgaggagcgcgagauccccgagcgguccuggagcuccggccacgagugggugaccgacuucaaggggaagaccgugugguucgucccgagcauccgcgccggcaacgacaucgccgccugccugcggaagaacggcaagaaggugauccagcucucccgcaagaccuucgacagcgaguacgugaagacgcggaccaacgacugggacuucgucgugaccaccgacaucuccgagaugggggcgaacuucaaggccgagcgcgugaucgacccccggcgcugcaugaagcccgucauccugacggacggcgaggagcgggugauccuggccgggcccaugccggugacccacagcuccgccgcccagcgccggggccgcaucgggcgcaaccccaagaacgagaacgaccaguacaucuacaugggcgagccccucgagaacgacgaggacugcgcgcacuggaaggaggccaagaugcugcuggacaacaucaacacccccgagggcaucaucccgagcauguucgagcccgagcgggagaaggucgacgccaucgacggggaguaccgccuccggggcgaggcccgcaagaccuucguggaccugaugcggcgcggggaccugcccguguggcucgccuaccgggucgcggccgagggcaucaacuacgccgaccgccgguggugcuucgacgggaucaagaacaaccagauccuggaggagaacguggaggucgagaucuggacgaaggagggcgagcgcaagaagcugaagccgcgguggcucgacgcccgcaucuacuccgacccccuggcccugaaggaguucaaggaguucgcggccggccgcaagagccucacccugaaccugaucaccgagauggggcgccuccccaccuucaugacgcagaaggcccgggacgcccuggacaaccuggcggugcuccacaccgccgaggccggcgggcgcgccuacaaccacgcccuguccgagcugcccgagacccucgagacccugcugcuccugacgcugcucgcgaccgugaccggcggcaucuuccuguuccugaugagcgggcggggcaucgggaagaugacccucggcaugugcugcaucaucaccgccuccauccugcugugguacgcccagauccagccgcacuggaucgccgccagcaucauccucgaguucuuccugaucguccugcucauccccgagcccgagaagcagcgcacgccccaggacaaccagcugaccuacguggugaucgcgauccugaccgucguggccgccaccauggccaacgagaugggguuccucgagaagacgaagaaggaccugggccugggcagcaucaccacccagcagccggaguccaacauccucgacaucgaccugcggcccgccagcgcguggacccuguacgccguggccacgaccuucgucacccccaugcuccgccacuccaucgagaacagcuccgugaacgugagccugaccgccaucgccaaccaggcgacgguccugauggggcucggcaagggguggccccuguccaagauggacaucggcgugccgcugcucgccaucgggugcuacagccaggugaaccccaucacccugaccgccgcccuguuccuccuggucgcgcacuacgccaucaucggccccggccugcaggccaaggccacccgggaggcccagaagcgcgcggccgccgggaucaugaagaaccccacgguggacggcaucaccgugaucgaccucgacccgauccccuacgaccccaaguucgagaagcagcuggggcaggucaugcugcucgugcugugcgugacccagguccugaugaugcgcaccacgugggcccucugcgaggcccugacccuggcgaccggccccaucuccacccucugggaggggaacccgggccgguucuggaacacgaccaucgccgugagcauggccaacaucuuccgcggcuccuaccuggccggggccggccugcuguucagcaucaugaagaacaccaccaacacgcggcgcgggaccggcaacaugggcgagacccugggggagaaguggaagucccggcugaacgcgcucggcaagagcgaguuccagaucuacaagaaguccgggauccaggagguggaccgcacccuggccaaggagggcaucaagcgcggggagacggaccaccacgccgucagccgcggcuccgccaagcugcggugguucguggagcgcaacauggugacccccgagggcaaggucguggaccucgggugcggccgcgggggcuggagcuacuacugcgggggccugaagaacgugcgcgaggucaagggccugaccaagggcggccccgggcacgaggagcccaucccgauguccaccuacggcuggaaccucgugcggcugcagagcgggguggacgucuucuucacgccgcccgagaagugcgacacccugcucugcgacaucggcgagagcucccccaacccgaccguggaggcgggccgcacccugcgggugcugaaccucgucgagaacuggcugaacaacaacacccaguucugcaucaaggugcugaaccccuacaugcccagcgugaucgagaagauggaggcccuccagcgcaaguacgggggcgcccugguccggaacccgcugucccgcaacagcacgcacgagauguacuggguguccaacgccagcgggaacaucguguccagcgucaacaugaucucccggaugcugaucaaccgcuucaccaugcgccacaagaaggccaccuucgagcccgacguggaccucggcagcgggacccggaacaucggcaucgaguccgagauccccaaccuggacaucaucggcaagcgcaucgagaagaucaagcaggaguacgagacgagcuggcacuacgaccaggaccaccccuacaagaccugggcguaccacggguccuacgagaccaagcagaccggcagcgccuccagcauggugaacggggucgugcggcugcucacgaagccgugggacgugguccccauggugacccagauggccaugaccgacaccacgcccuucggccagcagcgcguguucaaggagaaggucgacacccggacccaggagcccaaggagggcaccaagaagcugaugaagaucacggccgaguggcuguggaaggagcucgggaagaagaagaccccgcgcaugugcacccgggaggaguucacccgcaaggugcgguccaacgccgcgcugggcgccaucuucacggacgagaacaaguggaaguccgcccgcgaggccgucgaggacucccgguucugggagcugguggacaaggagcgcaaccuccaccuggaggggaagugcgagaccugcguguacaacaugaugggcaagcgggagaagaagcugggggaguucggcaaggccaagggcagccgcgcgaucugguacauguggcucggggcccgguuccuggaguucgaggcccugggcuuccucaacgaggaccacugguucagccgcgagaacucccugagcggggucgagggcgaggggcugcacaagcucggcuacauccugcgggacguguccaagaaggagggcggggccauguacgcggacgacaccgccggcugggacacccgcaucacgcuggaggaccucaagaacgaggagauggugaccaaccacauggagggggagcacaagaagcuggccgaggccaucuucaagcugaccuaccagaacaaggucgugcgggugcagcgccccacgccccggggcacggucauggacaucaucagccgccgcgaccagcggggguccggccaggugggcaccuacgggcucaacaccuucaccaacauggaggcccagcugauccgccagauggagggcgaggggguguucaagaacauccagcaccugacggucaccgaggagaucgcggugcagaacuggcucgcccgggugggccgcgagcggcugagccgcauggccaucuccggcgacgacugcgucgugaagccccuggacgaccgguucgccagcgcccucaccgcgcugaacgacauggggaaggugcgcaaggacauccagcagugggagccgucccggggcuggaacgacuggacccagguccccuucugcagccaccacuuccacgagcugaucaugaaggacgggcgcgugcucgugguccccugccggaaccaggacgagcugaucggccgcgcccggaucucccagggggccggcuggagccugcgcgagacggccugccucggcaaguccuacgcccagauguggagccugauguacuuccaccggcgcgaccugcggcucgcggccaacgccaucugcuccgccgugcccagccacugggugccgaccucccgcaccaccuggagcauccacgccaagcacgaguggaugaccacggaggacaugcugaccgucuggaaccggguguggauccaggagaaccccuggauggaggacaagacccccguggagagcugggaggagauccccuaccuggggaagcgcgaggaccaguggugcggcucccucaucgggcugaccagccgcgcgacgugggccaagaacauccagaccgccaucaaccagguccggucccugaucggcaacgaggaguacaccgacuacaugccgagcaugaagcgcuuccggcgcgaggaggaggaggccggggugcucugguga

SEQ ID NO: 9032 - RNA, 9876 nt, Artificial Sequence
  derived and/or modified CDS sequence (opt1) from DENV-2__KF704355__SS-prME
accgccgggaugaucaucaugcugauccccaccgugauggccuuccaccucaccacccggaacggggagccccacaugaucgucagccggcaggagaagggcaagagccugcuguucaagaccggggacggcgugaacaugugcacccucauggcgauggaccugggggagcugugcgaggacacgaucaccuacaagugccccuuccuccggcagaacgagcccgaggacaucgacugcuggugcaacagcaccuccaccugggugacguacgggaccugcaccaccacgggcgagcaccggcgcgagaagcggagcgucgcccuggugccccacguggggaugggccuggagacccgcaccgagaccuggauguccagcgagggggccuggaagcacgcccagcggaucgagacguggauccuccgccacccgggcuucaccaucauggccgcgauccuggccuacaccaucgggaccacgcacuuccagcgggcccugaucuucauccuccugaccgccgucgcgcccuccaugaccaugcgcugcaucggcaucagcaaccgggacuucguggagggcguguccgggggcagcugggucgacaucgugcuggagcacggguccugcgugaccacgauggccaagaacaagcccacccucgaccuggagcugaucaagaccgaggccaagcagcccgccacccuccgcaaguacugcaucgaggccaagcugacgaacaccaccaccgagagccggugcccgacgcagggcgagcccucccugaacgaggagcaggacaagcgcuucgucugcaagcacagcaugguggaccggggcugggggaacggcugcggccucuucggcaagggguccaucgugaccugcgcgauguucacgugcaagaagaucaugaagggcaaggucgugcagcccgagaaccuggaguacaccaucgugaucacgccccacagcggcgaggagcacgccgucgggaacgacaccggcaaguacgggaaggagaucaagaucaccccgcaguccagcaucaccgaggccgagcugaccggcuacgggacggugaccauggagugcagcccccggaccggccucgacuucaacgagauggugcugcugcagauggaggacaaggccuggcucguccaccggcagugguuccuggaccugccccuccccuggcugccgggcgccgacacccaggggagcaacuggauccagaaggagacgcuggugaccuucaagaacccccacgcgaagaagcaggacguggucgugcucggcagccaggagggggccaugcacaccgcccugaccggcgccacggagauccagauguccagcgggaacguccuguucaccggccaccucaagugccgccugcggauggacaagcugcagcucaagggcauguccuacagcaugugcaccgggaaguucaagguggugaaggagaucgccgagacccagcacggcacgaucgucauccgcgugcaguacgagggggacggcucccccugcaagauccccuucgagaucauggaccuggagaagcggcacgugcugggccgccucaucaccgucaacccgaucgugaccgggaaggacagccccgugaacaucgaggcggagccgcccuucggcgacuccuacaucaucaucggggucgagccgggccagcugaagcugaacugguucaagaaggggagcuccaucggccagauguucggcaccacgaugcgcggggccaagcggauggccauccucggcgacaccgccugggacuucgggagccugggcgggguguucaccuccaucggcaaggcccugcaccagguguucggcgcgaucuacggggccgccuucagcggcgucuccuggaccaugaagauccucacgggggugaucaucaccuggaucggcaugaacagccgcuccaccagccuguccgugagccugguccugguggggguggucacccucuaccugggcgugauggugcaggccgacuccggcugcgucgugagcuggaagaacaaggagcugaagugcgggagcggcaucuucaucacggacaacgugcacaccuggaccgagcaguacaaguuccagcccgagucccccagcaagcucgcguccgccauccagaaggcccacgaggaggggaucugcggcauccggagcgucacccgccuggagaaccugauguggaagcagaucacgcccgagcucaaccacauccuguccgagaacgaggugaagcugaccaucaugaccggggacaucaagggcaucaugcaggccggcaagcggagccuccgcccgcagcccaccgagcugaaguacuccuggaagacgugggggaaggccaagaugcugagcaccgagucccacaaccagaccuuccucaucgacggccccgagaccgcggagugcccgaacacgaaccgggccuggaacagccuggagguggaggacuacggguucggcgucuucaccaccaacaucuggcugaagcuccgcgagaagcaggacguguucugcgacuccaagcugaugagcgccgccaucaaggacaaccgggccgugcacgcggacaugggcuacuggaucgaguccgcccugaacgacaccuggaagaucgagaaggccagcuucaucgaggucaaguccugccacuggcccaagagccacacccucugguccaacggggugcuggagagcgagaugaucauccccaagaacuucgccggccccgugagccagcacaacuaccgcccgggguaccacacgcagaccgccggccccuggcaccuggggaagcucgagauggacuucgacuucugcgagggcaccaccgucguggugacggaggacugcggcaaccgggggcccucccugcgcaccaccaccgcgagcggcaagcugaucacggaguggugcugccgguccugcacccucccgccccugcgcuaccgcggggaggacggcugcugguacgggauggagauccgcccccugaaggagaaggaggagaaccucgucaacagccuggugaccgccggccacggccagaucgacaacuucucccugggggugcucggcauggcccuguuccuggaggagaugcuccggacccgcgucgggacgaagcacgccauccugcugguggcggugagcuucgucacccucaucaccggcaacauguccuuccgggaccuggggcgcgugauggugauggucggcgccaccaugacggacgacaucggcaugggggugaccuaccuggcccuccuggccgccuucaaggugcgccccaccuucgcggccggccugcuccugcggaagcugaccagcaaggagcucaugaugacgaccaucgggaucguccugcugucccagagcaccauccccgagaccauccucgagcugacggacgcccuggcccucggcaugauggugcugaagauggugcgcaagauggagaaguaccagcuggccgucaccaucauggcgauccucugcgugcccaacgccgucauccugcagaacgccuggaagguguccugcaccauccuggccguggucagcgugagcccccucuuccugaccagcucccagcagaaggccgacuggaucccccuggcgcucacgaucaagggccugaaccccaccgccaucuuccugaccacccucagccggacgaacaagaagcgcuccuggccgcugaacgaggccaucauggccguggggauggucagcauccuggcguccagccuccugaagaacgacauccccaugaccggcccccugguggccgggggccuccugaccgugugcuacguccugaccgggcggagcgccgaccucgagcuggagcgcgccgccgacgugaagugggaggaccaggcggagaucuccggcagcucccccauccugagcaucacgaucuccgaggacggcagcauguccaucaagaacgaggaggaggagcagacccucaccauccugauccggaccgggcugcucgugaucagcggccuguucccggucuccauccccaucaccgccgccgccugguaccugugggaggugaagaagcagcgcgccggggugcucugggacguccccuccccgccgcccgugggcaaggcggagcuggaggacggggccuaccggaucaagcagaagggcauccugggcuacucccagaucggggccggcguguacaaggaggggacguuccacaccauguggcacgucacccgcggcgccgugcucaugcacaaggggaagcggaucgagcccagcugggccgacgugaagaaggaccugaucuccuacggcggcggguggaagcuggagggcgaguggaaggagggggaggagguccaggugcucgcgcuggagcccggcaagaacccccgcgccgugcagaccaagcccgggcuguucaagacgaacgccggcaccaucggcgccgucagccucgacuucucccccgggaccagcggcucccccaucaucgaccggaaggggaagguggugggccuguacggcaacggggucgugacccgcagcggcgccuacguguccgcgaucgcccagacggagaaguccaucgaggacaaccccgagaucgaggacgacaucuuccggaagcgcaagcugaccaucauggaccuccaccccggggccggcaagaccaagcgguaccugcccgccaucguccgcgaggcgaucaagcgggggcugcgcacccugauccucgccccgacgcgggugguggccgccgagauggaggaggcccugcgcggccugcccauccgcuaccagacccccgcgauccgggccgagcacaccggccgcgagaucgucgaccucaugugccacgccaccuucacgaugcggcugcugagccccgugcgcgugccgaacuacaaccucaucaucauggacgaggcccacuucaccgaccccgccuccaucgcggcccggggguacaucagcacccgcgucgagaugggcgaggccgccgggaucuucaugaccgccacgccgcccggcucccgggacccguucccccagagcaacgcgcccaucauggacgaggagcgcgagauccccgagcgguccuggagcuccgggcacgagugggugaccgacuucaagggcaagaccgugugguucgucccgagcauccgcgccggcaacgacaucgccgccugccugcggaagaacgggaagaaggugauccagcugucccgcaagaccuucgacagcgaguacgugaagacgcggaccaacgacugggacuucgucgugaccaccgacaucuccgagaugggcgcgaacuucaaggccgagcgcgugaucgacccccggcgcugcaugaagcccgucauccucacggacggggaggagcgggugauccuggccggccccaugccggugacccacagcuccgccgcccagcgccgggggcgcaucggccgcaaccccaagaacgagaacgaccaguacaucuacaugggcgagccccuggagaacgacgaggacugcgcgcacuggaaggaggccaagaugcuccuggacaacaucaacacccccgaggggaucaucccgagcauguucgagcccgagcgggagaaggucgacgccaucgacggcgaguaccgccugcgcggggaggcccgcaagaccuucguggaccucaugcggcgcggcgaccugcccguguggcuggccuaccgggucgcggccgaggggaucaacuacgccgaccgccgguggugcuucgacggcaucaagaacaaccagauccucgaggagaacguggaggucgagaucuggacgaaggagggcgagcgcaagaagcugaagccgcgguggcuggacgcccgcaucuacuccgacccccucgcccugaaggaguucaaggaguucgcggccgggcgcaagagccugacccucaaccugaucaccgagaugggccgccugcccaccuucaugacgcagaaggcccgggacgcccucgacaaccuggcggugcugcacaccgccgaggccgggggccgcgccuacaaccacgcccucuccgagcugcccgagacccuggagacccuccugcugcucacgcugcuggcgaccgugaccggcgggaucuuccucuuccugaugagcggccgggggaucggcaagaugacccuggggaugugcugcaucaucaccgccuccauccuccugugguacgcccagauccagccgcacuggaucgccgccagcaucauccuggaguucuuccucaucguccugcugauccccgagcccgagaagcagcgcacgccccaggacaaccagcucaccuacguggugaucgcgauccugaccgucguggccgccaccauggccaacgagaugggcuuccuggagaagacgaagaaggaccucggccuggggagcaucaccacccagcagccggaguccaacauccuggacaucgaccuccggcccgccagcgcguggacccuguacgccguggccacgaccuucgucacccccaugcugcgccacuccaucgagaacagcuccgugaacgugagccucaccgccaucgccaaccaggcgacgguccugaugggccuggggaagggcuggccccucuccaagauggacaucggggugccgcugcuggccaucggcugcuacagccaggugaaccccaucacccucaccgccgcccuguuccugcucgucgcgcacuacgccaucaucggccccgggcugcaggccaaggccacccgggaggcccagaagcgcgcggccgccggcaucaugaagaaccccacgguggacgggaucaccgugaucgaccuggacccgauccccuacgaccccaaguucgagaagcagcucggccaggucaugcugcuggugcucugcgugacccagguccugaugaugcgcaccacgugggcccugugcgaggcccucacccuggcgaccgggcccaucuccacccugugggagggcaacccgggccgguucuggaacacgaccaucgccgugagcauggccaacaucuuccgcggguccuaccucgccggcgccgggcugcuguucagcaucaugaagaacaccaccaacacgcggcgcggcaccggcaacaucggggagacccucggcgagaaguggaagucccggcugaacgcgcugggcaagagcgaguuccagaucuacaagaaguccggcauccaggagguggaccgcacccucgccaaggaggggaucaagcggggcgagacggaccaccacgccgucagccgcggcuccgccaagcugcggugguucguggagcgcaacauggugacccccgaggggaaggucguggaccugggcugcgggcggggcggguggagcuacuacugcggcggccucaagaacgugcgcgaggucaaggggcugaccaagggcgggcccggccacgaggagcccaucccgauguccaccuacggguggaaccuggugcggcuccagagcggcguggacgucuucuucacgccgcccgagaagugcgacacccugcugugcgacaucggcgagagcucccccaacccgaccguggaggcggggcgcacccuccgggugcugaaccuggucgagaacuggcucaacaacaacacccaguucugcaucaaggugcugaaccccuacaugcccagcgugaucgagaagauggaggcccugcagcgcaaguacggcggggcccucguccggaacccgcugucccgcaacagcacgcacgagauguacuggguguccaacgccagcggcaacaucguguccagcgucaacaugaucucccggaugcugaucaaccgcuucaccaugcgccacaagaaggccaccuacgagcccgacguggaccuggggagcggcacccggaacaucggcaucgaguccgagauccccaaccucgacaucaucgggaagcgcaucgagaagaucaagcaggaguacgagacgagcuggcacuacgaccaggaccaccccuacaagaccugggcguaccacggcuccuacgagaccaagcagaccgggagcgccuccagcauggugaacggcgucgugcggcugcugacgaagccgugggacgugguccccauggugacccagauggccaugaccgacaccacgcccuucggccagcagcgcguguucaaggagaaggucgacacccggacccaggagcccaaggaggggaccaagaagcucaugaagaucacggccgaguggcuguggaaggagcugggcaagaagaagaccccgcgcaugugcacccgggaggaguucacccgcaaggugcgguccaacgccgcgcucggggccaucuucacggacgagaacaaguggaaguccgcccgcgaggccgucgaggacucccgguucugggagcugguggacaaggagcgcaaccugcaccucgagggcaagugcgagaccugcguguacaacaugauggggaagcgggagaagaagcugggcgaguucggcaaggccaaggggagccgcgcgaucugguacauguggcugggcgcccgguuccucgaguucgaggcccugggguuccugaacgaggaccacugguucagccgcgagaacucccucagcggcgucgagggggagggccugcacaagcugggcuacauccuccgggacguguccaagaaggagggcggggccauguacgcggacgacaccgccgggugggacacccgcaucacgcuggaggaccugaagaacgaggagauggugaccaaccacauggagggcgagcacaagaagcucgccgaggccaucuucaagcugaccuaccagaacaaggucgugcgggugcagcgccccacgccccgggggaccgucauggacaucaucagccgccgcgaccagcggggcuccggccagguggggaccuacggccugaacaccuucaccaacauggaggcccagcucauccgccagauggagggggagggcguguucaagaacauccagcaccugacggucaccgaggagaucgcggugcagaacuggcuggcccgggugggccgcgagcggcucagccgcauggccaucuccggggacgacugcgucgugaagccccuggacgaccgguucgccagcgcccugaccgcgcucaacgacaugggcaaggugcgcaaggacauccagcagugggagccgucccggggguggaacgacuggacccagguccccuucugcagccaccacuuccacgagcugaucaugaaggacggccgcgugcuggugguccccugccggaaccaggacgagcucaucgggcgcgcccggaucucccagggcgccggcuggagccugcgcgagacggccugccuggggaaguccuacgcccagauguggagccucauguacuuccaccggcgcgaccugcggcuggcggccaacgccaucugcuccgccgugcccagccacugggugccgaccucccgcaccaccuggagcauccacgccaagcacgaguggaugaccacggaggacaugcucaccgucuggaaccggguguggauccaggagaaccccuggauggaggacaagacccccguggagagcugggaggagauccccuaccugggcaagcgcgaggaccaguggugcgggucccugaucggccucaccagccgcgcgacgugggccaagaacauccagaccgccaucaaccagguccggucccugaucgggaacgaggaguacaccgacuacaugccgagcaugaagcgcuuccggcgcgaggaggaggaggccggcgugcugugguga

SEQ ID NO: 9033 - RNA, 9876 nt, Artificial Sequence
  derived and/or modified CDS sequence (opt1) from DENV-2__KF704354__SS-prME
accgccgggaugaucaucaugcugauccccaccgugauggccuuccaccucaccacccgcaacggggagccccacaugaucgucagccggcaggagaagggcaagagccugcuguucaagaccgaggacggggugaacaugugcacccucauggcgauggaccugggcgagcugugcgaggacaccaucaccuacaagugccccuuccuccgccagaacgagcccgaggacaucgacugcuggugcaacagcaccuccaccugggugacguacgggaccugcaccaccacgggcgagcaccggcgcgagaagcggagcgucgcccuggugccccacgugggcauggggcuggagacccgcaccgagaccuggauguccagcgagggcgccuggaagcacgcccagcggaucgagacguggauccuccgccaccccggguucaccaucauggccgcgauccuggccuacaccaucggcaccacgcacuuccagcgggcccugaucuucauccuccugaccgccgucgcgcccuccaugaccaugcgcugcaucgggaucagcaaccgggacuucguggagggcguguccggcgggagcugggucgacaucgugcuggagcacggcuccugcgugaccacgauggccaagaacaagcccacccucgacuucgagcugaucaagaccgaggccaagcagcccgccacccugcgcaaguacugcaucgaggccaagcucacgaacaccaccaccgagagccggugcccgacgcagggggagcccucccugaacgaggagcaggacaagcgcuucgucugcaagcacagcaugguggaccggggcuggggcaacgggugcggccuguucgggaagggcgggaucgugaccugcgcgauguucacgugcaagaagaucaugaagggcaaggucgugcagcccgagaaccucgaguacaccaucgugaucacgccccacuccggcgaggagcacgccgucgggaacgacaccggcaagcacgggaaggagaucaagaucaccccgcagagcuccaucaccgaggccgagcugaccggcuacgggacggugaccauggagugcagcccccgcaccggccuggacuucaacgagauggugcuccugcagauggagaacaaggccuggcugguccaccggcagugguuccucgaccugccccugcccuggcucccgggcgccgacacccagggguccaacuggauccagaaggagacgcuggugaccuucaagaacccccacgcgaagaagcaggacguggucgugcugggcagccaggagggggccaugcacaccgcccucaccggcgccacggagauccagaugagcuccgggaacguccuguucaccggccaccugaagugccgccuccggauggacaagcugcagcugaagggcaugagcuacuccaugugcaccgggaaguucaagguggugaaggagaucgccgagacccagcacggcacgaucgucauccgcgugcaguacgagggggacggcagccccugcaagauccccuucgagaucauggaccucgagaagcggcacgugcugggccgccugaucaccgucaacccgaucgugaccgggaaggacucccccgugaacaucgaggcggagccgcccuucggcgacagcuacaucaucaucggggucgagccgggccagcucaagcugaacugguucaagaagggguccagcaucggccagauguucgccaccacgaugcgcggcgccaagcggauggccauccugggggacaccgccugggacuucggcucccucgggggcguguucaccagcaucgggaaggcgcugcaccagguguucggcgccaucuacggcgccgccuucuccggggucagcuggaccaugaagauccugaucggcgugaucaucacguggaucgggaugaacucccgcagcaccucccucagcgugucccugguccuggugggcguggucacccuguaccucggggugauggugcaggcggacagcggcugcgucguguccuggaagaacaaggagcugaagugcggcagcgggaucuucaucaccgacaacgugcacacguggaccgagcaguacaaguuccagcccgagagccccuccaagcuggccagcgccauccagaaggcccacgaggagggcaucugcgggauccgguccgucacccgccucgagaaccugauguggaagcagaucacccccgagcugaaccacauccucagcgagaacgaggugaagcugacgaucaugaccggcgacaucaaggggaucaugcaggccggcaagcggucccugcgcccgcagcccaccgagcucaaguacagcuggaagaccuggggcaaggcgaagaugcuguccacggagagccacaaccagaccuuccugaucgacgggcccgagaccgccgagugcccgaacaccaaccgggccuggaacucccucgagguggaggacuacggcuucggggucuucacgaccaacaucuggcugaagcugcgcgaggagcaggacguguucugcgacagcaagcucauguccgccgccaucaaggacaaccgggcggugcacgccgacaugggcuacuggaucgagagcgcccugaacgacaccuggaagaucgagaaggccuccuucaucgaggucaagagcugccacuggcccaagucccacacccuguggagcaacggcgugcucgaguccgagaugaucauccccaagaacuucgccgggcccgugagccagcacaacuaccgcccgggcuaccacacccagacggcggggcccuggcaccugggcaagcuggagauggacuucgacuucugcgaggggaccaccgucguggugaccgaggacugcggcaaccggggccccagccuccgcacgaccaccgccuccgggaagcugaucaccgaguggugcugccggagcugcacgcugcccccgcuccgcuaccggggcgaggacgggugcugguacggcauggagauccgcccccugaaggagaaggaggagaaccuggucaacucccucgugaccgccgggcacggccagaucgacaacuucagccugggcgugcuggggauggcccucuuccuggaggagaugcugcggacccgcgucggcaccaagcacgcgauccuccugguggccguguccuucgucacgcugaucaccgggaacaugagcuuccgggaccucggccgcgugauggugauggucggggccaccaugaccgacgacaucggcaugggcgugacguaccuggcccugcucgccgcguucaaggugcgccccaccuucgccgccgggcugcugcuccggaagcugaccuccaaggagcugaugaugaccacgaucggcaucguccuccugagccaguccaccauccccgagaccauccuggagcucaccgacgcccuggcccuggggaugauggugcucaagauggugcgcaagauggagaaguaccagcuggcggucacgaucauggccauccugugcgugccgaacgccgucauccuccagaacaccuggaaggugagcugcaccauccuggccguggucuccgugagcccccuguuccucaccuccagccagcagaaggccgacuggaucccccuggcgcugacgaucaagggccucaaccccaccgccaucuuccugaccacccugucccggacgaacaagaagcgcagcuggccgcucaacgaggccaucauggccgugggcauggucuccauccuggcgagcucccugcucaagaacgacauccccaugaccgggccccugguggccggcgggcugcucaccgugugcuacguccugaccggccggagcgccgaccuggagcucgagcgcgccgccgacgugaagugggaggaccaggcggagaucagcggguccagccccauccuguccaucacgaucagcgaggacggcuccaugagcaucaagaacgaggaggaggagcagacccugaccauccucauccggaccggccugcuggugaucuccggccuguucccggucagcauccccaucaccgccgccgccugguaccugugggaggugaagaagcagcgcgccggcgugcugugggacguccccagcccgccgcccguggggaaggcggagcucgaggacggcgccuaccggaucaagcagaaggggauccugggcuacagccagaucggcgccgggguguacaaggagggcacguuccacaccauguggcacgucacccgcggggccgugcugaugcacaagggcaagcggaucgagcccuccugggccgacgugaagaaggaccucaucagcuacgggggcggcuggcgccuggagggggaguggaaggagggcgaggagguccaggugcuggcgcucgagcccgggaagaacccccgggccgugcagaccaagcccggccuguucaagacgaacgccgggaccaucggcgccgucucccuggacuucagccccggcaccuccgggagccccaucaucgacaagaagggcaaggugguggggcucuacggcaacggcgucgugacccgcuccggggccuacgugagcgcgaucgcccagacggagaaguccaucgaggacaaccccgagaucgaggacgacaucuuccggaagcgcaagcugaccaucauggaccugcaccccggcgccgggaagaccaagcgguaccuccccgccaucguccgcgaggcgaucaagcggggccugcgcacccugauccuggccccgacgcgggugguggccgccgagauggaggaggcccuccgcgggcugcccauccgcuaccagacccccgcgauccgggccgagcacaccggccgcgagaucgucgaccugaugugccacgccaccuucacgaugcggcuccugagccccgugcgcgugccgaacuacaaccugaucaucauggacgaggcccacuucaccgaccccgccagcaucgcggcccggggcuacaucuccacccgcgucgagaugggggaggccgccggcaucuucaugaccgccacgccgcccgggagccgggacccguucccccaguccaacgcgcccaucauggacgaggagcgcgagauccccgagcggagcugguccagcggccacgagugggugaccgacuucaaggggaagaccgugugguucgucccguccaucaaggccggcaacgacaucgccgccugccuccgcaagaacggcaagaaggugauccagcugagccggaagaccuucgacuccgaguacgugaagacgcgcaccaacgacugggacuucgucgugaccaccgacaucagcgagaugggggcgaacuucaaggccgagcgggugaucgacccccgccggugcaugaagcccgucauccugacggacggcgaggagcgcgugauccucgccgggcccaugccggugacccacuccagcgccgcccagcggcgcggccggaucgggcgcaaccccaagaacgagaacgaccaguacaucuacaugggcgagccccuggagaacgacgaggacugcgcgcacuggaaggaggccaagaugcugcucgacaacaucaacacccccgagggcaucaucccguccauguucgagcccgagcgcgagaaggucgacgccaucgacggggaguaccggcugcgcggcgaggcccggaagaccuucguggaccugaugcgccgcggggaccuccccguguggcuggccuaccgcgucgcggccgagggcaucaacuacgccgaccggcgcuggugcuucgacgggaucaagaacaaccagauccuggaggagaacguggaggucgagaucuggacgaaggagggcgagcggaagaagcucaagccgcgcuggcuggacgcccggaucuacagcgacccccuggcccucaaggaguucaaggaguucgcggccggccgcaagucccugacccugaaccucaucaccgagauggggcggcugcccaccuucaugacgcagaaggcccgcgacgcccuggacaaccucgcggugcugcacaccgccgaggccggcgggcgggccuacaaccacgcccugagcgagcuccccgagacccuggagacccugcuccugcugacgcuccuggcgaccgugaccggcggcaucuuccuguuccucauguccgggcgcggcaucgggaagaugacccugggcaugugcugcaucaucaccgccagcauccugcucugguacgcccagauccagccgcacuggaucgccgccuccaucauccuggaguucuuccugaucguccuccugauccccgagcccgagaagcagcggacgccccaggacaaccagcugaccuacguggugaucgcgauccucaccgucguggccgccaccauggccaacgagaugggguuccuggagaagacgaagaaggaccugggcuggggcagcaucaccacccagcagccggagagcaacauccucgacaucgaccugcgccccgccuccgcguggacccuguacgccguggccacgaccuucgucacccccaugcuccggcacagcaucgagaacuccagcgugaacgugucccugaccgccaucgccaaccaggcgacgguccugauggggcucggcaagggguggccccugagcaagauggacaucggcgugccgcugcucgccaucgggugcuacucccaggugaaccccaucacccugaccgccgcccuguuccuccuggucgcgcacuacgccaucaucggccccggccugcaggccaaggccacccgcgaggcccagaagcgggcggccgccgggaucaugaagaaccccacgguggacggcaucaccgugaucgaccucgacccgauccccuacgaccccaaguucgagaagcagcuggggcaggucaugcugcucgugcugugcgugacccagguccugaugaugcgcaccacgugggcccucugcgaggcccugacccuggcgaccggccccaucagcacccucugggaggggaacccgggccgcuucuggaacacgaccaucgccguguccauggccaacaucuuccggggcagcuaccuggccggggccggccuccucuucuccaucaugaagaacaccaccaacacgcgccgggggaccggcaacaugggcgagacccugggggagaaguggaagucccgccugaacgcgcucggcaaguccgaguuccagaucuacaagaaguccgggauccaggagguggaccggacccuggccaaggagggcaucaagcgcggggagacggaccaccacgccgucucccggggcagcgccaagcugcgcugguucguggagcggaacauggugacccccgagggcaaggucguggaccucgggugcggccgcgggggcugguccuacuacugcgggggccugaagaacgugcgggaggucaagggccugaccaagggcgggcccgggcacgaggagcccaucccgaugagcaccuacggcuggaaccucgugcgccugcaguccgggguggacgucuucuucacgccgcccgagaagugcgacacccugcucugcgacaucggcgagagcagccccaacccgaccguggaggcgggccggacccugcgcgugcugaaccucgucgagaacuggcugaacaacaacacccaguucugcaucaaggugcugaaccccuacaugcccuccgugaucgagaagauggaggcccuccagcggaaguacgggggcgcccugguccgcaacccgcugagccggaacuccacgcacgagauguacugggugagcaacgccuccgggaacaucgugagcuccgucaacaugaucagccgcaugcucaucaaccgguucaccaugcgccacaagaaggccaccuucgagcccgacguggaccugggcuccgggacccgcaacaucggcaucgagagcgagauccccaaccuggacaucaucggcaagcggaucgagaagaucaagcaggaguacgagacguccuggcacuacgaccaggaccaccccuacaagaccugggcguaccacgggagcuacgagaccaagcagaccggcuccgccagcuccauggugaacggggucgugcgccugcucacgaagccgugggacgugguccccauggugacccagauggccaugaccgacaccacgcccuucggccagcagcggguguucaaggagaaggucgacacccgcacccaggagcccaaggagggcaccaagaagcugaugaagaucacggccgaguggcuguggaaggagcucgggaagaagaagaccccgcggaugugcacccgcgaggaguucacccggaaggugcgcagcaacgccgcgcugggcgccaucuucacggacgagaacaaguggaaguccgcccgggaggccgucgaggacagccgcuucugggagcugguggacaaggagcggaaccuccaccuggaggggaagugcgagaccugcguguacaacaugaugggcaagcgcgagaagaagcugggggaguucggcaaggccaagggcucccgggcgaucugguacauguggcucggggcccgcuuccuggaguucgaggcccugggcuuccucaacgaggaccacugguucagccgggagaacagccuguccggggucgagggcgaggggcugcacaagcucggcuacauccugcgcgacgugagcaagaaggagggcggggccauguacgcggacgacaccgccggcugggacacccggaucacgcuggaggaccucaagaacgaggagauggugaccaaccacauggagggggagcacaagaagcuggccgaggccaucuucaagcugaccuaccagaacaaggucgugcgcgugcagcggcccacgccccggggcacggucauggacaucaucucccggcgcgaccagcgcgggagcggccaggugggcaccuacgggcucaacaccuucaccaacauggaggcccagcugauccggcagauggagggcgaggggguguucaagaacauccagcaccugacggucaccgaggagaucgcggugcagaacuggcucgcccgcgugggccgggagcgccugucccggauggccaucagcggcgacgacugcgucgugaagccccuggacgaccgcuucgccuccgcccucaccgcgcugaacgacauggggaaggugcggaaggacauccagcagugggagccgagccgcggcuggaacgacuggacccagguccccuucugcucccaccacuuccacgagcugaucaugaaggacgggcgggugcucgugguccccugccgcaaccaggacgagcugaucggccgggcccgcaucagccagggggccggcuggucccugcgggagacggccugccucggcaagagcuacgcccagauguggucccugauguacuuccaccgccgggaccugcgccucgcggccaacgccaucugcagcgccgugcccucccacugggugccgaccagccggaccaccugguccauccacgccaagcacgaguggaugaccacggaggacaugcugaccgucuggaaccgcguguggauccaggagaaccccuggauggaggacaagacccccguggagagcugggaggagauccccuaccuggggaagcgggaggaccaguggugcggcagccucaucgggcugaccucccgcgcgacgugggccaagaacauccagaccgccaucaaccagguccgcagccugaucggcaacgaggaguacaccgacuacaugccguccaugaagcgguuccgccgggaggaggaggaggccggggugcucugguga

SEQ ID NO: 9034 - RNA, 9876 nt, Artificial Sequence
  derived and/or modified CDS sequence (opt1) from DENV-2__KF704357__SS-prME
accgccggcaugaucaucaugcugauccccaccgugauggccuuccaccucaccacccggaacggggagccccacaugaucgucagccggcaggagaagggcaagagccugcuguucaagaccggggacggcgugaacaugugcacccucauggcgauggaccugggggagcugugcgaggacaccaucaccuacaagugcccccuccugcggcagaacgagcccgaggacaucgacugcuggugcaacagcaccuccaccugggugacguacgggaccugcaccaccacgggcgagcaccggcgcgagaagcggagcgucgcccuggugccccacguggggaugggccucgagacccgcaccgagaccuggauguccagcgagggggccuggaagcacgcccagcggaucgagacguggauccugcgccaccccggcuucaccaucauggccgcgauccuggccuacaccaucgggaccacgcacuuccagcgggcccucaucuucauccugcugaccgccgucgcgcccuccaugaccaugcgcugcaucggcaucagcaaccgggacuucguggagggcguguccgggggcagcugggucgacaucgugcucgagcacggguccugcgugaccacgauggccaagaacaagcccacccuggaccuggagcucaucaagaccgaggccaagcagcccgccacccugcgcaaguacugcaucgaggccaagcugacgaacaccaccaccgagagccggugcccgacgcagggcgagcccucccucaacgaggagcaggacaagcgcuucgucugcaagcacagcaugguggaccggggcugggggaacggcugcgggcuguucggcaagggguccaucgugaccugcgcgauguucacgugcaagaagaucaugaagggcaaggucgugcagcccgagaaccuggaguacaccaucgugaucacgccccacagcggcgaggagcacgccgucgggaacgacaccggcaagcacgggaaggagaucaagaucaccccgcaguccagcaucaccgaggccgagcucaccggcuacgggacggugaccauggagugcagcccccggaccggccuggacuucaacgagauggugcugcuccagauggaggacaaggccuggcugguccaccggcagugguuccuggaccucccccugcccuggcugccgggcgccgacacccaggggagcaacuggauccagaaggagacgcucgugaccuucaagaacccccacgcgaagaagcaggacguggucgugcugggcagccaggagggggccaugcacaccgcccugaccggcgccacggagauccagauguccagcgggaacguccucuucaccggccaccugaagugccgccugcggauggacaagcuccagcugaagggcauguccuacagcaugugcaccgggaaguucaagguggugaaggagaucgccgagacccagcacggcacgaucgucauccgcgugcaguacgagggggacggcucccccugcaagauccccuucgagaucauggaccuggagaagcggcacgugcucggccgccugaucaccgucaacccgaucgugaccgggaaggacagccccgugaacaucgaggcggagccgcccuucggcgacuccuacaucaucaucggggucgagccgggccagcugaagcucaacugguucaagaaggggagcuccaucggccagauguucgccaccacgaugcgcggcgccaagcggauggccauccugggggacaccgccugggacuucggcagccucgggggcguguucaccuccaucgggaaggcgcuccaccagguguucggcgccaucuacggcgccgccuucagcggggucuccuggaccaugaagauccugaucggcgugaucaucacguggaucgggaugaacagccgcuccaccagccuguccgugagccugguccucgugggcguggucacccuguaccugggggugauggugcaggcggacuccggcugcgucgugagcuggaagaacaaggagcucaagugcggcagcgggaucuucaucaccgacaacgugcacacguggaccgagcaguacaaguuccagcccgagucccccagcaagcuggccuccgccauccagaaggcccacgaggagggcaucugcgggauccggagcgucacccgccuggagaaccucauguggaagcagaucacccccgagcugaaccacauccuguccgagaacgaggugaagcucacgaucaugaccggcgacaucaaggggaucaugcaggccggcaagcggagccugcgcccgcagcccaccgagcugaaguacuccuggaagaccuggggcaaggcgaagaugcucagcacggagucccacaaccagaccuuccugaucgacgggcccgagaccgccgagugcccgaacaccaaccgggccuggaacagccuggagguggaggacuacggcuucggggucuucacgaccaacaucuggcucaagcugcgcgaggagcaggacguguucugcgacuccaagcugaugagcgccgccaucaaggacaaccgggcggugcacgccgacaugggcuacuggaucgaguccgcccucaacgacaccuggaagaucgagaaggccagcuucaucgaggucaaguccugccacuggcccaagagccacacccugugguccaacggcgugcuggagagcgagaugaucauccccaagaacuucgccgggcccgugagccagcacaacuaccgcccgggcuaccacacccagacggcggggcccuggcaccucggcaagcuggagauggacuucgacuucugcgaggggaccaccgucguggugaccgaggacugcggcaaccggggccccucccugcgcacgaccaccgccagcgggaagcucaucaccgaguggugcugccgguccugcacgcugcccccgcugcgcuaccggggcgaggacgggugcugguacggcauggagauccgcccccucaaggagaaggaggagaaccuggucaacagccuggugaccgccgggcacggccagaucgacaacuucucccucggcgugcuggggauggcccuguuccucgaggagaugcugcggacccgcgucggcaccaagcacgcgauccugcucguggccgugagcuucgucacgcugaucaccgggaacauguccuuccgggaccugggccgcgugauggugauggucggggccaccaugaccgacgacaucggcaugggcgugacguaccucgcccugcuggccgcguucaaggugcgccccaccuucgccgccgggcuccugcugcggaagcucaccagcaaggagcugaugaugaccacgaucggcaucguccugcucucccagagcaccauccccgagaccauccuggagcugaccgacgcccucgcccuggggaugauggugcugaagauggugcgcaagauggagaaguaccagcucgcggucacgaucauggccauccugugcgugccgaacgccgucauccugcagaacaccuggaagguguccugcaccauccucgccguggucagcgugagcccccuguuccugaccagcucccagcagaaggccgacuggaucccccucgcgcugacgaucaagggccugaaccccaccgccaucuuccucaccacccugagccggacgaacaagaagcgcuccuggccgcugaacgaggccaucauggccgugggcauggucagcauccucgcguccagccugcugaagaacgacauccccaugaccgggccccucguggccggcgggcugcugaccgugugcuacguccucaccggccggagcgccgaccuggagcuggagcgcgccgccgacgugaagugggaggaccaggcggagaucuccgggagcucccccauccucagcaucacgaucuccgaggacggcagcauguccaucaagaacgaggaggaggagcagacccugaccauccugauccggaccggccuccuggugaucagcgggcuguucccggucuccauccccaucaccgccgccgccugguaccucugggaggugaagaagcagcgcgccggcgugcugugggacguccccuccccgccgcccguggggaaggcggagcuggaggacggcgccuaccggaucaagcagaaggggauccucggcuacucccagaucggcgccgggguguacaaggagggcacguuccacaccauguggcacgucacccgcggggccgugcugaugcacaagggcaagcggaucgagcccagcugggccgacgugaagaaggaccugaucuccuacgggggcggcuggaagcucgagggggaguggaaggagggcgaggagguccaggugcuggcgcuggagcccgggaagaacccccgcgccgugcagaccaagcccggccucuucaagacgaacgccgggaccaucggcgccgucagccuggacuucucccccggcaccagcgggucccccaucaucgaccggaagggcaaggugguggggcuguacggcaacggcgucgugacccgcagcggggccuacguguccgcgaucgcccagacggagaaguccaucgaggacaaccccgagaucgaggacgacaucuuccggaagcgcaagcucaccaucauggaccugcaccccggcgccgggaagaccaagcgguaccugcccgccaucguccgcgaggcgaucaagcggggccugcgcacccucauccuggccccgacgcgggugguggccgccgagauggaggaggcccugcgcgggcuccccauccgcuaccagacccccgcgauccgggccgagcacaccggccgcgagaucgucgaccugaugugccacgccaccuucacgaugcggcugcucagccccgugcgcgugccgaacuacaaccugaucaucauggacgaggcccacuucaccgaccccgccuccaucgcggcccggggcuacaucagcacccgcgucgagaugggggaggccgccggcaucuucaugaccgccacgccgcccgggucccgggacccguucccccagagcaacgcgcccaucauggacgaggagcgcgagauccccgagcgguccuggagcuccggccacgagugggugaccgacuucaaggggaagaccgugugguucgucccgagcauccgcgccggcaacgacaucgccgccugccugcggaagaacggcaagaaggugauccagcucucccgcaagaccuucgacagcgaguacgugaagacgcggaccaacgacugggacuucgucgugaccaccgacaucuccgagaugggggcgaacuucaaggccgagcgcgugaucgacccccggcgcugcaugaagcccgucauccugacggacggcgaggagcgggugauccuggccgggcccaugccggugacccacagcuccgccgcccagcgccggggccgcaucgggcgcaaccccaagaacgagaacgaccaguacaucuacaugggcgagccccucgagaacgacgaggacugcgcgcacuggaaggaggccaagaugcugcuggacaacaucaacacccccgagggcaucaucccgagcauguucgagcccgagcgggagaaggucgacgccaucgacggggaguaccgccuccggggcgaggcccgcaagaccuucguggaccugaugcggcgcggggaccugcccguguggcucgccuaccgggucgcggccgagggcaucaacuacgccgaccgccgguggugcuucgacgggaucaagaacaaccagauccuggaggagaacguggaggucgagaucuggacgaaggagggcgagcgcaagaagcugaagccgcgguggcucgacgcccgcaucuacuccgacccccuggcccugaaggaguucaaggaguucgcggccggccgcaagagccucacccugaaccugaucaccgagauggggcgccuccccaccuucaugacgcagaaggcccgggacgcccuggacaaccuggcggugcuccacaccgccgaggccggcgggcgcgccuacaaccacgcccuguccgagcugcccgagacccucgagacccugcugcuccugacgcugcucgcgaccgugaccggcggcaucuuccuguuccugaugagcgggcggggcaucgggaagaugacccucggcaugugcugcaucaucaccgccuccauccugcugugguacgcccagauccagccgcacuggaucgccgccagcaucauccucgaguucuuccugaucguccugcucauccccgagcccgagaagcagcgcacgccccaggacaaccagcugaccuacguggugaucgcgauccugaccgucguggccgccaccauggccaacgagaugggguuccucgagaagacgaagaaggaccugggccugggcagcaucaccacccagcagccggaguccaacauccucgacaucgaccugcggcccgccagcgcguggacccuguacgccguggccacgaccuucgucacccccaugcuccgccacuccaucgagaacagcuccgugaacgugagccugaccgccaucgccaaccaggcgacgguccugauggggcucggcaagggguggccccuguccaagauggacaucggcgugccgcugcucgccaucgggugcuacagccaggugaaccccaucacccugaccgccgcccuguuccuccuggucgcgcacuacgccaucaucggccccggccugcaggccaaggccacccgggaggcccagaagcgcgcggccgccgggaucaugaagaaccccacgguggacggcaucaccgugaucgaccucgacccgauccccuacgaccccaaguucgagaagcagcuggggcaggucaugcugcucgugcugugcgugacccagguccugaugaugcgcaccacgugggcccucugcgaggcccugacccuggcgaccggccccaucuccacccucugggaggggaacccgggccgguucuggaacacgaccaucgccgugagcauggccaacaucuuccgcggcuccuaccuggccggggccggccugcuguucagcaucaugaagaacaccaccaacacgcggcgcgggaccggcaacaugggcgagacccugggggagaaguggaagucccggcugaacgcgcucggcaagagcgaguuccagaucuacaagaaguccgggauccaggagguggaccgcacccuggccaaggagggcaucaagcgcggggagacggaccaccacgccgucagccgcggcuccgccaagcugcggugguucguggagcgcaacauggugacccccgagggcaaggucguggaccucgggugcggccgcgggggcuggagcuacuacugcgggggccugaagaacgugcgcgaggucaagggccugaccaagggcggccccgggcacgaggagcccaucccgauguccaccuacggcuggaaccucgugcggcugcagagcgggguggacgucuucuucacgccgcccgagaagugcgacacccugcucugcgacaucggcgagagcucccccaacccgaccguggaggcgggccgcacccugcgggugcugaaccucgucgagaacuggcugaacaacaacacccaguucugcaucaaggugcugaaccccuacaugcccagcgugaucgagaagauggaggcccuccagcgcaaguacgggggcgcccugguccggaacccgcugucccgcaacagcacgcacgagauguacuggguguccaacgccagcgggaacaucguguccagcgucaacaugaucucccggaugcugaucaaccgcuucaccaugcgccacaagaaggccaccuucgagcccgacguggaccucggcagcgggacccggaacaucggcaucgaguccgagauccccaaccuggacaucaucggcaagcgcaucgagaagaucaagcaggaguacgagacgagcuggcacuacgaccaggaccaccccuacaagaccugggcguaccacggguccuacgagaccaagcagaccggcagcgccuccagcauggugaacggggucgugcggcugcucacgaagccgugggacgugguccccauggugacccagauggccaugaccgacaccacgcccuucggccagcagcgcguguucaaggagaaggucgacacccggacccaggagcccaaggagggcaccaagaagcugaugaagaucacggccgaguggcuguggaaggagcucgggaagaagaagaccccgcgcaugugcacccgggaggaguucacccgcaaggugcgguccaacgccgcgcugggcgccaucuucacggacgagaacaaguggaaguccgcccgcgaggccgucgaggacucccgguucugggagcugguggacaaggagcgcaaccuccaccuggaggggaagugcgagaccugcguguacaacaugaugggcaagcgggagaagaagcugggggaguucggcaaggccaagggcagccgcgcgaucugguacauguggcucggggcccgguuccuggaguucgaggcccugggcuuccucaacgaggaccacugguucagccgcgagaacucccugagcggggucgagggcgaggggcugcacaagcucggcuacauccugcgggacguguccaagaaggagggcggggccauguacgcggacgacaccgccggcugggacacccgcaucacgcuggaggaccucaagaacgaggagauggugaccaaccacauggagggggagcacaagaagcuggccgaggccaucuucaagcugaccuaccagaacaaggucgugcgggugcagcgccccacgccccggggcacggucauggacaucaucagccgccgcgaccagcggggguccggccaggugggcaccuacgggcucaacaccuucaccaacauggaggcccagcugauccgccagauggagggcgaggggguguucaagaacauccagcaccugacggucaccgaggagaucgcggugcagaacuggcucgcccgggugggccgcgagcggcugagccgcauggccaucuccggcgacgacugcgucgugaagccccuggacgaccgguucgccagcgcccucaccgcgcugaacgacauggggaaggugcgcaaggacauccagcagugggagccgucccggggcuggaacgacuggacccagguccccuucugcagccaccacuuccacgagcugaucaugaaggacgggcgcgugcucgugguccccugccggaaccaggacgagcugaucggccgcgcccggaucucccagggggccggcuggagccugcgcgagacggccugccucggcaaguccuacgcccagauguggagccugauguacuuccaccggcgcgaccugcggcucgcggccaacgccaucugcuccgccgugcccagccacugggugccgaccucccgcaccaccuggagcauccacgccaagcacgaguggaugaccacggaggacaugcugaccgucuggaaccggguguggauccaggagaaccccuggauggaggacaagacccccguggagagcugggaggagauccccuaccuggggaagcgcgaggaccaguggugcggcucccucaucgggcugaccagccgcgcgacgugggccaagaacauccagaccgccaucaaccagguccggucccugaucggcaacgaggaguacaccgacuacaugccgagcaugaagcgcuuccggcgcgaggaggaggaggccggggugcucugguga

SEQ ID NO: 9035 - RNA, 9876 nt, Artificial Sequence
  derived and/or modified CDS sequence (opt1) from DENV-2__KF704358__SS-prME
accgccggcaugaucaucaugcugauccccaccgugauggccuuccaccucaccacccgcaacggggagccccacaugaucgucagccggcaggagaagggcaagagccugcuguucaacaccggggacggcgugcacaugugcacccucauggcgaugcaccugggggagcugugcgaggacaccaucaccuacaagugcccccuccugcgccagaacgagcccgaggacaucgacugcuggugcaacagcaccuccaccugggugaccuacgggaccugcaccaccaccggcgagcaccggcgcgagaagcggagcgucgcccuggugccccacguggggaugggccucgagacccgcaccgagaccuggauguccagcgagggggccuggaagcacgcccagcggaucgagacguggauccugcgccaccccggcuucaccaucauggccgcgauccuggccuacaccaucgggaccacgcacuuccagcgggcccucaucuucauccugcugaccgccgucgcgcccuccaugaccaugcgcugcaucggcaucagcaaccgggacuucguggagggcguguccgggggcagcugggucgacaucgugcucgagcacggguccugcgugaccacgauggccaagaacaagcccacccuggaccuggagcucaucaagaccgaggccaagcagcccgccacccugcgcaaguacugcaucgaggccaagcugacgaacaccaccaccgagagccggugcccgacgcagggcgagcccucccucaacgaggagcaggacaagcgcuucgucugcaagcacagcaugguggaccggggcugggggaacggcugcgggcuguucggcaagggguccaucgugaccugcgcgauguucacgugcaagaagaucaugaagggcaaggucgugcagcccgagaaccuggaguacaccaucgugaucacgccccacagcggcgaggagcacgccgucgggaacgacaccggcaagcacgggaaggagaucaagaucaccccgcaguccagcaucaccgaggccgagcucaccggcuacgggacggugaccauggagugcagcccccggaccggccuggacuucaacgagauggugcugcuccagauggaggacaaggccuggcugguccaccggcagugguuccuggaccucccccugcccuggcugccgggcgccgacacccaggggagcaacuggauccagaaggagacgcucgugaccuucaagaacccccacgcgaagaagcaggacguggucgugcugggcagccaggagggggccaugcacaccgcccugaccggcgccacggagauccagauguccagcgggaacguccucuucaccggccaccugaagugccgccugcggauggacaagcuccagcugaagggcauguccuacagcaugugcaccgggaaguucaagguggugaaggagaucgccgagacccagcacggcacgaucgucauccgcgugcaguacgagggggacggcucccccugcaagauccccuucgagaucauggaccuggagaagcggcacgugcucggccgccugaucaccgucaacccgaucgugaccgggaaggacagccccgugaacaucgaggcggagccgcccuucggcgacuccuacaucaucaucggggucgagccgggccagcugaagcucaacugguucaagaaggggagcuccaucggccagauguucgccaccacgaugcgcggcgccaagcggauggccauccugggggacaccgccugggacuucggcagccucgggggcguguucaccuccaucgggaaggcgcuccaccagguguucggcgccaucuacggcgccgccuucagcggggucuccuggaccaugaagauccugacgggcgugaucaucaccuggaucgggaugaacagccgcuccaccagccuguccgugagccugguccucgugggcguggucacccuguaccugggggugauggugcaggcggacuccggcugcgucgugagcuggaagaacaaggagcucaagugcggcagcgggaucuucaucacggacaacgugcacaccuggaccgagcaguacaaguuccagcccgagucccccagcaagcuggccuccgccauccagaaggcccacgaggagggcaucugcgggauccggagcgucacccgccuggagaaccucauguggaagcagaucacgcccgagcugaaccacauccuguccgagaacgaggugaagcucaccaucaugaccggcgacaucaaggggaucaugcaggccggcaagcggagccugcgcccgcagcccaccgagcugaaguacuccuggaagacguggggcaaggcgaagaugcucagcaccgagucccacaaccagaccuuccugaucgacgggcccgagaccgccgagugcccgaacacgaaccgggccuggaacagccuggagguggaggacuacggcuucggggucuucaccaccaacaucuggcucaagcugcgcgagaagcaggacguguucugcgacuccaagcugaugagcgccgccaucaaggacaaccgggcggugcacgccgacaugggcuacuggaucgaguccgcccucaacgacaccuggaagaucgagaaggccagcuucaucgaggucaaguccugccacuggcccaagagccacacccugugguccaacggcgugcuggagagcgagaugaucauccccaagaacuucgccgggcccgugagccagcacaacuaccgcccgggcuaccacacgcagaccgcggggcccuggcaccucggcaagcuggagauggacuucgacuucugcgaggggaccaccgucguggugacggaggacugcggcaaccggggccccucccugcgcaccaccaccgccagcgggaagcucaucacggaguggugcugccgguccugcacccugcccccgcugcgcuaccggggcgaggacgggugcugguacggcauggagauccgcccccucaaggagaaggaggagaaccuggucaacagccuggugaccgccgggcacggccagaucgacaacuucucccucggcgugcuggggauggcccuguuccucgaggagaugcugcggacccgcgucggcacgaagcacgcgauccugcucguggccgugagcuucgucacccugaucaccgggaacauguccuuccgggaccugggccgcgugauggugauggucggggccaccaugacggacgacaucggcaugggcgugaccuaccucgcccugcuggccgcguucaaggugcgccccaccuucgccgccgggcuccugcugcggaagcucaccagcaaggagcugaugaugacgaccaucggcaucguccugcucucccagagcaccauccccgagaccauccuggagcugacggacgcccucgcccuggggaugauggugcugaagauggugcgcaagauggagaaguaccagcucgcggucaccaucauggccauccugugcgugccgaacgccgucauccugcagaacaccuggaagguguccugcaccauccucgccguggucagcgugagcccccuguuccugacgagcucccagcagaaggccgacuggaucccccucgcgcugaccaucaagggccugaaccccaccgccaucuuccucaccacgcugagccggaccaacaagaagcgcuccuggccgcugaacgaggccaucauggccgugggcauggucagcauccucgcguccagccugcugaagaacgacauccccaugaccgggccccucguggccggcgggcugcugaccgugugcuacguccucacgggccggagcgccgaccuggagcuggagcgcgccgccgacgugaagugggaggaccaggcggagaucuccgggagcucccccauccucagcaucaccaucuccgaggacggcagcauguccaucaagaacgaggaggaggagcagacccugaccauccugauccggaccggccuccuggugaucagcgggcuguucccggucuccauccccaucacggccgccgccugguaccucugggaggugaagaagcagcgcgccggcgugcugugggacguccccuccccgccgcccguggggaaggcggagcuggaggacggcgccuaccggaucaagcagaaggggauccucggcuacucccagaucggcgccgggguguacaaggagggcaccuuccacaccauguggcacgucacccgcggggccgugcugaugcacaagggcaagcggaucgagcccagcugggccgacgugaagaaggaccugaucuccuacgggggcggcuggaagcucgagggggaguggaaggagggcgaggagguccaggugcuggcgcuggagcccgggaagaacccccgcgccgugcagacgaagcccggccucuucaagaccaacgccgggaccaucggcgccgucagccuggacuucucccccggcaccagcgggucccccaucaucgacaagaagggcaaggugguggggcuguacggcaacggcgucgugacgcggagcggggccuacguguccgcgaucgcccagaccgagaaguccaucgaggacaaccccgagaucgaggacgacaucuuccgcaagcggaagcucaccaucauggaccugcaccccggcgccgggaagaccaagcgcuaccugcccgccaucguccgggaggcgaucaagcgcggccugcggacgcucauccuggccccgacccgcgugguggccgccgagauggaggaggcccugcgggggcuccccauccgcuaccagacccccgcgauccgcgccgagcacaccggccgggagaucgucgaccugaugugccacgccacguucaccaugcgccugcucagccccgugcgggugccgaacuacaaccugaucaucauggacgaggcccacuucaccgaccccgccuccaucgcggcccgcggcuacaucagcacccgggucgagaugggggaggccgccggcaucuucaugacggccacgccgcccgggucccgcgacccguucccccagagcaacgcgcccaucauggacgaggagcgggagauccccgagcgcuccuggagcuccggccacgagugggugaccgacuucaaggggaagaccgugugguucgucccgagcauccgggccggcaacgacaucgccgccugccugcgcaagaacggcaagaaggugauccagcucucccggaagacguucgacagcgaguacgugaagacccgcaccaacgacugggacuucgucgugaccacggacaucuccgagaugggggcgaacuucaaggccgagcgggugaucgacccccgccggugcaugaagcccgucauccugaccgacggcgaggagcgcgugauccuggccgggcccaugccggugacccacagcuccgccgcccagcggcgcggccggaucgggcgcaaccccaagaacgagaacgaccaguacaucuacaugggcgagccccucgagaacgacgaggacugcgcgcacuggaaggaggccaagaugcugcuggacaacaucaacacccccgagggcaucaucccgagcauguucgagcccgagcgcgagaaggucgacgccaucgacggggaguaccggcuccgcggcgaggcccggaagacguucguggaccugaugcgccgcggggaccugcccguguggcucgccuaccgcgucgcggccgagggcaucaacuacgccgaccggcgcuggugcuucgacgggaucaagaacaaccagauccuggaggagaacguggaggucgagaucuggaccaaggagggcgagcggaagaagcugaagccgcgcuggcucgacgcccggaucuacuccgacccccuggcccugaaggaguucaaggaguucgcggccggccgcaagagccucacccugaaccugaucaccgagauggggcggcuccccacguucaugacccagaaggcccgcgacgcccuggacaaccuggcggugcuccacaccgccgaggccggcgggcgggccuacaaccacgcccuguccgagcugcccgagacccucgagacgcugcugcuccugacccugcucgcgaccgugaccggcggcaucuuccuguuccugaugagcgggcgcggcaucgggaagaugacccucggcaugugcugcaucaucacggccuccauccugcugugguacgcccagauccagccgcacuggaucgccgccagcaucauccucgaguucuuccugaucguccugcucauccccgagcccgagaagcagcggacgccccaggacaaccagcugaccuacguggugaucgcgauccugaccgucguggccgccacgauggccaacgagaugggguuccucgagaagaccaagaaggaccugggccugggcagcaucaccacccagcagccggaguccaacauccucgacaucgaccugcgccccgccagcgcguggacgcuguacgccguggccaccaccuucgucacccccaugcuccggcacuccaucgagaacagcuccgugaacgugagccugacggccaucgccaaccaggcgaccguccugauggggcucggcaagggguggccccuguccaagauggacaucggcgugccgcugcucgccaucgggugcuacagccaggugaaccccaucacccugaccgccgcccuguuccuccuggucgcgcacuacgccaucaucggccccggccugcaggccaaggccacgcgcgaggcccagaagcgggcggccgccgggaucaugaagaaccccaccguggacggcaucaccgugaucgaccucgacccgauccccuacgaccccaaguucgagaagcagcuggggcaggucaugcugcucgugcugugcgugacccagguccugaugaugcgcacgaccugggcccucugcgaggcccugacccuggcgaccggccccaucuccacgcucugggaggggaacccgggccgcuucuggaacaccaccaucgccgugagcauggccaacaucuuccggggcuccuaccuggccggggccggccugcuguucagcaucaugaagaacaccacgaacacccgccgggggaccggcaacaugggcgagacccugggggagaaguggaagucccgccugaacgcgcucggcaagagcgaguuccagaucuacaagaaguccgggauccaggagguggaccggacgcuggccaaggagggcaucaagcgcggggagaccgaccaccacgccgucagccggggcuccgccaagcugcgcugguucguggagcggaacauggugacccccgagggcaaggucguggaccucgggugcggccgcgggggcuggagcuacuacugcgggggccugaagaacgugcgggaggucaagggccugaccaagggcggccccgggcacgaggagcccaucccgauguccacguacggcuggaaccucgugcgccugcagagcgggguggacgucuucuucacgccgcccgagaagugcgacacccugcucugcgacaucggcgagagcucccccaacccgaccguggaggcgggccggacccugcgcgugcugaaccucgucgagaacuggcugaacaacaacacgcaguucugcaucaaggugcugaaccccuacaugcccagcgugaucgagaagauggaggcccuccagcggaaguacgggggcgcccugguccgcaacccgcugucccggaacagcacccacgagauguacuggguguccaacgccagcgggaacaucguguccagcgucaacaugaucucccgcaugcugaucaaccgguucaccaugcgccacaagaaggccaccuucgagcccgacguggaccucggcagcgggacgcgcaacaucggcaucgaguccgagauccccaaccuggacaucaucggcaagcggaucgagaagaucaagcaggaguacgagaccagcuggcacuacgaccaggaccaccccuacaagaccugggcguaccacggguccuacgagaccaagcagacgggcagcgccuccagcauggugaacggggucgugcgccugcucaccaagccgugggacgugguccccauggugacccagauggccaugaccgacacgacccccuucggccagcagcggguguucaaggagaaggucgacacccgcacccaggagcccaaggagggcacgaagaagcugaugaagaucaccgccgaguggcuguggaaggagcucgggaagaagaagaccccgcggaugugcacccgcgaggaguucacgcggaaggugcgcuccaacgccgcgcugggcgccaucuucaccgacgagaacaaguggaaguccgcccgggaggccgucgaggacucccgcuucugggagcugguggacaaggagcggaaccuccaccuggaggggaagugcgagaccugcguguacaacaugaugggcaagcgcgagaagaagcugggggaguucggcaaggccaagggcagccgggcgaucugguacauguggcucggggcccgcuuccuggaguucgaggcccugggcuuccucaacgaggaccacugguucagccgggagaacucccugagcggggucgagggcgaggggcugcacaagcucggcuacauccugcgcgacguguccaagaaggagggcggggccauguacgcggacgacaccgccggcugggacacgcggaucacccuggaggaccucaagaacgaggagauggugaccaaccacauggagggggagcacaagaagcuggccgaggccaucuucaagcugaccuaccagaacaaggucgugcgcgugcagcggcccacgccccgcggcaccgucauggacaucaucagccggcgcgaccagcgcggguccggccaggugggcaccuacgggcucaacaccuucacgaacauggaggcccagcugauccggcagauggagggcgaggggguguucaagaacauccagcaccugaccgucaccgaggagaucgcggugcagaacuggcucgcccgcgugggccgggagcgccugagccggauggccaucuccggcgacgacugcgucgugaagccccuggacgaccgcuucgccagcgcccucaccgcgcugaacgacauggggaaggugcggaaggacauccagcagugggagccgucccgcggcuggaacgacuggacgcagguccccuucugcagccaccacuuccacgagcugaucaugaaggacgggcgggugcucgugguccccugccgcaaccaggacgagcugaucggccgggcccgcaucucccagggggccggcuggagccugcgggagaccgccugccucggcaaguccuacgcccagauguggagccugauguacuuccaccgccgggaccugcgccucgcggccaacgccaucugcuccgccgugcccagccacugggugccgaccucccggaccaccuggagcauccacgccaagcacgaguggaugacgaccgaggacaugcugaccgucuggaaccgcguguggauccaggagaaccccuggauggaggacaagacccccguggagagcugggaggagauccccuaccuggggaagcgggaggaccaguggugcggcucccucaucgggcugacgagccgcgcgaccugggccaagaacauccagaccgccaucaaccagguccgcucccugaucggcaacgaggaguacaccgacuacaugccgagcaugaagcgguuccgccgggaggaggaggaggccggggugcucugguga

SEQ ID NO: 9036 - RNA, 9876 nt, Artificial Sequence
  derived and/or modified CDS sequence (opt1) from DENV-2__KF041232__SS-prME
accgccggggugaucaucaugcugauccccaccgccauggcguuccaccucaccacccgcaacggggagccccacaugaucgucagcaagcaggagaagggcaagagccugcuguucaagaccgaggacggggugaacaugugcacccucauggccauggaccugggcgagcugugcgaggacaccaucaccuacaacugcccccuccugcggcagaacgagcccgaggacaucgacugcuggugcaacgccaccagcaccugggugaccuacgggaccugcaccgccaccggcgagcaccgccgggagaagcgcuccgucgcccuggugccccacgugggcauggggcucgagacccggaccgagaccuggaugagcuccgagggcgcguggaagcacgcccagcgcaucgagaccuggauccugcggcaccccggguucaccaucauggccgccauccuggcguacaccaucggcaccaccuacuuccagcgcguccucaucuucauccugcugacggccguggcccccagcaugaccaugcggugcaucgggaucuccaaccgcgacuucguggagggcgucagcggcggguccuggguggacaucgugcucgagcacggcagcugcgucaccaccauggccaagaacaagcccacgcuggacuucgagcugaucaagaccgaggccaagcagcccgcgacccuccggaaguacugcaucgaggccaagcugaccaacacgaccaccgccucccgcugcccgacccagggggagcccagccugaacgaggagcaggacaagcgguucgugugcaagcacuccaugguggaccgcggcuggggcaacgggugcggccucuucgggaagggcgggaucgucacgugcgccauguucacgugcaagaagaacauggagggcaagaucgugcagcccgagaaccuggaguacaccaucguggucacgccccacagcggcgaggagaacgccguggggaacgacacgggcaagcacgggaaggagaucaaggugaccccgcaguccagcaucaccgaggcggagcugaccggcuacgggaccgucacgauggagugcagcccccggaccggccucgacuucaacgagauggugcugcugcagauggagaacaaggccuggcucgugcaccgccagugguuccuggaccugccccuccccuggcugccgggcgccgacauccaggggagcaacuggauccagaaggagacccuggucaccuucaagaacccccacgccaagaagcaggacguggucgugcucggcucccaggagggggccaugcacacggcgcugaccggcgccaccgagauccagaugagcagcgggaaccuccuguucaccggccaccugaagugccggcugcgcauggacaagcuccagcugaagggcauguccuacagcaugugcacggggaaguucaagguggucaaggagaucgccgagacccagcacggcaccaucguggugcggguccaguacgagggggacggcucccccugcaagauccccuucgagaucauggaccuggagaagcgccacgugcucggccggcugaucaccgugaacccgaucgucacggagaaggacagccccgugaacaucgaggccgagccgcccuucggggacuccuacaucaucaucggcguggagccggggcagcugaagcucagcugguucaagaagggcuccagcaucgggcagauguucgagaccaccaugcgcggcgccaagcgcauggcgauccugggcgacaccgccugggacuucgggucccugggcggggucuucacgagcaucggcaaggcccuccaccagguguucggggccaucuacggcgcggccuucuccggcgugagcuggaccaugaagauccugaucggggucgugaucaccuggaucggcaugaacucccggagcaccucccugagcgugucccugguccucguggggguggucacgcuguaccugggcgccauggugcaggccgacagcgggugcguggucuccuggaagaacaaggagcucaagugcggcagcggcaucuucaucaccgacaacgugcacaccuggaccgagcaguacaaguuccagcccgagagccccuccaagcuggccagcgcgauccagaaggcccacgaggaggggaucugcggcauccgcuccgugacgcggcuggagaaccucauguggaagcagaucacccccgagcugaaccacauccugagcgagaacgaggucaagcucuccaucaugaccggggacaucaagggcaucaugcaggccgggaagcgcagccugcggccgcagcccaccgagcugaaguacuccuggaagacguggggcaaggccaagaugcucagcaccgagccccacaaccagaccuuccugaucgacggcccggagaccgccgagugccccaacacgaaccgcgcguggaacucccuggagguggaggacuacggguucggcguguucaccaccaacaucuggcucaagcugaaggagcggcaggacgucuucugcgacagcaagcugauguccgccgccaucaaggacaaccgcgccgugcacgccgacaugggguacuggaucgagagcgcgcucaacgacaccuggaagaucgagaaggccuccuucaucgaggucaagagcugccacuggcccaagucccacacgcuguggagcaacggcgugcuggaguccgagaugaucauccccaagaacuucgccggcccggugagccagcacaacuaccggcccggguaccacacccagaccgccggccccuggcaccucgggaagcuggagauggacuucgacuucugcgagggcaccaccguggucgugacggaggacugcgggaaccgcggccccagccugcggaccaccaccgcguccggcaagcucaucacggaguggugcugccgcagcugcacccugccgccccugcgguaccgcggggaggacggcugcugguacgggauggagauccggccccucaaggagaaggaggagaaccuggugaacucccuggucaccgccggccacgggcagaucgacaacuucagccucggcgugcugggcauggcccuguuccucgaggagaugcugcgcacccggguggggacgaagcacgccguccugcucguggccguguccuucaugacccugaucaccggcaacaugagcuuccgcgaccuggggcgggucauggugauggugggcgcggccaugaccgacgacaucgggaugggcgucacguaccucgcccugcuggccgccuucaaggugcgccccaccuucgcggccggccuccugcugcgcaagcucaccuccaaggagcugaugaugaccacgaucgggaucgugcugcucagccaguccaccaccccggagaccauccuggagcugacggacgcccucgcccugggcaugaugauccugaagaucguccggaacauggagaaguaccagcucgccgugaccaucauggcgauccugugcguccccaacgccgugauccugcagaacgccuggaaggugagcugcaccauccucgccgcggucuccgugagcccccugcugcucaccuccagccagcagaaggccgacuggaucccccuggcccugacgaucaaggggcucaacccgaccgccaucuuccugaccacccugucccgcacgaacaagaagcggagcuggccccucaacgaggccaucauggcggugggcauggucuccauccuggccagcucccugcucaagaacgacauccccaugaccggcccccugguggccgggggccugcucaccgugugcuacguccugaccgggcgcagcgccgaccuggagcucgagcgggccgcggacgugcgcugggaggaccaggccgagaucagcggcuccagcccgauccuguccaucacgaucagcgaggacggguccaugagcaucaagaacgaggaggaggagcagacccugaccauccucauccggaccggccugcuggugaucuccggccucuuccccgucagcauccccaucacggccgccgccugguaccugugggaggugaagaagcagcgcgcgggggugcugugggacguccccuccccgccgcccgugggcaaggccgagcucgaggacggggccuaccggaucaagcagaagggcauccugggguacagccagaucggcgccggcguguacaaggaggggaccuuccacaccauguggcacgucacccgcggcgccgugcugaugcacaaggggaagcggaucgagccguccugggcggacgugcgcaaggaccucaucagcuacggcgggggcuggaagcuggagggcgaguggaaggagggggaggagguccaggugcuggcccucgagcccggcaagaacccccgggccgugcagaccaagcccgggcuguucaagacgaacaccggcaccaucggggccgucucccuggacuucagcccgggcaccuccggcagccccaucguggacaagaaggggaagguggucggccucuacgggaacggcguggugacgcgcuccggcaccuacgucagcgcgaucgcccagaccgagaaguccaucgaggacaaccccgagaucgaggacgacaucuuccggaagaagcgccugaccaucauggaccugcaccccggggccggcaagacgaagcgguaccugccggccaucgugcgcgaggccaucaagcgggggcuccgcacccugauccuggcgcccacccggguggucgccgccgagauggaggaggcccuccgcggccugcccauccgcuaccagacccccgccauccgggcggagcacacggggcgcgagaucguggaccugaugugccacgccaccuucaccaugcggcuccugagcccggugcgcguccccaacuacaaccugaucaucauggacgaggcccacuucaccgaccccgccagcaucgccgcgcggggcuacaucuccacgcgcguggagaugggcgaggccgccgggaucuucaugaccgccacgccgcccggcagccgggaccccuucccccaguccaacgcgcccaucauggacgaggagcgcgagauccccgagcggagcuggaacuccgggcacgagugggugaccgacuucaagggcaagacggucugguucgugcccagcaucaaggccgggaacgacaucgccgccugccuccgcaagaacggcaagaaggugauccagcugucccggaagaccuucgacagcgaguacaucaagacccgcaccaacgacugggacuucgucgugacgaccgacaucuccgagaugggcgccaacuucaaggcggagcgggugaucgacccccgccggugcaugaagcccgucauccugaccgacggggaggagcgcgugauccucgccggcccgaugcccgugacccacagcuccgccgcccagcggcgcgggcggaucggccgcaaccccaagaacgagaacgaccaguacaucuacaugggggagccccuggagaacgacgaggacugcgcccacuggaaggaggcgaagaugcugcucgacaacaucaacacgccggagggcaucauccccagcauguucgagcccgagcgcgagaaggucgacgccaucgacggcgaguaccggcugcgcggggaggcccggaagaccuucguggaccugaugcgccggggcgaccucccgguguggcuggccuaccgcgucgccgcggaggggaucaacuacgccgaccggcgcuggugcuucgacggcaucaagaacaaccagauccuggaggagaacguggaggucgagaucuggaccaaggagggggagcggaagaagcucaagccccgcuggcuggacgcccggaucuacuccgacccccuggcccucaaggaguucaaggaguucgcggccggccgcaagagccugacccugaaccucaucacggagaugggccggcugcccaccuucaugacccagaaggcccgcaacgcccuggacaaccucgccgugcugcacaccgcggaggccgggggccgggccuacaaccacgcccuguccgagcucccggagacgcuggagacccugcuccugcugacccuccuggccaccgugaccggcgggaucuuccuguuccucaugagcgggaaggggaucggcaagaugacccuggggaugugcugcaucaucaccgcguccauccugcucugguacgcccagauccagccccacuggaucgccgccagcaucauccuggaguucuuccugaucguccuccugauccccgagcccgagaagcagcgcaccccgcaggacaaccagcugaccuacguggugaucgccauccucacggucguggcggccaccauggccaacgagaugggcuuccuggagaagaccaagaaggacuucgggcugggcuccaucgccacccagcagcccgagagcaacauccucgacaucgaccugcggcccgccagcgcguggacgcuguacgccguggccaccaccuucaucacccccaugcuccgccacuccaucgagaacagcuccgucaacgugagccugacggccaucgcgaaccaggccaccgugcugaugggccucgggaagggcuggccgcuguccaagauggacaucggggucccccugcucgccaucggcugcuacagccaggugaaccccaucacccugaccgccgcccugcuccugcugguggcgcacuacgccaucaucgggcccggccuccaggccaaggccacgcgggaggcccagaagcgcgcggccgccggcaucaugaagaacccgaccgucgacgggaucaccgugaucgaccuggaccccauccccuacgaccccaaguucgagaagcagcugggccaggugaugcuccugguccugugcgugacccaggugcucaugaugcggacgaccugggcccugugcgaggcccugacccucgcgaccgggccgaucuccacgcugugggagggcaaccccgggcgcuucuggaacaccaccaucgccgucagcauggccaacaucuuccgcggcuccuaccuggccggcgcggggcuccuguucagcaucaugaagaacaccacgaacacccggcgcggcaccgggaacaccggcgagacgcugggcgagaaguggaagaaccggcucaacucccuggggaaguccgaguuccagaucuacaagcgcuccggcauccaggagguggaccggacccuggccaaggaggggaucaagcgcggcgagaccgaccaccacgccgugagccggggguccgccaagcuccgcugguucgucgagcggaaccuggugacccccgagggcaagguggucgaccugggcugcgggcgcggcggguggagcuacuacugcggcgggcucaagaacgugcgggaggugaagggccugacgaagggcgggcccggccacgaggagccgauccccauguccaccuacggguggaaccugguccgccuccagagcggcguggacguguucuucacgccgcccgagaagugcgacacccugcugugcgacaucggggaguccagcccgaaccccacggucgaggccggccggacccuccgcgugcugaaccugguggagaacuggcucaacaacaacacccaguucugcaucaagguccugaaccccuacaugccgagcgugaucgagaagauggagacccugcagcggaaguacggcggggcgcuggugcgcaacccccucucccggaacagcacccacgagauguacugggucuccaacgccagcggcaacaucguguccagcgugaacaugaucucccgcaugcugaucaaccgguucacgaugcgccacaagaaggccaccuacgagcccgacgucgaccuggggagcggcacccgcaacaucgggaucgaguccgagacccccaaccucgacaucaucggcaagcggaucgagaagaucaagcaggagcacgagacgagcuggcacuacgaccaggaccacccguacaagaccugggccuaccacggcuccuacgagaccaagcagaccgggagcgccuccagcauggugaacggcgugguccgccugcugacgaagcccugggacgugauccccauggugacccagauggcgaugaccgacaccacgcccuucgggcagcagcgggucuucaaggagaagguggacacccgcacccaggagccgaaggagggcaccaagaagcucaugaagaucacggccgaguggcuguggaaggagcugggcaagaagaagacgccccggaugugcacccgcgaggaguucgcccggaaggugcgcuccaacgccgcccucggggcgaucuucaccgacgagaacaaguggaaguccgcccgggaggccgucgaggacucccgcuucugggagcugguggacaaggagcggaaccugcaccucgagggcaagugcgagacgugcgucuacaacaugauggggaagcgcgagaagaagaucggcgaguucgggaaggccaagggcagccgggcgaucugguacauguggcugggcgcccgcuuccuggaguucgaggcccucggguuccugaacgaggaccacugguucucccgggagaacagccugagcggcguggagggggagggccuccacaagcugggguacauccugcgcgagguguccaagaaggagggcggcgccauguacgccgacgacaccgcggggugggacacccggaucacccucgaggaccugaagaacgaggagauggucacgaaccacauggagggcgagcacaagaagcuggccgaggccaucuucaagcucaccuaccagaacaagguggugcgcguccagcggcccacgccccgcgggaccgugauggacaucaucagccggcgcgaccagcgcggcuccggccaggugggcacguacggccugaacaccuucaccaacaugggggcccagcugauccggcagauggagggcgagggggucuucaagggcauccagcaccucaccgccacggaggagguggcggugcaggacuggcuggcccgcgucggccgggagcgccugagccggauggccaucuccggggacgacugcguggugaagccgcucgacgaccgcuucgccaacgcccugaccgcgcugaacgacaugggcaagguccggaaggacauccagcagugggagcccagccgcggguggaacgacuggacccaggugcccuucugcucccaccacuuccacgagcucaucaugaaggacggccgggugcuggucgugcccugccgcaaccaggacgagcugaucgggcgggcccgcaucagccagggcgccggcuggucccuccgggagaccgccugccugggcaagagcuacgcccagauguggucccugauguacuuccaccgccgggaccuccgccuggcggccaacgccaucugcagcgccgugccgucccacuggguccccacgagccggaccaccugguccauccacgcgcgccacgaguggaugaccaccgaggacaugcugacgguguggaaccggguguggauccaggagaaccccuggauggaggacaagacccccgucgagagcugggaggagaucccguaccucggcaagcgcgaggaccaguggugcgggucccugaucggccugaccagccgcgccaccugggcccggaacauccagacggccaucaaccaggugcgcagccucaucggguccgaggaguacaccgacuacaugcccagcaugaagcgguuccgccgggaggaggaggaggccggcgugcugugguga

SEQ ID NO: 9037 - RNA, 9876 nt, Artificial Sequence
  derived and/or modified CDS sequence (opt1) from DENV-2__KF041233__SS-prME
accgcgggcgugaucaucaugcugauccccaccgccauggcguuccaccucaccacccggaacggggagccccacaugaucgucagcaagcaggagaagggcaagagccugcuguucaagaccgaggacggggugaacaugugcacccucauggccauggaccugggcgagcugugcgaggacaccaucaccuacaacugcccccuccugcggcagaacgagcccgaggacaucgacugcuggugcaacagcaccuccaccugggugaccuacgggaccugcaccgccaccggcgagcaccgccgggagaagcgcagcgucgcccuggugccccacgugggcauggggcucgagacccggaccgagaccuggauguccagcgagggcgccuggaagcacgcgcagcgcaucgagaccuggauccugcggcaccccggguucaccaucauggccgccauccuggccuacaccaucggcaccaccuacuuccagcgcguccucaucuucauccugcugacggcgguggcccccuccaugaccaugcggugcaucgggaucagcaaccgcgacuucguggagggcgucuccggcgggagcuggguggacaucgugcucgagcacggcuccugcgucaccaccauggccaagaacaagcccacgcuggacuucgagcugaucaagaccgaggccaagcagcccgccacccuccggaaguacugcaucgaggcgaagcugaccaacacgaccaccgccagccgcugcccgacccagggggagcccucccugaacgaggagcaggacaagcgguucgugugcaagcacagcaugguggaccgcggcuggggcaacgggugcggccucuucgggaagggcgggaucgucacgugcgccauguucacgugcaagaagaacauggagggcaagaucgugcagcccgagaaccuggaguacaccaucguggucacgccccacuccggcgaggagaacgccguggggaacgacacgggcaagcacgggaaggagaucaaggugaccccgcagagcuccaucaccgaggccgagcugaccggcuacgggaccgucacgauggagugcagcccccggaccggccucgacuucaacgagauggugcugcugcagauggagaacaaggcguggcucgugcaccgccagugguuccuggaccugccccuccccuggcugccgggcgccgacauccagggguccaacuggauccagaaggagacccuggucaccuucaagaacccccacgccaagaagcaggacguggucgugcucggcagccaggagggggccaugcacacggcccugaccggcgcgaccgagauccagaugagcuccgggaaccuccuguucaccggccaccugaagugccggcugcgcauggacaagcuccagcugaagggcaugagcuacuccaugugcacggggaaguucaagguggucaaggagaucgccgagacccagcacggcaccaucguggugcggguccaguacgagggggacggcagccccugcaagauccccuucgagaucauggaccuggagaagcgccacgugcucggccggcugaucaccgugaacccgaucgucacggagaaggacucccccgugaacaucgaggccgagccgcccuucggggacagcuacaucaucaucggcguggagccggggcagcugaagcucuccugguucaagaagggcagcuccaucgggcagauguucgagaccaccaugcgcggcgccaagcgcauggccauccugggcgacaccgcgugggacuucgggagccugggcggggucuucacguccaucggcaaggcccuccaccagguguucggggccaucuacggcgccgcguucagcggcguguccuggaccaugaagauccugaucggggucgugaucaccuggaucggcaugaacagccgguccaccagccuguccgugagccugguccucguggggguggucacgcuguaccugggcgugauggugcaggccgacuccgggugcgucgugagcuggaagaacaaggagcucaagugcggcagcggcaucuucaucaccgacaacgugcacaccuggaccgagcaguacaaguuccagcccgagucccccagcaagcuggccgccgccauccagaaggcgcacgaggaggggaucugcggcauccgcuccgucacgcggcuggagaaccucauguggaagcagaucacccccgagcugaaccacauccugagcgagaacgaggugaagcucuccaucaugaccggggacaucaagggcaucaugcaggccgggaagcgcagccugcggccgcagcccaccgagcugaaguacuccuggaagacguggggcaaggccaagaugcucagcaccgagccccacaaccagaccuuccugaucgacggcccggagaccgccgagugccccaacacgaaccgcgccuggaacucccuggagguggaggacuacggguucggcgucuucaccaccaacaucuggcucaagcugaaggagcggcaggacguguucugcgacagcaagcugauguccgcggccaucaaggacaaccgcgccgugcacgccgacaugggguacuggaucgagagcgcccucaacgacaccuggaagaucgagaaggcguccuucaucgaggucaagagcugccacuggcccaagucccacacgcuguggagcaacggcgugcuggaguccgagaugaucauccccaagaacuucgccggcccggugagccagcacaacuaccggcccggguaccacacccagaccgccggccccuggcaccucgggaagcuggagauggacuucgacuucugcgagggcaccaccgucguggugacggaggacugcgggaaccgcggccccagccugcggaccaccaccgccuccggcaagcucaucacggaguggugcugccgcagcugcacccugccgccccugcgguaccgcggggaggacggcugcugguacgggauggagauccggccccucaaggagaaggaggagaaccuggucaacucccuggugaccgcgggccacgggcagaucgacaacuucagccucggcgugcugggcauggcccuguuccucgaggagaugcugcgcacccgggucgggacgaagcacgccgugcugcucaucgccguguccuucaugacccugaucaccggcaacaugagcuuccgcgaccuggggcgggucauggugauggugggcgccgcgaugaccgacgacaucgggaugggcgucacguaccucgcccugcuggccgccuucaaggugcgccccaccuucgccgcgggccuccugcugcgcaagcucaccuccaaggagcugaugaugaccacgaucgggaucgugcugcucagccaguccaccaccccggagaccauccuggagcugacggacgcccucgcccugggcaugaugauccugaagaucguccggaacauggagaaguaccagcucgccgugaccaucauggccauccugugcguccccaacgcggugauccugcagaacgccuggaaggugagcugcaccauccucgccgccgucuccgugagcccccugcugcucaccuccagccagcagaaggcggacuggaucccccuggcccugacgaucaaggggcucaacccgaccgccaucuuccugaccacccugucccgcacgaacaagaagcggagcuggccccucaacgaggccaucauggccgugggcauggucuccauccuggcgagcucccugcucaagaacgacauccccaugaccggcccccugguggccgggggccugcucaccgugugcuacguccugaccgggcgcagcgccgaccuggagcucgagcgggccgccgacgugcgcugggaggaccaggcggagaucagcggcuccagcccgauccuguccaucacgaucagcgaggacggguccaugagcaucaagaacgaggaggaggagcagacccugaccauccucauccggaccggccugcuggugaucuccggccucuuccccgucagcauccccaucacggccgccgccugguaccugugggaggugaagaagcagcgcgccggggugcugugggacguccccuccccgccgcccgugggcaaggcggagcucgaggacggggccuaccggaucaagcagaagggcauccugggguacagccagaucggcgccggcguguacaaggaggggaccuuccacaccauguggcacgucacccgcggcgccgugcugaugcacaaggggaagcggaucgagccguccugggccgacgugcgcaaggaccucaucagcuacggcgggggcuggaagcuggagggcgaguggaaggagggggaggagguccaggugcuggcgcucgagcccggcaagaacccccgggccgugcagaccaagcccgggcuguucaagacgaacaccggcaccaucggggccgucucccuggacuucagcccgggcaccuccggcagccccaucguggacaagaaggggaagguggucggccucuacgggaacggcguggugacgcgcuccggcaccuacgucagcgccaucgcgcagaccgagaaguccaucgaggacaaccccgagaucgaggacgacaucuuccggaagaagaagcugaccaucauggaccugcaccccggggccggcaagacgaagcgcuaccugccggccaucgugcgggaggccaucaagcgcgggcuccggacccugauccuggcccccacccgcguggucgcggccgagauggaggaggcccuccggggccugcccauccgcuaccagacccccgccauccgcgccgagcacacggggcgggagaucguggaccugaugugccacgcgaccuucaccaugcgccuccugagcccggugcggguccccaacuacaaccugaucaucauggacgaggcccacuucaccgaccccgccagcaucgccgcccgcggcuacaucuccacgcggguggagaugggcgaggcggccgggaucuucaugaccgccacgccgcccggcagccgcgaccccuucccccaguccaacgcccccaucauggacgaggagcgggagauccccgagcgcagcuggaacuccgggcacgagugggugaccgacuucaagggcaagacggucugguucgugcccagcaucaaggcggggaacgacaucgccgccugccuccggaagaacggcaagaaggugauccagcugucccgcaagaccuucgacagcgaguacaucaagacccggaccaacgacugggacuucgucgugacgaccgacaucuccgagaugggcgccaacuucaaggccgagcgcgugaucgacccccggcgcugcaugaagcccgucauccugaccgacggggaggagcgggugauccucgcgggcccgaugcccgugacccacagcuccgccgcccagcgccgggggcgcaucggccggaaccccaagaacgagaacgaccaguacaucuacaugggggagccccuggagaacgacgaggacugcgcccacuggaaggaggccaagaugcugcucgacaacaucaacacgccggagggcaucauccccagcauguucgagcccgagcgcgagaaggucgacgcgaucgacggcgaguaccgccugcgcggggaggcccgcaagaccuucguggaccugaugcggcgcggcgaccucccgguguggcuggccuaccgggucgccgccgaggggaucaacuacgcggaccgccgguggugcuucgacggcaucaagaacaaccagauccuggaggagaacguggaggucgagaucuggaccaaggagggggagcgcaagaagcucaagccccgguggcuggacgcccgcaucuacuccgacccccuggcccucaaggaguucaaggaguucgccgcgggccgcaagagccugacccugaaccucaucacggagaugggccgccugcccaccuucaugacccagaaggcccggaacgcccuggacaaccucgccgugcugcacaccgccgaggccggcgggcgcgccuacaaccacgcccuguccgagcucccggagacgcuggagacccugcuccugcugacccuccuggccaccgugaccggcgggaucuuccuguuccucaugagcgggaaggggaucgggaagaugacccuggggaugugcugcaucaucaccgccuccauccugcucugguacgcgcagauccagccccacuggaucgccgccagcaucauccuggaguucuuccugaucguccuccugauccccgagcccgagaagcagcggaccccgcaggacaaccagcugaccuacguggugaucgccauccucacggucguggccgcgaccauggccaacgagaugggcuuccuggagaagaccaagaaggacuucgggcugggcuccaucgccacccagcagcccgagagcaacauccucgacaucgaccugcgccccgccagcgccuggacgcuguacgcgguggccaccaccuucaucacccccaugcuccggcacuccaucgagaacagcuccgucaacgugagccugacggccaucgccaaccaggcgaccgugcugaugggccucgggaagggcuggccgcuguccaagauggacaucggggucccccugcucgccaucggcugcuacagccaggugaaccccaucacccugaccgccgcccugcuccugcugguggcccacuacgcgaucaucgggcccggccuccaggccaaggccacgcgcgaggcccagaagcgggccgcggccggcaucaugaagaacccgaccgucgacgggaucaccgugaucgaccuggaccccauccccuacgaccccaaguucgagaagcagcugggccaggugaugcuccugguccugugcgugacccaggugcucaugaugcgcacgaccugggcccugugcgaggcccugacccucgccaccgggccgaucuccacgcugugggagggcaaccccgggcgguucuggaacaccaccaucgcggucagcauggccaacaucuuccgcggcuccuaccuggccggcgccgggcuccuguucagcaucaugaagaacaccacgaacacccgccggggcaccgggaacaccggcgagacgcugggcgagaaguggaagaaccgccucaacucccugggcaagagcgaguuccagaucuacaagcgguccggcauccaggagguggaccgcacccuggcgaaggaggggaucaagcggggcgagaccgaccaccacgccgugagccgcggguccgccaagcuccggugguucgucgagcgcaaccuggugacccccgagggcaagguggucgaccugggcugcgggcggggcggguggagcuacuacugcggcgggcucaagaacgugcgcgaggugaagggccugacgaagggcgggcccggccacgaggagccgauccccauguccaccuacggguggaaccugguccggcuccagagcggcguggacguguucuucacgccgcccgagaagugcgacacccugcugugcgacaucggggaguccagcccgaaccccacggucgaggccggccgcacccuccgggugcugaaccugguggagaacuggcucaacaacaacacccaguucugcaucaagguccugaaccccuacaugccgagcgugaucgagaagauggagacccugcagcgcaaguacggcggggcccuggugcggaacccccucucccgcaacagcacccacgagauguacugggucuccaacgcgagcggcaacaucguguccagcgugaacaugaucucccggaugcugaucaaccgcuucacgaugcggcacaagaaggccaccuacgagcccgacgucgaccuggggagcggcacccgcaacaucgggaucgaguccgagacccccaaccucgacaucaucggcaagcgcaucgagaagaucaagcaggagcacgagacgagcuggcacuacgaccaggaccacccguacaagaccugggccuaccacggcuccuacgagaccaagcagaccgggagcgccuccagcauggugaacggcgugguccggcugcugacgaagcccugggacgugauccccauggugacccagauggccaugaccgacaccacgcccuucgggcagcagcgcgucuucaaggagaagguggacacccggacccaggagccgaaggagggcaccaagaagcucaugaagaucacggcggaguggcuguggaaggagcugggcaagaagaagacgccccggaugugcacccgggaggaguucgcccgcaaggugcgguccaacgccgcccucggggccaucuucaccgacgagaacaaguggaaguccgcgcgcgaggccgucgaggacucccgguucugggagcugguggacaaggagcgcaaccugcaccucgagggcaagugcgagacgugcgucuacaacaugauggggaagcgggagaagaagaucggcgaguucgggaaggccaagggcagccgcgccaucugguacauguggcugggcgcgcgguuccuggaguucgaggcccucggguuccugaacgaggaccacugguucucccgcgagaacagccugagcggcguggagggggagggccuccacaagcugggguacauccugcgggagguguccaagaaggagggcggcgccauguacgccgacgacaccgccgggugggacacccgcaucacccucgaggaccugaagaacgaggagauggucacgaaccacauggagggcgagcacaagaagcuggcggaggccaucuucaagcucaccuaccagaacaagguggugcggguccagcgccccacgccccgggggaccgugauggacaucaucagccgccgggaccagcgcggcuccggccaggugggcacguacggccugaacaccuucaccaacaugggggcccagcugauccgccagauggagggcgagggggucuucaagggcauccagcaccucaccgccacggaggagguggccgugcaggacuggcuggcgcgggucggccgcgagcggcugagccgcauggccaucuccggggacgacugcguggugaagccgcucgacgaccgguucgccagcgcccugaccgcccugaacgacaugggcaagguccgcaaggacauccagcagugggagcccucccggggguggaacgacuggacccaggugcccuucugcagccaccacuuccacgagcucaucaugaaggacggccgcgugcuggucgugcccugccggaaccaggacgagcugaucgggcgcgcgcggaucucccagggcgccggcuggagccuccgcgagaccgccugccuggggaaguccuacgcccagauguggagccugauguacuuccaccggcgcgaccuccggcuggccgcgaacgccaucugcuccgccgugccgagccacuggguccccacgucccgcaccaccuggagcauccacgcccggcacgaguggaugaccaccgaggacaugcugacgguguggaaccgcguguggauccaggagaaccccuggauggaggacaagacccucgucgaguccugggaggagauccccuaccugggcaagcgggaggaccaguggugcgggagccugaucggccucaccagccgcgcgaccugggcccgcaacauccagacggccaucaaccaggugcggucccugaucgggagcgaggaguacaccgacuacaugccguccaugaagcgcuuccggcgcgaggaggaggaggccggcgugcugugguga

SEQ ID NO: 9038 - RNA, 9876 nt, Artificial Sequence
  derived and/or modified CDS sequence (opt1) from DENV-2__KF041234__SS-prME
accgcgggcgugaucaucaugcugauccccaccgccauggcguuccaccucaccacccgcaacggggagccccacaugaucgucagcaagcaggagaagggcaagagccugcuguucaagaccgaggacggggugaacaugugcacccucauggccauggaccugggcgagcugugcgaggacaccaucaccuacaacugcccccuccugcggcagaacgagcccgaggacaucgacugcuggugcaacgccaccagcaccugggugaccuacgggaccugcaccgccaccggcgagcaccgccgggagaagcgcuccgucgcccuggugccccacgugggcauggggcucgagacccggaccgagaccuggaugagcuccgagggcgcguggaagcacgcccagcgcaucgagaccuggauccugcggcaccccggguucaccaucauggccgccauccuggcguacaccaucggcaccaccuacuuccagcgcguccucaucuucauccugcugacggccguggcccccagcaugaccaugcggugcaucgggaucuccaaccgcgacuucguggagggcgucagcggcggguccuggguggacaucgugcucgagcacggcagcugcgucaccaccauggccaagaacaagcccacgcuggacuucgagcugaucaagaccgaggccaagcagcccgcgacccuccggaaguacugcaucgaggccaagcugaccaacacgaccaccgccucccgcugcccgacccagggggagcccagccugaacgaggagcaggacaagcgguucgugugcaagcacuccaugguggaccgcggcuggggcaacgggugcggccucuucgggaagggcgggaucgucacgugcgccauguucacgugcaagaagaacauggagggcaagaucgugcagcccgagaaccuggaguacaccaucguggucacgccccacagcggcgaggagaacgccguggggaacgacacgggcaagcacgggaaggagaucaaggugaccccgcaguccagcaucaccgaggcggagcugaccggcuacgggaccgucacgauggagugcagcccccggaccggccucgacuucaacgagauggugcugcugcagauggagaacaaggccuggcucgugcaccgccagugguuccuggaccugccccuccccuggcugccgggcgccgacauccaggggagcaacuggauccagaaggagacccuggucaccuucaagaacccccacgccaagaagcaggacguggucgugcucggcucccaggagggggccaugcacacggcgcugaccggcgccaccgagauccagaugagcagcgggaaccuccuguucaccggccaccugaagugccggcugcgcauggacaagcuccagcugaagggcauguccuacagcaugugcacggggaaguucaaggugaucaaggagaucgccgagacccagcacggcaccaucgucgugcgggugcaguacgagggggacggcucccccugcaagauccccuucgagaucauggaccuggagaagcgccacguccucggccggcugaucaccgugaacccgaucgugacggagaaggacagccccgucaacaucgaggccgagccgcccuucggggacuccuacaucaucaucggcguggagccggggcagcugaagcucagcugguucaagaagggcuccagcaucgggcagauguucgagaccaccaugcgcggcgccaagcgcauggcgauccugggcgacaccgccugggacuucgggucccugggcgggguguucacgagcaucggcaaggcccuccaccaggucuucggggccaucuacggcgcggccuucuccggcgugagcuggaccaugaagauccugaucgggguggucaucaccuggaucggcaugaacucccggagcaccucccugagcgugucccuggugcucgucgggguggugacgcuguaccugggcgucauggugcaggccgacagcgggugcguggucuccuggaagaacaaggagcucaagugcggcagcggcaucuucaucaccgacaacgugcacaccuggaccgagcaguacaaguuccagcccgagagccccuccaagcuggccagcgccauccagaaggcgcacgaggaggggaucugcggcauccgcuccgugacgcggcuggagaaccucauguggaagcagaucacccccgagcugaaccacauccugagcgagaacgaggucaagcucuccaucaugaccggggacaucaagggcaucaugcaggccgggaagcgcagccugcggccgcagcccaccgagcugaaguacuccuggaagacguggggcaaggccaagaugcucagcaccgagccccacaaccagaccuuccugaucgacggcccggagaccgccgagugccccaacacgaaccgcgccuggaacucccuggagguggaggacuacggguucggcguguucaccaccaacaucuggcucaagcugaaggagcggcaggacgucuucugcgacagcaagcugauguccgcggccaucaaggacaaccgcgccgugcacgccgacaugggguacuggaucgagagcgcccucaacgacaccuggaagaucgagaaggcguccuucaucgaggucaagagcugccacuggcccaagucccacacgcuguggagcaacggcgugcuggaguccgagaugaucauccccaagaacuucgccggcccggugagccagcacaacuaccggcccggguaccacacccagaccgccggccccuggcaccucgggaagcuggagauggacuucgacuucugcgagggcaccaccguggucgugacggaggacugcgggaaccgcggccccagccugcggaccaccaccgccuccggcaagcucaucacggaguggugcugccgcagcugcacccugccgccccugcgguaccgcggggaggacggcugcugguacgggauggagauccggccccucaaggagaaggaggagaaccuggugaacucccuggucaccgcgggccacgggcagaucgacaacuucagccucggcgugcugggcauggcccuguuccucgaggagaugcugcgcacccggguggggacgaagcacgccguccugcucguggccguguccuucaugacccugaucaccggcaacaugagcuuccgcgaccuggggcgggucauggugauggugggcgccgcgaugaccgacgacaucgggaugggcgucacguaccucgcccugcuggccgccuucaaggugcgccccaccuucgccgcgggccuccugcugcgcaagcucaccuccaaggagcugaugaugaccacgaucgggaucgugcugcucagccaguccaccaccccggagaccauccuggagcugacggacgcccucgcccugggcaugaugauccugaagaucguccggaacauggagaaguaccagcucgccgugaccaucauggccauccugugcguccccaacgcggugauccugcagaacgccuggaaggugagcugcaccauccucgccgccgucuccgugagcccccugcugcucaccuccagccagcagaaggcggacuggaucccccuggcccugacgaucaaggggcucaacccgaccgccaucuuccugaccacccugucccgcacgaacaagaagcggagcuggccccucaacgaggccaucauggccgugggcauggucuccauccuggcgagcucccugcucaagaacgacauccccaugaccggcccccugguggccgggggccugcucaccgugugcuacguccugaccgggcgcagcgccgaccuggagcucgagcgggccgccgacgugcgcugggaggaccaggcggagaucagcggcuccagcccgauccuguccaucacgaucagcgaggacggguccaugagcaucaagaacgaggaggaggagcagacccugaccauccucauccggaccggccugcuggugaucuccggccucuuccccgucagcauccccaucacggccgccgccugguaccugugggaggugaagaagcagcgcgccggggugcugugggacguccccuccccgccgcccgugggcaaggcggagcucgaggacggggccuaccggaucaagcagaagggcauccugggguacagccagaucggcgccggcguguacaaggaggggaccuuccacaccauguggcacgucacccgcggcgccgugcugaugcacaaggggaagcggaucgagccguccugggccgacgugcgcaaggaccucaucagcuacggcgggggcuggaagcuggagggcgaguggaaggagggggaggagguccaggugcuggcgcucgagcccggcaagaacccccgggccgugcagaccaagcccgggcuguucaagacgaacaccggcaccaucggggccgucucccuggacuucagcccgggcaccuccggcagccccaucguggacaagaaggggaagguggucggccucuacgggaacggcguggugacgcgcuccggcaccuacgucagcgccaucgcgcagaccgagaaguccaucgaggacaaccccgagaucgaggacgacaucuuccggaagaagcgccugaccaucauggaccugcaccccggggccggcaagacgaagcgguaccugccggccaucgugcgcgaggccaucaagcgggggcuccgcacccugauccuggcccccacccggguggucgcggccgagauggaggaggcccuccgcggccugcccauccgcuaccagacccccgccauccgggccgagcacacggggcgcgagaucguggaccugaugugccacgcgaccuucaccaugcggcuccugagcccggugcgcguccccaacuacaaccugaucaucauggacgaggcccacuucaccgaccccgccagcaucgccgcccggggcuacaucuccacgcgcguggagaugggcgaggcggccgggaucuucaugaccgccacgccgcccggcagccgggaccccuucccccaguccaacgcccccaucauggacgaggagcgcgagauccccgagcggagcuggaacuccgggcacgagugggugaccgacuucaagggcaagacggucugguucgugcccagcaucaaggcggggaacgacaucgccgccugccuccgcaagaacggcaagaaggugauccagcugucccggaagaccuucgacagcgaguacaucaagacccgcaccaacgacugggacuucgucgugacgaccgacaucuccgagaugggcgccaacuucaaggccgagcgggugaucgacccccgccggugcaugaagcccgucauccugaccgacggggaggagcgcgugauccucgcgggcccgaugcccgugacccacagcuccgccgcccagcggcgcgggcggaucggccgcaaccccaagaacgagaacgaccaguacaucuacaugggggagccccuggagaacgacgaggacugcgcccacuggaaggaggccaagaugcugcucgacaacaucaacacgccggagggcaucauccccagcauguucgagcccgagcgcgagaaggucgacgcgaucgacggcgaguaccggcugcgcggggaggcccggaagaccuucguggaccugaugcgccggggcgaccucccgguguggcuggccuaccgcgucgccgccgaggggaucaacuacgcggaccggcgcuggugcuucgacggcaucaagaacaaccagauccuggaggagaacguggaggucgagaucuggaccaaggagggggagcggaagaagcucaagccccgcuggcuggacgcccggaucuacuccgacccccuggcccucaaggaguucaaggaguucgccgcgggccgcaagagccugacccugaaccucaucacggagaugggccggcugcccaccuucaugacccagaaggcccgcaacgcccuggacaaccucgccgugcugcacaccgccgaggccggcgggcgggccuacaaccacgcccuguccgagcucccggagacgcuggagacccugcuccugcugacccuccuggccaccgugaccggcgggaucuuccuguuccucaugagcgggaaggggaucggcaagaugacccuggggaugugcugcaucaucaccgccuccauccugcucugguacgcgcagauccagccccacuggaucgccgccagcaucauccuggaguucuuccugaucguccuccugauccccgagcccgagaagcagcgcaccccgcaggacaaccagcugaccuacguggugaucgccauccucacggucguggccgcgaccauggccaacgagaugggcuuccuggagaagaccaagaaggacuucgggcugggcuccaucgccacccagcagcccgagagcaacauccucgacaucgaccugcggcccgccagcgccuggacgcuguacgcgguggccaccaccuucaucacccccaugcuccgccacuccaucgagaacagcuccgucaacgugagccugacggccaucgccaaccaggcgaccgugcugaugggccucgggaagggcuggccgcuguccaagauggacaucggggucccccugcucgccaucggcugcuacagccaggugaaccccaucacccugaccgccgcccugcuccugcugguggcccacuacgcgaucaucgggcccggccuccaggccaaggccacgcgggaggcccagaagcgcgccgcggccggcaucaugaagaacccgaccgucgacgggaucaccgugaucgaccuggaccccauccccuacgaccccaaguucgagaagcagcugggccaggugaugcuccugguccugugcgugacccaggugcucaugaugcggacgaccugggcccugugcgaggcccugacccucgccaccgggccgaucuccacgcugugggagggcaaccccgggcgcuucuggaacaccaccaucgcggucagcauggccaacaucuuccgcggcuccuaccuggccggcgccgggcuccuguucagcaucaugaagaacaccacgaacacccggcgcggcaccgggaacaccggcgagacgcugggcgagaaguggaagaaccggcucaacucccuggggaaguccgaguuccagaucuacaagcgcuccggcauccaggagguggaccggacccuggcgaaggaggggaucaagcgcggcgagaccgaccaccacgccgugagccggggguccgccaagcuccgcugguucgucgagcggaaccuggugacccccgagggcaagguggucgaccugggcugcgggcgcggcggguggagcuacuacugcggcgggcucaagaacgugcgggaggugaagggccugacgaagggcgggcccggccacgaggagccgauccccauguccaccuacggguggaaccugguccgccuccagagcggcguggacguguucuucacgccgcccgagaagugcgacacccugcugugcgacaucggggaguccagcccgaaccccacggucgaggccggccggacccuccgcgugcugaaccugguggagaacuggcucaacaacaacacccaguucugcaucaagguccugaaccccuacaugccgagcgugaucgagaagauggagacccugcagcggaaguacggcggggcccuggugcgcaacccccucucccggaacagcacccacgagauguacugggucuccaacgcgagcggcaacaucguguccagcgugaacaugaucucccgcaugcugaucaaccgguucacgaugcgccacaagaaggccaccuacgagcccgacgucgaccuggggagcggcacccgcaacaucgggaucgaguccgagacccccaaccucgacaucaucggcaagcggaucgagaagaucaagcaggagcacgagacgagcuggcacuacgaccaggaccacccguacaagaccugggccuaccacggcuccuacgagaccaagcagaccgggagcgccuccagcauggugaacggcgugguccgccugcugacgaagcccugggacgugauccccauggugacccagauggccaugaccgacaccacgcccuucgggcagcagcgggucuucaaggagaagguggacacccgcacccaggagccgaaggagggcaccaagaagcucaugaagaucacggcggaguggcuguggaaggagcugggcaagaagaagacgccccggaugugcacccgcgaggaguucgcccggaaggugcgcuccaacgccgcccucggggccaucuucaccgacgagaacaaguggaaguccgcgcgggaggccgucgaggacucccgcuucugggagcugguggacaaggagcgggaccugcaccucgagggcaagugcgagacgugcgucuacaacaugauggggaagcgcgagaagaagaucggcgaguucgggaaggccaagggcagccgggccaucugguacauguggcugggcgcgcgcuuccuggaguucgaggcccucggguuccugaacgaggaccacugguucucccgggagaacagccugagcggcguggagggggagggccuccacaagcugggguacauccugcgcgagguguccaagaaggagggcggcgccauguacgccgacgacaccgccgggugggacacccggaucacccucgaggaccugaagaacgaggagauggucacgaaccacauggagggcgagcacaagaagcuggcggaggccaucuucaagcucaccuaccagaacaagguggugcgcguccagcggcccacgccccgcgggaccgugauggacaucaucagccggcgcgaccagcgcggcuccggccaggugggcacguacggccugaacaccuucaccaacaugggggcccagcugauccggcagauggagggcgagggggucuucaagggcauccagcaccucaccgccacggaggagguggccgugcaggacuggcuggcgcgcgucggccgggagcgccugagccggauggccaucuccggggacgacugcguggugaagccgcucgacgaccgcuucgccaacgcccugaccgcccugaacgacaugggcaagguccggaaggacauccagcagugggagcccagccgcgggugguccgacuggacccaggugcccuucugcagccaccacuuccacgagcucaucaugaaggacggccgggugcuggucgugcccugccgcaaccaggacgagcugaucgggcgggcgcgcaucucccagggcgccggcuggagccuccgggagaccgccugccuggggaaguccuacgcccagauguggagccugauguacuuccaccgccgggaccuccgccuggccgcgaacgccaucugcuccgccgugccgagccacuggguccccacgucccggaccaccuggagcauccacgcccgccacgaguggaugaccaccgaggacaugcugacgguguggaaccggguguggauccaggagaaccccuggauggaggacaagacccccgucgaguccugggaggagaucccguaccucggcaagcgcgaggaccaguggugcgggagccugaucggccugaccagccgcgcgaccugggcccggaacauccagacggccaucaaccaggugcgcucccucaucgggagcgaggaguacaccgacuacaugcccuccaugaagcgguuccgccgggaggaggaggaggccggcgugcugugguga

SEQ ID NO: 9039 - RNA, 9876 nt, Artificial Sequence
  derived and/or modified CDS sequence (opt1) from DENV-2__KF041235__SS-prME
accgcgggcgugaucaucaugcugauccccaccgccauggcguuccaccucaccacccgcaacggggagccccacaugaucgugagcaagcaggagaagggcaagucccugcuguucaagaccgaggacggggugaacaugugcacccucauggccauggaccugggcgagcugugcgaggacaccaucaccuacaacugcccccuccugcggcagaacgagcccgaggacaucgacugcuggugcaacagcaccuccaccugggugaccuacgggaccugcaccgccaccggcgagcaccgccgggagaagcgcagcgucgcccuggugccccacgugggcauggggcucgagacccggaccgagaccuggauguccagcgagggcgccuggaagcacgcgcagcgcaucgagaccuggauccugcggcaccccggguucaccaucauggccgccauccuggccuacaccaucggcaccaccuacuuccagcgcguccucaucuucauccugcugacggcgguggcccccuccaugaccaugcggugcaucgggaucagcaaccgcgacuucguggagggcgucuccggcgggagcuggguggacaucgugcucgagcacggcuccugcgucaccaccauggccaagaacaagcccacgcuggacuucgagcugaucaagaccgaggccaagcagcccgccacccuccggaaguacugcaucgaggcgaagcugaccaacacgaccaccgccagccgcugcccgacccagggggagcccucccugaacgaggagcaggacaagcgguucgugugcaagcacagcaugguggaccgcggcuggggcaacgggugcggccucuucgggaagggcgggaucgucacgugcgccauguucacgugcaagaagaacauggagggcaagaucgugcagcccgagaaccuggaguacaccaucguggucacgccccacuccggcgaggagaacgccguggggaacgacacgggcaagcacgggaaggagaucaaggugaccccgcagagcuccaucaccgaggccgagcugaccggcuacgggaccgucacgauggagugcagcccccggaccggccucgacuucaacgagauggugcugcugcagauggagaacaaggcguggcucgugcaccgccagugguuccuggaccugccccuccccuggcugccgggcgccgacauccagggguccaacuggauccagaaggagacccuggucaccuucaagaacccccacgccaagaagcaggacguggucgugcucggcagccaggagggggccaugcacacggcccugaccggcgcgaccgagauccagaugagcuccgggaaccuccuguucaccggccaccugaagugccggcugcgcauggacaagcuccagcugaagggcaugagcuacuccaugugcacggggaaguucaagguggucaaggagaucgccgagacccagcacggcaccaucguggugcggguccaguacgagggggacggcagccccugcaagauccccuucgagaucauggaccuggagaagcgccacgugcucggccggcugaucaccgugaacccgaucgucacggagaaggacucccccgugaacaucgaggccgagccgcccuucggggacagcuacaucaucaucggcguggagccggggcagcugaagcucuccugguucaagaagggcagcuccaucgggcagauguucgagaccaccaugcgcggcgccaagcgcauggccauccugggcgacaccgcgugggacuucgggagccugggcggggucuucacguccaucggcaaggcccuccaccagguguucggggccaucuacggcgccgcguucagcggcguguccuggaccaugaagauccugaucggggucgugaucaccuggaucggcaugaacagccgguccaccagccuguccgugagccugguccucguggggguggucacgcuguaccugggcgugauggugcaggccgacuccgggugcgucgugagcuggaagaacaaggagcucaagugcggcagcggcaucuucaucaccgacaacgugcacaccuggaccgagcaguacaaguuccagcccgagucccccagcaagcuggccuccgccauccagaaggcccacgaggaggggaucugcggcauccgcagcgucacgcggcuggagaaccucauguggaagcagaucacccccgagcugaaccacauccuguccgagaacgaggugaagcucagcaucaugaccggggacaucaagggcaucaugcaggcggggaagcgcucccugcggccgcagcccaccgagcugaaguacagcuggaagacguggggcaaggccaagaugcucuccaccgagccccacaaccagaccuuccugaucgacggcccggagaccgccgagugccccaacacgaaccgcgccuggaacagccuggagguggaggacuacggguucggcgucuucaccaccaacaucuggcucaagcugaaggagcggcaggacguguucugcgacuccaagcugaugagcgccgcgaucaaggacaaccgcgccgugcacgccgacaugggguacuggaucgaguccgcccucaacgacaccuggaagaucgagaaggccagcuucaucgaggucaaguccugccacuggcccaagagccacacgcugugguccaacggcgugcuggagagcgagaugaucauccccaagaacuucgcgggcccggugagccagcacaacuaccggcccggguaccacacccagaccgccggccccuggcaccucgggaagcuggagauggacuucgacuucugcgagggcaccaccgucguggugacggaggacugcgggaaccgcggccccucccugcggaccaccaccgccagcggcaagcucaucacggaguggugcugccgcuccugcacccugccgccccugcgguaccgcggggaggacggcugcugguacgggauggagauccggccccucaaggagaaggaggagaaccuggucaacagccuggugaccgccggccacgggcagaucgacaacuucucccucggcgugcugggcauggcgcuguuccucgaggagaugcugcgcacccgggucgggacgaagcacgccgugcugcucguggccgucagcuucaugacccugaucaccggcaacauguccuuccgcgaccuggggcgggugauggugauggucggcgccgccaugaccgacgacaucgggaugggcgugacguaccucgcgcugcuggccgccuucaaggugcgccccaccuucgccgccggccuccugcugcgcaagcucaccagcaaggagcugaugaugaccacgaucgggaucguccugcucucccagagcaccaccccggagaccauccuggagcugacggacgcgcucgcccugggcaugaugauccugaagaucgugcggaacauggagaaguaccagcucgccgucaccaucauggccauccugugcgugcccaacgccgugauccugcagaacgcguggaaggucuccugcaccauccucgccgccgugagcgugagcccccugcugcucaccagcucccagcagaaggccgacuggaucccccuggcgcugacgaucaaggggcucaacccgaccgccaucuuccugaccacccugagccgcacgaacaagaagcgguccuggccccucaacgaggccaucauggccgucggcauggugagcauccuggccuccagccugcucaagaacgacauccccaugaccggcccccugguggccggcgggcugcucaccgucugcuacgugcugaccgggcgcagcgccgaccuggagcucgagcgggccgccgacgugcgcugggaggaccaggccgagaucuccgggagcuccccgauccugagcaucacgaucuccgaggacgggagcauguccaucaagaacgaggaggaggagcagacccugaccauccucauccggaccggccugcuggucaucagcggccucuuccccguguccauccccaucacggcggccgccugguaccugugggaggugaagaagcagcgcgccgggguccugugggacgugcccagcccgccgcccgugggcaaggccgagcucgaggacggggcguaccggaucaagcagaagggcauccugggguacucccagaucggcgccggcgucuacaaggaggggaccuuccacaccauguggcacgugacccgcggcgccgugcugaugcacaaggggaagcggaucgagccgagcugggccgacguccgcaaggaccucaucuccuacggcgggggcuggaagcuggagggcgaguggaaggagggggaggagguccaggugcuggcccucgagcccggcaagaacccccgggcgguccagaccaagcccgggcuguucaagacgaacaccggcaccaucggggccgugagccuggacuucuccccgggcaccagcggcucccccaucguggacaagaaggggaaggucgugggccucuacgggaacggcguggucacgcgcagcggcaccuacguguccgccaucgcccagaccgagaaguccaucgaggacaaccccgagaucgaggacgacaucuuccggaagaagcgccugaccaucauggaccugcaccccggggcgggcaagacgaagcgguaccugccggccaucgugcgcgaggccaucaagcgggggcuccgcacccugauccuggcccccacccgggucguggccgcggagauggaggaggcccuccgcggccugcccauccgcuaccagacccccgccauccgggccgagcacacggggcgcgagaucguggaccugaugugccacgccaccuucaccaugcggcuccugagcccgguccgcgugcccaacuacaaccugaucaucauggacgaggcgcacuucaccgaccccgccuccaucgccgcccggggcuacaucagcacgcgcguggagaugggcgaggccgcggggaucuucaugaccgccacgccgcccggcucccgggaccccuucccccagagcaacgcccccaucauggacgaggagcgcgagauccccgagcgguccuggaacagcgggcacgagugggucaccgacuucaagggcaagacggugugguucgugcccuccaucaaggccgggaacgacaucgcggccugccuccgcaagaacggcaagaaggucauccagcugagccggaagaccuucgacuccgaguacaucaagacccgcaccaacgacugggacuucguggugacgaccgacaucagcgagaugggcgccaacuucaaggccgagcgggucaucgacccccgccggugcaugaagcccgugauccugaccgacggggaggagcgcgugauccucgccggcccgaugcccgucacccacuccagcgcggcccagcggcgcgggcggaucggccgcaaccccaagaacgagaacgaccaguacaucuacaugggggagccccuggagaacgacgaggacugcgcccacuggaaggaggccaagaugcugcucgacaacaucaacacgccggagggcaucauccccuccauguucgagcccgagcgcgagaagguggacgccaucgacggcgaguaccggcugcgcggggaggcgcggaagaccuucguggaccugaugcgccggggcgaccucccggucuggcuggccuaccgcguggccgccgaggggaucaacuacgccgaccggcgcuggugcuucgacggcaucaagaacaaccagauccuggaggagaacgucgagguggagaucuggaccaaggagggggagcggaagaagcucaagccccgcuggcuggacgcgcggaucuacagcgacccccuggcccucaaggaguucaaggaguucgccgccggccgcaagucccugacccugaaccucaucacggagaugggccggcugcccaccuucaugacccagaaggcgcgcaacgcccuggacaaccucgccgugcugcacaccgccgaggccgggggccgggcguacaaccacgcccugagcgagcucccggagacgcuggagacccugcuccugcugacccuccuggccaccgucaccgggggcaucuuccuguuccucauguccggcaaggggaucggcaagaugacccuggggaugugcugcaucaucaccgccagcauccugcucugguacgcccagauccagccccacuggaucgcggccuccaucauccuggaguucuuccugaucgugcuccugauccccgagcccgagaagcagcgcaccccgcaggacaaccagcugaccuacguggucaucgccauccucacggugguggccgccaccauggcgaacgagaugggcuuccuggagaagaccaagaaggacuucgggcugggcagcaucgccacccagcagcccgagagcaacauccucgacaucgaccugcggcccgccuccgccuggacgcuguacgccgucgcgaccaccuucaucacccccaugcuccgccacagcaucgagaacuccagcgugaacgugucccugacggccaucgccaaccaggccaccguccugaugggccucgggaagggcuggccgcugagcaagauggacaucggggugccccugcucgcgaucggcugcuacucccaggugaaccccaucacccugaccgccgcccugcuccugcuggucgcccacuacgccaucaucgggcccggccuccaggcgaaggccacgcgggaggcccagaagcgcgccgccgcgggcaucaugaagaacccgaccguggacgggaucaccgugaucgaccuggaccccauccccuacgaccccaaguucgagaagcagcugggccaggucaugcuccuggugcugugcgugacccagguccucaugaugcggacgaccugggcccugugcgaggcccugacccucgccaccgggccgaucagcacgcugugggagggcaaccccgggcgcuucuggaacaccaccaucgccguguccauggcgaacaucuuccgcggcagcuaccuggccggcgccgggcuccuguucuccaucaugaagaacaccacgaacacccggcgcggcaccgggaacaccggcgagacgcugggcgagaaguggaagaaccggcucaacagccuggggaaguccgaguuccagaucuacaagcgcagcggcauccaggagguggaccggacccuggccaaggaggggaucaagcgcggcgagaccgaccaccacgcggucucccgggggagcgccaagcuccgcugguucguggagcggaaccuggugacccccgagggcaaggucguggaccugggcugcgggcgcggcgggugguccuacuacugcggcgggcucaagaacgugcgggaggucaagggccugacgaagggcgggcccggccacgaggagccgauccccaugagcaccuacggguggaaccuggugcgccuccaguccggcguggacgucuucuucacgccgcccgagaagugcgacacccugcugugcgacaucggggagagcagcccgaaccccacgguggaggccggccggacccuccgcgugcugaaccuggucgagaacuggcucaacaacaacacccaguucugcaucaaggugcugaaccccuacaugccguccgugaucgagaagauggagacccugcagcggaaguacggcggggcccugguccgcaacccccucagccggaacuccacccacgagauguacugggugagcaacgccuccggcaacaucgugagcuccgucaacaugaucagccgcaugcugaucaaccgguucacgaugcgccacaagaaggcgaccuacgagcccgacguggaccugggguccggcacccgcaacaucgggaucgagagcgagacccccaaccucgacaucaucggcaagcggaucgagaagaucaagcaggagcacgagacguccuggcacuacgaccaggaccacccguacaagaccugggccuaccacggcagcuacgagaccaagcagaccggguccgccagcuccauggugaacggcgucgugcgccugcugacgaagcccugggacgugauccccauggucacccagauggccaugaccgacaccacgcccuucgggcagcagcggguguucaaggagaagguggacacccgcacccaggagccgaaggagggcaccaagaagcucaugaagaucacggccgaguggcuguggaaggagcugggcaagaagaagacgccccggaugugcacccgcgaggaguucgcgcggaagguccgcagcaacgccgcccucggggccaucuucaccgacgagaacaaguggaaguccgcccgggaggcgguggaggacagccgcuucugggagcuggucgacaaggagcggaaccugcaccucgagggcaagugcgagacgugcguguacaacaugauggggaagcgcgagaagaagaucggcgaguucgggaaggccaagggcucccgggccaucugguacauguggcugggcgcccgcuuccuggaguucgaggcgcucggguuccugaacgaggaccacugguucagccgggagaacagccuguccggcguggagggggagggccuccacaagcugggguacauccugcgcgaggucagcaagaaggagggcggcgccauguacgccgacgacaccgccgggugggacacccggaucacccucgaggaccugaagaacgaggagauggugacgaaccacauggagggcgagcacaagaagcuggccgaggcgaucuucaagcucaccuaccagaacaaggugguccgcgugcagcggcccacgccccgcgggaccgugauggacaucaucucccggcgcgaccagcgcggcagcgggcaggucggcacguacggccugaacaccuucaccaacaugggggcccagcugauccggcagauggagggcgaggggguguucaagggcauccagcaccucaccgccacggaggagguggccguccaggacuggcuggcccgcgugggccgggagcgccugucccggauggcgaucagcggggacgacugcguggucaagccgcucgacgaccgcuucgccuccgcccugaccgcccugaacgacaugggcaaggugcggaaggacauccagcagugggagcccagccgcggguggaacgacuggacccaggugcccuucugcucccaccacuuccacgagcucaucaugaaggacggccggguccugguggugcccugccgcaaccaggacgagcugaucgggcgggcccgcaucagccagggcgcgggcuggucccuccgggagaccgccugccugggcaagagcuacgcccagauguggucccugauguacuuccaccgccgggaccuccgccuggccgccaacgcgaucugcagcgccgucccgucccacugggugcccacgagccggaccaccugguccauccacgcccgccacgaguggaugaccaccgaggacaugcugacgguguggaaccgggucuggauccaggagaaccccuggauggaggacaagacccccguggagagcugggaggagaucccguaccucggcaagcgcgaggaccaguggugcgggagccugaucggccugaccucccgcgccaccugggcgcggaacauccagacggccaucaaccaggugcgcagccucaucggguccgaggaguacaccgacuacaugcccagcaugaagcgguuccgccgggaggaggaggaggccggcguccugugguga

SEQ ID NO: 9040 - RNA, 9876 nt, Artificial Sequence
  derived and/or modified CDS sequence (opt1) from DENV-2__KF041237__SS-prME
accgcgggcgugaucaucaugcugauccccaccgccauggcguuccaccucaccacccgcaacggggagccccacaugaucgugagcaagcaggagaagggcaagucccugcuguucaagaccgaggacggggugaacaugugcacccucauggccauggaccugggcgagcugugcgaggacaccaucaccuacaacugcccccuccugcggcagaacgagcccgaggacaucgacugcuggugcaacagcaccuccaccugggugaccuacgggaccugcaccgccaccggcgagcaccgccgggagaagcgcagcgucgcccuggugccccacgugggcauggggcucgagacccggaccgagaccuggauguccagcgagggcgccuggaagcacgcgcagcgcaucgagaccuggauccugcggcaccccggguucaccaucauggccgccauccuggccuacaccaucggcaccaccuacuuccagcgcguccucaucuucauccugcugacggcgguggcccccuccaugaccaugcggugcaucgggaucagcaaccgcgacuucguggagggcgucuccggcgggagcuggguggacaucgugcucgagcacggcuccugcgucaccaccauggccaagaacaagcccacgcuggacuucgagcugaucaagaccgaggccaagcagcccgccacccuccggaaguacugcaucgaggcgaagcugaccaacacgaccaccgccagccgcugcccgacccagggggagcccucccugaacgaggagcaggacaagcgguucgugugcaagcacagcaugguggaccgcggcuggggcaacgggugcggccucuucgggaagggcgggaucgucacgugcgccauguucacgugcaagaagaacauggagggcaagaucgugcagcccgagaaccuggaguacaccaucguggucacgccccacuccggcgaggagaacgccguggggaacgacacgggcaagcacgggaaggagaucaaggugaccccgcagagcuccaucaccgaggccgagcugaccggcuacgggaccgucacgauggagugcagcccccggaccggccucgacuucaacgagauggugcugcugcagauggagaacaaggcguggcucgugcaccgccagugguuccuggaccugccccuccccuggcugccgggcgccgacauccagggguccaacuggauccagaaggagacccuggucaccuucaagaacccccacgccaagaagcaggacguggucgugcucggcagccaggagggggccaugcacacggcccugaccggcgcgaccgagauccagaugagcuccgggaaccuccuguucaccggccaccugaagugccggcugcgcauggacaagcuccagcugaagggcaugagcuacuccaugugcacggggaaguucaagguggucaaggagaucgccgagacccagcacggcaccaucguggugcggguccaguacgagggggacggcagccccugcaagauccccuucgagaucauggaccuggagaagcgccacgugcucggccggcugaucaccgugaacccgaucgucacggagaaggacucccccgugaacaucgaggccgagccgcccuucggggacagcuacaucaucaucggcguggagccggggcagcugaagcucuccugguucaagaagggcagcuccaucgggcagauguucgagaccaccaugcgcggcgccaagcgcauggccauccugggcgacaccgcgugggacuucgggagccugggcggggucuucacguccaucggcaaggcccuccaccagguguucggggccaucuacggcgccgcguucagcggcguguccuggaccaugaagauccugaucggggucgugaucaccuggaucggcaugaacagccgguccaccagccuguccgugagccugguccucguggggguggucacgcuguaccugggcgugauggugcaggccgacuccgggugcgucgugagcuggaagaacaaggagcucaagugcggcagcggcaucuucaucaccgacaacgugcacaccuggaccgagcaguacaaguuccagcccgagucccccagcaagcuggccuccgccauccagaaggcccacgaggaggggaucugcggcauccgcagcgucacgcggcuggagaaccucauguggaagcagaucacccccgagcugaaccacauccuguccgagaacgaggugaagcucagcaucaugaccggggacaucaagggcaucaugcaggcggggaagcgcucccugcggccgcagcccaccgagcugaaguacagcuggaagacguggggcaaggccaagaugcucuccaccgagccccacaaccagaccuuccugaucgacggcccggagaccgccgagugccccaacacgaaccgcgccuggaacagccuggagguggaggacuacggguucggcgucuucaccaccaacaucuggcucaagcugaaggagcggcaggacguguucugcgacuccaagcugaugagcgccgcgaucaaggacaaccgcgccgugcacgccgacaugggguacuggaucgaguccgcccucaacgacaccuggaagaucgagaaggccagcuucaucgaggucaaguccugccacuggcccaagagccacacgcugugguccaacggcgugcuggagagcgagaugaucauccccaagaacuucgcgggcccggugagccagcacaacuaccggcccggguaccacacccagaccgccggccccuggcaccucgggaagcuggagauggacuucgacuucugcgagggcaccaccgucguggugacggaggacugcgggaaccgcggccccucccugcggaccaccaccgccagcggcaagcucaucacggaguggugcugccgcuccugcacccugccgccccugcgguaccgcggggaggacggcugcugguacgggauggagauccggccccucaaggagaaggaggagaaccuggucaacagccuggugaccgccggccacgggcagaucgacaacuucucccucggcgugcugggcauggcgcuguuccucgaggagaugcugcgcacccgggucgggacgaagcacgccgugcugcucguggccgucagcuucaugacccugaucaccggcaacauguccuuccgcgaccuggggcgggugauggugauggucggcgccgccaugaccgacgacaucgggaugggcgugacguaccucgcgcugcuggccgccuucaaggugcgccccaccuucgccgccggccuccugcugcgcaagcucaccagcaaggagcugaugaugaccacgaucgggaucguccugcucucccagagcaccaccccggagaccauccuggagcugacggacgcgcucgcccugggcaugaugauccugaagaucgugcggaacauggagaaguaccagcucgccgucaccaucauggccauccugugcgugcccaacgccgugauccugcagaacgcguggaaggucuccugcaccauccucgccgccgugagcgugagcccccugcugcucaccagcucccagcagaaggccgacuggaucccccuggcgcugacgaucaaggggcucaacccgaccgccaucuuccugaccacccugagccgcacgaacaagaagcgguccuggccccucaacgaggccaucauggccgucggcauggugagcauccuggccuccagccugcucaagaacgacauccccaugaccggcccccugguggccggcgggcugcucaccgucugcuacgugcugaccgggcgcagcgccgaccuggagcucgagcgggccgccgacgugcgcugggaggaccaggccgagaucuccgggagcuccccgauccugagcaucacgaucuccgaggacgggagcauguccaucaagaacgaggaggaggagcagacccugaccauccucauccggaccggccugcuggucaucagcggccucuuccccguguccauccccaucacggcggccgccugguaccugugggaggugaagaagcagcgcgccgggguccugugggacgugcccagcccgccgcccgugggcaaggccgagcucgaggacggggcguaccggaucaagcagaagggcauccugggguacucccagaucggcgccggcgucuacaaggaggggaccuuccacaccauguggcacgugacccgcggcgccgugcugaugcacaaggggaagcggaucgagccgagcugggccgacguccgcaaggaccucaucuccuacggcgggggcuggaagcuggagggcgaguggaaggagggggaggagguccaggugcuggcccucgagcccggcaagaacccccgggcgguccagaccaagcccgggcuguucaagacgaacaccggcaccaucggggccgugagccuggacuucuccccgggcaccagcggcucccccaucguggacaagaaggggaaggucgugggccucuacgggaacggcguggucacgcgcagcggcaccuacguguccgccaucgcccagaccgagaaguccaucgaggacaaccccgagaucgaggacgacaucuuccggaagaagcgccugaccaucauggaccugcaccccggggcgggcaagacgaagcgguaccugccggccaucgugcgcgaggccaucaagcgggggcuccgcacccugauccuggcccccacccgggucguggccgcggagauggaggaggcccuccgcggccugcccauccgcuaccagacccccgccauccgggccgagcacacggggcgcgagaucguggaccugaugugccacgccaccuucaccaugcggcuccugagcccgguccgcgugcccaacuacaaccugaucaucauggacgaggcgcacuucaccgaccccgccuccaucgccgcccggggcuacaucagcacgcgcguggagaugggcgaggccgcggggaucuucaugaccgccacgccgcccggcucccgggaccccuucccccagagcaacgcccccaucauggacgaggagcgcgagauccccgagcgguccuggaacagcgggcacgagugggucaccgacuucaagggcaagacggugugguucgugcccuccaucaaggccgggaacgacaucgcggccugccuccgcaagaacggcaagaaggucauccagcugagccggaagaccuucgacuccgaguacaucaagacccgcaccaacgacugggacuucguggugacgaccgacaucagcgagaugggcgccaacuucaaggccgagcgggucaucgacccccgccggugcaugaagcccgugauccugaccgacggggaggagcgcgugauccucgccggcccgaugcccgucacccacuccagcgcggcccagcggcgcgggcggaucggccgcaaccccaagaacgagaacgaccaguacaucuacaugggggagccccuggagaacgacgaggacugcgcccacuggaaggaggccaagaugcugcucgacaacaucaacacgccggagggcaucauccccuccauguucgagcccgagcgcgagaagguggacgccaucgacggcgaguaccggcugcgcggggaggcgcggaagaccuucguggaccugaugcgccggggcgaccucccggucuggcuggccuaccgcguggccgccgaggggaucaacuacgccgaccggcgcuggugcuucgacggcaucaagaacaaccagauccuggaggagaacgucgagguggagaucuggaccaaggagggggagcggaagaagcucaagccccgcuggcuggacgcgcggaucuacagcgacccccuggcccucaaggaguucaaggaguucgccgccggccgcaagucccugacccugaaccucaucacggagaugggccggcugcccaccuucaugacccagaaggcgcgcaacgcccuggacaaccucgccgugcugcacaccgccgaggccgggggccgggcguacaaccacgcccugagcgagcucccggagacgcuggagacccugcuccugcugacccuccuggccaccgucaccgggggcaucuuccuguuccucauguccggcaaggggaucggcaagaugacccuggggaugugcugcaucaucaccgccagcauccugcucugguacgcccagauccagccccacuggaucgcggccuccaucauccuggaguucuuccugaucgugcuccugauccccgagcccgagaagcagcgcaccccgcaggacaaccagcugaccuacguggucaucgccauccucacggugguggccgccaccauggcgaacgagaugggcuuccuggagaagaccaagaaggacuucgggcugggcagcaucgccacccagcagcccgagagcaacauccucgacaucgaccugcggcccgccuccgccuggacgcuguacgccgucgcgaccaccuucaucacccccaugcuccgccacagcaucgagaacuccagcgugaacgugucccugacggccaucgccaaccaggccaccguccugaugggccucgggaagggcuggccgcugagcaagauggacaucggggugccccugcucgcgaucggcugcuacucccaggugaaccccaucacccugaccgccgcccugcuccugcuggucgcccacuacgccaucaucgggcccggccuccaggcgaaggccacgcgggaggcccagaagcgcgccgccgcgggcaucaugaagaacccgaccguggacgggaucaccgugaucgaccuggaccccauccccuacgaccccaaguucgagaagcagcugggccaggucaugcuccuggugcugugcgugacccagguccucaugaugcggacgaccugggcccugugcgaggcccugacccucgccaccgggccgaucagcacgcugugggagggcaaccccgggcgcuucuggaacaccaccaucgccguguccauggcgaacaucuuccgcggcagcuaccuggccggcgccgggcuccuguucuccaucaugaagaacaccacgaacacccggcgcggcaccgggaacaccggcgagacgcugggcgagaaguggaagaaccggcucaacagccuggggaaguccgaguuccagaucuacaagcgcagcggcauccaggagguggaccggacccuggccaaggaggggaucaagcgcggcgagaccgaccaccacgcggucucccgggggagcgccaagcuccgcugguucguggagcggaaccuggugacccccgagggcaaggucguggaccugggcugcgggcgcggcgggugguccuacuacugcggcgggcucaagaacgugcgggaggucaagggccugacgaagggcgggcccggccacgaggagccgauccccaugagcaccuacggguggaaccuggugcgccuccaguccggcguggacgucuucuucacgccgcccgagaagugcgacacccugcugugcgacaucggggagagcagcccgaaccccacgguggaggccggccggacccuccgcgugcugaaccuggucgagaacuggcucaacaacaacacccaguucugcaucaaggugcugaaccccuacaugccguccgugaucgagaagauggagacccugcagcggaaguacggcggggcccugguccgcaacccccucagccggaacuccacccacgagauguacugggugagcaacgccuccggcaacaucgugagcuccgucaacaugaucagccgcaugcugaucaaccgguucacgaugcgccacaagaaggcgaccuacgagcccgacguggaccugggguccggcacccgcaacaucgggaucgagagcgagacccccaaccucgacaucaucggcaagcggaucgagaagaucaagcaggagcacgagacguccuggcacuacgaccaggaccacccguacaagaccugggccuaccacggcagcuacgagaccaagcagaccggguccgccagcuccauggugaacggcgucgugcgccugcugacgaagcccugggacgugauccccauggucacccagauggccaugaccgacaccacgcccuucgggcagcagcggguguucaaggagaagguggacacccgcacccaggagccgaaggagggcaccaagaagcucaugaagaucacggccgaguggcuguggaaggagcugggcaagaagaagacgccccggaugugcacccgcgaggaguucgcgcggaagguccgcagcaacgccgcccucggggccaucuucaccgacgagaacaaguggaaguccgcccgggaggcgguggaggacagccgcuucugggagcuggucgacaaggagcggaaccugcaccucgagggcaagugcgagacgugcguguacaacaugauggggaagcgcgagaagaagaucggcgaguucgggaaggccaagggcucccgggccaucugguacauguggcugggcgcccgcuuccuggaguucgaggcgcucggguuccugaacgaggaccacugguucagccgggagaacagccuguccggcguggagggggagggccuccacaagcugggguacauccugcgcgaggucagcaagaaggagggcggcgccauguacgccgacgacaccgccgggugggacacccggaucacccucgaggaccugaagaacgaggagauggugacgaaccacauggagggcgagcacaagaagcuggccgaggcgaucuucaagcucaccuaccagaacaaggugguccgcgugcagcggcccacgccccgcgggaccgugauggacaucaucucccggcgcgaccagcgcggcagcgggcaggucggcacguacggccugaacaccuucaccaacaugggggcccagcugauccggcagauggagggcgaggggguguucaagggcauccagcaccucaccgccacggaggagguggccguccaggacuggcuggcccgcgugggccgggagcgccugucccggauggcgaucagcggggacgacugcguggucaagccgcucgacgaccgcuucgccuccgcccugaccgcccugaacgacaugggcaaggugcggaaggacauccagcagugggagcccagccgcggguggaacgacuggacccaggugcccuucugcucccaccacuuccacgagcucaucaugaaggacggccggguccugguggugcccugccgcaaccaggacgagcugaucgggcgggcccgcaucagccagggcgcgggcuggucccuccgggagaccgccugccugggcaagagcuacgcccagauguggucccugauguacuuccaccgccgggaccuccgccuggccgccaacgcgaucugcagcgccgucccgucccacugggugcccacgagccggaccaccugguccauccacgccggccacgaguggaugaccaccgaggacaugcugacgguguggaaccgcgucuggauccaggagaaccccuggauggaggacaagacccccguggagagcugggaggagaucccguaccucgggaagcgggaggaccaguggugcggcagccugaucgggcugaccucccgcgccaccugggcgcgcaacauccagacggccaucaaccaggugcggagccucaucggcuccgaggaguacaccgacuacaugcccagcaugaagcgcuuccggcgcgaggaggaggaggccggcguccugugguga

SEQ ID NO: 9041 - RNA, 9876 nt, Artificial Sequence
  derived and/or modified CDS sequence (opt1) from DENV-2__KM217156__SS-prME
accgccggggugaucaucaugcugauccccaccgccauggcguuccaccucaccacccgcaacggggagccccacaugaucgucagcaagcaggagaaggggaagucccugcuguucaagaccgaggacggggugaacaugugcacccucauggccauggaccugggcgagcugugcgaggacaccaucaccuacaacugcccccuccugcggcagaacgagcccgaggacaucgacugcuggugcaacgccaccuccaccugggugaccuacgggaccugcaccgccaccggcgagcaccgccgggagaagcgcuccgucgcccuggugccccacgugggcauggggcucgagacccggaccgagaccuggaugagcuccgagggcgcguggaagcacgcccagcgcaucgagaccuggauccugcggcacccgggguucaccaucauggccgccauccuggcguacaccaucggcaccaccuacuuccagcgcguccucaucuucauccugcugacggccguggcccccagcaugaccaugcggugcaucgggaucuccaaccgcgacuucguggagggcgucagcggcggguccuggguggacaucgugcucgagcacggcagcugcgucaccaccauggccaagaacaagcccacgcuggacuucgagcugaucaagaccgaggccaagcagcccgcgacccuccggaaguacugcaucgaggccaagcugaccaacacgaccaccgccucccgcugcccgacccagggggagcccagccugaacgaggagcaggacaagcgguucgugugcaagcacuccaugguggaccgcggcuggggcaacgggugcggccucuucgggaagggcgggaucgucacgugcgccauguucacgugcaagaagaacauggagggcaagaucgugcagcccgagaaccuggaguacaccaucguggucacgccccacagcggcgaggagaacgccguggggaacgacacgggcaagcacgggaaggagaucaaggugaccccgcaguccagcaucaccgaggcggagcugaccggcuacgggaccgucacgauggagugcagcccccggaccggccucgacuucaacgagauggugcugcugcagauggagaacaaggccuggcucgugcaccgccagugguuccuggaccugccccuccccuggcugccgggcgccgacauccaggggagcaacuggauccagaaggagacccuggucaccuucaagaacccccacgccaagaagcaggacguggucgugcucggcucccaggagggggccaugcacacggcgcugaccggcgccaccgagauccagaugagcagcgggaacccccuguucaccggccaccucaagugccggcugcgcauggacaagcugcagcucaagggcauguccuacagcaugugcacggggaaguucaagguggucaaggagaucgccgagacccagcacggcaccaucguggugcggauccaguacgagggggacggcucccccugcaagaucccguucgagaucauggaccuggagaagcgccacguccugggccggcucaucaccgugaaccccaucgugacggagaaggacagccccgucaacaucgaggccgagcccccguucggggacuccuacaucaucaucggcguggagcccgggcagcugaagcugagcugguucaagaagggcuccagcaucgggcagauguucgagaccaccaugcgcggcgccaagcgcauggcgauccucggcgacaccgccugggacuucgggucccugggcgggguguucacgagcaucggcaaggcccugcaccaggucuucggggccaucuacggcgcggccuucuccggcgugagcuggaccaugaagauccucaucgggguggucaucaccuggaucggcaugaacucccggagcaccucccugagcgugucccuggugcuggucgggguggugacgcucuaccugggcgucauggugcaggccgacagcgggugcguggucuccuggaagaacaaggagcugaagugcggcagcggcaucuucuucaccgacaacgugcacaccuggaccgagcaguacaaguuccagcccgagagccccuccaagcucgccagcgccauccagaaggcgcacgaggaggggaucugcggcauccgcuccaucacgcggcuggacaaccugauguggaagcagaucaccccggagcucaaccacauccugagcgagaacgaggugaagcuguccaucaugaccggggacaucaagggcaucaugcaggccgggaagcgcagccuccggccccagcccaccgagcugaaguacuccuggaagacguggggcaaggccaagaugcugagcaccgagccgcacaaccagaccuuccucaucgacggccccgagaccgcccagugccccaacacgaaccgcgccuggaacucccuggaggucgaggacuacggguucggcguguucaccaccaacaucuggcugaagcucaaggagcggcaggacguguucugcgacagcaagcugauguccgcggccaucaaggacaaccgcgccguccacgccgacaugggguacuggaucgagagcgcccugaacgacaccuggaagaucgagaaggcguccuucaucgaggucaagagcugccacuggcccaagucccacacgcucuggagcaacggcgugcuggaguccgagaugaucaucccgaagaacuucgccggccccgugagccagcacaacuaccggcccggguaccacacccagaccgccggccccuggcaccuggggaagcucgagauggacuucgacuucugcgagggcaccaccgugguggucacggaggacugcgggaaccgcggcccgagccugcggaccaccaccgccuccggcaagcugaucacggaguggugcugccgcagcugcacccugccgccccuccgguaccgcggggaggacggcugcugguacgggauggagauccggccccugaaggagaaggaggagaaccucgugaacucccuggugaccgcgggccacgggcagaucgacaacuucagccugggcguccucggcauggcccuguuccuggaggagaugcuccgcacccggguggggacgaagcacgccgugcugcuggucgccguguccuucaugacccucaucaccggcaacaugagcuuccgcgaccuggggcgggugauggucauggugggcgccgcgaugaccgacgacaucgggaugggcgugacguaccuggcccuccuggccgccuucaagguccgcccgaccuucgccgcgggccugcuccugcgcaagcugaccuccaaggagcucaugaugaccacgaucgggaucgugcugcugagccaguccaccacccccgagaccauccucgagcugacggacgcccuggcccucggcaugaugauccugaagaucgugcggaacauggagaaguaccagcuggccgucaccaucauggccauccucugcgugcccaacgcggucauccugcagaacgccuggaaggugagcugcaccauccuggccgccguguccgucagcccccuccugcugaccuccagccagcagaaggcggacuggaucccgcucgcccugacgaucaaggggcugaaccccaccgccaucuuccucaccacccugucccgcacgaacaagaagcggagcuggccccugaacgaggccaucauggccgugggcaugguguccauccucgcgagcucccugcugaagaacgacauccccaugaccggcccgcucgucgccgggggccugcugaccgugugcuacgugcucaccgggcgcagcgccgaccuggagcuggagcgggccgccgacguccgcugggaggaccaggcggagaucagcggcuccagccccauccucuccaucacgaucagcgaggacggguccaugagcaucaagaacgaggaggaggagcagacccugaccauccugauccggaccggccuccuggugaucuccggccuguuccccgugagcauccccaucacggccgccgccugguaccucugggaggucaagaagcagcgcgccggggugcugugggacgugccgagcccgccgcccgucggcaaggcggagcuggaggacggggccuaccggaucaagcagaagggcauccucggguacagccagaucggcgccggcguguacaaggaggggaccuuccacaccauguggcacgugacccgcggcgccguccugaugcacaaggggaagcggaucgagcccuccugggccgacgugcgcaaggaccugaucagcuacggcgggggcuggaagcucgagggcgaguggaaggagggggaggaggugcagguccuggcgcuggagcccggcaagaacccccgggccgugcagaccaagcccggccuguucaagacgaacaccggcaccaucggggccgugucccuggacuucagccccggcaccuccggcagccccaucgucgacaagaaggggaagguggugggccuguacgggaacggcgucgugacgcgcuccggcaccuacgugagcgccaucgcgcagaccgagaaguccaucgaggacaaccccgagaucgaggacgacaucuuccggaagaagcgccucaccaucauggaccugcacccgggggccggcaagacgaagcgguaccugcccgccaucguccgcgaggccaucaagcgggggcugcgcacccucauccuggcccccacccgggugguggcggccgagauggaggaggcccugcgcggccuccccauccgcuaccagaccccggccauccgggccgagcacacggggcgcgagaucgucgaccugaugugccacgcgaccuucaccaugcggcugcucagccccgugcgcgugcccaacuacaaccugaucaucauggacgaggcccacuucaccgaccccgccagcaucgccgcccggggcuacaucuccacgcgcgucgagaugggcgaggcggccgggaucuucaugaccgccaccccgcccggcagccgggaccccuucccccaguccaacgccccgaucauggacgaggagcgcgagauccccgagcggagcuggaacuccgggcacgagugggugaccgacuucaagggcaagacggugugguucguccccagcaucaaggcggggaacgacaucgccgccugccugcgcaagaacggcaagaaggugauccagcucucccggaagaccuucgacagcgaguacaucaagacccgcaccaacgacugggacuucguggucacgaccgacaucuccgagaugggcgccaacuucaaggccgagcgggugaucgacccccgccggugcaugaagccggugauccugaccgacggggaggagcgcgucauccuggcgggccccaugcccgugacccacagcuccgccgcccagcggcgcgggcggaucggccgcaaccccaagaacgagaacgaccaguacaucuacaugggggagccgcucgagaacgacgaggacugcgcccacuggaaggaggccaagaugcugcuggacaacaucaacacgcccgagggcaucauccccagcauguucgagccggagcgcgagaagguggacgcgaucgacggcgaguaccggcuccgcggggaggcccggaagaccuucgucgaccugaugcgccggggcgaccugcccguguggcucgccuaccgcguggccgccgaggggaucaacuacgcggaccggcgcuggugcuucgacggcaucaagaacaaccagauccuggaggagaacgucgagguggagaucuggaccaaggagggggagcggaagaagcugaagccccgcuggcucgacgcccggaucuacuccgacccccuggcccugaaggaguucaaggaguucgccgcggcccgcaagagccucacccugaaccugaucacggagaugggccggcucccgaccuucaugacccagaaggcccgcaacgcccuggacaaccuggccguccuccacaccgcggaggccggcgggcgggccuacaaccacgcccuguccgagcugcccgagacgcucgagacccugcugcuccugacccugcucgccaccgugacgggcgggaucuuccuguuccugaugagcggcaagggcaucgggaagaugacccucggcaugugcugcaucaucaccgcguccauccugcugugguacgcccagauccagccccacuggaucgccgccagcaucauccucgaguucuuccugaucgugcugcucauccccgagccggagaagcagcgcacgccccaggacaaccagcugaccuacgucgugaucgccauccugacgguggucgcggccaccauggccaacgagaugggguuccucgagaagaccaagaaggacuucggccugggguccaucgccacccagcagcccgagagcaacauccuggacaucgaccuccggcccgccagcgcguggacgcuguacgccguggccaccaccuucaucaccccgaugcugcgccacuccaucgagaacagcuccgugaacgucagccucacggccaucgcgaaccaggccaccgugcugaugggccugggcaagggguggccccucuccaagauggacaucggcgugccccugcuggccaucgggugcuacagccaggucaaccccaucacccucaccgccgcccugcugcuccugguggcgcacuacgccaucaucggcccggggcugcaggccaaggccucccgggaggcccagaagcgcgcggccgccggcaucaugaagaaccccacgguggacggcaucaccgucaucgaccucgaccccauccccuacgacccgaaguucgagaagcagcugggccaggugaugcugcucauccugugcgugacccagguccugaugaugcggaccacgugggcccucugcgaggcccugacccuggcgaccggccccaucagcacccucugggaggggaaccccggccgcuucuggaacacgaccaucgccguguccauggccaacaucuuccgcgggagcuaccuggccggcgcgggccuccucuucuccaucaugaagaacaccaccaacacgcggcgcgggaccggcaacaccggggagacccugggcgagaaguggaagaaccgggugagccugcucggcaaguccgaguuccagaucuacaagcgcagcgggauccaggaggucgaccggacgcuggccaaggagggcaucaagcgcggggagaccgaccaccacgccgugucccggggcagcgccaagcugcgcugguucguggagcggaaccucgucacccccgaggggaaggugguggaccugggcugcggccgcgggggcugguccuacuacugcgggggccugaagaacguccgggaggugaaggggcucaccaagggcggcccggggcacgaggagcccauccccaugagcacguacggcuggaaccuggugcgccugcucaccggggccgacgucuucuucacgcccccggagaagugcgacacccugcugugcgacaucggcgaguccagccccaaccccacgguggaggcggggcggacccuccgcgugcugaaccuggucgagaacuggcucaacaacaacacccaguucugcaucaaggugcugaacccguacaugcccagcgugaucgagaagauggagacccugcagcggaaguacggcggcgcccugguccgcaacccccucucccggaacagcacccacgagauguacuggguguccaacgccagcgggaacaucguguccagcgucaacaugaucucccgcaugcugaucaaccgguucacgaugcgccacaagaaggccaccuacgaccccgacguggaccugggcagcgggacccgcaacaucggcaucgaguccgagaccccgaaccucgacaucaucgggaagcggaucgagaagaucaagcaggagcacgagacgagccgccacuacgaccaggaccaccccuacaagaccugggccuaccacggcuccuacgagaccaagcagaccggcagcgcguccagcacggugaacggggucgugcggcugcugaccaagcccugggacgugauccccauggucacccagauggccaugaccgacacgaccccguucggccagcagcgcguguucaaggagaagguggacacccggacccaggagcccaaggaggggacgaagaagcucaugaagaucaccgccgaguggcuguggaaggagcugggcaagaagaagacgccccgcaugugcacccgggaggaguucgcccgcaagguccgguccaacgccgcgcucggcgccaucuucacggacgagaacaaguggaaguccgcccgcgaggccguggaggacucccgguucugggagcugguggacaaggagcgcaaccugcaccucgaggggaagugcgagaccugcgucuacaacaugaugggcaagcgggagaagaagaucggggaguucggcaaggcgaaggggagccgcgccaucugguacauguggcugggcgcccgguuccuggaguucgaggcccucggcuuccugaacgaggaccacugguucucccgcgagaacagccugagcgggguggagggcgaggggcuccacaagcugggcuacauccugcgggaggucuccaagaaggagggcggggccauguacgcggacgacaccgccggcugggacacccgcaucacgcucgaggaccugaagaacgaggagauggugaccaaccacauggagggggagcacaagaagcuggccgaggccaucuucaagcucaccuaccagaacaaggugguccgggugcagcgccccaccccgcggggcacggugauggacaucaucagccgccgcgaccagcggggguccguccaggugggcaccuacgggcugggcaccuucaccaacaugggcgcccagcugauccgccagauggagggggagggcguguucaaggggauccagcaccucacggcgaccgaggaggucgccgugcaggacuggcuggcccgggugggccgcgagcggcugagccgcauggccaucuccggcgacgacugcgucgugaagccccucgacgaccgguucgccagcgcgcugaccgcccugaacgacauggggaaggugcgcaaggacauccagcagugggagcccucccggggcuggaacgacuggacccagguccccuucugcagccaccacuuccacgagcucaucaugaaggacgggcgcgugcugguggucgccugccggaaccaggacgagcugaucggccgcgcccggaucucccagggggccggcuggagccuccgcgagacggcgugccugggcaaguccuacgcccagauguggagccugauguacuuccaccggcgcgaccuccggcuggccgccaacgcgaucugcuccgccgugccgagccacugggugcccaccucccgcaccaccuggagcauccacgccgggcacgaguggaugaccacggaggacaugcugaccgucuggaaccggguguggauccaggagaaccccuggauggaggacaagacccccguggaguccugggaggagaucccguaccucggcaagcgcgaggaccaguggugcgggagccugaucggccugaccagccgcgccacgugggcccggaacauccagaccgcgaucaaccagguccgcucccucaucgggagcgaggaguacaccgacuacaugcccuccaugaagcgguucggccgcgaggaggaggaggccggcgugcugugguga

SEQ ID NO: 9042 - RNA, 9876 nt, Artificial Sequence
  derived and/or modified CDS sequence (opt1) from DENV-2__KX380809__SS-prME
accgccgggaucaucaucaugaugauccccaccgugauggccuuccaccugaccacccggaacggggagccccacaugaucgugagccggcaggagaagggcaagagccuccuguucaagaccgagaacggggugaacaugugcacccugauggcgauggaccucggcgagcugugcgaggacaccaucaccuacaacugcccccugcuccgccagaacgagcccgaggacaucgacugcuggugcaacagcaccagcaccugggugaccuacgggaccugcaccgccaccggcgagcaccggcgcgagaagcggagcgucgcccuggugccccacgugggcauggggcuggagacccgcaccgagaccuggauguccagcgagggcgccuggaagcacgcccagcggaucgagaccuggguccuccgccaccccggguucaccgugauggcggccauccuggccuacaccaucggcaccaccuacuuccagcgggugcugaucuucauccuccugaccgccgucgcgcccuccaugaccaugcgcugcaucgggaucagcaaccgggacuucguggagggcguguccggcgggagcugggucgacaucgugcuggagcacggcuccugcgugaccaccauggccaagaacaagcccacgcucgacuucgagcugaucaagaccgaggccaagcaccccgccacccugcgcaaguacugcaucgaggccaagcucaccaacacgaccaccgcgagccggugcccgacccagggggagcccucccugaacgaggagcaggacaagcgcuucgucugcaagcacagcaugguggaccggggcuggggcaacgggugcggccuguucgggaagggcgggaucgugacgugcgccauguucacgugcaagaagaacauggagggcaagaucguccagcccgagaaccucgaguacaccaucgugaucacgccccacuccggcgaggagaacgccguggggaacgacacgggcaagcacgggaaggagaucaaggucaccccgcagagcuccaucaccgaggccgagcugaccggcuacgggaccgccacgauggagugcagcccccgcaccggccuggacuucaacgagauggugcuccugcagauggagaacaaggcguggcuggugcaccggcagugguuccucgaccugccccugcccuggcucccgggcgccgacacccagggguccaacuggauccagaaggagacccuggucacguucaagaacccccacgccaagaagcaggacguggucgugcugggcagccaggagggggccaugcacaccgcccucaccggcgcgaccgagauccagaugagcuccgggaaccugcuguucacgggccaccucaagugccgccugcggauggacaagcugcagcucaagggcaugagcuacuccaugugcaccgggaaguucaagguggucaaggagaucgccgagacccagcacggcaccaucgugauccgcgugcaguacgagggggacggcagccccugcaagauccccuucgagaucauggaccuggagaagcggcacguccugggccgccucaucacggugaacccgaucgugaccgagaaggacucccccgucaacaucgaggccgagccgcccuucggggacagcuacaucaucaucggcguggagccggggcagcugaagcuguccugguucaagaagggcagcuccaucgggcagauguucgagaccaccaugcgcggcgccaagcggauggccauccucggcgacacggcgugggacuucgggagccugggcgggguguucaccuccaucggcaaggcccugcaccaggucuucggggccaucuacggcgccgcguucagcggcguguccuggaccaugaagauccucaucgggguggucaucaccuggaucggcaugaacagccgcuccacgagccuguccgugagccuggugcuggucgggaucgugacccucuaccugggcgugaugguccaggccgacuccgggugcguggugagcuggaagaacaaggagcugaagugcggcagcggcaucuucaucaccgacaacguccacaccuggacggagcaguacaaguuccagcccgagucccccagcaagcucgccuccgccauccagaaggcccacgaggaggggaucugcggcauccggagcgugacccgccuggagaaccugauguggaagcagaucacccccgagcucaaccacauccuguccgagaacgaggugaagcugaccaucaugacgggggacaucaagggcaucaugcaggcggggaagcggagccuccgcccgcagcccaccgagcugaaguacuccuggaaggccuggggcaaggccaagaugcugagcaccgagcuccacaaccacaccuuccugaucgacggccccgagacggccgagugcccgaacaccaaccgggccuggaacucccuggaggucgaggacuacggguucggcguguucaccaccaacaucuggcucaagcugaaggagcgccaggacguguucugcgacagcaagcugauguccgcggccaucaaggacaaccgggccguccacgccgacaugggguacuggaucgagagcgcccucaacgacacguggaagaucgagaaggcguccuucaucgaggucaagagcugccacuggcccaagucccacacccuguggagcaacggcgugcuggaguccgagaugaucauccccaagaacuucgccggccccgugagccagcacaacuaccgcccgggguaccacacccagaccgccggccccuggcaccucgggcggcuggagauggacuucgacuucugcgagggcaccacggugguggucaccgaggacugcgggaaccgcggccccagccugcggaccaccacggccuccggcaagcucaucaccgaguggugcugccgcagcugcacccugcccccgcugcgguaccgcggggaggacggcugcugguacgggauggagauccggccccucaaggagaaggaggagaaccuggugaacucccuggugaccgcgggccacgggcagaucgacaacuucagccucggcguccugggcauggcccuguuccucgaggagaugcugcgcacgcggguggggaccaagcacgccauccugcucguggccgucuccuucgugacccugaucaccggcaacaugagcuuccgcgaccuggggcgcgugauggucauggugggcgccacgaugaccgacgacaucgggaugggcgugaccuaccucgcgcugcuggccgccuucaagguccggcccaccuucgccgccggccuccugcugcgcaagcucacguccaaggagcugaugaugaccaccaucgggaucgugcugcucagccaguccaccauccccgagacgauccuggagcugaccgacgcgcucgcccugggcaugauggugcugaagaucguccggaacauggagaaguaccagcucgccgugaccaucauggccauccugugcgucccgaacgccgugauccugcagaacgcguggaaggugagcugcaccauccucgccgucguguccgugagcccccugcugcucacguccagccagcagaaggccgacuggaucccccuggcccugaccaucaaggggcucaaccccaccgcgaucuuccugaccacgcugucccgcaccagcaagaagcgguccuggccgcucaacgaggccaucauggccgucggcauggugagcauccuggccuccagccugcucaagaacgacauccccaugaccggcccccugguggccgggggccugcucaccgucugcuacgugcugacggggcgcagcgcggaccuggagcucgagcgggccgccgacgugcgcugggaggagcaggccgagaucuccggcagcucccccauccugagcaucaccaucuccgaggacgggagcauguccaucaagaacgaggaggaggagcagacccugaccauccucauccggacgggccugcuggucaucagcggccucuucccgguguccauccccaucaccgccgcggccugguaccugugggaggugaagaagcagcgcgccgggguccugugggacgugcccagcccgccgcccgugggcaaggccgagcucgaggacggggccuaccggaucaagcagaagggcauccugggguacucccagaucggcgcgggcgucuacaaggaggggaccuuccacaccauguggcacgugacccgcggcgccgugcugaugcacaaggggaagcggaucgagcccagcugggccgacgucaagaaggaccucaucuccuacggcgggggcuggaagcuggagggcgaguggaaggagggggaggagguccaggugcuggcccucgagcccggcaagaacccccgcgccguccagacgaagcccgggcuguucaagaccaacaccggcaccaucggggcggugagccuggacuucucccccggcacgagcggcucccccaucguggacaagaaggggaaggucgugggccucuacgggaacggcguggucacccggagcggcaccuacguguccgccaucgcccagaccgagaaguccaucgaggacaaccccgagaucgaggacgacaucuuccgcaagaagcggcugacgaucauggaccugcaccccggggccggcaagaccaagcgcuaccugcccgcgaucgugcgggaggccaucaagcgcgggcuccggacccugauccuggccccgacccgcgucguggccgccgagauggaggaggcgcuccgcggccugcccauccgguaccagacgcccgccauccgcgccgagcacaccgggcgggagaucguggaccugaugugccacgccaccuucaccaugcgccuccugagccccauccgggucccgaacuacaaccugaucaucauggacgaggcccacuucacggaccccgcguccaucgccgcccgcggcuacaucagcacccggguggagaugggcgaggccgccgggaucuucaugaccgcgacgccgcccggcucccgcgacccguucccccagagcaacgcccccaucauggacgaggagcgggagauccccgagcgcuccuggaacagcgggcacgagugggugacggacuucaagggcaagaccgucugguucgugccguccaucaaggccgggaacgacaucgccgcgugccuccggaagaacggcaagaaggugauccagcugagccgcaagaccuucgacuccgaguacaucaagacccggacgaacgacugggacuucgucgugaccaccgacaucagcgagaugggcgccaacuucaaggccgagcgcgugaucgacccccggcgcugcaugaagcccgucauccugaccgacggggaggagcgggugauccucgccggccccaugccggugacgcacuccagcgccgcgcagcgccgggggcgcgucggccgcaaccccaagaacgagaacgaccaguacaucuacaugggggagccccuggagaacgacgaggacugcgcccacuggaaggaggccaagaugcugcucgacaacaucaacacccccgagggcaucaucccguccauguucgagcccgagcgggagaagguggacgccaucgacggcgaguaccgccugcgcggggaggcccgcaagaccuucguggaccugaugcggcgcggcgaccuccccgucuggcuggcguaccggguggccgccgaggggaucaacuacgccgaccgccgguggugcuucgacggcgucaagaacaaccagauccuggaggagaacguggagguggagaucuggaccaaggagggggagcgcaagaagcucaagccgcgguggcuggacgcccgcaucuacagcgacccccuggcgcucaaggaguucaaggaguucgccgccggccggaagucccugacgcugaaccucaucaccgagaugggccgccugcccaccuucaugacccagaaggcccggaacgcgcuggacaaccucgccguccugcacacggccgaggccgggggccgcgccuacaaccacgcgcugagcgagcuccccgagacccuggagacccugcuccugcugacccuccuggccacggugaccgggggcaucuuccuguuccucauguccggcaaggggaucggcaagaugacccuggggaugugcugcaucaucaccgccagcauccugcucugguacgcccagauccagccgcacuggaucgccgcguccaucauccuggaguucuuccugaucgugcuccugauccccgagcccgagaagcagcggacgccccaggacaaccagcugacguacgucgugaucgccauccucaccguggucgccgccaccauggccaacgagaugggcuuccuggagaagaccaagaaggacuucgggcugggcagcaucacgacccagcagccggacagcaacauccucgacaucgaccugcgccccgcguccgccuggacccuguacgccguggccaccacguucaucacccccaugcuccggcacagcaucgagaacuccagcgugaacgucucccugaccgccaucgcgaaccaggccaccgugcugaugggccucgggaagggcuggccccugagcaagauggacaucggggugccgcugcucgccaucggcugcuacucccaggucaaccccaucacgcugaccgccgcgcugcuccugcugguggcccacuacgccaucaucgggcccggccuccaggccaaggccacccgcgaggcgcagaagcgggccgccgccggcaucaugaagauccccaccguggacgggaucacggucaucgaccuggacccgauccccuacgaccccaaguucgagaagcagcugggccaggugaugcuccuggugcugugcgucacccaggugcucaugaugcgcaccaccugggcccugugcgaggcgcugacgcucgccaccgggcccaucagcacccugugggagggcaacccggggcgcuucuggaacaccacgaucgccguguccauggccaacaucuuccggggcagcuaccuggccggcgcggggcuccuguucuccaucaugaagaacaccgccaacacccgccggggcaccgggaacacgggcgagacccugggcgagaaguggaagaaccgccucaacgcccugggcaagagcgaguuccagaucuacaagaaguccggcauccaggaggucgaccggacccuggccaaggaggggaucaagcgcggcgagaccgaccaccacgcggugagccggggguccgccaagcuccgcugguucguggagcggaaccuggucacgcccgagggcaaggugguggaccugggcugcgggcgcggcggguggagcuacuacugcggcgggcucaagaacgucaaggaggugaagggccugaccaagggcgggcccggccacgaggagcccaucccgauguccaccuacggguggaaccuggugcggcuccagagcggcgucgacguguucuucacgccgcccgagaagugcgacacgcugcugugcgacaucggggaguccagccccaacccgaccguggaggccggccgcacccuccggguccugaaccugguggagaacuggcucaacaacaacacccaguucugcaucaaggugcugaaccccuacaugcccagcgucaucgagaagauggaggcccugcagcgcaaguacggcggggcccuggugcggaacccgcucucccgcaacagcacccacgagauguacuggguguccaacgcgagcggcaacaucgucuccagcgugaacaugaucucccggaugcugaucaaccgcuucacgaugaagcacaagaaggccaccuacgagcccgacguggaccuggggagcggcacccggaacaucgggaucgaguccgagacccccaaccucgacaucaucggcaagcgcaucgagaagaucaagcaggagcacgagacgagcuggcacuacgaccaggaccaccccuacaagaccugggccuaccacggcuccuacgagaccaagcagaccgggagcgccuccagcauggucaacggcguggugcgccugcugacgaagccgugggacgucauccccauggugacccagauggccaugaccgacaccacgcccuucgggcagcagcggguguucaaggagaaggucgacacccgcacccaggagcccaaggagggcaccaagaagcucaugaagaucacggcggaguggcuguggaaggagcugggcaagaagaagaccccgcggaugugcacccgcgaggaguucacccggaaggugcgcuccaacgccgcccucggggccaucuucacggacgagaacaaguggaaguccgcccgggaggcggucgaggacuccggcuucugggagcugguggacaaggagcgcaaccugcaccucgaggggaagugcgagaccugcguguacaacaugaugggcaagcgggagaagaagcugggggaguucggcaaggccaagggcagccgcgccaucugguacauguggcugggggcccgguuccucgaguucgaggcgcugggcuuccugaacgaggaccacugguucucccgcgagaacagccucagcggggucgagggcgaggggcugcacaagcugggcuacauccuccgggacguguccaagaaggagggcggggccauguacgccgacgacaccgccggcugggacacccgcaucacgcuggaggaccugaagaacgaggagauggugaccaaccacauggagggggagcaccggaagcucgccgaggcgaucuuccgccugaccuaccagaacaaggucgugcgggugcagcgccccacgccccggggcacggucauggacaucaucagccgccgggaccagcgcggguccggccagguggugaccuacggccugaacaccuucaccaacauggaggcccagcucauccgccagauggagggggagggcgucuucaagagcauccagcaccugacggugaccgaggagaucgccgugaagaacuggcuggagcgggucgggcgcgagcggcucucccgcauggccaucagcggcgacgacugcguggugaagccccuggacgaccgguucgccuccgcgcugaccgcccucaacgacaugggcaagguccgcaaggacauccagcagugggagccgagccggggguggaacgacuggacccaggugcccuucugcucccaccacuuccacgagcugaucaugaaggacggccgcgugcuggucgugcccugccggaaccaggacgagcucaucgggcgcgcccggaucagccagggcgccggguggucccugcgcgagacggccugccugggcaagagcuacgcgcagauguggucccucauguacuuccaccggcgcgaccugcggcuggccgccaacgccaucugcagcgccgugcccucccacugggucccgaccagccgcaccaccugguccauccacgcgacccacgaguggaugacgaccgaggacaugcucaccguguggaaccggguguggauccaggagaaccccuggauggaggacaagacccccgucgagagcugggaggagauccccuaccugggcaagcgcgaggaccaguggugcgggagccugaucggccucacgucccgggccaccugggccaagaacauccagaccgccaucaaccaggugcgcagccugaucgggaacgaggaguacaccgacuacaugccguccaugaagcgcuuccggcgcgaggaggaggaggcgggcgugcugugguga

SEQ ID NO: 9043 - RNA, 9876 nt, Artificial Sequence
  derived and/or modified CDS sequence (opt1) from DENV-2__KX380810__SS-prME
accgccggcaucaucaucaugaugauccccaccgugauggccuuccaccugaccacccgcaacggggagccccacaugaucgugagccggcaggagaagggcaagagccuccuguucaagaccgagaacggggugaacaugugcacccugauggcgauggaccucggcgagcugugcgaggacaccaucaccuacaacugcccccugcuccgccagaacgagcccgaggacaucgacugcuggugcaacagcaccagcaccugggugaccuacgggaccugcaccgccaccggcgagcaccggcgcgagaagcggagcgucgcccuggugccccacgugggcauggggcuggagacccgcaccgagaccuggauguccagcgagggcgccuggaagcacgcccagcggaucgagaccuggguccuccgccaccccggguucaccgugauggcggccauccuggccuacaccaucggcaccaccuacuuccagcgggugcugaucuucauccuccugacggccgucgcgcccuccaugaccaugcgcugcaucgggaucagcaaccgggacuucguggagggcguguccggcgggagcugggucgacaucgugcuggagcacggcuccugcgugaccaccauggccaagaacaagcccacgcucgacuucgagcugaucaagaccgaggccaagcaccccgccacccugcgcaaguacugcaucgaggccaagcucaccaacacgaccaccgcgagccggugcccgacccagggggagcccucccugaacgaggagcaggacaagcgcuucgucugcaagcacagcaugguggaccggggcuggggcaacgggugcggccuguucgggaagggcgggaucgugacgugcgccauguucacgugcaagaagaacauggagggcaagaucguccagcccgagaaccucgaguacaccaucgugaucacgccccacuccggcgaggagaacgccguggggaacgacacgggcaagcacgggaaggagaucaaggucaccccgcagagcuccaucaccgaggccgagcugaccggcuacgggaccgccacgauggagugcagcccccgcaccggccuggacuucaacgagauggugcuccugcagauggagaacaaggcguggcuggugcaccggcagugguuccucgaccugccccugcccuggcucccgggcgccgacacccagggguccaacuggauccagaaggagacccuggucacguucaagaacccccacgccaagaagcaggacguggucgugcugggcagccaggagggggccaugcacaccgcccucaccggcgcgaccgagauccagaugagcuccgggaaccugcuguucacgggccaccucaagugccgccugcggauggacaagcugcagcucaagggcaugagcuacuccaugugcaccgggaaguucaagguggucaaggagaucgccgagacccagcacggcaccaucgugauccgcgugcaguacgagggggacggcagccccugcaagauccccuucgagaucauggaccuggagaagcggcacguccugggccgccucaucacggugaacccgaucgugaccgggaaggacucccccgucaacaucgaggccgagccgcccuucggcgacagcuacaucaucaucgggguggagccgggccagcugaagcuguccugguucaagaaggggagcuccaucggccagauguucgagaccaccaugcgcggcgccaagcggauggccauccucggggacacggcgugggacuucggcagccucggcgggguguucaccuccaucgggaaggcccugcaccaggucuucggggccaucuacggcgccgcguucagcgggguguccuggaccaugaagauccucaucggcguggucaucaccuggaucgggaugaacagccgcuccacgagccuguccgugagccuggugcuggucggcaucgugacccucuaccugggggugaugguccaggccgacuccggcugcguggugagcuggaagaacaaggagcugaagugcggcagcgggaucuucaucaccgacaacguccacaccuggacggagcaguacaaguuccagcccgagucccccagcaagcucgccuccgccauccagaaggcccacgaggagggcaucugcgggauccggagcgugacccgccuggagaaccugauguggaagcagaucacccccgagcucaaccacauccuguccgagaacgaggugaagcugaccaucaugacgggcgacaucaaggggaucaugcaggcgggcaagcggagccuccgcccgcagcccaccgagcugaaguacuccuggaaggccuggggcaaggccaagaugcugagcaccgagcuccacaaccacaccuuccugaucgacgggcccgagacggccgagugcccgaacaccaaccgggccuggaacucccuggaggucgaggacuacggcuucgggguguucaccaccaacaucuggcucaagcugaaggagcgccaggacguguucugcgacagcaagcugauguccgcggccaucaaggacaaccgggccguccacgccgacaugggcuacuggaucgagagcgcccucaacgacacguggaagaucgagaaggcguccuucaucgaggucaagagcugccacuggcccaagucccacacccuguggagcaacggcgugcuggaguccgagaugaucauccccaagaacuucgccgggcccgugagccagcacaacuaccgcccgggcuaccacacccagaccgccgggcccuggcaccucggccggcuggagauggacuucgacuucugcgaggggaccacggugguggucaccgaggacugcggcaaccgcggccccagccugcggaccaccacggccuccgggaagcucaucaccgaguggugcugccgcagcugcacccugcccccgcugcgguaccgcggcgaggacgggugcugguacggcauggagauccggccccucaaggagaaggaggagaaccuggugaacucccuggugaccgcggggcacggccagaucgacaacuucagccucggcguccuggggauggcccuguuccucgaggagaugcugcgcacgcgggugggcaccaagcacgccauccugcucguggccgucuccuucgugacccugaucaccgggaacaugagcuuccgcgaccugggccgcgugauggucauggugggggccacgaugaccgacgacaucggcaugggcgugaccuaccucgcgcugcuggccgccuucaagguccggcccaccuucgccgccgggcuccugcugcgcaagcucacguccaaggagcugaugaugaccaccaucggcaucgugcugcucagccaguccaccauccccgagacgauccuggagcugaccgacgcgcucgcccuggggaugauggugcugaagaucguccggaacauggagaaguaccagcucgccgugaccaucauggccauccugugcgucccgaacgccgugauccugcagaacgcguggaaggugagcugcaccauccucgccgucguguccgugagcccccugcugcucacguccagccagcagaaggccgacuggaucccccuggcccugaccaucaagggccucaaccccaccgcgaucuuccugaccacgcugucccgcaccagcaagaagcgguccuggccgcucaacgaggccaucauggccgucggcauggugagcauccuggccuccagccugcucaagaacgacauccccaugaccgggccccugguggccggcgggcugcucaccgucugcuacgugcugacgggccgcagcgcggaccuggagcucgagcgggccgccgacgugcgcugggaggagcaggccgagaucuccgggagcucccccauccugagcaucaccaucuccgaggacggcagcauguccaucaagaacgaggaggaggagcagacccugaccauccucauccggacgggccugcuggucaucagcgggcuguucccgguguccauccccaucaccgccgcggccugguaccugugggaggugaagaagcagcgcgccggcguccugugggacgugcccagcccgccgcccguggggaaggccgagcucgaggacggcgccuaccggaucaagcagaaggggauccugggcuacucccagaucggcgcgggggucuacaaggagggcaccuuccacaccauguggcacgugacccgcggggccgugcugaugcacaagggcaagcggaucgagcccagcugggccgacgucaagaaggaccucaucuccuacgggggcggcuggaagcuggagggggaguggaaggagggcgaggagguccaggugcuggcccucgagcccgggaagaacccccgcgccguccagacgaagcccggccuguucaagaccaacaccgggaccaucggcgcggugagccuggacuucucccccggcacgagcgggucccccaucguggacaagaagggcaaggucguggggcucuacggcaacggcguggucacccggagcgggaccuacguguccgccaucgcccagaccgagaaguccaucgaggacaaccccgagaucgaggacgacaucuuccgcaagaagcggcugacgaucauggaccugcaccccggcgccgggaagaccaagcgcuaccugcccgcgaucgugcgggaggccaucaagcgcggccuccggacccugauccuggccccgacccgcgucguggccgccgagauggaggaggcgcuccgcgggcugcccauccgguaccagacgcccgccauccgcgccgagcacaccggccgggagaucguggaccugaugugccacgccaccuucaccaugcgccuccugagccccauccgggucccgaacuacaaccugaucaucauggacgaggcccacuucacggaccccgcguccaucgccgcccgcggcuacaucagcacccggguggagaugggggaggccgccggcaucuucaugaccgcgacgccgcccgggucccgcgacccguucccccagagcaacgcccccaucauggacgaggagcgggagauccccgagcgcuccuggaacagcggccacgagugggugacggacuucaaggggaagaccgucugguucgugccguccaucaaggccggcaacgacaucgccgcgugccuccggaagaacggcaagaaggugauccagcugagccgcaagaccuucgacuccgaguacaucaagacccggacgaacgacugggacuucgucgugaccaccgacaucagcgagaugggggccaacuucaaggccgagcgcgugaucgacccccggcgcugcaugaagcccgucauccugaccgacggcgaggagcgggugauccucgccgggcccaugccggugacgcacuccagcgccgcgcagcgccggggccgcgucgggcgcaaccccaagaacgagaacgaccaguacaucuacaugggcgagccccuggagaacgacgaggacugcgcccacuggaaggaggccaagaugcugcucgacaacaucaacacccccgagggcaucaucccguccauguucgagcccgagcgggagaagguggacgccaucgacggggaguaccgccugcggggcgaggcccgcaagaccuucguggaccugaugcggcgcggggaccuccccgucuggcuggcguaccggguggccgccgagggcaucaacuacgccgaccgccgguggugcuucgacggggucaagaacaaccagauccuggaggagaacguggagguggagaucuggaccaaggagggcgagcgcaagaagcucaagccgcgguggcuggacgcccgcaucuacagcgacccccuggcgcucaaggaguucaaggaguucgccgccggccggaagucccugacgcugaaccucaucaccgagauggggcgccugcccaccuucaugacccagaaggcccggaacgcgcuggacaaccucgccguccugcacacggccgaggccggcgggcgcgccuacaaccacgcgcugagcgagcuccccgagacccuggagacccugcuccugcugacccuccuggccacggugaccggcggcaucuuccuguuccucauguccgggaagggcaucgggaagaugacccugggcaugugcugcaucaucaccgccagcauccugcucugguacgcccagauccagccgcacuggaucgccgcguccaucauccuggaguucuuccugaucgugcuccugauccccgagcccgagaagcagcggacgccccaggacaaccagcugacguacgucgugaucgccauccucaccguggucgccgccaccauggccaacgagaugggguuccuggagaagaccaagaaggacuucggccugggcagcaucacgacccagcagccggacagcaacauccucgacaucgaccugcgccccgcguccgccuggacccuguacgccguggccaccacguucaucacccccaugcuccggcacagcaucgagaacuccagcgugaacgucucccugaccgccaucgcgaaccaggccaccgugcugauggggcucggcaagggguggccccugagcaagauggacaucggcgugccgcugcucgccaucgggugcuacucccaggucaaccccaucacgcugaccgccgcgcugcuccugcugguggcccacuacgccaucaucggccccggccuccaggccaaggccacccgcgaggcgcagaagcgggccgccgccgggaucaugaagauccccgccgcggacaucggcaccgugaucgaccuggacccgauccccuacgaccccaaguucgagaagcagcuggggcaggucaugcuccuggugcugugcagcacccaggugcucaugaugcgcaccaccugggcccugugcgaggcccugacccucgccacgggccccaucuccacccugugggaggggaacccgggccgcuucuggaacaccaccaucgccgucagcauggcgaacaucuuccggggcuccuaccuggccggggccggccuccuguucagcaucaugaagaacacggccaacacccgccgggggaccggcaacaccggcgagacgcugggggagaaguggaagaaccgccucaacgcgcugggcaaguccgaguuccagaucuacaagaaguccgggauccaggagguggaccggacccuggccaaggagggcaucaagcgcggggagaccgaccaccacgccgugucccggggcagcgccaagcuccgcugguucgucgagcggaaccuggugacccccgagggcaagguggucgaccuggggugcggccgcgggggcugguccuacuacugcgggggccucaagaacgugaaggaggugaagggccugacgaagggcgggcccgggcacgaggagcccaucccgaugagcaccuacggcuggaaccugguccggcuccaguccgggguggacguguucuucacgccgcccgagaagugcgacacccugcugugcgacaucggcgagagcagccccaacccgacggucgaggccggccgcacccuccgggugcugaaccugguggagaacuggcucaacaacaacacccaguucugcaucaagguccugaaccccuacaugcccuccgugaucgagaagauggaggcgcugcagcgcaaguacgggggcgcccuggugcggaacccgcucagccgcaacuccacccacgagauguacugggucagcaacgccuccgggaacaucgugagcuccgugaacaugaucagccggaugcugaucaaccgcuucaccaugaagcacaagaaggccacguacgagcccgacgucgaccugggcuccgggacccggaacaucggcaucgagagcgagacccccaaccucgacaucaucggcaagcgcaucgagaagaucaagcaggagcacgagaccuccuggcacuacgaccaggaccaccccuacaagacgugggccuaccacgggagcuacgagaccaagcagaccggcuccgcgagcuccauggugaacggggugguccgccugcugaccaagccgugggacgugauccccauggugacgcagauggccaugaccgacaccacccccuucggccagcagcgggucuucaaggagaagguggacacgcgcacccaggagcccaaggagggcaccaagaagcucaugaagaucaccgccgaguggcuguggaaggagcuggggaagaagaagacgccgcggaugugcacccgcgaggaguucacccggaaggugcgcagcaacgccgcccucggcgcgaucuucaccgacgagaacaaguggaaguccgcccgggaggccgucgaggacagcggguucugggagcugguggacaaggagcgcaaccugcaccucgagggcaagugcgagacgugcgucuacaacaugauggggaagcgggagaagaagcugggcgaguucggcaaggccaaggggucccgcgcgaucugguacauguggcugggcgcccgguuccucgaguucgaggcccugggguuccugaacgaggaccacugguucagccgcgagaacagccucuccggcguggagggggagggccugcacaagcugggcuacauccuccgggacgugagcaagaaggagggcggcgccauguacgccgacgacaccgcggggugggacacccgcaucacccuggaggaccugaagaacgaggagauggucacgaaccacauggagggcgagcaccggaagcucgccgaggccaucuuccgccugaccuaccagaacaagguggugcggguccagcgccccacgccccgggggaccgugauggacaucaucucccgccgggaccagcgcggcagcggccagguggucacguacgggcugaacaccuucaccaacauggaggcccagcucauccgccagauggagggcgaggggguguucaaguccauccagcaccugaccgugacggaggagaucgccgucaagaacuggcuggagcgggugggccgcgagcggcucagccgcauggcgaucuccggcgacgacugcguggucaagccccuggacgaccgguucgccagcgcccugaccgcccucaacgacauggggaaggugcgcaaggacauccagcagugggagccgucccggggcuggaacgacuggacccaggugcccuucugcagccaccacuuccacgagcugaucaugaaggacgggcgcguccugguggugcccugccggaaccaggacgagcucaucggccgcgcccggaucucccagggggcgggcuggagccugcgcgagaccgccugccugggcaaguccuacgcccagauguggagccucauguacuuccaccggcgcgaccugcggcuggccgccaacgcgaucugcuccgccguccccagccacugggugccgaucucccgcacgaccuggagcauccacgccacccacgaguggaugaccaccgaggacaugcucacgguguggaaccgggucuggauccaggagaaccccuggauggaggacaagacccccguggagagcugggaggagauccccuaccuggggaagcgcgaggaccaguggugcggcucccugaucgggcucaccagccgggccaccugggcgaagaacauccagacggccaucaaccaggugcgcucccugaucggcaacgaggaguacaccgacuacaugccgagcaugaagcgcuuccggcgcgaggaggaggaggccgggguccugugguga

SEQ ID NO: 9044 - RNA, 9876 nt, Artificial Sequence
  derived and/or modified CDS sequence (opt1) from DENV-2__KX380811__SS-prME
accgcggggaucaucaucaugaugauccccaccgugauggccuuccaccugaccacccggaacggggagccccacaugaucgucagccggcaggagaagggcaagagccuccuguucaagaccgagaacggggugaacaugugcacccugauggcgauggaccucggcgagcugugcgaggacaccaucaccuacaacugcccccugcuccgccagaacgagcccgaggacaucgacugcuggugcaacagcaccagcaccugggugaccuacgggaccugcaccgccaccggcgagcaccggcgcgagaagcggagcgucgcccuggugccccacgugggcauggggcuggagacccgcaccgagaccuggaugagcagcgagggcgccuggaagcacgcccagcggaucgagaccuggauccuccgccaccccggguucacgaucauggcggccauccuggccuacaccaucggcaccaccuacuuccagcggguccugaucuucauccuccugacggccgugacccccuccauggcgaugcgcugcaucgggaucagcaaccgggacuucguggagggcgucuccggcgggagcuggguggacaucgugcuggagcacggcuccugcgucaccaccauggccaagaacaagcccacgcucgacuucgagcugaucaagaccgaggccaagcaccuggccacccuccgcaaguacugcguggaggccaagcugaccaacacgaccaccgcgagccggugccccacccagggggagcccucccugaacgaggagcaggacaagcgcuucgugugcaagcacagcauggucgaccggggcuggggcaacgggugcggccucuucgggaagggcgggaucgugacgugcgccauguucacgugcaagaagaacauggagggcaaggugguccagcccgagaaccuggaguacaccaucgugaucacgccccacuccggcgaggagaacgccguggggaacgacacgggcaagcacgggaaggagaucaaggucacgccccagagcuccaucaccgaggccgagcugaccggcuacgggaccgugacgauggagugcagcccgcgcaccggccucgacuucaacgagauggugcugcugcagauggagaacaaggccuggcucguccaccggcagugguuccuggaccugccccuccccuggcugcccggcgcggacacccagggguccaacuggauccagaaggagacccuggugacguucaagaacccgcacgccaagaagcaggacgucguggugcucggcagccaggagggggccaugcacaccgcccugaccggcgccaccgagauccagaugagcuccgggaaccuccuguucacgggccaccugaagugccgccugcggauggacaagcuccagcugaagggcaugagcuacuccaugugcaccgggaaguucaaggucgugaaggagaucgcggagacccagcacggcaccaucgugauccgcguccaguacgagggggacggcagccccugcaagauccccuucgagaucauggaccuggagaagcggcacgugcucggccgccugaucacggugaaccccaucgucaccgagaaggacuccccggugaacaucgaggccgagccgcccuucggggacagcuacaucaucaucggcguggagcccgggcagcugaagcucuccugguucaagaagggcagcuccaucgggcagauguucgagaccaccaugcgcggcgccaagcggauggccauccugggcgacacggccugggacuucgggagccugggcggggucuucaccuccaucggcaaggcgcuccaccagguguucggggccaucuacggcgccgccuucagcggcguguccuggaccaugaagauccugaucggggucgugaucaccuggaucggcaugaacagccgcuccacgagccuguccgugagccugguccucguggggguggucacccuguaccugggcgugauggugcaggcggacuccgggugcgucgugagcuggaagaacaaggagcucaagugcggcagcggcaucuucaucaccgacaacgugcacaccuggacggagcaguacaaguuccagccggagucccccagcaagcuggccuccgccauccagaaggcccacgaggaggggaucugcggcauccggagcgucacccgccuggagaaccucauguggaagcagaucacccccgagcugaaccacauccugaccgagaacgaggugaagcucacgaucaugaccggggacaucaagggcaucaugcaggccgggaagcggucccugcgcccccagccgaccgagcugaaguacagcuggaaggcguggggcaaggccaagaugcucuccaccgagcugcacaaccacacguuccugaucgacggccccgagaccgccgagugccccaacaccaaccgggccuggaacagccucgagguggaggacuacggguucggcgucuucaccacgaacaucuggcugaagcugaaggagcgccaggacguguucugcgacuccaaccucaugagcgccgcgaucaaggacaaccgggccgugcacgccgacaugggguacuggaucgaguccgcccugaacgacaccuggaagaucgagaaggccagcuucaucgaggucaaguccugccacuggcccaagagccacacccugugguccaacggcgugcucgagagcgagaugaucauccccaagaacuucgcgggccccgugucccagcacaacuaccgccccggguaccacacccagaccgccggcccguggcaccuggggcggcuggagauggacuucgacuucugcgagggcacgaccgucguggugaccgaggacugcgggaaccgcggccccagccuccggaccacgaccgccagcggcaagcugaucaccgaguggugcugccgcuccugcacccugccgccccuccgguaccgcggggaggacggcugcugguacgggauggagauccggccgcugaaggagaaggaggagaaccuggucaacagccucgugacggccggccacgggcagaucgacaacuucucccugggcgugcugggcauggcccucuuccuggaggagaugcugcgcacccgggucgggaccaagcacgccauccuccugguggccgugagcuucgucacccugaucacgggcaacauguccuuccgcgaccucgggcgcgugauggugauggucggcgccaccaugaccgacgacaucgggaugggcgugaccuaccuggcccugcucgcggccuucaaggugcggcccacguucgccgccggccugcugcuccgcaagcugaccagcaaggagcugaugaugaccaccaucgggaucguccuccugucccagagcacgauccccgaguccauccuggagcucaccgacgcccuggcgcugggcaugauggugcucaagaucguccggaacauggagaaguaccagcuggccgugaccaucauggccauccugugcgugcccaacgccgucauccuccagaacgccuggaaggugagcugcaccacgcuggcgguggucuccgugagcccgcugcuccugaccuccagccagcagaaggccgacuggaucccccuggcccucaccaucaaggggcugaaccccaccgccaucuuccugacgacccucucccgcaccagcaagaagcgguccuggccccugaacgaggcgaucauggccgugggcauggucagcauccuggccuccagccuccugaagaacgacaucccgaugaccggcccccugguggccgggggccuccugacggugugcuacguccugaccgggcgcagcgccgaccucgagcuggagcgggcggccgacgugcgcugggaggagcaggccgagaucuccggcagcucccccauccugagcaucaccaucuccgaggacgggagcauguccaucaagaacgaggaggaggagcagacccucacgauccugauccggaccggccugcucgugaucagcggccuguuccccgucuccaucccgaucaccgccgccgcgugguaccugugggaggugaagaagcagcgcgccggggugcucugggacguccccuccccgccgcccgugggcaaggccgagcuggaggacggggccuaccggaucaagcagaagggcauccugggguacucccagaucggcgccggcguguacaaggaggggaccuuccacaccauguggcacgucacgcgcggcgcggugcucaugcacaaggggaagcggaucgagcccagcugggccgacgugaagaaggaccugaucuccuacggcgggggcuggaagcuggagggcgaguggaaggagggggaggagguccaggugcucgcccuggagcccggcaagaacccgcgcgccgugcagaccaagcccgggcuguucaagaccaacaccggcacgaucggggccgucagccucgacuucucccccggcaccagcggcucccccaucguggacaagaaggggaagguggucggccuguacgggaacggcguggugacccggagcggcaccuacgucuccgcgaucgcccagacggagaaguccaucgaggacaacccggagaucgaggacgacaucuuccgcaagaagcggcugaccaucauggaccugcaccccggggccggcaagaccaagcgcuaccuccccgccaucgugcgggaggcgaucaagcgcgggcugcggacccugauccucgcccccacgcgcguggucgccgccgagauggaggaggcccugcgcggccugccgauccgguaccagacccccgcgauccgcgccgagcacaccgggcgggagaucguggaccucaugugccacgccaccuucacgaugcgccugcugagccccauccgggugcccaacuacaaccucaucaucauggacgaggcccacuucaccgacccggccuccaucgcggcccgcggcuacaucagcacccgggucgagaugggcgaggccgccgggaucuucaugaccgccacgccgcccggcucccgcgaccccuucccgcagagcaacgcgcccaucauggacgaggagcgggagauccccgagcgcuccuggaacagcgggcacgagugggugaccgacuucaagggcaagaccgugugguucguccccuccaucaaggccgggaacgacaucgccgccugccugcggaagaacggcaagaaggugauccagcugagccgcaagaccuucgacuccgaguacaucaagacgcggaccaacgacugggacuucguggucaccaccgacaucagcgagaugggcgcgaacuucaaggccgagcgcgugaucgacccgcggcgcugcaugaagcccgugauccucacggacggggaggagcgggucauccuggccggccccaugcccgugacccacuccagcgccgcccagcgccgggggcgcgugggccgcaacccgaagaacgagaacgaccaguacaucuacaugggggagccccuggagaacgacgaggacugcgcgcacuggaaggaggccaagaugcuccuggacaacaucaacacccccgagggcaucauccccuccauguucgagccggagcgggagaaggucgacgccaucgacggcgaguaccgccugcgcggggaggcccgcaagaccuucguggaccucaugcggcgcggcgaccugcccgucuggcuggccuaccggguggcggccgaggggaucaacuacgccgaccgccgguggugcuucgacggcgugaagaacaaccagauccucgaggagaacgucgagguggagaucuggacgaaggagggggagcgcaagaagcugaagccccgguggcuggacgcccgcaucuacagcgacccgcucgcccugaaggaguucaaggaguucgcggccggccggaagucccugacccucaaccugaucaccgagaugggccgccugcccaccuucaugacgcagaaggccaagaacgcccucgacaaccuggcggugcugcacaccgccgaggccgggggccgggccuacaaccacgcccucagcgagcugcccgagacccuggagacccuccugcugcucacgcugcuggcgaccgucaccgggggcaucuuccucuuccugauguccggcaaggggaucggcaagaugacccuggggaugugcugcaucaucaccgccagcauccuccugugguacgcccagauccagccccacuggaucgccgccuccaucauccuggaguucuuccucaucgugcugcugaucccggagcccgagaagcagcgcacgccccaggacaaccagcucaccuacguggucaucgcgauccugaccgugguggccgccaccauggccaacgagaugggcuuccuggagaagacgaagaaggacuucgggcucggcagcaucaccacccagcagcccgagagcaacauccuggacaucgaccugcggccggccuccgcguggacccucuacgccgucgccacgaccuucaucacccccaugcugcgccacagcaucgagaacuccagcgugaacgugucccugaccgccaucgccaaccaggcgacgguccucaugggccuggggaagggcuggccccugagcaagauggacaucggggugccccuccuggccaucggcugcuacucccaggugaacccgaucacccugaccgccgcccuccugcugcucgucgcgcacuacgccaucaucgggcccggccugcaggccaaggccacccgggaggcccagaagcgcgcggccgccggcaucaugaagauccccacgguggacgggaugaccgugaucgaccuggaccccaucccguacgaccccaaguucgagaagcagcucggccaggucaugcugcuggugcucugcgugacccagguccugaugaugcggaccacgugggcccugugcgaggcccucacccuggcgaccgggcccaucagcacccugugggagggcaaccccgggcgcuucuggaacacgaccaucgccguguccauggccaacaucuuccgcggcagcuaccucgccggcgccgggcugcuguucuccaucaugaagaacaccgcgaacacccggcgcggcacggggaacaccggcgagacccucggcgagaaguggaagaaccggcugaacgcccugggcaagagcgaguuccagaucuacaagaaguccggcauccaggagguggaccgcacccucgccaaggaggggaucaagcggggcgagacggaccaccacgccgucagccgcggguccgcgaagcugcggugguucguggagcgcaaccuggugaccccggagggcaaggucguggaccucggcugcgggcggggcggguggagcuacuacugcggcgggcugaagaacgugaaggaggucaagggccugaccaagggcgggcccggccacgaggagcccauccccauguccaccuacggguggaaccucgugcgccugcagagcggcguggacgucuucuucacgccgcccgagaagugcgacacccugcucugcgacaucggggaguccagccccaaccccaccguggaggccggccggacccugcgcgugcugaaccucgucgagaacuggcugaacaacaacacccaguucugcaucaaggugcugaacccguacaugcccagcgugaucgagaagauggaggcccugcagcggaaguacggcggggcccucguccgcaacccccugucccggaacagcacgcacgagauguacuggguguccaacgccagcggcaacaucguguccagcgucaacaugaucucccgcaugcugaucaaccgguucaccaugcgccacaagaaggcgaccuacgagccggacguggaccucgggagcggcacccggaacaucgggaucgaguccgagacgcccaaccuggacaucaucggcaagcgcaucgagaagaucaagcaggagcacgagaccagcuggcacuacgaccaggaccaccccuacaagaccugggccuaccacggcuccuacgagaccaagcagacggggagcgccuccagcauggugaacggcgucgugcgccugcucaccaagcccugggacgugaucccgauggucacccagauggccaugaccgacacgacccccuucgggcagcagcggguguucaaggagaaggucgacacccgcacccaggagcccaaggagggcacgaagaagcugaugaagaucaccgccgaguggcuguggaaggagcucggcaagaagaagacgccccggaugugcacccgcgaggaguucacgcggaaggugcgcuccaacgcggcccugggggccaucuucaccgacgagaacaaguggaaguccgcccgggaggccguggaggacuccggcuucugggagcuggucgacaaggagcgcaaccuccaccuggaggggaagugcgagaccugcguguacaacaugaugggcaagcgggagaagaagcugggggaguucggcaaggcgaagggcagccgcgccaucugguacauguggcucggggcccgguuccuggaguucgaggcccugggcuuccucaacgaggaccacugguucucccgcgagaacagccugagcgggguggagggcgaggggcugcacaagcucggcuacauccugcgggacgucuccaagaaggagggcggggcgauguacgccgacgacaccgccggcugggacacgcgcaucacccuggaggaccucaagaacgaggagauggugaccaaccacauggagggggagcacaagaagcuggccgaggccaucuucaagcugaccuaccagaacaaggugguccgggugcagcgcccgacgccccggggcaccgugauggacaucaucagccgccgggaccagcgcggguccggccaggucgugaccuacggccucaacaccuucacgaacauggaggcgcagcugauccggcagauggagggggagggcguguucaagagcauccagcagcugaccgucaaggaggagaucgccgugaagaacuggcucauccgcguggggcgcgagcggcugucccgcauggccaucagcggcgacgacugcgucgugaagccccuggacgaccgguucgccuccgcccucaccgcgcugaacgacaugggcaaggugcgcaaggacauccagcagugggagcccagccggggguggaacgacuggacccaggucccguucugcucccaccacuuccacgagcugaucaugaaggacggccgcgugcucgugguccccugccggaaccaggacgagcugaucgggcgcgcccggaucagccagggcgccggguggucccugcgcgagacggccugccucggcaagagcuacgcccagauguggucccugauguacuuccaccggcgcgaccugcggcucgcggccaacgccaucugcagcgccgugcccucccacuggauccccaccagccgcaccaccugguccauccacgccacccacgaguggaugacgaccgaggacaugcugaccguguggaaccgggucuggauccaggagaacccguggauggaggacaagacccccguggagagcugggaggagauccccuaccugggcaagcgcgaggaccaguggugcgggagccucaucggccugacgucccgggcgaccugggccaagaacauccagaccgccaucaaccaggugcgcagccugaucgggaacgaggaguacaccgacuacaugcccuccaugaagcgguuccgccgcgaggaggaggaggccggcguccucugguga

SEQ ID NO: 9045 - RNA, 9876 nt, Artificial Sequence
  derived and/or modified CDS sequence (opt1) from DENV-2__KX380813__SS-prME
accgcggggaucaucaucaugaugauccccaccgugauggccuuccaccugaccacccgcaacggggagccccacaugaucgucagccggcaggagaagggcaagagccuccuguucaagaccgagaacggggugaacaugugcacccugauggcgauggaccucggcgagcugugcgaggacaccaucaccuacaacugcccccugcuccgccagaacgagcccgaggacaucgacugcuggugcaacagcaccagcaccugggugaccuacgggaccugcaccgccaccggcgagcaccggcgcgagaagcggagcgucgcccuggugccccacgugggcauggggcuggagacccgcaccgagaccuggauguccagcgagggcgccuggaagcacgcccagcggaucgagaccuggauccuccgccaccccggguucaccaucauggcggccauccuggccuacaccaucggcaccaccuacuuccagcggguccugaucuucauccuccugacggccgugacccccuccauggcgaugcgcugcaucgggaucagcaaccgggacuucguggagggcgucuccggcgggagcuggguggacaucgugcuggagcacggcuccugcgucaccaccauggccaagaacaagcccacgcucgacuucgagcugaucaagaccgaggccaagcaccuggccacccuccgcaaguacugcguggaggccaagcugaccaacacgaccaccgcgagccggugccccacccagggggagcccucccugaacgaggagcaggacaagcgcuucgugugcaagcacagcauggucgaccggggcuggggcaacgggugcggccucuucgggaagggcgggaucgugacgugcgccauguucacgugcaagaagaacauggagggcaaggugguccagcccgagaaccuggaguacaccaucgugaucacgccccacuccggcgaggagaacgccguggggaacgacacgggcaagcacgggaaggagaucaaggucacgccccagagcuccaucaccgaggccgagcugaccggcuacgggaccgugacgauggagugcagcccgcgcaccggccucgacuucaacgagauggugcugcugcagauggagaacaaggccuggcucguccaccggcagugguuccuggaccugccccuccccuggcugcccggcgcggacacccagggguccaacuggauccagaaggagacccuggugacguucaagaacccgcacgccaagaagcaggacgucguggugcucggcagccaggagggggccaugcacaccgcccugaccggcgccaccgagauccagaugagcuccgggaaccuccuguucacgggccaccugaagugccgccugcggauggacaagcuccagcugaagggcaugagcuacuccaugugcaccgggaaguucaaggucgugaaggagagcgcggagacccagcacggcaccaucgugauccgcguccaguacgagggggacggcucccccugcaagauccccuucgagaucauggaccuggagaagcggcacgugcucggccgccugaucacggugaaccccaucgucaccgagaaggacagcccggugaacaucgaggccgagccgcccuucggggacuccuacaucaucaucggcguggagcccgggcagcugaagcucagcugguucaagaagggcuccagcaucgggcagauguucgagaccaccaugcgcggcgccaagcggauggccauccugggcgacacggccugggacuucgggucccugggcggggucuucaccagcaucggcaaggcgcuccaccagguguucggggccaucuacggcgccgccuucuccggcgugagcuggaccaugaagauccugaucggggucgugaucaccuggaucggcaugaacucccgcagcacgucccugagcgugucccugguccucguggggguggucacccuguaccugggcgugauggugcaggcggacagcgggugcgucgugagcuggaagaacaaggagcucaagugcggcuccggcaucuucaucaccgacaacgugcacaccuggacggagcaguacaaguuccagccggagagccccuccaagcuggccagcgccauccagaaggcccacgaggaggggaucugcggcauccgguccgucacccgccuggagaaccucauguggaagcagaucacccccgagcugaaccacauccugaccgagaacgaggugaagcucacgaucaugaccggggacaucaagggcaucaugcaggccgggaagcggacccugcgcccccagccgaccgagcugaaguacagcuggaaggcguggggcaaggccaagaugcucuccacggagcugcacaaccacaccuuccugaucgacggccccgagaccgccgagugccccaacaccaaccgggccuggaacagccucgagguggaggacuacggguucggcgucuucacgaccaacaucuggcugaagcugaaggagcgccaggacguguucugcgacuccaagcucaugagcgccgcgaucaaggacaaccgggccgugcacgccgacaugggguacuggaucgaguccgcccugaacgacaccuggaagaucgagaaggccagcuucaucgaggucaaguccugccacuggcccaagagccacacccugugguccaacggcgugcucgagagcgagaugaucauccccaagaacuucgcgggccccgugucccagcacaacuaccgccccggguaccacacccagacggccggcccguggcaccuggggcggcuggagauggacuucgacuucugcgagggcaccaccgucguggugaccgaggacugcgggaaccgcggccccagccuccggacgaccaccgccagcggcaagcugaucaccgaguggugcugccgcuccugcacgcugccgccccuccgguaccgcggggaggacggcugcugguacgggauggagauccggccgcugaaggagaaggaggagaaccuggucaacagccucgugaccgccggccacgggcagaucgacaacuucucccugggcgugcugggcauggcccucuuccuggaggagaugcugcgcacccgggucgggaccaagcacgccauccuccugguggccgugagcuucgucacgcugaucaccggcaacauguccuuccgcgaccucgggcgcgugauggugauggucggcgccaccaugaccgacgacaucgggaugggcgugacguaccuggcccugcucgcggccuucaagauccggcccaccuucgccgccggccugcugcuccgcaagcugaccagcaaggagcugaugaugaccacgaucgggaucgugcuccugucccagagcaccauccccgaguccauccuggagcucaccgacgcccuggcgcugggcaugaugguccucaagaucgugcggaacauggagaaguaccagcuggccgucaccaucauggccauccugugcgugcccaacgccgugauccuccagaacgccuggaaggucagcugcacgacccuggcggugguguccgucagcccgcugcuccugaccuccagccagcagaaggccgacuggaucccccuggcccucaccaucaaggggcugaaccccacggccaucuuccugaccacccucucccgcaccagcaagaagcgguccuggccccugaacgaggcgaucauggccgugggcauggugagcauccuggccuccagccuccugaagaacgacaucccgaugacgggcccccuggucgccgggggccuccugaccgugugcuacgugcugaccgggcgcagcgccgaccucgagcuggagcgggcggccgacguccgcugggaggagcaggccgagaucuccggcagcucccccauccugagcaucaccaucuccgaggacgggagcauguccaucaagaacgaggaggaggagcagacgcucaccauccugauccggaccggccugcucgugaucagcggccuguuccccguguccaucccgaucaccgccgccgcgugguaccugugggaggucaagaagcagcgcgccggggugcucugggacgugcccuccccgccgcccgucggcaaggccgagcuggaggacggggccuaccggaucaagcagaagggcauccugggguacucccagaucggcgccggcguguacaaggaggggaccuuccacacgauguggcacgugacccgcggcgcgguccucaugcacaaggggaagcggaucgagcccagcugggccgacgugaagaaggaccugaucuccuacggcgggggcuggaagcuggagggcgaguggaaggagggggaggaggugcagguccucgcccuggagcccggcaagaacccgcgcgccgugcagaccaagcccgggcuguucaagaccaacacgggcaccaucggggccgugagccucgacuucucccccggcaccagcggcucccccaucgucgacaagaaggggaagguggugggccuguacgggaacggcgucgugacccggagcggcacguacguguccgcgaucgcccagaccgagaaguccaucgaggacaacccggagaucgaggacgacaucuuccgcaagaagcggcugaccaucauggaccugcaccccggggccggcaagaccaagcgcuaccuccccgccaucguccgggaggcgaucaagcgcgggcugcggacgcugauccucgcccccacccgcgugguggccgccgagauggaggaggcccugcgcggccugccgauccgguaccagacccccgcgauccgcgccgagcacaccgggcgggagaucgucgaccucaugugccacgccacguucaccaugcgccugcugagccccauccgggugcccaacuacaaccucaucaucauggacgaggcccacuucaccgacccggccuccaucgcggcccgcggcuacaucagcacccggguggagaugggcgaggccgccgggaucuucaugacggccacgccgcccggcucccgcgaccccuucccgcagagcaacgcgcccaucauggacgaggagaaggagauccccgagcgguccuggaacagcgggcacgagugggucaccgacuucaagggcaagaccgugugguucgugcccuccaucaaggccgggaacgacaucgccgccugccugcgcaagaacggcaagaaggucauccagcugagccggaagacguucgacuccgaguacaucaagacccgcaccaacgacugggacuucguggugaccacggacaucagcgagaugggcgcgaacuucaaggccgagcgggucaucgacccgcgccggugcaugaagcccgugauccucaccgacggggaggagcgcgugauccuggccggccccaugcccgucacccacuccagcgccgcccagcggcgcgggcgggugggccgcaacccgaagaacgagaacgaccaguacaucuacaugggggagccccuggagaacgacgaggacugcgcgcacuggaaggaggccaagaugcuccuggacaacaucaacacccccgagggcaucauccccuccauguucgagccggagcgcgagaagguggacgccaucgacggcgaguaccggcugcgcggggaggcccggaagacguucgucgaccucaugcgccggggcgaccugcccguguggcuggccuaccgcgucgcggccgaggggaucaacuacgccgaccggcgcuggugcuucgacggcgugaagaacaaccagauccucgaggagaacguggaggucgagaucuggaccaaggagggggagcggaagaagcugaagccccgcuggcuggacgcccggaucuacagcgacccgcucgcccugaaggaguucaaggaguucgcggccggccgcaagucccugacccucaaccugaucaccgagaugggccggcugcccacguucaugacccagaaggccaagaacgcccucgacaaccuggcggugcugcacaccgccgaggccgggggccgcgccuacaaccacgcccucagcgagcugcccgagacccuggagacgcuccugcugcucacccugcuggcgaccgugaccgggggcaucuuccucuuccugauguccggcaaggggaucggcaagaugacccuggggaugugcugcaucaucacggccagcauccuccugugguacgcccagauccagccccacuggaucgccgccuccaucauccuggaguucuuccucaucguccugcugaucccggagcccgagaagcagcggacgccccaggacaaccagcucaccuacguggugaucgcgauccugaccgucguggccgccacgauggccaacgagaugggcuuccuggagaagaccaagaaggacuucgggcucggcagcaucaccacccagcagcccgagagcaacauccuggacaucgaccugcgcccggccuccgcguggacgcucuacgccguggccaccaccuucaucacccccaugcugcggcacagcaucgagaacuccagcgucaacgugucccugacggccaucgccaaccaggcgaccgugcucaugggccuggggaagggcuggccccugagcaagauggacaucggggucccccuccuggccaucggcugcuacucccaggugaacccgaucacccugaccgccgcccuccugcugcucguggcgcacuacgccaucaucgggcccggccugcaggccaaggccacgcgcgaggcccagaagcgggcggccgccggcaucaugaagaaccccaccgucgacgggaugaccgugaucgaccuggaccccaucccguacgaccccaaguucgagaagcagcucggccaggugaugcugcugguccucugcgugacccaggugcugaugaugcgcacgaccugggcccugugcgaggcccucacccuggcgaccgggcccaucagcacgcugugggagggcaaccccgggcgguucuggaacaccaccaucgccgucuccauggccaacaucuuccgcggcagcuaccucgccggcgccgggcugcuguucuccaucaugaagaacaccgcgaacacgcgccggggcaccgggaacaccggcgagacccucggcgagaaguggaagaaccgccugaacgcccugggcaagagcgaguuccagaucuacaagaaguccggcauccaggagguggaccggacgcucgccaaggaggggaucaagcgcggcgagaccgaccaccacgccgugagccggggguccgcgaagcugcgcugguucgucgagcggaaccuggugaccccggagggcaagguggucgaccucggcugcgggcgcggcggguggagcuacuacugcggcgggcugaagaacgugaaggaggugaagggccugaccaagggcgggcccggccacgaggagcccauccccauguccacguacggguggaaccucguccggcugcagagcggcguggacguguucuucaccuccccggagaagugcgacacccugcucugcgacaucggggagagcagccccaaccccaccgucgaggccggccgcacccugcgggugcugaaccucguggagaacuggcugaacaacaacacgcaguucugcaucaagguccugaaccccuacaugccguccgugaucgagaagauggaggcccugcagcgcaaguacggcggggcccucgugcggaacccccugagccgcaacuccacccacgagauguacugggucagcaacgccuccggcaacaucgugagcuccgugaacaugaucagccggaugcugaucaaccgcuucaccaugcggcacaagaaggcgaccuacgagcccgacgucgaccucggguccggcacgcgcaacaucgggaucgagagcgagaccccgaaccuggacaucaucggcaagcggaucgagaagaucaagcaggagcacgagaccuccuggcacuacgaccaggaccaccccuacaagaccugggccuaccacggcagcuacgagacgaagcagaccggguccgccagcuccauggugaacggcgugguccgccugcucaccaagcccugggacgugauccccauggugacccagauggccaugacggacaccaccccguucgggcagcagcgcgucuucaaggagaagguggacacccggacgcaggagcccaaggagggcaccaagaagcugaugaagaucaccgccgaguggcuguggaaggagcucggcaagaagaagacgccccgcaugugcacgcgggaggaguucacccgcaagguccggagcaacgcggcccugggggccaucuucaccgacgagaacaaguggaaguccgcccgcgaggccguggaggacagcggcuucugggagcugguggacaaggagcggaaccuccaccuggaggggaagugcgagaccugcgucuacaacaugaugggcaagcgcgagaagaagcugggggaguucggcaaggcgaagggcucccgggccaucugguacauguggcucggggcccgcuuccuggaguucgaggcccugggcuuccucaacgaggaccacugguucagccgggagaacagccuguccgggguggagggcgaggggcugcacaagcucggcuacauccugcgcgacgugagcaagaaggagggcggggcgauguacgccgacgacacggccggcugggacacccggaucacccuggaggaccucaagaacgaggagauggucaccaaccacauggagggggagcacaagaagcuggccgaggccaucuucaagcugacguaccagaacaagguggugcgcguccagcggcccaccccgcgcggcaccgugauggacaucaucucccggcgcgaccagcgggggagcggccagguggucaccuacggccucaacacguucaccaacauggaggcgcagcugauccgccagauggagggggagggcguguucaaguccauccagcagcugaccgugaaggaggagaucgccgucaagaacuggcucauccggguggggcgcgagcgccugagccggauggccaucuccggcgacgacugcguggucaagccccuggacgaccgcuucgccagcgcccucaccgcgcugaacgacaugggcaaggugcggaaggacauccagcagugggagcccucccgcggguggaacgacuggacccaggugcccuucugcagccaccacuuccacgagcugaucaugaaggacggccggguccucguggugccgugccgcaaccaggacgagcugaucgggcgggcccgcaucucccagggcgccggguggagccugcgggagaccgccugccucggcaaguccuacgcccagauguggagccugauguacuuccaccgccgggaccugcgccucgcggccaacgccaucugcuccgccguccccagccacuggauccccaccucccggaccaccuggagcauccacgccacgcacgaguggaugaccaccgaggacaugcugaccguguggaaccgcguguggauccaggagaaccccuggauggaggacaagacgccggucgagagcugggaggagauccccuaccugggcaagcgggaggaccaguggugcgggucccucaucggccugaccagccgcgcgaccugggccaagaacauccagaccgccaucaaccaggugcggucccugaucgggaacgaggaguacacggacuacaugcccagcaugaagcgcuuccggcgcgaggaggaggaggccggcgugcucugguga

SEQ ID NO: 9046 - RNA, 9876 nt, Artificial Sequence
  derived and/or modified CDS sequence (opt1) from DENV-2__KX380814__SS-prME
accgcgggcaucaucaucaugaugauccccaccgugauggccuuccaccugaccacccgcaacggggagccccacaugaucgucagccggcaggagaagggcaagucccuccuguucaagaccgagaacggggugaacaugugcacccugauggcgauggaccucggcgagcugugcgaggacaccaucaccuacaacugcccccugcuccgccagaacgagcccgaggacaucgacugcuggugcaacagcaccuccaccugggugaccuacgggaccugcaccgccaccggcgagcaccggcgcgagaagcggagcgucgcccuggugccccacgugggcauggggcuggagacccgcaccgagaccuggauguccagcgagggcgccuggaagcacgcccagcggaucgagaccuggauccuccgccaccccggguucaccaucauggcggccauccuggccuacaccaucggcaccaccuacuuccagcggguccugaucuucauccuccugacggccgugacccccuccauggcgaugcgcugcaucgggaucagcaaccgggacuucguggagggcgucuccggcgggagcuggguggacaucgugcuggagcacggcuccugcgucaccaccauggccaagaacaagcccacgcucgacuucgagcugaucaagaccgaggccaagcaccuggccacccuccgcaaguacugcguggaggccaagcugaccaacacgaccaccgcgagccggugccccacccagggggagcccucccugaacgaggagcaggacaagcgcuucgugugcaagcacagcauggucgaccggggcuggggcaacgggugcggccucuucgggaagggcgggaucgugacgugcgccauguucacgugcaagaagaacauggagggcaaggugguccagcccgagaaccuggaguacaccaucgugaucacgccccacuccggcgaggagaacgccguggggaacgacacgggcaagcacgggaaggagaucaaggucacgccccagagcuccaucaccgaggccgagcugaccggcuacgggaccgugacgauggagugcagcccgcgcaccggccucgacuucaacgagauggugcugcugcagauggagaacaaggccuggcucguccaccggcagugguuccuggaccugccccuccccuggcugcccggcgcggacacccagggguccaacuggauccagaaggagacccuggugacguucaagaacccgcacgccaagaagcaggacgucguggugcucggcagccaggagggggccaugcacaccgcccugaccggcgccaccgagauccagaugagcuccgggaaccuccuguucacgggccaccugaagugccgccugcggauggacaagcuccagcugaagggcaugagcuacuccaugugcaccgggaaguucaaggucgugaaggagaucgcggagacccagcacggcaccaucgugauccgcguccaguacgagggggacggcagccccugcaagauccccuucgagaucauggaccuggagaagcggcacgugcucggccgccugaucacggugaaccccaucgucaccgagaaggacuccccggugaacaucgaggccgagccgcccuucggggacagcuacaucaucaucggcguggagcccgggcagcugaagcucuccugguucaagaagggcagcuccaucgggcagauguucgagaccaccaugcgcggcgccaagcggauggccauccugggcgacacggccugggacuucgggagccugggcggggucuucaccuccaucggcaaggcgcuccaccagguguucggggccaucuacggcgccgccuucagcggcguguccuggaccaugaagauccugaucggggucgugaucaccuggaucggcaugaacagccgcuccacgagccuguccgugagccugguccucguggggguggucacccuguaccugggcgugauggugcaggcggacuccgggugcgucgugagcuggaagaacaaggagcucaagugcggcagcggcaucuucaucaccgacaacgugcacaccuggacggagcaguacaaguuccagccggagucccccagcaagcuggccuccgccauccagaaggcccacgaggaggggaucugcggcauccggagcgucacccgccuggagaaccucauguggaagcagaucacccccgagcugaaccacauccugaccgagaacgaggugaagcucacgaucaugaccggggacaucaagggcaucaugcaggccgggaagcggacccugcgcccccagccgaccgagcugaaguacuccuggaaggcguggggcaaggccaagaugcucagcacggagcugcacaaccacaccuuccugaucgacggccccgagaccgccgagugccccaacaccaaccgggccuggaacucccucgagguggaggacuacggguucggcgucuucacgaccaacaucuggcugaagcugaaggagcgccaggacguguucugcgacagcaagcucauguccgccgcgaucaaggacaaccgggccgugcacgccgacaugggguacuggaucgagagcgcccugaacgacaccuggaagaucgagaaggccuccuucaucgaggucaagagcugccacuggccgaagucccacacccuguggagcaacggcgugcucgaguccgagaugaucauccccaagaacuucgcgggccccgugagccagcacaacuaccgccccggguaccacacccagacggccggcccguggcaccuggggcggcuggagauggacuucgacuucugcgagggcaccaccgucguggugaccgaggacugcgggaaccgcggccccucccuccggacgaccaccgccagcggcaagcugaucaccgaguggugcugccgcagcugcacgcugccgccccuccgguaccgcggggaggacggcugcugguacgggauggagauccggccgcugaaggagaaggaggagaaccuggucaacucccucgugaccgccggccacgggcagaucgacaacuucagccugggcgugcugggcauggcccucuuccuggaggagaugcugcgcacccgggucgggaccaagcacgccauccuccugguggccguguccuucgucacgcugaucaccggcaacaugagcuuccgcgaccucgggcgcgugauggugauggucggcgccaccaugaccgacgacaucgggaugggcgugacguaccuggcccugcucgcggccuucaagauccggcccaccuucgccgccggccugcugcuccgcaagcugaccuccaaggagcugaugaugaccacgaucgggaucgugcuccugagccaguccaccauccccgagagcauccuggagcucaccgacgcccuggcgcugggcaugaugguccucaagaucgugcggaacauggagaaguaccagcuggccgucaccaucauggccauccugugcgugcccaacgccgugauccuccagaacgccuggaaggucuccugcacgacccuggcgguggugagcgucuccccgcugcuccugaccagcucccagcagaaggccgacuggaucccccuggcccucaccaucaaggggcugaaccccacggccaucuuccugaccacccucagccgcaccuccaagaagcggagcuggccccugaacgaggcgaucauggccgugggcaugguguccauccuggccagcucccuccugaagaacgacaucccgaugacgggcccccuggucgccgggggccuccugaccgugugcuacgugcugaccgggcgcagcgccgaccucgagcuggagcgggcggccgacguccgcugggaggagcaggccgagaucagcggcuccagccccauccuguccaucaccaucagcgaggacggguccaugagcaucaagaacgaggaggaggagcagacgcucaccauccugauccggaccggccugcucgugaucuccggccuguuccccgugagcaucccgaucaccgccgccgcgugguaccugugggaggucaagaagcagcgcgccggggugcucugggacgugcccagcccgccgcccgucggcaaggccgagcuggaggacggggccuaccggaucaagcagaagggcauccugggguacagccagaucggcgccggcguguacaaggaggggaccuuccacacgauguggcacgugacccgcggcgcgguccucaugcacaaggggaagcggaucgagcccuccugggccgacgugaagaaggaccugaucagcuacggcgggggcuggaagcuggagggcgaguggaaggagggggaggaggugcagguccucgcccuggagcccggcaagaacccccgcgccgugcagaccaagcccgggcuguucaagaccaacacgggcaccaucggggccgugucccucgacuucagccccggcaccuccggcagccccaucgucgacaagaaggggaagguggugggccuguacgggaacggcgucgugacccgguccggcacguacgugagcgcgaucgcccagaccgagaaguccaucgaggacaacccggagaucgaggacgacaucuuccgcaagaagcggcugaccaucauggaccugcaccccggggccggcaagaccaagcgcuaccuccccgccaucguccgggaggcgaucaagcgcgggcugcggacgcugauccucgcccccacccgcgugguggccgccgagauggaggaggcccugcgcggccugccgauccgguaccagacccccgcgauccgcgccgagcacaccgggcgggagaucgucgaccucaugugccacgccacguucaccaugcgccugcugagccccauccgggugcccaacuacaaccucaucaucauggacgaggcccacuucaccgacccggccagcaucgcggcccgcggcuacaucuccacccggguggagaugggcgaggccgccgggaucuucaugacggccacgccgcccggcagccgcgaccccuucccgcaguccaacgcgcccaucauggacgaggagaaggagauccccgagcggagcuggaacuccgggcacgagugggucaccgacuucaagggcaagaccgugugguucgugcccagcaucaaggccgggaacgacaucgccgccugccugcgcaagaacggcaagaaggucauccagcugucccggaagacguucgacagcgaguacaucaagacccgcaccaacgacugggacuucguggugaccacggacaucuccgagaugggcgcgaacuucaaggccgagcgggucaucgacccgcgccggugcaugaagcccgugauccucaccgacggggaggagcgcgugauccuggccggccccaugcccgucacccacagcuccgccgcccagcggcgcgggcgggugggccgcaacccgaagaacgagaacgaccaguacaucuacaugggggagccccuggagaacgacgaggacugcgcgcacuggaaggaggccaagaugcuccuggacaacaucaacacccccgagggcaucauccccagcauguucgagccggagcgcgagaagguggacgccaucgacggcgaguaccggcugcgcggggaggcccggaagacguucgucgaccucaugcgccggggcgaccugcccguguggcuggccuaccgcgucgcggccgaggggaucaacuacgccgaccggcgcuggugcuucgacggcgugaagaacaaccagauccucgaggagaacguggaggucgagaucuggaccaaggagggggagcggaagaagcugaagccccgcuggcuggacgcccggaucuacuccgacccgcucgcccugaaggaguucaaggaguucgcggccggccgcaagagccugacccucaaccugaucaccgagaugggccggcugcccacguucaugacccagaaggccaagaacgcccucgacaaccuggcggugcugcacaccgccgaggccgggggccgcgccuacaaccacgcccucuccgagcugcccgagacccuggagacgcuccugcugcucacccugcuggcgaccgugaccgggggcaucuuccucuuccugaugagcggcaaggggaucggcaagaugacccuggggaugugcugcaucaucacggccuccauccuccugugguacgcccagauccagccccacuggaucgccgccagcaucauccuggaguucuuccucaucguccugcugaucccggagcccgagaagcagcggacgccccaggacaaccagcucaccuacguggugaucgcgauccugaccgucguggccgccacgauggccaacgagaugggcuuccuggagaagaccaagaaggacuucgggcucggcuccaucaccacccagcagcccgagagcaacauccuggacaucgaccugcgcccggccagcgcguggacgcucuacgccguggccaccaccuucaucacccccaugcugcggcacuccaucgagaacagcuccgucaacgugagccugacggccaucgccaaccaggcgaccgugcucaugggccuggggaagggcuggccccuguccaagauggacaucggggucccccuccuggccaucggcugcuacagccaggugaacccgaucacccugaccgccgcccuccugcugcucguggcgcacuacgccaucaucgggcccggccugcaggccaaggccacgcgcgaggcccagaagcgggcggccgccggcaucaugaagaaccccaccgucgacgggaugaccgugaucgaccuggaccccaucccguacgaccccaaguucgagaagcagcucggccaggugaugcugcugguccucugcgugacccaggugcugaugaugcgcacgaccugggcccugugcgaggcccucacccuggcgaccgggcccaucuccacgcugugggagggcaaccccgggcgguucuggaacaccaccaucgccgucagcauggccaacaucuuccgcggcuccuaccucgccggcgccgggcugcuguucagcaucaugaagaacaccgcgaacacgcgccggggcaccgggaacaccggcgagacccucggcgagaaguggaagaaccgccugaacgcccuggggaaguccgaguuccagaucuacaagaaguccggcauccaggagguggaccggacgcucgccaaggaggggaucaagcgcggcgagaccgaccaccacgccgugagccgggggagcgcgaagcugcgcugguucgucgagcggaaccuggugaccccggagggcaagguggucgaccucggcugcgggcgcggcgggugguccuacuacugcggcgggcugaagaacgugaaggaggugaagggccugaccaagggcgggcccggccacgaggagcccauccccaugagcacguacggguggaaccucguccggcugcaguccggcguggacguguucuucaccagcccggagaagugcgacacccugcucugcgacaucggggaguccagccccaaccccaccgucgaggccggccgcacccugcgggugcugaaccucguggagaacuggcugaacaacaacacgcaguucugcaucaagguccugaaccccuacaugccgagcgugaucgagaagauggaggcccugcagcgcaaguacggcggggcccucgugcggaacccccugucccgcaacagcacccacgagauguacugggucuccaacgccagcggcaacaucguguccagcgugaacaugaucucccggaugcugaucaaccgcuucaccaugcggcacaagaaggcgaccuacgagcccgacgucgaccucgggagcggcacgcgcaacaucgggaucgaguccgagaccccgaaccuggacaucaucggcaagcggaucgagaagaucaagcaggagcacgagaccagcuggcacuacgaccaggaccaccccuacaagaccugggccuaccacggcuccuacgagacgaagcagaccgggagcgccuccagcauggugaacggcgugguccgccugcucaccaagcccugggacgugauccccauggugacccagauggccaugacggacaccaccccguucgggcagcagcgcgucuucaaggagaagguggacacccggacgcaggagcccaaggagggcaccaagaagcugaugaagaucaccgccgaguggcuguggaaggagcucggcaagaagaagacgccccgcaugugcacgcgggaggaguucacccgcaagguccgguccaacgcggcccugggggccaucuucaccgacgagaacaaguggaaguccgcccgcgaggccguggaggacuccggcuucugggagcugguggacaaggagcggaaccuccaccuggaggggaagugcgagaccugcgucuacaacaugaugggcaagcgcgagaagaagcugggggaguucggcaaggcgaagggcagccgggccaucugguacauguggcucggggcccgcuuccuggaguucgaggcccugggcuuccucaacgaggaccacugguucucccgggagaacagccugagcgggguggagggcgaggggcugcacaagcucggcuacauccugcgcgacguguccaagaaggagggcggggcgauguacgccgacgacacggccggcugggacacccggaucacccuggaggaccucaagaacgaggagauggucaccaaccacauggagggggagcacaagaagcuggccgaggccaucuucaagcugacguaccagaacaagguggugcgcguccagcggcccaccccgcgcggcaccgugauggacaucaucagccggcgcgaccagcggggguccggccagguggucaccuacggccucaacacguucaccaacauggaggcgcagcugauccgccagauggagggggagggcguguucaagagcauccagcagcugaccgugaaggaggagaucgccgucaagaacuggcucauccggguggggcgcgagcgccugucccggauggccaucagcggcgacgacugcguggucaagccccuggacgaccgcuucgccuccgcccucaccgcgcugaacgacaugggcaaggugcggaaggacauccagcagugggagcccagccgcggguggaacgacuggacccaggugcccuucugcucccaccacuuccacgagcugaucaugaaggacggccggguccucguggugccgugccgcaaccaggacgagcugaucgggcgggcccgcaucagccagggcgccggguggucccugcgggagaccgccugccucggcaagagcuacgcccagauguggucccugauguacuuccaccgccgggaccugcgccucgcggccaacgccaucugcagcgccguccccucccacuggauccccaccagccggaccaccugguccauccacgccacgcacgaguggaugaccaccgaggacaugcugaccguguggaaccgcguguggauccaggagaaccccuggauggaggacaagacgccggucgagagcugggaggagauccccuaccugggcaagcgggaggaccaguggugcgggagccucaucggccugaccucccgcgcgaccugggccaagaacauccagaccgccaucaaccaggugcggagccugaucgggaacgaggaguacacggacuacaugcccuccaugaagcgcuuccggcgcgaggaggaggaggccggcgugcucugguga

SEQ ID NO: 9047 - RNA, 9876 nt, Artificial Sequence
  derived and/or modified CDS sequence (opt1) from DENV-2__KX380807__SS-prME
accgccggcaucaucaucaugaugauccccaccgugauggccuuccaccugaccacccggaacggggagccccacaugaucgugagccggcaggagaagggcaagagccuccuguucaagaccgagaacggggugaacaugugcacccugauggccauggaccucggcgagcugugcgaggacaccaucaccuacaacugcccccugcuccggcagaacgagcccgaggacaucgacugcuggugcaacagcaccagcaccugggugacguacgggaccugcaccgccaccggcgagcaccggcgcgagaagcggagcgucgcccuggcgccccacgugggcauggggcuggagacgcggaccgagaccuggauguccagcgagggcgccuggaagcacgcgcagcggaucgagaucugggugcuccgccaccccggguucaccaucauggccgccauccuggccuacacgaucggcaccaccuacuuccagcggguccugaucuucauccuccugaccgcgguggcccccuccaugacgaugcgcugcaucgggaucagcaaccgggacuucguggagggcgucuccggcgggagcuggguggacaucgugcuggagcacggcuccugcgucaccaccauggccaagaacaagcccacccucgacuucgagcugaucaagacggaggccaagcaccccgccacccugcgcaaguacugcaucgaggcgaagcucaccaacaccacgaccgccagccggugcccgacccagggggagcccucccugaacgaggagcaggacaagcgcuucgugugcaagcacagcaugguggaccggggcuggggcaacgggugcggccuguucgggaagggcgggaucgugaccugcgccauguucacgugcaagaagaacauggagggcaagaucgugcagcccgagaaccucgaguacaccaucgugaucacgccccacuccggcgaggagaacgccgucgggaacgacaccggcaagcacgggaaggagaucaaggugaccccgcagagcuccaucaccgaggccgagcugaccggcuacgggaccgugaccauggagugcagcccccgcacgggccuggacuucaacgagaugguccuccugcagauggagaacaaggcguggcuggugcaccggcagugguuccucgaccugccccugcccuggcucccgggcgccgacacccagggguccaacuggauccagaaggagacccuggugaccuucaagaacccccacgccaagaagcaggacgucgugguccugggcagccaggagggggccaugcacacggcccucaccggcgcgaccgagauccagaugagcuccgggaaccugcuguucaccggccaccucaagugccgccugcggauggacaagcugcagcucaagggcaugagcuacuccaugugcacggggaaguucaagguggugaaggagaucgccgagacccagcacggcaccaucgucauccgcgugcaguacgagggggacggcagccccugcaagauccccuucgagaucauggaccuggagaagcggcacgugcugggccgccucaucaccgucaacccgaucgugacggagaaggacucccccgugaacaucgaggccgagccgcccuucggggacagcuacaucaucaucggcgucgagccggggcagcugaagcuguccugguucaagaagggcagcuccaucgggcagauguucgagaccaccaugcgcggcgccaagcggauggccauccucggcgacaccgcgugggacuucgggagccugggcgggguguucacguccaucggcaaggcccugcaccagguguucggggccaucuacggcgccgcguucagcggcgucuccuggaccaugaagauccucaucgggguggugaucaccuggaucggcaugaacagccgcuccaccagccuguccgucagccuggugcuggugggggucgugacgcucuaccugggcgugaugguccaggccgacuccgggugcguggugagcuggaagaacaaggagcugaagugcggcagcggcaucuucaucaccgacaacguccacaccuggaccgagcaguacaaguuccagcccgagucccccagcaagcucgccuccgccauccagaaggcccacgaggaggggaucugcggcauccggagcgugacgcgccuggagaaccugauguggaagcagaucacccccgagcucaaccacauccuguccgagaacgaggugaagcugaccaucaugaccggggacaucaagggcaucaugcaggcggggaagcggagccuccgcccgcagcccacggagcugaaguacuccuggaaggccuggggcaaggccaagaugcugagcaccgagcuccacaaccacaccuuccugaucgacggccccgagaccgccgagugcccgaacacgaaccgggccuggaacucccuggaggucgaggacuacggguucggcguguucaccaccaacaucuggcucaagcugaaggagcgccaggacguguucugcgacagcaagcugauguccgcggccaucaaggacaaccgggccguccacgccgacaugggguacuggaucgagagcgcccucaacgacaccuggaagaucgagaaggcguccuucaucgaggucaagagcugccacuggcccaagucccacacgcuguggagcaacggcgugcuggaguccgagaugaucauccccaagaacuucgccggccccgucagccagcacaacuaccgcccgggguaccacacccagaccgccggccccuggcaccucgggcggcuggagauggacuucgacuucugcgagggcaccaccgugguggucacggaggacugcgggaaccgcggccccagccugcggaccaccaccgccuccggcaagcucaucacggaguggugcugccgcagcugcacccugcccccgcugcgguaccgcggggaggacggcugcugguacgggauggagauccggccccucaaggagaaggaggagaaccuggugaacucccuggugaccgcgggccacgggcagaucgacaacuucagccucggcguccugggcauggcccuguuccucgaggagaugcugcgcacccggguggggacgaagcacgccauccugcucguggccgucuccuucgugacccugaucaccggcaacaugagcuuccgcgaccuggggcgcgugauggucauggugggcgccaccaugacggacaacaucgggaugggcgugaccuaccucgcgcugcuggccgccuucaagguccggcccaccuucgccgccggccuccugcugcgcaagcucaccuccaaggagcugaugaugacgaccaucgggaucgugcugcucagccaguccaccauccccgagaccauccuggagcugacggacgcgcucgcccugggcaugauggugcugaagaucguccggaacauggagaaguaccagcucgccgugaccaucauggccauccugugcgucccgaacgccgugauccugcagaacgcguggaaggugagcugcaccauccucgccgucguguccgugagcccccugcugcucaccuccagccagcagaaggccgacuggaucccccuggcccugacgaucaaggggcucaaccccaccgcgaucuuccugaccacccugucccgcacgagcaagaagcgguccuggccgcucaacgaggccaucauggccgucggcauggugagcauccuggccuccagccugcucaagaacgacauccccaugaccggcccccugguggccgggggccugcucaccgucugcuacgugcugaccgggcgcagcgcggaccuggagcucgagcgggccgccgacgugcgcugggaggagcaggccgagaucuccggcagcucccccauccugagcaucacgaucuccgaggacgggagcauguccaucaagaacgaggaggaggagcagacccugaccauccucauccggaccggccugcuggucaucagcggccucuucccgguguccauccccaucacggccgcggccugguaccugugggaggugaagaagcagcgcgccgggguccugugggacgugcccagcccgccgcccgugggcaaggccgagcucgaggacggggccuaccggaucaagcagaagggcauccugggguacucccagaucggcgcgggcgucuacaaggaggggaccuuccacaccauguggcacgugacccgcggcgccgugcugaugcacaaggggaagcggaucgagcccagcugggccgacgucaagaaggaccucaucuccuacggcgggggcuggaagcuggagggcgaguggaaggagggggaggagguccaggugcuggcccucgagcccggcaagaacccccgcgccguccagaccaagcccgggcuguucaagacgaacaccggcaccaucggggcggugagccuggacuucucccccggcaccagcggcucccccaucguggacaagaaggggaaggucgugggccucuacgggaacggcguggucacgcggagcggcaccuacguguccgccaucgcccagaccgagaaguccaucgaggacaaccccgagaucgaggacgacaucuuccgcaagaagcggcugaccaucauggaccugcaccccggggccggcaagacgaagcgcuaccugcccgcgaucgugcgggaggccaucaagcgcgggcuccggacccugauccuggccccgacccgcgucguggccgccgagauggaggaggcgcuccgcggccugcccauccgguaccagacccccgccauccgcgccgagcacacggggcgggagaucguggaccugaugugccacgccaccuucaccaugcgccuccugagccccauccgggucccgaacuacaaccugaucaucauggacgaggcccacuucaccgaccccgcguccaucgccgcccgcggcuacaucagcacgcggguggagaugggcgaggccgccgggaucuucaugaccgcgacgccgcccggcucccgcgacccguucccccagagcaacgcccccaucauggacgaggagcgggagauccccgagcgcuccuggaacagcgggcacgagugggugaccgacuucaagggcaagacggucugguucgugccguccaucaaggccgggaacgacaucgccgcgugccuccggaagaacggcaagaaggugauccagcugagccgcaagaccuucgacuccgaguacaucaagacccggaccaacgacugggacuucgucgugacgaccgacaucagcgagaugggcgccaacuucaaggccgagcgcgugaucgacccccggcgcugcaugaagcccgucauccugaccgacggggaggagcgggugauccucgccggccccaugccggugacccacuccagcgccgcgcagcgccgggggcgcgucggccgcaaccccaagaacgagaacgaccaguacaucuacaugggggagccccuggagaacgacgaggacugcgcccacuggaaggaggccaagaugcugcucgacaacaucaacacgcccgagggcaucaucccguccauguucgagcccgagcgggagaagguggacgccguggacggcgaguaccgccugcgcggggaggcccgcaagaccuucgucgaccugaugcggcgcggcgaccuccccguguggcuggcguacaaggucgccgccgaggggaucaacuacgccgaccggcgcuggugcuucgacggcgugaagaacaaccagauccuggaggagaacguggaggucgagaucuggaccaaggagggggagcggaagaagcucaagccgcgcuggcuggacgcccggaucuacagcgacccccuggcgcucaaggaguucaaggaguucgccgccggccgcaagucccugacccugaaccucaucacggagaugggccggcugcccaccuucaugacccagaaggcccgcaacgcgcuggacaaccucgccgugcugcacaccgccgaggccgggggccgggccuacaaccacgcgcugagcgagcuccccgagacgcuggagacccugcuccugcugacccuccuggccaccgugaccggcgggaucuuccuguuccucauguccgggaaggggaucggcaagaugacccuggggaugugcugcaucaucaccgccagcauccugcucugguacgcccagauccagccgcacuggaucgccgcguccaucauccuggaguucuuccugaucguccuccugauccccgagcccgagaagcagcgcacgccccaggacaaccagcugaccuacguggugaucgccauccucacggucguggccgccaccauggccaacgagaugggcuuccuggagaagaccaagaaggacuucgggcugggcagcaucaccacgcagcagccggagagcaacauccucgacaucgaccugcggcccgcguccgccuggacccuguacgccguggccaccaccuucaucacgcccaugcuccgccacagcaucgagaacuccagcgucaacgugucccugaccgccaucgcgaaccaggccaccgugcugaugggccucgggaagggcuggccccugagcaagauggacaucggggucccgcugcucgccaucggcugcuacucccaggugaaccccaucacccugacggccgcgcugcuccugcugguggcccacuacgccaucaucgggcccggccuccaggccaaggccacccgggaggcgcagaagcgcaccgccgccggcaucaugaagauccccgccgcccugaucgucaccgugaucgaccuggacccgauccccuacgaccccaaguucgagaagcagcucggccaggugaugcugcugguccucugcagcacccaggugcugaugaugcggaccaccugggcgcugugcgaggcccucacccuggccacgggccccaucuccacccugugggaggggaacccgggccgcuucuggaacaccaccaucgccgugagcauggccaacaucuuccgcggguccuaccucgcgggcgccggccugcuguucagcaucaugaagaacacggccaacacccggcgcgggaccggcaacaccggggagacgcucggcgagaaguggaagaaccggcugaacgcccugggcaaguccgaguuccagaucuacaagaaguccgggauccaggaggucgaccgcacccucgcgaaggagggcaucaagcgcggggagaccgaccaccacgccgugucccgcggcagcgccaagcugcggugguucguggagcgcaaccuggucacccccgaggggaaggugguggaccucggcugcggccgcggcgggugguccuacuacugcggcgggcugaagaacgucaaggaggugaaggggcugacgaagggcgggcccgggcacgaggagcccaucccgaugagcaccuacggcuggaaccucgugcgccugcaguccggggucgacguguucuucacgccgcccgagaagugcgacacccugcucugcgacaucggcgagagcagccccaacccgacgguggaggccgggcggacccugcgcguccugacccucguggagaacuggcugaacaacaacacccaguucugcaucaaggugcugaaccccuacaugcccuccgucaucgagaagauggaggcccugcagcggaaguacggcggcgcgcucgugcgcaacccgcugagccggaacuccacccacgagauguacugggugagcaacgccuccgggaacaucgucagcuccgugaacaugaucagccgcaugcugaucaaccgguucacgaugcgccacaagaaggccaccuacgagcccgacguggaccucggcuccgggacccggaacaucggcaucgagagcgagacccccaaccuggacaucaucgggaagcgcaucgagaagaucaagcaggagcacgagacguccuggcacuacgaccaggaccaccccuacaagaccugggccuaccacggcagcuacgagaccaagcagaccggcuccgccagcuccauggucaacgggguggugcgccugcucacgaagccgugggacgucauccccauggugacccagauggcgaugaccgacaccacgcccuucggccagcagcggguguucaaggagaaggucgacacccgcacccaggagcccaaggaggggaccaagaagcugaugaagaucacggccgaguggcuguggaaggagcucggcaagaagaagaccccgcggaugugcacccgcgaggaguucacccggaaggugcgcagcaacgccgcccugggcgccaucuucacggacgagaacaaguggaaguccgcgcgggaggccgucgaggacagcggguucugggagcugguggacaaggagcgcaaccuccaccuggagggcaagugcgagaccugcguguacaacaugauggggaagcgggagaagaagcugggcgaguucgggaaggccaagggcucccgcgccaucugguacauguggcucggcgcgcgguuccuggaguucgaggcccugggguuccucaacgaggaccacugguucagccgcgagaacagccuguccggcgucgagggggagggccugcacaagcucggguacauccugcgggacgugagcaagaaggagggcggcgccauguacgccgacgacaccgccgggugggacacccgcaucacgcuggaggaccucaagaacgaggagauggugaccaaccacauggagggcgagcacaagaagcuggcggaggccaucuucaagcugaccuaccagaacaaggucgugcgggugcagcgccccacgccccgggggacggucauggacaucaucucccgccgggaccagcgcggcagcggccagguggugaccuacggccucaacaccuucaccaacauggaggcccagcugauccggcagauggagggcgagggggucuucaaguccauccagcagcugacggccaccgaggagaucgccgugaagaacuggcucgugcgcgucggccgcgagcggcugagccgcauggcgaucuccggggacgacugcguggugaagccccuggacgaccgguucgccagcgcccucaccgcccugaacgacaugggcaagguccgcaaggacauccagcagugggagccgucccggggcuggaacgacuggacccaggugcccuucugcagccaccacuuccacgagcugaucaugaaggacgggcgcgugcucgucgugcccugccggaaccaggacgagcugaucggccgcgcccggaucucccagggggcgggcuggagccugcgcgagacggccugccucgggaaguccuacgcccagauguggagccugauguacuuccaccggcgcgaccugcggcucgccgccaacgcgaucugcuccgccgugcccagccacugggucccgaccucccgcaccaccuggagcauccacgccacccacgaguggaugacgaccgaggacaugcugaccguguggaaccggguguggauccaggagaaccccuggauggaggacaagacccccgucgagagcugggaggagauccccuaccugggcaagcgcgaggaccaguggugcggcucccucaucgggcugacgagccgggccaccugggcgaagaacauccagaccgccaucaaccaggugcgcucccugaucggcaacgaggaguacaccgacuacaugccgagcaugaagcgguuccgccgcgaggaggaggaggccggggugcucugguga

SEQ ID NO: 9048 - RNA, 9876 nt, Artificial Sequence
  derived and/or modified CDS sequence (opt1) from DENV-2__KX380815__SS-prME
accgccgggaucaucaucaugaugauccccaccgugauggccuuccaccugaccacccggaacggggagccccacaugaucgugagccggcaggagaagggcaagagccuccuguucaagaccgagaacggggugaacaugugcacccugauggcgauggaccucggggagcugugcgaggacaccaucaccuacaacugcccccugcuccggcagaacgagcccgaggacaucgacugcuggugcaacagcaccuccaccugggugaccuacgggaccugcaccgccaccggcgagcaccggcgggagaagcggagcgucgcccuggugccccacgugggcauggggcuggagacccggaccgagaccuggauguccagcgagggcgccuggaagcacgcccagcggaucgagaccuggguccuccgccaccccggguucacgaucauggcggccauccuggccuacaccaucggcaccaccuacuuccagcgggugcugaucuucauccuccugacggccguggcgcccuccaugaccaugcgcugcaucgggaucagcaaccgggacuucgucgagggcguguccggcgggagcuggguggacaucguccuggagcacggcuccugcgugaccaccauggccaagaacaagcccacgcucgacuucgagcugaucaagaccgaggccaagcaccccgccacccugcgcaaguacugcaucgaggccaagcucaccaacacgaccaccgcgagccggugcccgacccagggggagcccucccugaacgaggagcaggacaagcgcuucgugugcaagcacagcauggucgaccggggcuggggcaacgggugcggccuguucgggaagggcgggaucgugacgugcgccauguucacgugcaagaagaacauggagggcaagaucgugcagcccgagaaccucgaguacaccaucgucaucacgccccacuccggcgaggagaacgccguggggaacgacacgggcaagcacgggaaggagaucaaggugaccccgcagagcuccaucaccgaggccgagcugaccggcuacgggaccgucacgauggagugcagcccccgcaccggccuggacuucaacgagauggugcuccugcagauggagaacaaggccuggcuggugcaccggcagugguuccucgaccugccccugcccuggcucccgggcgcggacacccagggguccaacuggauccagaaggagacccuggucacguucaagaacccccacgccaagaagcaggacguggucgugcugggcagccaggagggggccaugcacaccgcccucaccggcgccaccgagauccagaugagcuccgggaaccugcuguucacgggccaccucaagugccgccugcggauggacaagcugcagcucaagggcaugagcuacuccaugugcaccgggaaguucaagguggucaaggagaucgcggagacccagcacggcaccaucgugauccgcgugcaguacgagggggacggcagccccugcaagauccccuucgagaucauggaccuggagaagcggcacguccugggccgccucaucacggugaacccgaucgugaccgagaaggacucccccgucaacaucgaggccgagccgcccuucggggacagcuacaucaucaucggcguggagccggggcagcugaagcuguccugguucaagaagggcagcuccaucgggcagauguucgagaccaccaugcgcggcgccaagcggauggccauccucggcgacacggccugggacuucgggagccugggcgggguguucaccuccaucggcaaggcgcugcaccaggucuucggggccaucuacggcgccgccuucagcggcguguccuggaccaugaagauccucaucgggguggucaucaccuggaucggcaugaacagccgcuccacgagccuguccgugagccuggugcuggucgggguggugacccucuaccugggcgucauggugcaggcggacuccgggugcguggucagcuggaagaacaaggagcugaagugcggcagcggcaucuucaucaccgacaacgugcacaccuggacggagcaguacaaguuccagcccgagucccccagcaagcucgccuccgccauccagaaggcccacgaggaggggaucugcggcauccggagcgugacccgccuggagaaccugauguggaagcagaucacccccgagcucaaccacauccugaccgagaacgaggucaagcugacgaucaugaccggggacaucaagggcaucaugcaggccgggaagcggucccuccgcccgcagcccaccgagcugaaguacagcuggaaggcguggggcaaggccaagaugcuguccaccgagcuccacaaccacacguuccugaucgacggccccgagaccgccgagugcccgaacaccaaccgggccuggaacagccuggagguggaggacuacggguucggcguguucaccacgaacaucuggcucaagcugaaggagcgccaggacgucuccugcgacagcaagcugauguccgccgcgaucaaggacaaccgggccgugcacgccgacaugggguacuggaucgagagcgcccucaacgacaccuggaagaucgagaaggccuccuucaucgaggucaagagcugccacuggcccaagucccacacccuguggagcaacggcgugcuggaguccgagaugaucauccccaagaacuucgcgggccccgugagccagcacaacuaccgcccgggguaccacacccagaccgccggccccuggcaccucgggcggcuggagauggacuucgacuucugcgagggcacgaccguggucgugaccgaggacugcgggaaccgcggccccagccugcggaccacgaccgccuccggcaagcucaucaccgaguggugcugccgcagcugcacccugcccccgcugcgguaccgcggggaggacggcugcugguacgggauggagauccggccccucaaggagaaggaggagaaccuggugaacucccuggucacggccggccacgggcagaucgacaacuucagccucggcgugcugggcauggcgcuguuccucgaggagaugcugcgcacccggguggggaccaagcacgccauccugcucgucgccguguccuucgugacccugaucacgggcaacaugagcuuccgcgaccuggggcgcgucauggugauggugggcgccaccaugaccgacgacaucgggaugggcgucaccuaccucgcccugcuggcggccuucaaggugcggcccacguucgccgccggccuccugcugcgcaagcucaccuccaaggagcugaugaugaccaccaucgggaucgugcugcucagccaguccacgauccccgagaccauccuggagcugaccgacgcccucgcgcugggcaugaugguccugaagaucgugcggaacauggagaaguaccagcucgccgucaccaucauggccauccugugcgugccgaacgccgugauccugcagaacgccuggaaggucagcugcacgacccucgcggugguguccgucagcccccugcugcucaccuccagccagcagaagaccgacuggaucccccuggcccugacgaucaaggggcucaaccccaccgccaucuuccugaccacccugucccgcacgagcaagaagcgguccuggccgcucaacgaggccaucauggcggugggcauggugagcauccuggccuccagcuuccugaagaacgacauccccaugaccggcccccucgucgccgggggccugcugaccgugugcuacgugcucaccgggcgcagcgccgaccuggagcuggagcgggccgcggacauccgcugggaggagcaggccgagaucuccggcagcucccccauccucagcaucacgaucuccgaggacgggagcauguccaucaagaacgaggaggaggagcagacccugaccauccugauccggaccggccuccuggucaucagcggccuguucccgguguccauccccaucaccgccgccgccugguaccucugggaggugaagaagcagcgcgcggggguccugugggacgugcccagcccgccgcccgugggcaaggccgagcuggaggacggggccuaccggaucaagcagaagggcauccucggguacucccagaucggcgccggcgucuacaaggaggggacguuccacaccauguggcacgugacccgcggcgccgugcugaugcacaaggggaagcggaucgagcccagcugggcggacgucaagaaggaccugaucuccuacggcgggggcuggaagcucgagggcgaguggaaggagggggaggagguccaggugcuggcccuggagcccggcaagaacccccgcgccguccagaccaagcccggccucuucaagacgaacaccggcaccaucggggccgugagccuggacuucucccccggcaccagcggcucccccaucguggacaagaaggggaaggucgugggccuguacgggaacggcguggucacgcggagcggcaccuacguguccgccaucgcgcagaccgagaagaacaucgaggacaaccccgagaucgaggacgacaucuuccgcaagaagcggcucaccaucauggaccugcaccccggggccggcaagacgaagcgcuaccugcccgccaucgugcgggaggccaucaagcgcgggcugcggacccucauccuggcgccgacccgcgucguggccgccgagauggaggaggcccugcgcggccuccccauccgguaccagacccccgccauccgcgcggagcacacggggcgggagaucguggaccugaugugccacgccaccuucaccaugcgccugcucagccccauccgggucccgaacuacaaccugaucaucauggacgaggcccacuucaccgaccccgccagcaucgccgcgcgcggcuacaucuccacgcggguggagaugggcgaggccgccgggaucuucaugaccgccacgccgcccggcagccgcgacccguucccccaguccaacgcccccaucauggacgaggagcgggagauccccgagcgcagcuggaacuccgggcacgagugggugaccgacuucaagggcaagacggucugguucgugccgagcaucaaggcggggaacgacaucgccgccugccugcggaagaacggcaagaaggugauccagcucucccgcaagaccuucgacagcgaguacgucaagacccggaccaacgacugggacuucguggugacgaccgacaucuccgagaugggcgccaacuucaaggcggagcgcgucaucgacccccggcgcugcaugaagcccgugauccugaccgacggggaggagcgggugauccuggccggccccaugccggucacccacagcuccgccgcccagcgccgggggcgcgugggccgcaaccccaagaacgagaacgaccaguacaucuacaugggggagccccucgagaacgacgaggacugcgcccacuggaaggaggcgaagaugcugcuggacaacaucaacacgcccgagggcaucaucccgagcauguucgagcccgagcgggagaagguggacgccaucgacggcgaguaccgccuccgcggggaggcccgcaagaccuucgucgaccugaugcggcgcggcgaccugcccguguggcucgccuaccgggucgccgcggaggggaucaacuacgccgaccgccgguggugcuucgacggcgugaagaacaaccagauccuggaggagaacguggaggucgagaucuggaccaaggagggggagcgcaagaagcugaagccgcgguggcucgacgcccgcaucuacuccgacccccuggcccugaaggaguucaaggaguucgccgcgggccgcaagagccucacccugaaccugaucacggagaugggccgccuccccaccuucaugacccagaaggcccggaacgcccuggacaaccuggccgugcuccacaccgcggaggccgggggccgcgccuacaaccacgcccuguccgagcugcccgagacgcucgagacccugcugcuccugacccugcucgccaccgugaccgggggcaucuuccuguuccugaugagcggcaaggggaucggcaagaugacgcucgggaugugcugcaucgucaccgcguccauccugcugugguacgcccagauccagccgcacuggaucgccgccagcaucauccucgaguucuuccugaucgugcugcucauccccgagcccgagaagcagcggacgccccaggacaaccagcugaccuacguggucaucgccauccugacggugguggcggccaccauggccaacgagaugggcuuccucgagaagaccaagaaggacuucgggcugggcuccaucaccacgcagcagccggagagcaacauccuggacaucgaccuccgccccgccagcgccuggacccuguacgcggucgccaccaccuucaucacgcccaugcugcggcacuccaucgagaacagcuccgugaacgugagccucaccgccaucgccaaccaggccaccguccugaugggccuggggaagggcuggccccucuccaagauggacaucggggugccgcugcuggcgaucggcugcuacagccaggugaaccccaucacccucacggccgcccugcugcuccuggucgcccacuacgcgaucaucgggcccggccugcaggccaaggccacccgcgaggcccagaagcgggccgcggccggcaucaugaagauccccgccgcccucaucaugaccgugaucgaccuggacccgauccccuacgaccccaaguucgagaagcagcugggccaggugaugcuccugguccugugcuccacccaggugcucaugaugcgcacgaccugggcccugugcgaggcgcugacccucgccaccggccccaucagcacgcugugggaggggaacccgggccgcuucuggaacaccaccaucgccguguccauggccaacaucuuccgggggagcuaccuggccggcgcgggccuccuguucuccaucaugaagaacaccgccaacacgcgccgggggaccggcaacaccggggagacccugggcgagaaguggaagaaccagcucaacgcccugggcaagagcgaguuccagaucuacaagaaguccgggauccaggaggucgaccgcacgcuggccaaggagggcaucaagcgcggggagaccgaccaccacgcggugagccgcggcuccgccaagcuccggugguucguggagcgcaaccuggucacccccgaggggaaggugguggaccugggcugcggccgcggcggguggagcuacuacugcggcgggcucaagaacgucaaggaggugaaggggcugaccaagggcgggcccgggcacgaggagcccaucccgauguccacguacggcuggaaccuggugcgccuccagagcggggucgacguguucuucacgccgcccgagaagugcgacacccugcugugcgacaucggcgaguccagccccaacccgaccguggaggccgggcggacccuccgcguccugaaccugguggagaacuggcucaacaacaacacgcaguucugcaucaaggugcugaaccccuacaugcccagcgucaucgagaagauggaggcccugcagcggaaguacggcggcgcccuggugcgcaacccgcucucccggaacagcacccacgagauguacuggguguccaacgcgagcgggaacaucgucuccagcgugaacaugaucucccgcaugcugaucaaccgguucaccaugcgccacaagaaggccaccuacgagcccgacguggaccugggcagcgggacgcggaacaucggcaucgaguccgagguccccaaccucgacaucaucgggaagcgcaucgagaagaucaagcaggagcacgagaccagcuggcacuacgaccaggaccaccccuacaagaccugggccuaccacggcuccuacgagaccaagcagacgggcagcgccuccagcauggugaacggggugguccgccugcugaccaagccgugggacgugauccccauggugacccagauggccaugaccgacacgacccccuucggccagcagcgggucuucaaggagaagguggacacccgcacccaggagcccaaggaggggacgaagaagcucaugaagaucaccgcggaguggcuguggaaggagcugggcaagaagaagaccccgcggaugugcacccgcgaggaguucacgcggaagguccgcuccaacgccgcccucggcgccaucuucaccgacgagaacaaguggaaguccgcccgggaggcgguggaggacuccggguucugggagcugguggacaaggagcgcaaccugcaccucgagggcaagugcgagaccugcgucuacaacaugauggggaagcgggagaagaagcugggcgaguucgggaaggccaagggcagccgcgccaucugguacauguggcugggcgcccgguuccucgaguucgaggcgcugggguuccugaacgaggaccacugguucucccgcgagaacagccucagcggcguggagggggagggccugcacaagcugggguacauccuccgggacguguccaagaaggagggcggcgccauguacgccgacgacaccgccgggugggacacgcgcaucacccuggaggaccugaagaacgaggagauggucaccaaccacauggagggcgagcacaagaagcucgccgaggcgaucuuccggcugaccuaccagaacaagguggugcgcguccagcggcccacgccccgcgggaccgugauggacaucaucagccggcgcgaccagcggggcuccggccagguggucaccuacggccugaacaccuucacgaacauggaggcccagcucauccgccagauggagggcgaggggguguucaagagcauccagcaccugaccgccaccgaggagaucgccgugaagaacuggcugguccgcgugggccgggagcgccucucccggauggccaucagcggggacgacugcguggucaagccccuggacgaccgcuucgcgaacgcccugaccgcccucaacgacaugggcaaggugcggaaggacauccagcagugggagccgucccgcggcuggaacgacuggacccaggugcccuucugcagccaccacuuccacgagcugaucaugaaggacgggcggguccugguggugcccugccgcaaccaggacgagcucaucggccgggcccgcaucucccagggggccggcuggagccugcgggagaccgcgugccuggggaaguccuacgcccagauguggagccucauguacuuccaccgccgggaccugcgccuggccgccaacgccaucugcuccgcgguccccagccacugggugccgaccucccggaccaccuggagcauccacgccacgcacgaguggaugaccaccgaggacaugcucaccguguggaaccgcgucuggauccaggagaaccccuggauggaggacaagacgcccguggaguccugggaggagauccccuaccugggcaagcgggaggaccaguggugcggcagccugaucgggcucaccagccgcgccaccugggccaagaacauccagaccgcgaucaaccaggugcggucccugaucggcaacgaggaguacacggacuacaugccgagcaugaagcgcuuccgccgggaggaggaggaggccgggguccugugguga

SEQ ID NO: 9049 - RNA, 9876 nt, Artificial Sequence
  derived and/or modified CDS sequence (opt1) from DENV-2__KX380816__SS-prME
accgcgggcaucaucaucaugaugauccccaccgugauggccuuccaccugaccacccgcaacggggagccccacaugaucgucagccggcaggagaagggcaagucccuccuguucaagaccgagaacggggugaacaugugcacccugauggcgauggaccucggcgagcugugcgaggacaccaucaccuacaacugcccccugcuccgccagaacgagcccgaggacaucgacugcuggugcaacagcaccuccaccugggugaccuacgggaccugcaccgccaccggcgagcaccggcgcgagaagcggagcgucgcccuggugccccacgugggcauggggcuggagacccgcaccgagaccuggauguccagcgagggcgccuggaagcacgcccagcggaucgagaccuggauccuccgccaccccggguucaccaucauggcggccauccuggccuacaccaucggcaccaccuacuuccagcggguccugaucuucauccuccugacggccgugacccccuccauggcgaugcgcugcaucgggaucagcaaccgggacuucguggagggcgucuccggcgggagcuggguggacaucgugcuggagcacggcuccugcgucaccaccauggccaagaacaagcccacgcucgacuucgagcugaucaagaccgaggccaagcaccuggccacccuccgcaaguacugcguggaggccaagcugaccaacacgaccaccgcgagccggugccccacccagggggagcccucccugaacgaggagcaggacaagcgcuucgugugcaagcacagcauggucgaccggggcuggggcaacgggugcggccucuucgggaagggcgggaucgugacgugcgccauguucacgugcaagaagaacauggagggcaaggugguccagcccgagaaccuggaguacaccaucgugaucacgccccacuccggcgaggagaacgccguggggaacgacacgggcaagcacgggaaggagaucaaggucacgccccagagcuccaucaccgaggccgagcugaccggcuacgggaccgugacgauggagugcagcccgcgcaccggccucgacuucaacgagauggugcugcugcagauggagaacaaggccuggcucguccaccggcagugguuccuggaccugccccuccccuggcugcccggcgcggacacccagggguccaacuggauccagaaggagacccuggugacguucaagaacccgcacgccaagaagcaggacgucguggugcucggcagccaggagggggccaugcacaccgcccugaccggcgccaccgagauccagaugagcuccgggaaccuccuguucacgggccaccugaagugccgccugcggauggacaagcuccagcugaagggcaugagcuacuccaugugcaccgggaaguucaaggucgugaaggagaucgcggagacccagcacggcaccaucgugauccgcguccaguacgagggggacggcagccccugcaagauccccuucgagaucauggaccuggagaagcggcacgugcucggccgccugaucacggugaaccccaucgucaccgagaaggacuccccggugaacaucgaggccgagccgcccuucggggacagcuacaucaucaucggcguggagcccgggcagcugaagcucuccugguucaagaagggcagcuccaucgggcagauguucgagaccaccaugcgcggcgccaagcggauggccauccugggcgacacggccugggacuucgggagccugggcggggucuucaccuccaucggcaaggcgcuccaccagguguucggggccaucuacggcgccgccuucagcggcguguccuggaccaugaagauccugaucggggucgugaucaccuggaucggcaugaacagccgcuccacgagccuguccgugagccugguccucguggggguggucacccuguaccugggcgugauggugcaggcggacuccgggugcgucgugagcuggaagaacaaggagcucaagugcggcagcggcaucuucaucaccgacaacgugcacaccuggacggagcaguacaaguuccagccggagucccccagcaagcuggccuccgccauccagaaggcccacgaggaggggaucugcggcauccggagcgucacccgccuggagaaccucauguggaagcagaucacccccgagcugaaccacauccugaccgagaacgaggugaagcucacgaucaugaccggggacaucaagggcaucaugcaggccgggaagcggacccugcgcccccagccgaccgagcugaaguacuccuggaaggcguggggcaaggccaagaugcucagcacggagcugcacaaccacaccuuccugaucgacggccccgagaccgccgagugccccaacaccaaccgggccuggaacucccucgagguggaggacuacggguucggcgucuucacgaccaacaucuggcugaagcugaaggagcgccaggacguguucugcgacagcaagcucauguccgccgcgaucaaggacaaccgggccgugcacgccgacaugggguacuggaucgagagcgcccugaacgacaccuggaagaucgagaaggccuccuucaucgaggucaagagcugccacuggccgaagucccacacccuguggagcaacggcgugcucgaguccgagaugaucauccccaagaacuucgcgggccccgugagccagcacaacuaccgccccggguaccacacccagacggccggcccguggcaccuggggcggcuggagauggacuucgacuucugcgagggcaccaccgucguggugaccgaggacugcgggaaccgcggccccucccuccggacgaccaccgccagcggcaagcugaucaccgaguggugcugccgcagcugcacgcugccgccccuccgguaccgcggggaggacggcugcugguacgggauggagauccggccgcugaaggagaaggaggagaaccuggucaacucccucgugaccgccggccacgggcagaucgacaacuucagccugggcgugcugggcauggcccucuuccuggaggagaugcugcgcacccgggucgggaccaagcacgccauccuccugguggccguguccuucgucacgcugaucaccggcaacaugagcuuccgcgaccucgggcgcgugauggugauggucggcgccaccaugaccgacgacaucgggaugggcgugacguaccuggcccugcucgcggccuucaagauccggcccaccuucgccgccggccugcugcuccgcaagcugaccuccaaggagcugaugaugaccacgaucgggaucgugcuccugagccaguccaccauccccgagagcauccuggagcucaccgacgcccuggcgcugggcaugaugguccucaagaucgugcggaacauggagaaguaccagcuggccgucaccaucauggccauccugugcgugcccaacgccgugauccuccagaacgccuggaaggucuccugcacgacccuggcgguggugagcgucuccccgcugcuccugaccagcucccagcagaaggccgacuggaucccccuggcccucaccaucaaggggcugaaccccacggccaucuuccugaccacccucagccgcaccuccaagaagcggagcuggccccugaacgaggcgaucauggccgugggcaugguguccauccuggccagcucccuccugaagaacgacaucccgaugacgggcccccuggucgccgggggccuccugaccgugugcuacgugcugaccgggcgcagcgccgaccucgagcuggagcgggcggccgacguccgcugggaggagcaggccgagaucagcggcuccagccccauccuguccaucaccaucagcgaggacggguccaugagcaucaagaacgaggaggaggagcagacgcucaccauccugauccggaccggccugcucgugaucuccggccuguuccccgugagcaucccgaucaccgccgccgcgugguaccugugggaggucaagaagcagcgcgccggggugcucugggacgugcccagcccgccgcccgucggcaaggccgagcuggaggacggggccuaccggaucaagcagaagggcauccugggguacagccagaucggcgccggcguguacaaggaggggaccuuccacacgauguggcacgugacccgcggcgcgguccucaugcacaaggggaagcggaucgagcccuccugggccgacgugaagaaggaccugaucagcuacggcgggggcuggaagcuggagggcgaguggaaggagggggaggaggugcagguccucgcccuggagcccggcaagaacccccgcgccgugcagaccaagcccgggcuguucaagaccaacacgggcaccaucggggccgugucccucgacuucagccccggcaccuccggcagccccaucgucgacaagaaggggaagguggugggccuguacgggaacggcgucgugacccgguccggcacguacgugagcgcgaucgcccagaccgagaaguccaucgaggacaacccggagaucgaggacgacaucuuccgcaagaagcggcugaccaucauggaccugcaccccggggccggcaagaccaagcgcuaccuccccgccaucguccgggaggcgaucaagcgcgggcugcggacgcugauccucgcccccacccgcgugguggccgccgagauggaggaggcccugcgcggccugccgauccgguaccagacccccgcgauccgcgccgagcacaccgggcgggagaucgucgaccucaugugccacgccacguucaccaugcgccugcugagccccauccgggugcccaacuacaaccucaucaucauggacgaggcccacuucaccgacccggccagcaucgcggcccgcggcuacaucuccacccggguggagaugggcgaggccgccgggaucuucaugacggccacgccgcccggcagccgcgaccccuucccgcaguccaacgcgcccaucauggacgaggagaaggagauccccgagcggagcuggaacuccgggcacgagugggucaccgacuucaagggcaagaccgugugguucgugcccagcaucaaggccgggaacgacaucgccgccugccugcgcaagaacggcaagaaggucauccagcugucccggaagacguucgacagcgaguacaucaagacccgcaccaacgacugggacuucguggugaccacggacaucuccgagaugggcgcgaacuucaaggccgagcgggucaucgacccgcgccggugcaugaagcccgugauccucaccgacggggaggagcgcgugauccuggccggccccaugcccgucacccacagcuccgccgcccagcggcgcgggcgggugggccgcaacccgaagaacgagaacgaccaguacaucuacaugggggagccccuggagaacgacgaggacugcgcgcacuggaaggaggccaagaugcuccuggacaacaucaacacccccgagggcaucauccccagcauguucgagccggagcgcgagaagguggacgccaucgacggcgaguaccggcugcgcggggaggcccggaagacguucgucgaccucaugcgccggggcgaccugcccguguggcuggccuaccgcgucgcggccgaggggaucaacuacgccgaccggcgcuggugcuucgacggcgugaagaacaaccagauccucgaggagaacguggaggucgagaucuggaccaaggagggggagcggaagaagcugaagccccgcuggcuggacgcccggaucuacuccgacccgcucgcccugaaggaguucaaggaguucgcggccggccgcaagagccugacccucaaccugaucaccgagaugggccggcugcccacguucaugacccagaaggccaagaacgcccucgacaaccuggcggugcugcacaccgccgaggccgggggccgcgccuacaaccacgcccucuccgagcugcccgagacccuggagacgcuccugcugcucacccugcuggcgaccgugaccgggggcaucuuccucuuccugaugagcggcaaggggaucggcaagaugacccuggggaugugcugcaucaucacggccuccauccuccuguggcacgcccagauccagccccacuggaucgccgccagcaucauccuggaguucuuccucaucguccugcugaucccggagcccgagaagcagcggacgccccaggacaaccagcucaccuacguggugaucgcgauccugaccgucguggccgccacgauggccaacgagaugggcuuccuggagaagaccaagaaggacuucgggcucggcuccaucaccacccagcagcccgagagcaacauccuggacaucgaccugcgcccggccagcgcguggacgcucuacgccguggccaccaccuucaucacccccaugcugcggcacuccaucgagaacagcuccgucaacgugagccugacggccaucgccaaccaggcgaccgugcucaugggccuggggaagggcuggccccuguccaagauggacaucggggucccccuccuggccaucggcugcuacagccaggugaacccgaucacccugaccgccgcccuccugcugcucguggcgcacuacgccaucaucgggcccggccugcaggccaaggccacgcgcgaggcccagaagcgggcggccgccggcaucaugaagaaccccaccgucgacgggaugaccgugaucgaccuggaccccaucccguacgaccccaaguucgagaagcagcucggccaggugaugcugcugguccucugcgugacccaggugcugaugaugcgcacgaccugggcccugugcgaggcccucacccuggcgaccgggcccaucuccacgcugugggagggcaaccccgggcgguucuggaacaccaccaucgccgucagcauggccaacaucuuccgcggcuccuaccucgccggcgccgggcugcuguucagcaucaugaagaacaccgcgaacacgcgccggggcaccgggaacaccggcgagacccucggcgagaaguggaagaaccgccugaacgcccuggggaaguccgaguuccagaucuacaagaaguccggcauccaggagguggaccggacgcucgccaaggaggggaucaagcgcggcgagaccgaccaccacgccgugagccgggggagcgcgaagcugcgcugguucgucgagcggaaccuggugaccccggagggcaagguggucgaccucggcugcgggcgcggcgggugguccuacuacugcggcgggcugaagaacgugaaggaggugaagggccugaccaagggcgggcccggccacgaggagcccauccccaugagcacguacggguggaaccucguccggcugcaguccggcguggacguguucuucaccagcccggagaagugcgacacccugcucugcgacaucggggaguccagccccaaccccaccgucgaggccggccgcacccugcgggugcugaaccucguggagaacuggcugaacaacaacacgcaguucugcaucaagguccugaaccccuacaugccgagcgugaucgagaagauggaggcccugcagcgcaaguacggcggggcccucgugcggaacccccugucccgcaacagcacccacgagauguacugggucuccaacgccagcggcaacaucguguccagcgugaacaugaucucccggaugcugaucaaccgcuucaccaugcggcacaagaaggcgaccuacgagcccgacgucgaccucgggagcggcacgcgcaacaucgggaucgaguccgagaccccgaaccuggacaucaucggcaagcggaucgagaagaucaagcaggagcacgagaccagcuggcacuacgaccaggaccaccccuacaagaccugggccuaccacggcuccuacgagacgaagcagaccgggagcgccuccagcauggugaacggcgugguccgccugcucaccaagcccugggacgugauccccauggugacccagauggccaugacggacaccaccccguucgggcagcagcgcgucuucaaggagaagguggacacccggacgcaggagcccaaggagggcaccaagaagcugaugaagaucaccgccgaguggcuguggaaggagcucggcaagaagaagacgccccgcaugugcacgcgggaggaguucacccgcaagguccgguccaacgcggcccugggggccaucuucaccgacgagaacaaguggaaguccgcccgcgaggccguggaggacuccggcuucugggagcugguggacaaggagcggaaccuccaccuggaggggaagugcgagaccugcgucuacaacaugaugggcaagcgcgagaagaagcugggggaguucggcaaggcgaagggcagccgggccaucugguacauguggcucggggcccgcuuccuggaguucgaggcccugggcuuccucaacgaggaccacugguucucccgggagaacagccugagcgggguggagggcgaggggcugcacaagcucggcuacauccugcgcgacguguccaagaaggagggcggggcgauguacgccgacgacacggccggcugggacacccggaucacccuggaggaccucaagaacgaggagauggucaccaaccacauggagggggagcacaagaagcuggccgaggccaucuucaagcugacguaccagaacaagguggugcgcguccagcggcccaccccgcgcggcaccgugauggacaucaucagccggcgcgaccagcggggguccggccagguggucaccuacggccucaacacguucaccaacauggaggcgcagcugauccgccagauggagggggagggcguguucaagagcauccagcagcugaccgugaaggaggagaucgccgucaagaacuggcucauccggguggggcgcgagcgccugucccggauggccaucagcggcgacgacugcguggucaagccccuggacgaccgcuucgccuccgcccucaccgcgcugaacgacaugggcaaggugcggaaggacauccagcagugggagcccagccgcggguggaacgacuggacccaggugcccuucugcucccaccacuuccacgagcugaucaugaaggacggccggguccucguggugccgugccgcaaccaggacgagcugaucgggcgggcccgcaucagccagggcgccggguggucccugcgggagaccgccugccucggcaagagcuacgcccagauguggucccugauguacuuccaccgccgggaccugcgccucgcggccaacgccaucugcagcgccguccccucccacuggauccccaccagccggaccaccugguccauccacgccacgcacgaguggaugaccaccgaggacaugcugaccguguggaaccgcguguggauccaggagaaccccuggauggaggacaagacgccggucgagagcugggaggagauccccuaccugggcaagcgggaggaccaguggugcgggagccucaucggccugaccucccgcgcgaccugggccaagaacauccagaccgccaucaaccaggugcggagccugaucgggaacgaggaguacacggacuacaugcccuccaugaagcgcuuccggcgcgaggaggaggaggccggcgugcucugguga

SEQ ID NO: 9050 - RNA, 9876 nt, Artificial Sequence
  derived and/or modified CDS sequence (opt1) from DENV-2__KX380817__SS-prME
accgcgggcaucaucaucaugaugauccccaccgugauggccuuccaccugaccacccggaacggggagccccacaugaucgucagccggcaggagaagggcaagagccuccuguucaagaccgagaacggggugaacaugugcacccugauggcgauggaccucggcgagcugugcgaggacaccaucaccuacaacugcccccugcuccgccagaacgagcccgaggacaucgacugcuggugcaacagcaccuccaccugggugaccuacgggaccugcaccgccaccggcgagcaccggcgcgagaagcggagcgucgcccuggugccccacgugggcauggggcuggagacccgcaccgagaccuggauguccagcgagggcgccuggaagcacgcccagcggaucgagaccuggauccuccgccaccccggguucacgaucauggcggccauccuggccuacaccaucggcaccaccuacuuccagcggguccugaucuucauccuccugacggccgugacccccuccauggcgaugcgcugcaucgggaucagcaaccgggacuucguggagggcgucuccggcgggagcuggguggacaucgugcuggagcacggcuccugcgucaccaccauggccaagaacaagcccacgcucgacuucgagcugaucaagaccgaggccaagcaccuggccacccuccgcaaguacugcguggaggccaagcugaccaacacgaccaccgcgagccggugccccacccagggggagcccucccugaacgaggagcaggacaagcgcuucgugugcaagcacagcauggucgaccggggcuggggcaacgggugcggccucuucgggaagggcgggaucgugacgugcgccauguucacgugcaagaagaacauggagggcaaggugguccagcccgagaaccuggaguacaccaucgugaucacgccccacuccggcgaggagaacgccguggggaacgacacgggcaagcacgggaaggagaucaagaucacgccccagagcuccaucaccgaggccgagcugaccggcuacgggaccgucacgauggagugcagcccgcgcaccggccucgacuucaacgagauggugcugcugcagauggagaacaaggccuggcucgugcaccggcagugguuccuggaccugccccuccccuggcugcccggcgcggacacccagggguccaacuggauccagaaggagacccuggucacguucaagaacccgcacgccaagaagcaggacguggucgugcucggcagccaggagggggccaugcacaccgcccugaccggcgccaccgagauccagaugagcuccgggaaccuccuguucacgggccaccugaagugccgccugcggauggacaagcuccagcugaagggcaugagcuacuccaugugcaccgggaaguucaagguggucaaggagaucgcggagacccagcacggcaccaucgugauccgcgugcaguacgagggggacggcagccccugcaagauccccuucgagaucauggaccuggagaagcggcacguccucggccgccugaucacggugaaccccaucgugaccgagaaggacuccccggucaacaucgaggccgagccgcccuucggggacagcuacaucaucaucggcguggagcccgggcagcugaagcucuccugguucaagaagggcagcuccaucgggcagauguucgagaccaccaugcgcggcgccaagcggauggccauccugggcgacacggccugggacuucgggagccugggcgggguguucaccuccaucggcaaggcgcuccaccaggucuucggggccaucuacggcgccgccuucagcggcguguccuggaccaugaagauccugaucgggguggucaucaccuggaucggcaugaacagccgcuccacgagccuguccgugagccuggugcucgucgggguggugacccuguaccugggcgucauggugcaggcggacuccgggugcguggucagcuggaagaacaaggagcucaagugcggcagcggcaucuucaucaccgacaacgugcacaccuggacggagcaguacaaguuccagccggagucccccagcaagcuggccuccgccauccagaaggcccacgaggaggggaucugcggcauccggagcgugacccgccuggagaaccucauguggaagcagaucacccccgagcugaaccacauccugaccgagaacgaggucaagcucacgaucaugaccggggacaucaagggcaucaugcaggccgggaagcggucccugcgcccccagccgaccgagcugaaguacagcuggaaggcguggggcaaggccaagaugcucuccaccgagcugcacaaccacacguuccugaucgacggccccgagaccgccgagugccccaacaccaaccgggccuggaacagccucgagguggaggacuacggguucggcguguucaccacgaacaucuggcugaagcugaaggagcgccaggacgucuucugcgacuccaagcucaugagcgccgcgaucaaggacaaccgggccgugcacgccgacaugggguacuggaucgaguccgcccugaacgacaccuggaagaucgagaaggccagcuucaucgaggugaaguccugccacuggcccaagagccacacccugugguccaacggcguccucgagagcgagaugaucauccccaagaacuucgcgggccccgugucccagcacaacuaccgccccggguaccacacccagaccgccggcccguggcaccuggggcggcuggagauggacuucgacuucugcgagggcacgaccguggucgugaccgaggacugcgggaaccgcggccccagccuccggaccacgaccgccagcggcaagcugaucaccgaguggugcugccgcuccugcacccugccgccccuccgguaccgcggggaggacggcugcugguacgggauggagauccggccgcugaaggagaaggaggagaaccuggugaacagccucgucacggccggccacgggcagaucgacaacuucucccugggcgugcugggcauggcccucuuccuggaggagaugcugcgcacccggguggggaccaagcacgccauccuccuggucgccgugagcuucgugacccugaucacgggcaacauguccuuccgcgaccucgggcgcgucauggugauggugggcgccaccaugaccgacgacaucgggaugggcgucaccuaccuggcccugcucgcggccuucaaggugcggcccacguucgccgccggccugcugcuccgcaagcugaccagcaaggagcugaugaugaccaccaucgggaucgugcuccugucccagagcacgauccccgaguccauccuggagcucaccgacgcccuggcgcugggcaugaugguccucaagaucgugcggaacauggagaaguaccagcuggccgucaccaucauggccaucagcugcgugcccaacgccgugauccugcagaacgccuggaaggucuccugcaccacgcucgcgguggugagcgucuccccgcugcugcucaccagcucccagcagaaggccgacuggaucccccuggcccugaccaucaaggggcucaaccccaccgccaucuuccugacgacccugagccgcaccuccaagaagcggagcuggccccucaacgaggcgaucauggccgugggcaugguguccauccuggccagcagccugcucaagaacgacaucccgaugaccggcccccuggucgccgggggccugcucacggugugcuacgugcugaccgggcgcuccgccgaccuggagcucgagcgggcggccgacguccgcugggaggagcaggccgagaucagcggcuccagccccauccuguccaucaccaucagcgaggacggguccaugagcaucaagaacgaggaggaggagcagacccugacgauccucauccggaccggccugcuggugaucuccggccucuuccccgugagcaucccgaucaccgccgccgcgugguaccugugggaggucaagaagcagcgcgccggggugcugugggacgugcccagcccgccgcccgucggcaaggccgagcucgaggacggggccuaccggaucaagcagaagggcauccugggguacagccagaucggcgccggcguguacaaggaggggaccuuccacaccauguggcacgugacgcgcggcgcgguccugaugcacaaggggaagcggaucgagcccuccugggccgacgugaagaaggaccucaucagcuacggcgggggcuggaagcuggagggcgaguggaaggagggggaggaggugcagguccuggcccucgagcccggcaagaacccgcgcgccgugcagaccaagcccgggcuguucaagaccaacaccggcacgaucggggccgugucccuggacuucagccccggcaccuccggcagccccaucgucgacaagaaggggaagguggugggccucuacgggaacggcgucgugacccgguccggcaccuacgugagcgcgaucgcccagacggagaaguccaucgaggacaacccggagaucgaggacgacaucuuccgcaagaagcggcugaccaucauggaccugcaccccggggccggcaagaccaagcgcuaccugcccgccaucguccgggaggcgaucaagcgcgggcuccggacccugauccuggcccccacgcgcgugguggccgccgagauggaggaggcccuccgcggccugccgauccgguaccagacccccgcgauccgcgccgagcacaccgggcgggagaucgucgaccugaugugccacgccaccuucacgaugcgccuccugagccccauccgggugcccaacuacaaccugaucaucauggacgaggcccacuucaccgacccggccagcaucgcggcccgcggcuacaucuccacccggguggagaugggcgaggccgccgggaucuucaugaccgccacgccgcccggcagccgcgaccccuucccgcaguccaacgcgcccaucauggacgaggagcgggagauccccgagcgcagcuggaacuccgggcacgagugggucaccgacuucaagggcaagaccgugugguucgugcccagcaucaaggccgggaacgacaucgccgccugccuccggaagaacggcaagaaggucauccagcugucccgcaagaccuucgacagcgaguacaucaagacgcggaccaacgacugggacuucguggugaccaccgacaucuccgagaugggcgcgaacuucaaggccgagcgcgucaucgacccgcggcgcugcaugaagcccgugauccugacggacggggaggagcgggugauccucgccggccccaugcccgucacccacagcuccgccgcccagcgccgggggcgcgugggccgcaacccgaagaacgagaacgaccaguacaucuacaugggggagccccuggagaacgacgaggacugcgcgcacuggaaggaggccaagaugcugcucgacaacaucaacacccccgagggcaucauccccagcauguucgagccggagcgggagaagguggacgccaucgacggcgaguaccgccugcgcggggaggcccgcaagaccuucgucgaccugaugcggcgcggcgaccuccccguguggcuggccuaccgggucgcggccgaggggaucaacuacgccgaccgccgguggugcuucgacggcgugaagaacaaccagauccuggaggagaacguggaggucgagaucuggacgaaggagggggagcgcaagaagcucaagccccgguggcuggacgcccgcaucuacuccgacccgcuggcccucaaggaguucaaggaguucgcggccggccggaagucccugacccugaaccucaucaccgagaugggccgccugcccaccuucaugacgcagaaggccaagaacgcccuggacaaccucgcggugcugcacaccgccgaggccgggggccgggccuacaaccacgcccuguccgagcuccccgagacccuggagacccugcuccugcugacgcuccuggcgaccgugaccgggggcaucuuccuguuccucaugagcggcaaggggaucggcaagaugacccuggggaugugcugcaucaucaccgccuccauccugcucugguacgcccagauccagccccacuggaucgccgccagcaucauccuggaguucuuccugaucguccuccugaucccggagcccgagaagcagcgcacgccccaggacaaccagcugaccuacguggugaucgcgauccucaccgucguggccgccaccauggccaacgagaugggcuuccuggagaagacgaagaaggacuucgggcugggcagcaucaccacccagcagcccgaguccaacauccucgacaucgaccugcggccggccagcgcguggacccuguacgccguggccacgaccuucaucacccccaugcuccgccacuccaucgagaacagcuccgucaacgugagccugaccgccaucgccaaccaggcgacggugcugaugggccucgggaagggcuggccccuguccaagauggacaucggggucccccugcucgccaucggcugcuacagccaggugaacccgaucacccugaccgccgcccugcuccugcugguggcgcacuacgccaucaucgggcccggccuccaggccaaggccacccgggaggcccagaagcgcgcggccgccggcaucaugaagaaccccacggucgacgggaugaccgugaucgaccuggaccccaucccguacgaccccaaguucgagaagcagcugggccaggugaugcuccugguccugugcgugacccaggugcucaugaugcggaccacgugggcccugugcgaggcccugacccucgcgaccgggcccaucuccacccugugggagggcaaccccgggcgcuucuggaacacgaccaucgccgucagcauggccaacaucuuccgcggcuccuaccuggccggcgccgggcuccuguucagcaucaugaagaacaccgcgaacacccggcgcggcacggggaacaccggcgagacccugggcgagaaguggaagaaccggcucaacgcccuggggaaguccgaguuccagaucuacaagaaguccggcauccaggagguggaccgcacccuggccaaggaggggaucaagcggggcgagacggaccaccacgccgugucccgcgggagcgcgaagcuccggugguucgucgagcgcaaccuggugaccccggagggcaagguggucgaccugggcugcgggcggggcgggugguccuacuacugcggcgggcucaagaacgugaaggaggugaagggccugaccaagggcgggcccggccacgaggagcccauccccaugagcaccuacggguggaaccugguccgccuccaguccggcguggacguguucuucacgccgcccgagaagugcgacacccugcugugcgacaucggggagagcagccccaaccccaccgucgaggccggccggacccuccgcgugcugaaccugguggagaacuggcucaacaacaacacccaguucugcaucaagguccugaacccguacaugcccuccgugaucgagaagauggaggcccugcagcggaaguacggcggggcccuggugcgcaacccccucagccggaacuccacgcacgagauguacugggucagcaacgccuccggcaacaucgugagcuccgugaacaugaucagccgcaugcugaucaaccgguucaccaugcgccacaagaaggcgaccuacgagccggacgucgaccugggguccggcacccggaacaucgggaucgagagcgagacgcccaaccucgacaucaucggcaagcgcaucgagaagaucaagcaggagcacgagaccuccuggcacuacgaccaggaccaccccuacaagaccugggccuaccacggcagcuacgagaccaagcagacgggguccgccagcuccauggugaacggcgugguccgccugcugaccaagcccugggacgugaucccgauggugacccagauggccaugaccgacacgacccccuucgggcagcagcgggucuucaaggagaagguggacacccgcacccaggagcccaaggagggcacgaagaagcucaugaagaucaccgccgaguggcuguggaaggagcugggcaagaagaagacgccccggaugugcacccgcgaggaguucacgcggaagguccgcagcaacgcggcccucggggccaucuucaccgacgagaacaaguggaaguccgcccgggaggccguggaggacagcggcuucugggagcugguggaccgcgagcggaaccugcaccucgaggggaagugcgagaccugcgucuacaacaugaugggcaagcgcgagaagaagcugggggaguucggcaaggcgaagggcucccgggccaucugguacauguggcugggggcccgcuuccucgaguucgaggcccugggcuuccugaacgaggaccacugguucagccgggagaacagccucuccgggguggagggcgaggggcugcacaagcugggcuacauccuccgcgacgugagcaagaaggagggcggggcgauguacgccgacgacaccgccggcugggacacgcggaucacccuggaggaccugaagaacgaggagauggucaccaaccacauggagggggagcacaagaagcucgccgaggccaucuucaagcugaccuaccagaacaagguggugcgcguccagcggccgacgccccgcggcaccgugauggacaucaucucccggcgcgaccagcgggggagcggccagguggucaccuacggccugaacaccuucacgaacauggaggcgcagcucauccgccagauggagggggagggcguguucaaguccauccagcagcugaccgugaaggaggagaucgccgucaagaacuggcugauccgcguggggcgggagcgccucagccggauggccaucuccggcgacgacugcguggucaagccccuggacgaccgcuucgccagcgcccugaccgcgcucaacgacaugggcaaggugcggaaggacauccagcagugggagcccucccgcggguggaacgacuggacccaggugccguucugcagccaccacuuccacgagcugaucaugaaggacggccggguccugguggugcccugccgcaaccaggacgagcucaucgggcgggcccgcaucucccagggcgccggguggagccugcgggagacggccugccugggcaaguccuacgcccagauguggagccucauguacuuccaccgccgggaccugcgccuggcggccaacgccaucugcuccgccguccccagccacuggauccccaccucccggaccaccuggagcauccacgccacccacgaguggaugacgaccgaggacaugcucaccguguggaaccgcguguggauccaggagaacccguggauggaggacaagacccccgucgagagcugggaggagauccccuaccugggcaagcgggaggaccaguggugcgggucccugaucggccucacgagccgcgcgaccugggccaagaacauccagaccgccaucaaccaggugcggucccugaucgggaacgaggaguacaccgacuacaugcccagcaugaagcgcuuccgccgggaggaggaggaggccggcgugcugugguga

SEQ ID NO: 9051 - RNA, 9876 nt, Artificial Sequence
  derived and/or modified CDS sequence (opt1) from DENV-2__KX380818__SS-prME
accgccgggaucaucaucaugaugauccccaccgugauggccuuccaccugaccacccggaacggggagccccacaugaucgugagccggcaggagaagggcaagagccuccuguucaagaccgagaacggggugaacaugugcacccugauggcgauggaccucggcgagcugugcgaggacaccaucaccuacaacugcccccugcuccggcagaacgagcccgaggacaucgacugcuggugcaacagcaccuccaccugggugaccuacgggaccugcaccgccaccggcgagcaccggcgcgagaagcggagcgucgcccuggugccccacgugggcauggggcuggagacccgcaccgagaccuggauguccagcgagggcgccuggaagcacgcccagcggaucgagaccuggguccuccgccaccccggguucaccaucauggcggccauccuggccuacaccaucggcaccaccuacuuccagcgggugcugaucuucauccuccugacggccguggcgcccuccaugaccaugcgcugcaucgggaucagcaaccgggacuucgucgagggcguguccggcgggagcuggguggacaucguccuggagcacggcuccugcgugaccaccauggccaagaacaagcccacgcucgacuucgagcugaucaagaccgaggccaagcaccccgccacccugcgcaaguacugcaucgaggccaagcucaccaacacgaccaccgcgagccggugcccgacccagggggagcccucccugaacgaggagcaggacaagcgcuucgugugcaagcacagcauggucgaccggggcuggggcaacgggugcggccuguucgggaagggcgggaucgugacgugcgccauguucacgugcaagaagaacauggagggcaagaucgugcagcccgagaaccucgaguacaccaucgucaucacgccccacuccggcgaggagaacgccguggggaacgacacgggcaagcacgggaaggagaucaaggugaccccgcagagcuccaucaccgaggccgagcugaccggcuacgggaccgucacgauggagugcagcccccgcaccggccuggacuucaacgagauggugcuccugcagauggagaacaaggccuggcuggugcaccggcagugguuccucgaccugccccugcccuggcucccgggcgcggacacccagggguccaacuggauccagaaggagacccuggucacguucaagaacccccacgccaagaagcaggacguggucgugcugggcagccaggagggggccaugcacaccgcccucaccggcgccaccgagauccagaugagcuccgggaaccugcuguucacgggccaccucaagugccgccugcggauggacaagcugcagcucaagggcaugagcuacuccaugugcaccgggaaguucaagguggucaaggagaucgcggagacccagcacggcaccaucgugauccgcgugcaguacgagggggacggcagccccugcaagauccccuucgagaucauggaccuggagaagcggcacguccugggccgccucaucacggugaacccgaucgugaccgagaaggacucccccgucaacaucgaggccgagccgcccuucggggacagcuacaucaucaucggcguggagccggggcagcugaagcuguccugguucaagaagggcagcuccaucgggcagauguucgagaccaccaugcgcggcgccaagcggauggccauccucggcgacacggccugggacuucgggagccugggcgggguguucaccuccaucggcaaggcgcugcaccaggucuucggggccaucuacggcgccgccuucagcggcguguccuggaccaugaagauccucaucgggguggucaucaccuggaucggcaugaacagccgcuccacgagccuguccgugagccuggugcuggucgggguggugacccucuaccugggcgucauggugcaggcggacuccgggugcguggucagcuggaagaacaaggagcugaagugcggcagcggcaucuucaucaccgacaacgugcacaccuggacggagcaguacaaguuccagcccgagucccccagcaagcucgccuccgccauccagaaggcccacgaggaggggaucugcggcauccggagcgugacccgccuggagaaccugauguggaagcagaucacccccgagcucaaccacauccugaccgagaacgaggucaagcugacgaucaugaccggggacaucaagggcaucaugcaggccgggaagcggucccuccgcccgcagcccaccgagcugaaguacagcuggaaggcguggggcaaggccaagaugcuguccaccgagcuccacaaccacacguuccugaucgacggccccgagaccgccgagugcccgaacaccaaccgggccuggaacagccuggagguggaggacuacggguucggcguguucaccacgaacaucuggcucaagcugaaggagcgccaggacgucuccugcgacagcaagcugauguccgccgcgaucaaggacaaccgggccgugcacgccgacaugggguacuggaucgagagcgcccucaacgacaccuggaagaucgagaaggccuccuucaucgaggucaagagcugccacuggcccaagucccacacccuguggagcaacggcgugcuggaguccgagaugaucauccccaagaacuucgcgggccccgugagccagcacaacuaccgcccgggguaccacacccagaccgccggccccuggcaccucgggcggcuggagauggacuucgacuucugcgagggcacgaccguggucgugaccgaggacugcgggaaccgcggccccagccugcggaccacgaccgccuccggcaagcucaucaccgaguggugcugccgcagcugcacccugcccccgcugcgguaccgcggggaggacggcugcugguacgggauggagauccggccccucaaggagaaggaggagaaccuggugaacucccuggucacggccggccacgggcagaucgacaacuucagccucggcgugcugggcauggcgcuguuccucgaggagaugcugcgcacccggguggggaccaagcacgccauccugcucgucgccguguccuucgugacccugaucacgggcaacaugagcuuccgcgaccuggggcgcgucauggugauggugggcgccaccaugaccgacgacaucgggaugggcgucaccuaccucgcccugcuggcggccuucaaggugcggcccacguucgccgccggccuccugcugcgcaagcucaccuccaaggagcugaugaugaccaccaucgggaucgugcugcucagccaguccacgauccccgagaccauccuggagcugaccgacgcccucgcgcugggcaugaugguccugaagaucgugcggaacauggagaaguaccagcucgccgucaccaucauggccauccugugcgugccgaacgccgugauccugcagaacgccuggaaggucagcugcacgacccucgcggugguguccgucagcccccugcugcucaccuccagccagcagaagaccgacuggaucccccuggcccugacgaucaaggggcucaaccccaccgccaucuuccugaccacccugucccgcacgagcaagaagcgguccuggccgcucaacgaggccaucauggcggugggcauggugagcauccuggccuccagcuuccugaagaacgacauccccaugaccggcccccucgucgccgggggccugcugaccgugugcuacgugcucaccgggcgcagcgccgaccuggagcuggagcgggccgcggacauccgcugggaggagcaggccgagaucuccggcagcucccccauccucagcaucacgaucuccgaggacgggagcauguccaucaagaacgaggaggaggagcagacccugaccauccugauccggaccggccuccuggucaucagcggccuguucccgguguccauccccaucaccgccgccgccugguaccucugggaggugaagaagcagcgcgcggggguccugugggacgugcccagcccgccgcccgugggcaaggccgagcuggaggacggggccuaccggaucaagcagaagggcauccucggguacucccagaucggcgccggcgucuacaaggaggggacguuccacaccauguggcacgugacccgcggcgccgugcugaugcacaaggggaagcggaucgagcccagcugggcggacgucaagaaggaccugaucuccuacggcgggggcuggaagcucgagggcgaguggaaggagggggaggagguccaggugcuggcccuggagcccggcaagaacccccgcgccguccagaccaagcccggccuguucaagacgaacaccggcaccaucggggccgugagccuggacuucucccccggcaccagcggcucccccaucguggacaagaaggggaaggucgugggccuguacgggaacggcguggucacgcggagcggcaccuacguguccgccaucgcgcagaccgagaagaacaucgaggacaaccccgagaucgaggacgacaucuuccgcaagaagcggcucaccaucauggaccugcaccccggggccggcaagacgaagcgcuaccugcccgccaucgugcgggaggccaucaagcgcgggcugcggacccucauccuggcgccgacccgcgucguggccgccgagauggaggaggcccugcgcggccuccccauccgguaccagacccccgccauccgcgcggagcacacggggcgggagaucguggaccugaugugccacgccaccuucaccaugcgccugcucagccccauccgggucccgaacuacaaccugaucaucauggacgaggcccacuucaccgaccccgccagcaucgccgcgcgcggcuacaucuccacgcggguggagaugggcgaggccgccgggaucuucaugaccgccacgccgcccggcagccgcgacccguucccccaguccaacgcccccaucauggacgaggagcgggagauccccgagcgcagcuggaacuccgggcacgagugggugaccgacuucaagggcaagacggucugguucgugccgagcaucaaggcggggaacgacaucgccgccugccugcggaagaacggcaagaaggugauccagcucucccgcaagaccuucgacagcgaguacgucaagacccggaccaacgacugggacuucguggugacgaccgacaucuccgagaugggcgccaacuucaaggcggagcgcgucaucgacccccggcgcugcaugaagcccgugauccugaccgacggggaggagcgggugauccuggccggccccaugccggucacccacagcuccgccgcccagcgccgggggcgcgugggccgcaaccccaagaacgagaacgaccaguacaucuacaugggggagccccucgagaacgacgaggacugcgcccacuggaaggaggcgaagaugcugcuggacaacaucaacacgcccgagggcaucaucccgagcauguucgagcccgagcgggagaagguggacgccaucgacggcgaguaccgccuccgcggggaggcccgcaagaccuucgucgaccugaugcggcgcggcgaccugcccguguggcucgccuaccgggucgccgcggaggggaucaacuacgccgaccgccgguggugcuucgacggcgugaagaacaaccagauccuggaggagaacguggaggucgagaucuggaccaaggagggggagcgcaagaagcugaagccgcgguggcucgacgcccgcaucuacuccgacccccuggcccugaaggaguucaaggaguucgccgcgggccgcaagagccucacccugaaccugaucacggagaugggccgccuccccaccuucaugacccagaaggcccggaacgcccuggacaaccuggccgugcuccacaccgcggaggccgggggccgcgccuacaaccacgcccuguccgagcugcccgagacgcucgagacccugcugcuccugacccugcucgccaccgugaccgggggcaucuuccuguuccugaugagcggcaaggggaucggcaagaugacgcucgggaugugcugcaucgucaccgcguccauccugcugugguacgcccagauccagccgcacuggaucgccgccagcaucauccucgaguucuuccugaucgugcugcucauccccgagcccgagaagcagcggacgccccaggacaaccagcugaccuacguggucaucgccauccugacggugguggcggccaccauggccaacgagaugggcuuccucgagaagaccaagaaggacuucgggcugggcuccaucaccacgcagcagccggagagcaacauccuggacaucgaccuccgccccgccagcgccuggacccuguacgcggucgccaccaccuucaucacgcccaugcugcggcacuccaucgagaacagcuccgugaacgugagccucaccgccaucgccaaccaggccaccguccugaugggccuggggaagggcuggccccucuccaagauggacaucggggugccgcugcuggcgaucggcugcuacagccaggugaaccccaucacccucacggccgcccugcugcuccuggucgcccacuacgcgaucaucgggcccggccugcaggccaaggccacccgcgaggcccagaagcgggccgcggccggcaucaugaagauccccgccgccgacaucgggcgcgugaucgaccucgacccgauccccuacgaccccaaguucgagaagcagcugggccaggugaugcugcucguccugugcgugacccaggugcugaugaugcgcaccacgugggcccucugcgaggcgcugacccuggccaccgggcccaucuccacccucugggagggcaacccggggcgguucuggaacacgaccaucgccgucagcauggccaacaucuuccgcggcuccuaccuggccggcgcggggcuccucuucagcaucaugaagaacaccgccaacacccggcgcggcacggggaacaccggcgagacccugggcgagaaguggaagaaccagcugaacgcccucgggaaguccgaguuccagaucuacaagaaguccggcauccaggagguggaccggacccuggccaaggaggggaucaagcgcggcgagacggaccaccacgcggugucccgggggagcgccaagcugcgcugguucgucgagcggaaccucgugacccccgagggcaagguggucgaccugggcugcgggcgcggcgggugguccuacuacugcggcgggcugaagaacgugaaggaggugaagggccucaccaagggcgggcccggccacgaggagcccaucccgaugagcaccuacggguggaaccugguccggcugcaguccggcguggacguguucuucacgccgcccgagaagugcgacacccuccugugcgacaucggggagagcucccccaacccgaccgucgaggccggccgcacccugcgggugcucaaccugguggagaacuggcugaacaacaacacccaguucugcaucaagguccucaaccccuacaugcccagcgugaucgagaagauggaggcccugcagcgcaaguacggcggggcccuggugcggaacccgcugagccgcaacuccacgcacgagauguacugggucagcaacgcguccggcaacaucgugagcuccgugaacaugaucagccggaugcucaucaaccgcuucaccaugcggcacaagaaggccaccuacgagcccgacgucgaccugggguccggcacccgcaacaucgggaucgagagcgaggugcccaaccuggacaucaucggcaagcgcaucgagaagaucaagcaggagcacgagacguccuggcacuacgaccaggaccaccccuacaagaccugggccuaccacggcagcuacgagaccaagcagaccggguccgccagcuccauggugaacggcgucgugcggcuccugacgaagccgugggacgugauccccauggucacccagauggccaugaccgacaccacgcccuucgggcagcagcgcguguucaaggagaaggucgacacccggacccaggagcccaaggagggcaccaagaagcugaugaagaucacggcggaguggcucuggaaggagcugggcaagaagaagaccccgcgcaugugcacccgggaggaguucacccgcaaggugcggagcaacgccgcccugggggccaucuucacggacgagaacaaguggaaguccgcccgcgaggcgguggaggacagcggcuucugggagcucgucgacaaggagcggaaccugcaccuggaggggaagugcgagaccugcguguacaacaugaugggcaagcgcgagaagaagcucggggaguucggcaaggccaagggcucccgggccaucugguacauguggcugggggcccgcuuccuggaguucgaggcgcucggcuuccugaacgaggaccacugguucagccgggagaacucccugagcgggguggagggcgaggggcuccacaagcugggcuacauccugcgcgacgucagcaagaaggagggcggggccauguacgccgacgacaccgccggcugggacacccggaucacgcucgaggaccugaagaacgaggagauggugaccaaccacauggagggggagcacaagaagcuggccgaggcgaucuuccgccucaccuaccagaacaaggugguccgggugcagcgccccacgccccggggcacggugauggacaucaucucccgccgggaccagcgcgggagcggccaggucgugaccuacggccugaacaccuucaccaacauggaggcccagcugauccgccagauggagggggagggcguguucaaguccauccagcaccucacggccaccgaggagaucgccgucaagaacuggcuggugcggguggggcgcgagcggcugagccgcauggccaucuccggcgacgacugcgucgugaagccccucgacgaccgguucgcgaacgcccugaccgcccugaacgacaugggcaaggugcgcaaggacauccagcagugggagccgagccggggguggaacgacuggacccagguccccuucugcucccaccacuuccacgagcucaucaugaaggacggccgcgugcuggugguccccugccggaaccaggacgagcugaucgggcgcgcccggaucagccagggcgccggguggucccuccgcgagacggcgugccugggcaagagcuacgcccagauguggucccugauguacuuccaccggcgcgaccuccggcuggccgccaacgccaucugcagcgcggugcccucccacugggugccgaccagccgcaccaccugguccauccacgccacccacgaguggaugacgaccgaggacaugcugaccgucuggaaccggguguggauccaggagaaccccuggauggaggacaagacccccguggagagcugggaggagauccccuaccucggcaagcgcgaggaccaguggugcgggucccugaucggccugacgagccgggccaccugggccaagaacauccagaccgcgaucaaccagguccgcagccucaucgggaacgaggaguacaccgacuacaugccguccaugaagcgcuuccggcgcgaggaggaggaggccggcgugcugugguga

SEQ ID NO: 9052 - RNA, 9876 nt, Artificial Sequence
  derived and/or modified CDS sequence (opt1) from DENV-2__KX380819__SS-prME
accgccgggaucaucaucaugaugauccccaccgugauggccuuccaccugaccacccgcaacggggagccccacaugaucgucagccggcaggagaagggcaagagccuccuguucaagaccgagaacggggugaacaugugcacccugauggcgauggaccucggcgagcugugcgaggacaccaucaccuacaacugcccccugcuccgccagaacgagcccgaggacaucgacugcuggugcaacagcaccagcaccugggugaccuacgggaccugcaccgccaccggcgagcaccggcgcgagaagcggagcgucgcccuggugccccacgugggcauggggcuggagacccgcaccgagaccuggauguccagcgagggcgccuggaagcacgcccagcggaucgagaccuggguccuccgccaccccggguucaccgugauggcggccauccuggccuacaccaucggcaccaccuacuuccagcgggugcugaucuucauccuccugaccgccgucgcgcccuccaugaccaugcgcugcaucgggaucagcaaccgggacuucguggagggcaucuccggcgggagcuggguggacaucguccuggagcacggcuccugcgugaccaccauggccaagaacaagcccacgcucgacuucgagcugaucaagaccgaggccaagcaccccgccacccugcgcaaguacugcaucgaggccaagcucaccaacacgaccaccgcgagccggugcccgacccagggggagcccucccugaacgaggagcaggacaagcgcuucgugugcaagcacagcauggucgaccggggcuggggcaacgggugcggccuguucgggaagggcgggaucgugacgugcgccauguucacgugcaagaagaacauggagggcaagaucgugcagcccgagaaccucgaguacaccaucgucaucacgccccacuccggcgaggagaacgccguggggaacgacacgggcaagcacgggaaggagaucaaggugaccccgcagagcuccaucaccgaggccgagcugaccggcuacgggaccgccacgauggagugcagcccccgcaccggccuggacuucaacgagaugguccuccugcagauggagaacaaggcguggcuggugcaccggcagugguuccucgaccugccccugcccuggcucccgggcgccgacacccagggguccaacuggauccagaaggagacccuggugacguucaagaacccccacgccaagaagcaggacgucgugguccugggcagccaggagggggccaugcacaccgcccucaccggcgcgaccgagauccagaugagcuccgggaaccugcuguucacgggccaccucaagugccgccugcggauggacaagcugcagcucaagggcaugagcuacuccaugugcaccgggaaguucaagguggugaaggagaucgccgagacccagcacggcaccaucgucauccgcgugcaguacgagggggacggcagccccugcaagauccccuucgagaucauggaccuggagaagcggcacgugcugggccgccucaucacggucaacccgaucgugaccgagaaggacucccccgugaacaucgaggccgagccgcccuucggggacagcuacaucaucaucggcgucgagccggggcagcugaagcuguccugguucaagaagggcagcuccaucgggcagauguucgagaccaccaugcgcggcgccaagcggauggccauccucggcgacacggcgugggacuucgggagccugggcgggguguucaccuccaucggcaaggcccugcaccagguguucggggccaucuacggcgccgcguucagcggcgucuccuggaccaugaagauccucaucgggguggugaucaccuggaucggcaugaacagccgcuccacgagccuguccgucagccuggugcugguggggaucgucacccucuaccugggcgugauggugcaggccgacuccgggugcgucgugagcuggaagaacaaggagcugaagugcggcagcggcaucuucaucaccgacaacgugcacaccuggacggagcaguacaaguuccagcccgagucccccagcaagcucgccuccgccauccagaaggcccacgaggaggggaucugcggcauccggagcgucacccgccuggagaaccugauguggaagcagaucacccccgagcucaaccacauccuguccgagaacgaggugaagcugaccaucaugacgggggacaucaagggcaucaugcaggcggggaagcggagccuccgcccgcagcccaccgagcugaaguacuccuggaaggccuggggcaaggccaagaugcugagcaccgagcuccacaaccacaccuuccugaucgacggccccgagacggccgagugcccgaacaccaaccgggccuggaacucccuggagguggaggacuacggguucggcgucuucaccaccaacaucuggcucaagcugaaggagcgccaggacguguucugcgacagcaagcugauguccgcggccaucaaggacaaccgggccgugcacgccgacaugggguacuggaucgagagcgcccucaacgacacguggaagaucgagaaggcguccuucaucgaggucaagagcugccacuggcccaagucccacacccuguggagcaacggcgugcuggaguccgagaugaucauccccaagaacuucgccggccccgugagccagcacaacuaccgcccgggguaccacacccagaccgccggccccuggcaccucgggcggcuggagauggacuucgacuucugcgagggcaccacggucguggugaccgaggacugcgggaaccgcggccccagccugcggaccaccacggccuccggcaagcucaucaccgaguggugcugccgcagcugcacccugcccccgcugcgguaccgcggggaggacggcugcugguacgggauggagauccggccccucaaggagaaggaggagaaccuggucaacucccuggugaccgcgggccacgggcagaucgacaacuucagccucggcgugcugggcauggcccuguuccucgaggagaugcugcgcacgcgggucgggaccaagcacgccauccugcucguggccguguccuucgucacccugaucaccggcaacaugagcuuccgcgaccuggggcgcgugauggugauggucggcgccacgaugaccgacgacaucgggaugggcgugaccuaccucgcgcugcuggccgccuucaaggugcggcccaccuucgccgccggccuccugcugcgcaagcucacguccaaggagcugaugaugaccaccaucgggaucguccugcucagccaguccaccauccccgagacgauccuggagcugaccgacgcgcucgcccugggcaugauggugcugaagaucgugcggaacauggagaaguaccagcucgccgucaccaucauggccauccugugcgugccgaacgccgucauccugcagaacgcguggaaggugagcugcaccauccucgccguggucuccgugagcccccugcugcucacguccagccagcagaaggccgacuggaucccccuggcccugaccaucaaggggcucaaccccaccgcgaucuuccugaccacgcugucccgcaccagcaagaagcgguccuggccgcucaacgaggccaucauggccgugggcauggucagcauccuggccuccagccugcucaagaacgacauccccaugaccggcccccugguggccgggggccugcucaccgugugcuacguccugacggggcgcagcgcggaccuggagcucgagcgggccgccgacgugcgcugggaggagcaggccgagaucuccggcagcucccccauccugagcaucaccaucuccgaggacgggagcauguccaucaagaacgaggaggaggagcagacccugaccauccucauccggacgggccugcuggugaucagcggccucuucccggucuccauccccaucaccgccgcggccugguaccugugggaggugaagaagcagcgcgccggggugcugugggacguccccagcccgccgcccgugggcaaggccgagcucgaggacggggccuaccggaucaagcagaagggcauccugggguacucccagaucggcgcgggcguguacaaggaggggaccuuccacaccauguggcacgucacccgcggcgccgugcugaugcacaaggggaagcggaucgagcccagcugggccgacgugaagaaggaccucaucuccuacggcgggggcuggaagcuggagggcgaguggaaggagggggaggagguccaggugcuggcccucgagcccggcaagaacccccgcgccgugcagacgaagcccgggcuguucaagaccaacaccggcaccaucggggcggucagccuggacuucucccccggcacgagcggcucccccaucguggacaagaaggggaagguggucggccucuacgggaacggcguggugacccggagcggcaccuacgucuccgccaucgcccagaccgagaaguccaucgaggacaaccccgagaucgaggacgacaucuuccgcaagaagcggcugacgaucauggaccugcaccccggggccggcaagaccaagcgcuaccugcccgcgaucgugcgggaggccaucaagcgcgggcuccggacccugauccuggccccgacccgcguggucgccgccgagauggaggaggcgcuccgcggccugcccauccgguaccagacgcccgccauccgcgccgagcacaccgggcgggagaucguggaccugaugugccacgccaccuucaccaugcgccuccugagccccauccgggugccgaacuacaaccugaucaucauggacgaggcccacuucacggaccccgcguccaucgccgcccgcggcuacaucagcacccgggucgagaugggcgaggccgccgggaucuucaugaccgcgacgccgcccggcucccgcgacccguucccccagagcaacgcccccaucauggacgaggagcgggagauccccgagcgcuccuggaacagcgggcacgagugggugacggacuucaagggcaagaccgugugguucgucccguccaucaaggccgggaacgacaucgccgcgugccuccggaagaacggcaagaaggugauccagcugagccgcaagaccuucgacuccgaguacaucaagacccggacgaacgacugggacuucguggucaccaccgacaucagcgagaugggcgccaacuucaaggccgagcgcgugaucgacccccggcgcugcaugaagcccgugauccugaccgacggggaggagcgggucauccucgccggccccaugccggugacgcacuccagcgccgcgcagcgccgggggcgcgugggccgcaaccccaagaacgagaacgaccaguacaucuacaugggggagccccuggagaacgacgaggacugcgcccacuggaaggaggccaagaugcugcucgacaacaucaacacccccgagggcaucaucccguccauguucgagcccgagcgggagaaggucgacgccaucgacggcgaguaccgccugcgcggggaggcccgcaagaccuucguggaccugaugcggcgcggcgaccuccccguguggcuggcguaccgggucgccgccgaggggaucaacuacgccgaccgccgguggugcuucgacggcgugaagaacaaccagauccuggaggagaacgucgagguggagaucuggaccaaggagggggagcgcaagaagcucaagccgcgguggcuggacgcccgcaucuacagcgacccccuggcgcucaaggaguucaaggaguucgccgccggccggaagucccugacgcugaaccucaucaccgagaugggccgccugcccaccuucaugacccagaaggcccggaacgcgcuggacaaccucgccgugcugcacacggccgaggccgggggccgcgccuacaaccacgcgcugagcgagcuccccgagacccuggagacccugcuccugcugacccuccuggccacggucaccgggggcaucuuccuguuccucauguccggcaaggggaucggcaagaugacccuggggaugugcugcaucaucaccgccagcauccugcucugguacgcccagauccagccgcacuggaucgccgcguccaucauccuggaguucuuccugaucgugcuccugauccccgagcccgagaagcagcggacgccccaggacaaccagcugacguacguggucaucgccauccucaccgugguggccgccaccauggccaacgagaugggcuuccuggagaagaccaagaaggacuucgggcugggcagcaucacgacccagcagccggacagcaacauccucgacaucgaccugcgccccgcguccgccuggacccuguacgccgucgccaccacguucaucacccccaugcuccggcacagcaucgagaacuccagcgugaacgugucccugaccgccaucgcgaaccaggccaccguccugaugggccucgggaagggcuggccccugagcaagauggacaucggggugccgcugcucgccaucggcugcuacucccaggugaaccccaucacgcugaccgccgcgcugcuccugcuggucgcccacuacgccaucaucgggcccggccuccaggccaaggccacccgcgaggcgcagaagcgggccgccgccggcaucaugaagauccccgccgcgcugaucgggcgcgugaucgaccuggacccgauccccuacgaccccaaguucgagaagcagcucggccaggugaugcugcugguccucugcgugacccaggugcugaugaugcgcacgaccugggcccugugcgaggcccucacccuggccaccgggcccaucagcacgcugugggagggcaacccggggcgguucuggaacaccaccaucgccgucuccauggcgaacaucuuccgcggcagcuaccucgccggcgccgggcugcuguucuccaucaugaagaacaccgccaacacgcggcgcggcaccgggaacaccggcgagacccucggcgagaaguggaagaaccggcugaacgcgcugggcaagagcgaguuccagaucuacaagaaguccggcauccaggagguggaccgcacgcucgccaaggaggggaucaagcggggcgagaccgaccaccacgccgugagccgcggguccgccaagcugcggugguucgucgagcgcaaccuggugacccccgagggcaagguggucgaccucggcugcgggcggggcggguggagcuacuacugcggcgggcugaagaacgugaaggaggugaagggccugaccaagggcgggcccggccacgaggagcccaucccgauguccacguacggguggaaccucguccgccugcagagcggcguggacguguucuucacgccgcccgagaagugcgacacccugcucugcgacaucggggaguccagccccaacccgaccgucgaggccggccggacgcugcgcgugcugaaccucguggagaacuggcugaacaacaacacccaguucugcaucaagguccugaaccccuacaugcccagcgugaucgagaagauggaggcgcugcagcggaaguacggcggggcccucgugcgcaacccgcugucccggaacagcacccacgagauguacugggucuccaacgccagcggcaacaucguguccagcgugaacaugaucucccgcaugcugaucaaccgguucaccaugaagcacaagaaggccaccuacgagcccgacgucgaccucgggagcggcacgcgcaacaucgggaucgaguccgagacccccaaccuggacaucaucggcaagcgcaucgagaagaucaagcaggagcacgagaccagcuggcacuacgaccaggaccaccccuacaagaccugggccuaccacggcuccuacgagacgaagcagaccgggagcgcguccagcauggugaacggcgugguccggcugcucaccaagccgugggacgugauccccauggugacccagauggccaugacggacaccacccccuucgggcagcagcgcgucuucaaggagaagguggacacccggacgcaggagcccaaggagggcaccaagaagcugaugaagaucaccgccgaguggcuguggaaggagcucggcaagaagaagaccccgcgcaugugcacgcgggaggaguucacccgcaaggugcgguccaacgccgcccugggggcgaucuucaccgacgagaacaaguggaaguccgcccgcgaggccgucgaggacuccggcuucugggagcugguggacaaggagcggaaccuccaccuggaggggaagugcgagaccugcgucuacaacaugaugggcaagcgcgagaagaagcugggggaguucggcaaggccaagggcagccgggcgaucugguacauguggcucggggcccgcuuccuggaguucgaggcccugggcuuccucaacgaggaccacugguucucccgggagaacagccugagcgggguggagggcgaggggcugcacaagcucggcuacauccugcgcgacguguccaagaaggagggcggggccauguacgccgacgacacggcgggcugggacacccggaucacccuggaggaccucaagaacgaggagauggucaccaaccacauggagggggagcaccgcaagcuggccgaggccaucuuccggcugacguaccagaacaagguggugcgcguccagcggcccacgccccggggcaccgugauggacaucaucagccggcgcgaccagcgcggguccggccagguggucaccuacggccucaacacguucaccaacauggaggcccagcugauccggcagauggagggggagggcguguucaagagcauccagcaccugaccgugaccgaggagaucgccgucaagaacuggcucgagcgcguggggcgggagcgccugucccggauggcgaucagcggcgacgacugcguggucaagccccuggacgaccgcuucgccuccgcccucacggcccugaacgacaugggcaaggugcggaaggacauccagcagugggagccgagccgcggguggaacgacuggacccaggugcccuucugcucccaccacuuccacgagcugaucaugaaggacggccggguccucguggugcccugccgcaaccaggacgagcugaucgggcgggcccgcaucagccagggcgcgggguggucccugcgggagaccgccugccucggcaagagcuacgcccagauguggucccugauguacuuccaccgccgggaccugcgccucgccgccaacgcgaucugcagcgccguccccucccacugggugccgaucagccggaccacgugguccauccacgccacccacgaguggaugaccaccgaggacaugcugaccgccuggaaccgcguguggauccaggagaaccccuggauggaggacaagacgcccgucgagagcugggaggagauccccuaccugggcaagcgggaggaccaguggugcgggagccucaucggccugaccucccgcgcgaccugggccaagaacauccagaccgccaucaaccaggugcgcagccugaucgggaacgaggaguacacggacuacaugccguccaugaagcgguuccgccgggaggaggaggaggccggcgugcucugguga

SEQ ID NO: 9053 - RNA, 9876 nt, Artificial Sequence
  derived and/or modified CDS sequence (opt1) from DENV-2__KX380821__SS-prME
accgccggcaucaucaucaugaugauccccaccgugauggccuuccaccugaccacccgcaacggggagccccacaugaucgugucccggcaggagaagggcaagucccuccuguucaagaccgagaacggggugaacaugugcacccugauggcgauggaccucggcgagcugugcgaggacaccaucaccuacaacugcccccugcuccgccagaacgagcccgaggacaucgacugcuggugcaacagcaccuccaccugggugaccuacgggaccugcaccgccaccggcgagcaccggcgcgagaagcggagcgucgcccuggugccccacgugggcauggggcuggagacccgcaccgagaccuggauguccagcgagggcgccuggaagcacgcccagcggaucgagaccuggguccuccgccaccccggguucaccgugauggcggccauccuggccuacaccaucggcaccaccuacuuccagcgggugcugaucuucauccuccugacggccgucgcgcccuccaugaccaugcgcugcaucgggaucagcaaccgggacuucguggagggcguguccggcgggagcugggucgacaucgugcuggagcacggcuccugcgugaccaccauggccaagaacaagcccacgcucgacuucgagcugaucaagaccgaggccaagcaccccgccacccugcgcaaguacugcaucgaggccaagcucaccaacacgaccaccgcgagccggugcccgacccagggggagcccucccugaacgaggagcaggacaagcgcuucgucugcaagcacagcaugguggaccggggcuggggcaacgggugcggccuguucgggaagggcgggaucgugacgugcgccauguucacgugcaagaagaacauggagggcaagaucguccagcccgagaaccucgaguacaccaucgugaucacgccccacuccggcgaggagaacgccguggggaacgacacgggcaagcacgggaaggagaucaaggucaccccgcagagcuccaucaccgaggccgagcugaccggcuacgggaccgccacgauggagugcagcccccgcaccggccuggacuucaacgagauggugcuccugcagauggagaacaaggcguggcuggugcaccggcagugguuccucgaccugccccugcccuggcucccgggcgccgacacccagggguccaacuggauccagaaggagacccuggucacguucaagaacccccacgccaagaagcaggacguggucgugcugggcagccaggagggggccaugcacaccgcccucaccggcgcgaccgagauccagaugagcuccgggaaccugcuguucacgggccaccucaagugccgccugcggauggacaagcugcagcucaagggcaugagcuacuccaugugcaccgggaaguucaagguggucaaggagaucgccgagacccagcacggcaccaucgugauccgcgugcaguacgagggggacggcagccccugcaagauccccuucgagaucauggaccuggagaagcggcacguccugggccgccucaucacggugaacccgaucgugaccgagaaggacucccccgucaacaucgaggccgagccgcccuucggggacagcuacaucaucaucggcguggagccggggcagcugaagcuguccugguucaagaagggcagcuccaucgggcagauguucgagaccaccaugcgcggcgccaagcggauggccauccucggcgacacggcgugggacuucgggagccugggcgggguguucaccuccaucggcaaggcccugcaccaggucuucggggccaucuacggcgccgcguucagcggcguguccuggaccaugaagauccucaucgggguggucaucaccuggaucggcaugaacagccgcuccacgagccuguccgugagccuggugcuggucgggguggugacccucuaccugggcgucauggugcaggccgacuccgggugcguggucagcuggaagaacaaggagcugaagugcggcagcggcaucuucaucaccgacaacgugcacaccuggacggagcaguacaaguuccagcccgagucccccagcaagcucgccuccgccauccagaaggcccacgaggaggggaucugcggcauccggagcgugacccgccuggagaaccugauguggaagcagaucacccccgagcucaaccacauccugaccgagaacgaggucaagcugacgaucaugaccggggacaucaagggcaucaugcaggcggggaagcggacccuccgcccgcagcccaccgagcugaaguacuccuggaaggccuggggcaaggccaagaugcugagcacggagcuccacaaccacaccuuccugaucgacggccccgagaccgccgagugcccgaacaccaaccgggccuggaacucccuggagguggaggacuacggguucggcguguucacgaccaacaucuggcucaagcugaaggagcgccaggacgucuucugcgacagcaagcugauguccgcggccaucaaggacaaccgggccgugcacgccgacaugggguacuggaucgagagcgcccucaacgacaccuggaagaucgagaaggcguccuucaucgaggucaagagcugccacuggcccaagucccacacccuguggagcaacggcgugcuggaguccgagaugaucauccccaagaacuucgccggccccgugagccagcacaacuaccgcccgggguaccacacccagacggccggccccuggcaccucgggcggcuggagauggacuucgacuucugcgagggcaccaccguggucgugaccgaggacugcgggaaccgcggccccucccugcggacgaccaccgccagcggcaagcucaucaccgaguggugcugccgcagcugcacgcugcccccgcugcgguaccgcggggaggacggcugcugguacgggauggagauccggccccucaaggagaaggaggagaaccuggugaacucccuggucaccgcgggccacgggcagaucgacaacuucagccucggcgugcugggcauggcccuguuccucgaggagaugcugcgcacccggguggggaccaagcacgccauccugcucgucgccguguccuucgugacgcugaucaccggcaacaugagcuuccgcgaccuggggcgcgucauggugauggugggcgccaccaugaccgacgacaucgggaugggcgucacguaccucgcgcugcuggccgccuucaagauccggcccaccuucgccgccggccuccugcugcgcaagcucaccuccaaggagcugaugaugaccacgaucgggaucgugcugcucagccaguccaccauccccgagagcauccuggagcugaccgacgcgcucgcccugggcaugauggugcugaagaucguccggaacauggagaaguaccagcucgccgugaccaucauggccauccugugcgucccgaacgccgugauccugcagaacgcguggaagguguccugcacgacccucgccgucgugagcgugagcccccugcugcucaccagcucccagcagaaggccgacuggaucccccuggcccugaccaucaaggggcucaaccccacggcgaucuuccugaccacccugagccgcaccuccaagaagcggagcuggccgcucaacgaggccaucauggccgucggcaugguguccauccuggccagcucccugcucaagaacgacauccccaugacgggcccccugguggccgggggccugcucaccgucugcuacgugcugaccgggcgcagcgcggaccuggagcucgagcgggccgccgacgugcgcugggaggagcaggccgagaucagcggcuccagccccauccuguccaucaccaucagcgaggacggguccaugagcaucaagaacgaggaggaggagcagacgcugaccauccucauccggaccggccugcuggucaucuccggccucuucccggugagcauccccaucaccgccgcggccugguaccugugggaggugaagaagcagcgcgccgggguccugugggacgugcccagcccgccgcccgugggcaaggccgagcucgaggacggggccuaccggaucaagcagaagggcauccugggguacagccagaucggcgcgggcgucuacaaggaggggaccuuccacacgauguggcacgugacccgcggcgccgugcugaugcacaaggggaagcggaucgagcccuccugggccgacgucaagaaggaccucaucagcuacggcgggggcuggaagcuggagggcgaguggaaggagggggaggagguccaggugcuggcccucgagcccggcaagaacccccgcgccguccagaccaagcccgggcuguucaagaccaacacgggcaccaucggggcggugucccuggacuucagccccggcaccuccggcagccccaucguggacaagaaggggaaggucgugggccucuacgggaacggcguggucacccgguccggcacguacgugagcgccaucgcccagaccgagaaguccaucgaggacaaccccgagaucgaggacgacaucuuccgcaagaagcggcugaccaucauggaccugcaccccggggccggcaagaccaagcgcuaccugcccgcgaucgugcgggaggccaucaagcgcgggcuccggacgcugauccuggccccgacccgcgucguggccgccgagauggaggaggcgcuccgcggccugcccauccgguaccagacccccgccauccgcgccgagcacaccgggcgggagaucguggaccugaugugccacgccacguucaccaugcgccuccugagccccauccgggucccgaacuacaaccugaucaucauggacgaggcccacuucaccgaccccgcgagcaucgccgcccgcggcuacaucuccacccggguggagaugggcgaggccgccgggaucuucaugacggcgacgccgcccggcagccgcgacccguucccccaguccaacgcccccaucauggacgaggagaaggagauccccgagcggagcuggaacuccgggcacgagugggugaccgacuucaagggcaagaccgucugguucgugccgagcaucaaggccgggaacgacaucgccgcgugccuccgcaagaacggcaagaaggugauccagcugucccggaagacguucgacagcgaguacaucaagacccgcaccaacgacugggacuucgucgugaccacggacaucuccgagaugggcgccaacuucaaggccgagcgggugaucgacccccgccggugcaugaagcccgucauccugaccgacggggaggagcgcgugauccucgccggccccaugccggugacccacagcuccgccgcgcagcggcgcgggcgggucggccgcaaccccaagaacgagaacgaccaguacaucuacaugggggagccccuggagaacgacgaggacugcgcccacuggaaggaggccaagaugcugcucgacaacaucaacacccccgagggcaucaucccgagcauguucgagcccgagcgcgagaagguggacgccaucgacggcgaguaccggcugcgcggggaggcccggaagacguucguggaccugaugcgccggggcgaccuccccgucuggcuggcguaccgcguggccgccgaggggaucaacuacgccgaccggcgcuggugcuucgacggcgucaagaacaaccagauccuggaggagaacguggagguggagaucuggaccaaggagggggagcggaagaagcucaagccgcgcuggcuggacgcccggaucuacuccgacccccuggcgcucaaggaguucaaggaguucgccgccggccgcaagagccugacccugaaccucaucaccgagaugggccggcugcccacguucaugacccagaaggccaagaacgcgcuggacaaccucgccguccugcacaccgccgaggccgggggccgcgccuacaaccacgcgcuguccgagcuccccgagacccuggagacgcugcuccugcugacccuccuggccaccgugaccgggggcaucuuccuguuccucaugagcggcaaggggaucggcaagaugacccuggggaugugcugcaucaucacggccuccauccugcucugguacgcccagauccagccgcacuggaucgccgcgagcaucauccuggaguucuuccugaucgugcuccugauccccgagcccgagaagcagcggacgccccaggacaaccagcugaccuacgucgugaucgccauccucaccguggucgccgccacgauggccaacgagaugggcuuccuggagaagaccaagaaggacuucgggcugggcuccaucaccacccagcagccggagagcaacauccucgacaucgaccugcgccccgcgagcgccuggacgcuguacgccguggccaccaccuucaucacccccaugcuccggcacuccaucgagaacagcuccgugaacgucagccugacggccaucgcgaaccaggccaccgugcugaugggccucgggaagggcuggccccuguccaagauggacaucggggugccgcugcucgccaucggcugcuacagccaggucaaccccaucacccugaccgccgcgcugcuccugcugguggcccacuacgccaucaucgggcccggccuccaggccaaggccacgcgcgaggcgcagaagcgggccgccgccggcaucaugaagaaccccaccguggacgggaugaccgucaucgaccuggacccgauccccuacgaccccaaguucgagaagcagcugggccaggugaugcuccuggugcugugcgucacccaggugcucaugaugcgcacgaccugggcccugugcgaggcgcugacccucgccaccgggcccaucuccacgcugugggagggcaacccggggcgguucuggaacaccaccaucgccgugagcauggccaacaucuuccgcggcuccuaccuggccggcgcggggcuccuguucagcaucaugaagaacaccgccaacacgcgccggggcaccgggaacaccggcgagacccugggcgagaaguggaagaaccgccucaacgcccuggggaaguccgaguuccagaucuacaagaaguccggcauccaggaggucgaccggacgcuggccaaggaggggaucaagcgcggcgagaccgaccaccacgcggugucccgggggagcgccaagcuccgcugguucguggagcggaaccuggucacccccgagggcaaggugguggaccugggcugcgggcgcggcgggugguccuacuacugcggcgggcucaagaacgucaaggaggugaagggccugaccaagggcgggcccggccacgaggagcccaucccgaugagcacguacggguggaaccuggugcggcuccaguccggcgucgacguguucuucacgccgcccgagaagugcgacacccugcugugcgacaucggggagagcucccccaacccgaccguggaggccggccgcacccuccggguccugaaccugguggagaacuggcucaacaacaacacgcaguucugcaucaaggugcugaaccccuacaugcccagcgucaucgagaagauggaggcccugcagcgcaaguacggcggggcccuggugcggaacccgcucagccgcaacuccacccacgagauguacugggugagcaacgcguccggcaacaucgucagcuccgugaacaugaucagccggaugcugaucaaccgcuucaccaugcggcacaagaaggccaccuacgagcccgacguggaccugggguccggcacgcgcaacaucgggaucgagagcgagacccccaaccucgacaucaucggcaagcggaucgagaagaucaagcaggagcacgagaccuccuggcacuacgaccaggaccaccccuacaagaccugggccuaccacggcagcuacgagacgaagcagaccggguccgccagcuccauggucaacggcguggugcgccugcugaccaagccgugggacgucauccccauggugacccagauggccaugacggacaccacccccuucgggcagcagcgcguguucaaggagaaggucgacacccggacgcaggagcccaaggagggcaccaagaagcucaugaagaucaccgcggaguggcuguggaaggagcugggcaagaagaagaccccgcgcaugugcacgcgggaggaguucacccgcaaggugcggagcaacgccgcccucggggccaucuucaccgacgagaacaaguggaaguccgcccgcgaggcggucgaggacagcggcuucugggagcugguggacaaggagcggaaccugcaccucgaggggaagugcgagaccugcguguacaacaugaugggcaagcgcgagaagaagcugggggaguucggcaaggccaagggcucccgggccaucugguacauguggcugggggcccgcuuccucgaguucgaggcgcugggcuuccugaacgaggaccacugguucagccgggagaacucccucagcggggucgagggcgaggggcugcacaagcugggcuacauccuccgcgacgugagcaagaaggagggcggggccauguacgccgacgacacggccggcugggacacccggaucacccuggaggaccugaagaacgaggagauggugaccaaccacauggagggggagcacaagaagcucgccgaggcgaucuucaagcugacguaccagaacaaggucgugcgcgugcagcggcccacgccccgcggcaccgucauggacaucaucucccggcgcgaccagcgggggagcggccagguggugaccuacggccugaacacguucaccaacauggaggcccagcucauccgccagauggagggggagggcgucuucaaguccauccagcagcugaccgugaaggaggagaucgccgugaagaacuggcugauccgggucgggcgcgagcgccucagccggauggccaucuccggcgacgacugcguggugaagccccuggacgaccgcuucgccagcgcgcugaccgcccucaacgacaugggcaagguccggaaggacauccagcagugggagccgucccgcggguggaacgacuggacccaggugcccuucugcagccaccacuuccacgagcugaucaugaaggacggccgggugcuggucgugcccugccgcaaccaggacgagcucaucgggcgggcccgcaucucccagggcgccggguggagccugcgggagaccgccugccugggcaaguccuacgcgcagauguggagccucauguacuuccaccgccgggaccugcgccuggccgccaacgccaucugcuccgccgugcccagccacuggaucccgaccucccggaccaccuggagcauccacgcgacgcacgaguggaugaccaccgaggacaugcucaccgucuggaaccgcguguggauccaggagaaccccuggauggaggacaagacgcccguggaguccugggaggagauccccuaccugggcaagcgggaggaccaguggugcgggagccugaucggccucaccagccgcgccaccugggccaagaacauccagaccgccaucaaccagguccggucccugaucgggaacgaggaguacacggacuacaugccgagcaugaagcgcuuccggcgcgaggaggaggaggcgggcgugcugugguga

SEQ ID NO: 9054 - RNA, 9876 nt, Artificial Sequence
  derived and/or modified CDS sequence (opt1) from DENV-2__KX380822__SS-prME
accgccgggaucaucaucaugaugauccccaccgugauggccuuccaccugaccacccggaacggggagccccacaugaucgugagccggcaggagaagggcaagagccuccuguucaagaccgagaacggggugaacaugugcacccugauggcgauggaccucggcgagcugugcgaggacaccaucaccuacaacugcccccugcuccgccagaacgagcccgaggacaucgacugcuggugcaacagcaccagcaccugggugaccuacgggaccugcaccgccaccggcgagcaccggcgcgagaagcggagcgucgcccuggugccccacgugggcauggggcuggagacgcgcaccgagaccuggauguccagcgagggcgccuggaagcacgcccagcggaucgagaccuggguccuccgccaccccggguucacggugauggcggccauccuggccuacaccaucggcaccaccuacuuccagcgggugcugaucuucauccuccugacggccgucgcgcccuccaugaccaugcgcugcaucgggaucagcaaccgggacuucguggagggcguguccggcgggagcugggucgacaucgugcuggagcacggcuccugcgugaccaccauggccaagaacaagcccacgcucgacuucgagcugaucaagaccgaggccaagcaccccgccacccugcgcaaguacugcaucgaggccaagcucaccaacacgaccaccgcgagccggugcccgacccagggggagcccucccugaacgaggagcaggacaagcgcuucgucugcaagcacagcaugguggaccggggcuggggcaacgggugcggccuguucgggaagggcgggaucgugacgugcgccauguucacgugcaagaagaacauggagggcaagaucguccagcccgagaaccucgaguacaccaucgugaucacgccccacuccggcgaggagaacgccguggggaacgacacgggcaagcacgggaaggagaucaaggucaccccgcagagcuccaucaccgaggccgagcugaccggcuacgggaccgccacgauggagugcagcccccgcaccggccuggacuucaacgagauggugcuccugcagauggagaacaaggcguggcuggugcaccggcagugguuccucgaccugccccugcccuggcucccgggcgccgacacccagggguccaacuggauccagaaggagacccuggucacguucaagaacccccacgccaagaagcaggacguggucgugcugggcagccaggagggggccaugcacaccgcccucaccggcgcgaccgagauccagaugagcuccgggaaccugcuguucacgggccaccucaagugccgccugcggauggacaagcugcagcucaagggcaugagcuacuccaugugcaccgggaaguucaagguggucaaggagaucgccgagacccagcacggcaccaucgugauccgcgugcaguacgagggggacggcagccccugcaagauccccuucgagaucauggaccuggagaagcggcacguccugggccgccucaucacggugaacccgaucgugaccgagaaggacucccccgucaacaucgaggccgagccgcccuucggggacagcuacaucaucaucggcguggagccggggcagcugaagcuguccugguucaagaagggcagcuccaucgggcagauguucgagaccaccaugcgcggcgccaagcggauggccauccucggcgacacggcgugggacuucgggagccugggcgggguguucaccuccaucggcaaggcccugcaccaggucuucggggccaucuacggcgccgcguucagcggcguguccuggaccaugaagauccucaucgggguggucaucaccuggaucggcaugaacagccgcuccacgagccuguccgugagccuggugcuggucgggaucgugacccucuaccugggcgugaugguccaggccgacuccgggugcguggugagcuggaagaacaaggagcugaagugcggcagcggcaucuucaucaccgacaacguccacaccuggacggagcaguacaaguuccagcccgagucccccagcaagcucgccuccgccauccagaaggcccacgaggaggggaucugcggcauccggagcgugacccgccuggagaaccugauguggaagcagaucacccccgagcucaaccacauccuguccgagaacgaggugaagcugaccaucaugacgggggacaucaagggcaucaugcaggcggggaagcggagccuccgcccgcagcccaccgagcugaaguacuccuggaaggccuggggcaaggccaagaugcugagcaccgagcuccacaaccacaccuuccugaucgacggccccgagacggccgagugcccgaacaccaaccgggccuggaacucccuggaggucgaggacuacggguucggcguguucaccaccaacaucuggcucaagcugaaggagcgccaggacguguucugcgacagcaagcugauguccgcggccaucaaggacaaccgggccguccacgccgacaugggguacuggaucgagagcgcccucaacgacacguggaagaucgagaaggcguccuucaucgaggucaagagcugccacuggcccaagucccacacccuguggagcaacggcgugcuggaguccgagaugaucauccccaagaacuucgccggccccgugagccagcacaacuaccgcccgggguaccacacccagaccgccggccccuggcaccucgggcggcuggagauggacuucgacuucugcgagggcaccacggugguggucaccgaggacugcgggaaccgcggccccagccugcggaccaccacggccuccggcaagcucaucaccgaguggugcugccgcagcugcacccugcccccgcugcgguaccgcggggaggacggcugcugguacgggauggagauccggccccucaaggagaaggaggagaaccuggugaacucccuggugaccgcgggccacgggcagaucgacaacuucagccucggcguccugggcauggcccuguuccucgaggagaugcugcgcacgcggguggggaccaagcacgccauccugcucguggccgucuccuucgugacccugaucaccggcaacaugagcuuccgcgaccuggggcgcgugauggucauggugggcgccacgaugaccgacgacaucgggaugggcgugaccuaccucgcgcugcuggccgccuucaagguccggcccaccuucgccgccggccuccugcugcgcaagcucacguccaaggagcugaugaugaccaccaucgggaucgugcugcucagccaguccaccauccccgagacgauccuggagcugaccgacgcgcucgcccugggcaugauggugcugaagaucguccggaacauggagaaguaccagcucgccgugaccaucaugaccauccugugcgucccgaacgccgugauccugcagaacgccuggaaggugagcugcacgauccucgcggucguguccgugagcccccugcugcucaccuccagccagcagaaggccgacuggaucccccuggcccugaccaucaaggggcucaaccccaccgccaucuuccugacgacccugucccgcaccagcaagaagcgguccuggccgcucaacgaggcgaucauggccgucggcauggugagcauccuggccuccagccugcucaagaacgacauccccaugaccggcccccugguggccgggggccugcucacggucugcuacgugcugaccgggcgcagcgccgaccuggagcucgagcgggcggccgacgugcgcugggaggagcaggccgagaucuccggcagcucccccauccugagcaucaccaucuccgaggacgggagcauguccaucaagaacgaggaggaggagcagacccugacgauccucauccggaccggccugcuggucaucagcggccucuucccgguguccauccccaucaccgccgccgcgugguaccugugggaggugaagaagcagcgcgccgggguccugugggacgugcccagcccgccgcccgugggcaaggccgagcucgaggacggggccuaccggaucaagcagaagggcauccugggguacucccagaucggcgccggcgucuacaaggaggggaccuuccacaccauguggcacgugacgcgcggcgcggugcugaugcacaaggggaagcggaucgagcccagcugggccgacgucaagaaggaccucaucuccuacggcgggggcuggaagcuggagggcgaguggaaggagggggaggagguccaggugcuggcccucgagcccggcaagaacccccgcgccguccagaccaagcccgggcuguucaagaccaacaccggcacgaucggggccgugagccuggacuucucccccggcaccagcggcucccccaucguggacaagaaggggaaggucgugggccucuacgggaacggcguggucacccggagcggcaccuacguguccgcgaucgcccagacggagaaguccaucgaggacaaccccgagaucgaggacgacaucuuccgcaagaagcggcugaccaucauggaccugcaccccggggccggcaagaccaagcgcuaccugcccgccaucgugcgggaggcgaucaagcgcgggcuccggacccugauccuggccccgacgcgcgucguggccgccgagauggaggaggcccuccgcggccugcccauccgguaccagacccccgcgauccgcgccgagcacaccgggcgggagaucguggaccugaugugccacgccaccuucacgaugcgccuccugagccccauccgggucccgaacuacaaccugaucaucauggacgaggcccacuucaccgaccccgccuccaucgcggcccgcggcuacaucagcacccggguggagaugggcgaggccgccgggaucuucaugaccgccacgccgcccggcucccgcgacccguucccccagagcaacgcgcccaucauggacgaggagcgggagauccccgagcgcuccuggaacagcgggcacgagugggugaccgacuucaagggcaagaccgucugguucgugccguccaucaaggccgggaacgacaucaccgccugccuccggaagaacggcaagaaggugauccagcugagccgcaagacguucgacuccgaguacaucaagacccggaccaacgacugggacuucgucgugaccacggacaucagcgagaugggcgccaacuucaaggcggagcgcgugaucgacccccggcgcugcaugaagcccgucauccugaccgacggggaggagcgggugauccucgccggccccaugccggugacccacuccagcgccgcccagcgccgggggcgcgucggccgcaaccccaagaacgagaacgaccaguacaucuacaugggggagccccuggagaacgacgaggacugcgcccacuggaaggaggcgaagaugcugcucgacaacaucaacacccccgagggcaucaucccguccauguucgagcccgagcgggagaagguggacgccaucgacggcgaguaccgccugcgcggggaggcccgcaagacguucguggaccugaugcggcgcggcgaccuccccgucuggcuggccuaccggguggccgcggaggggaucaacuacgccgaccgccgguggugcuucgacggcgucaagaacaaccagauccuggaggagaacguggagguggagaucuggaccaaggagggggagcgcaagaagcucaagccgcgguggcuggacgcccgcaucuacagcgacccccuggcccucaaggaguucaaggaguucgccgcgggccggaagucccugacccugaaccucaucaccgagaugggccgccugcccacguucaugacccagaaggcccggaacgcccuggacaaccucgccguccugcacaccgcggaggccgggggccgcgccuacaaccacgcccugagcgagcuccccgagacccuggagacgcugcuccugcugacccuccuggccaccgugaccgggggcaucuuccuguuccucauguccggcaaggggaucggcaagaugacccuggggaugugcugcaucaucacggcgagcauccugcucugguacgcccagauccagccgcacuggaucgccgccuccaucauccuggaguucuuccugaucgugcuccugauccccgagcccgagaagcagcggacgccccaggacaaccagcugaccuacgucgugaucgccauccucaccguggucgcggccacgauggccaacgagaugggcuuccuggagaagaccaagaaggacuucgggcugggcagcaucaccacccagcagccggacagcaacauccucgacaucgaccugcgccccgccuccgccuggacgcuguacgcgguggccaccaccuucaucacccccaugcuccggcacagcaucgagaacuccagcgugaacgucucccugacggccaucgccaaccaggccaccgugcugaugggccucgggaagggcuggccccugagcaagauggacaucggggugccgcugcucgcgaucggcugcuacucccaggucaaccccaucacccugaccgccgcccugcuccugcugguggcccacuacgcgaucaucgggcccggccuccaggccaaggccacgcgcgaggcccagaagcgggccgcggccggcaucaugaagauccccgccgccgacgggaugaccgugaucgaccuggacccgauccccuacgaccccaaguucgagaagcagcugggccaggucaugcuccuggugcugugcgugacccagguccucaugaugcgcaccacgugggcccugugcgaggcgcugacccucgccaccgggcccaucagcacccugugggagggcaacccggggcgcuucuggaacacgaccaucgccguguccauggccaacaucuuccggggcagcuaccuggccggcgcggggcuccuguucuccaucaugaagaacaccgccaacacccgccggggcacggggaacaccggcgagacccugggcgagaaguggaagaaccgccucaacgcccugggcaagagcgaguuccagaucuacaagaaguccggcauccaggagguggaccggacccuggccaaggaggggaucaagcgcggcgagacggaccaccacgcggucagccggggguccgccaagcuccgcugguucguggagcggaaccuggugacccccgagggcaaggucguggaccugggcugcgggcgcggcggguggagcuacuacugcggcgggcucaagaacgugaaggaggucaagggccugaccaagggcgggcccggccacgaggagcccaucccgauguccaccuacggguggaaccuggugcggcuccagagcggcguggacgucuucuucacgccgcccgagaagugcgacacccugcugugcgacaucggggaguccagccccaacccgaccguggaggccggccgcacccuccgggugcugaaccuggucgagaacuggcucaacaacaacacccaguucugcaucaaggugcugaaccccuacaugcccagcgugaucgagaagauggaggcccugcagcgcaaguacggcggggcccugguccggaacccgcucucccgcaacagcacgcacgagauguacuggguguccaacgcgagcggcaacaucguguccagcgucaacaugaucucccggaugcugaucaaccgcuucaccaugaagcacaagaaggccaccuacgagcccgacguggaccuggggagcggcacccggaacaucgggaucgaguccgagacgcccaaccucgacaucaucggcaagcgcaucgagaagaucaagcaggagcacgagaccagcuggcacuacgaccaggaccaccccuacaagaccugggccuaccacggcuccuacgagaccaagcagacggggagcgccuccagcauggugaacggcgucgugcgccugcugaccaagccgugggacgugauccccauggucacccagauggccaugaccgacacgacccccuucgggcagcagcggguguucaaggagaagguggacacccgcacccaggagcccaaggagggcacgaagaagcucaugaagaucaccgcggaguggcuguggaaggagcugggcaagaagaagaccccgcggaugugcacccgcgaggaguucacgcggaagguccgcuccaacgccgcccucggggccaucuucaccgacgagaacaaguggaaguccgcccgggaggcgguggaggacuccggcuucugggagcuggucgacaaggagcgcaaccugcaccucgaggggaagugcgagaccugcguguacaacaugaugggcaagcgggagaagaagcugggggaguucggcaaggccaagggcagccgcgccaucugguacauguggcugggggcccgguuccucgaguucgaggcgcugggcuuccugaacgaggaccacugguucucccgcgagaacagccucagcgggguggagggcgaggggcugcacaagcugggcuacauccuccgggacgucuccaagaaggagggcggggccauguacgccgacgacaccgccggcugggacacgcgcaucacccuggaggaccugaagaacgaggagauggugaccaaccacauggagggggagcaccggaagcucgccgaggcgaucuuccgccugaccuaccagaacaaggugguccgggugcagcgccccacgccccggggcaccgugauggacaucaucagccgccgggaccagcgcggguccggccaggucgugaccuacggccugaacaccuucacgaacauggaggcccagcucauccgccagauggagggggagggcguguucaagagcauccagcaccugaccgucaccgaggagaucgccgugaagaacuggcuggagcggguggggcgcgagcggcucucccgcauggccaucagcggcgacgacugcgucgugaagccccuggacgaccgguucgccuccgcgcugaccgcccucaacgacaugggcaaggugcgcaaggacauccagcagugggagccgagccggggguggaacgacuggacgcagguccccuucugcucccaccacuuccacgagcugaucaugaaggacggccgcgugcuggugguccccugccggaaccaggacgagcucaucgggcgcgcccggaucagccagggcgccggguggucccugcgcgagaccgccugccugggcaagagcuacgcgcagauguggucccucauguacuuccaccggcgcgaccugcggcuggccgccaacgccaucugcagcgccgugcccucccacugggugccgaccagccgcaccaccugguccauccacgcgacgcacgaguggaugaccaccgaggacaugcucaccgucuggaaccggguguggauccaggagaaccccuggauggaggacaagacgcccguggagagcugggaggagauccccuaccugggcaagcgcgaggaccaguggugcgggagccugaucggccucaccucccgggccaccugggccaagaacauccagaccgccaucaaccagguccgcagccugaucgggaacgaggaguacacggacuacaugccguccaugaagcgcuuccggcgcgaggaggaggaggcgggcgugcugugguga

SEQ ID NO: 9055 - RNA, 9876 nt, Artificial Sequence
  derived and/or modified CDS sequence (opt1) from DENV-2__KX380828__SS-prME
accgcgggcgugaucaucaugcugauccccaccgccauggcguuccaccucaccacccgcaacggggagccccacaugaucgugagccggcaggagaagggcaagagccugcuguucaagaccgaggacggggugaacaugugcacccucauggccauggaccugggcgagcugugcgaggacaccaucaccuacaacugcccccuccugcgccagaacgagcccgaggacaucgacugcuggugcaacagcaccuccaccugggugaccuacgggaccugcaccgccaccggcgagcaccggcgcgagaagcggagcgucgcccuggugccccacgugggcauggggcucgagacccgcaccgagaccuggauguccagcgagggcgccuggaagcacgcgcagcggaucgagaccuggauccugcgccaccccggguucacgaucauggccgccauccuggccuacaccaucggcaccaccuacuuccagcggguccucaucuucauccugcugacggcgguggcccccuccaugaccaugcgcugcaucgggaucagcaaccgggacuucguggagggcgucuccggcgggagcuggguggacaucgugcucgagcacggcuccugcgucaccaccauggccaagaacaagcccacgcuggacuucgagcugaucaagaccgaggccaagcagcccgccacccuccgcaaguacugcaucgaggcgaagcugaccaacacgaccaccgccagccggugcccgacccagggggagcccucccugaacgaggagcaggacaagcgcuucgugugcaagcacagcaugguggaccggggcuggggcaacgggugcggccucuucgggaagggcgggaucgucacgugcgccauguucacgugcaagaagaacauggagggcaagaucgugcagcccgagaaccuggaguacaccaucguggucacgccccacuccggcgaggagaacgccguggggaacgacacgggcaagcacgggaaggagaucaaggugaccccgcagagcuccaucaccgaggccgagcugaccggcuacgggaccgucacgauggagugcagcccccgcaccggccucgacuucaacgagauggugcugcugcagauggagaacaaggcguggcucgugcaccggcagugguuccuggaccugccccuccccuggcugccgggcgccgacacccagggguccaacuggauccagaaggagaugcuggucaccuucaagaacccccacgccaagaagcaggacguggucgugcucggcagccaggagggggccaugcacacggcccugaccggcgcgaccgagauccagaugagcuccgggaaccuccuguucaccggccaccugaagugccgccugcggauggacaagcuccagcugaagggcaugagcuacuccaugugcacggggaaguucaagguggucaaggagaucgccgagacccagcacggcaccaucguggugcgcguccaguacgagggggacggcagccccugcaagauccccuucgagaucauggaccuggagaagcggcacgugcucggccgccugaucaccgugaacccgaucgucacggagaaggacucccccgugaacaucgaggccgagccgcccuucggggacagcuacaucaucaucggcguggagccggggcagcugaagcucuccugguucaagaagggcagcuccaucgggcagauguucgagaccaccaugcgcggcgccaagcggauggccauccugggcgacaccgcgugggacuucgggagccugggcggggucuucacguccaucggcaaggcccuccaccagguguucggggccaucuacggcgccgcguucagcggcguguccuggaccaugaagauccugaucggggucgugaucaccuggaucggcaugaacagccgcuccaccagccuguccgugagccugguccucguggggguggucacgcuguaccugggcgugauggugcaggccgacuccgggugcgucgugagcuggaagaacaaggagcucaagugcggcagcggcaucuucaucaccgacaacgugcacaccuggaccgagcaguacaaguuccagcccgagucccccagcaagcuggccuccgccauccagaaggcccacgaggaggggaucugcggcauccggagcgucacgcgccuggagaaccucauguggaagcagaucacccccgagcugaaccacauccuguccgagaacgaggugaagcucaccaucaugaccggggacaucaagggcaucaugcaggcggggaagcggagccugcgcccgcagcccacggagcugaaguacuccuggaagaccuggggcaaggccaagaugcucagcaccgagccccacaaccagaccuuccugaucgacggcccggagacggccgagugccccaacaccaaccgggccuggaacucccuggagguggaggacuacggguucggcgucuucaccaccaacaucuggcucaagcugaaggagcgccaggacguguucugcgacagcaagcugauguccgccgcgaucaaggacaaccgggccgugcacgccgacaugggguacuggaucgagagcgcccucaacgacacguggaagaucgagaaggccuccuucaucgaggucaagagcugccacuggcccaagucccacacccuguggagcaacggcgugcuggaguccgagaugaucauccccaagaacuucgcgggcccggugagccagcacaacuaccgccccggguaccacacccagaccgccggccccuggcaccucgggaagcuggagauggacuucgacuucugcgagggcaccacggucguggugaccgaggacugcgggaaccggggccccagccugcgcaccaccacggccuccggcaagcucaucaccgaguggugcugccggagcugcacccugccgccccugcgcuacaagggggaggacggcugcugguacgggauggagauccggccccucaaggagaaggaggagaaccuggucaacucccuggugaccgccggccacgggcagaucgacaacuucagccucggcgugcugggcauggcgcuguuccucgaggagaugcugcgcacgcgggucgggaccaagcacgccgugcugcucguggccgucuccuucaugacccugaucaccggcaacaugagcuuccgcgaccuggggcgggugauggugauggucggcgccgccaugacggacgacaucgggaugggcgugaccuaccucgcgcugcuggccgccuucaaggugcgccccaccuucgccgccggccuccugcugcgcaagcucaccuccaaggagcugaugaugacgaccaucgggaucguccugcucagccaguccaccaucccggagaccauccuggagcugacggacgcgcucgcccugggcaugaugauccugaagaucgugcggaacauggagaaguaccagcucgccgucaccaucauggccauccugugcgcccccaacgcggugauccugcagaacgccuggaaggugagcugcaccauccucgccgucguguccgugagcccccugcugcucaccuccagccagcagaaggccgacuggaucccccuggcgcugacgaucaaggggcucaacccgaccgccaucuuccugaccacccugucccgcacgaacaagaagcggagcuggccccucaacgaggccaucauggccgucggcaugguguccauccuggccagcucccugcucaagaacgacauccccaugaccggcccccugguggccggcgggcugcucaccgucugcuacgugcugaccgggcgcagcgccgaccuggagcucgagcgggccgccgacgugcgcugggaggaccaggccgagaucagcggguccagcccgauccuguccaucacgaucagcgaggacggguccaugagcaucaagaacgaggaggaggagcagacccugaccauccucauccggaccggccugcuggucaucuccggccucuuccccgugagcauccccaucacggcggccgccugguaccugugggaggugaagaagcagcgcgccgggguccugugggacgugcccuccccgccgcccgugggcaaggccgagcucgaggacggggcguaccggaucaagcagaagggcauccugggguacagccagaucggcgccggcgucuacaaggaggggaccuuccacaccauguggcacgugacccgcggcgccgugcugaugcacaaggggaagcggaucgagccguccugggccgacguccgcaaggaccucaucagcuacggcgggggcuggaagcuggagggcgaguggaaggagggggaggagguccaggugcuggcccucgagcccggcaagaacccccgggcgguccagaccaagcccgggcuguucaagacgaacaccggcaccaucggggccgugucccuggacuucagcccgggcaccuccggcagccccaucguggacaagaaggggaaggucgugggccucuacgggaacggcguggucacgcgcuccggcaccuacgugagcgccaucgcccagaccgagaaguccaucgaggacaaccccgagaucgaggacgacaucuuccggaagaagcgccugaccaucauggaccugcaccccggggcgggcaagacgaagcgguaccugccggccaucgugcgcgaggccaucaagcgggggcuccgcacccugauccuggcccccacccgggucguggccgcggagauggaggaggcccuccgcggccugcccauccgcuaccagacccccgccauccgggccgagcacacggggcgcgagaucguggaccugaugugccacgccaccuucaccaugcggcuccugagcccgguccgcgugcccaacuacaaccugaucaucauggacgaggcgcacuucaccgaccccgccagcaucgccgcccggggcuacaucuccacgcgcguggagaugggcgaggccgcggggaucuucaugaccgccacgccgcccggcagccgggaccccuucccccaguccaacgcccccaucauggacgaggagcgcgagauccccgagcggagcuggaacuccgggcacgagugggucaccgacuucaagggcaagacggugugguucgugcccagcaucaaggccgggaacgacaucgcggccugccuccgcaagaacggcaagaaggucauccagcugucccggaagaccuucgacagcgaguacaucaagacccgcaccaacgacugggacuucguggugacgaccgacaucuccgagaugggcgccaacuucaaggccgagcgggucaucgacccccgccggugcaugaagcccgugauccugaccgacggggaggagcgcgugauccucgccggcccgaugcccgucacccacagcuccgcggcccagcggcgcgggcggaucggccgcaaccccaagaacgagaacgaccaguacaucuacaugggggagccccuggagaacgacgaggacugcgcccacuggaaggaggccaagaugcugcucgacaacaucaacacgccggagggcaucauccccagcauguucgagcccgagcgcgagaagguggacgccaucgacggcgaguaccggcugcgcggggaggcgcggaagaccuucguggagcugaugcgccggggcgaccucccggucuggcuggccuaccgcguggccgccgaggggaucaacuacgccgaccggcgcuggugcuucgacggcaucaagaacaaccagauccuggaggagaacgucgagguggagaucuggaccaaggagggggagaagaagaagcucaagccccgguggcuggacgcgcgcaucuacuccgacccccuggcccucaaggaguucaaggaguucgccgccggccgcaagagccugaccaugaaccugaucacggagaugggccgccuccccaccuucaugacccagaaggcgcggaacgcccuggacaaccuggccgugcuccacaccgccgaggccgggggccgcgcguacaaccacgcccuguccgagcugccggagacgcucgagacccugcugcuccugacccugcucgccaccgucaccgggggcaucuuccuguuccugaugagcggcaaggggaucggcaagaugacccucgggaugugcugcaucaucaccgccuccauccugcugugguacgcccagauccagccccacuggaucgcggccagcaucauccucgaguucuuccugaucgugcugcucauccccgagcccgagaagcagcggaccccgcaggacaaccagcugaccuacguggucaucgccauccugacggugguggccgccaccauggcgaacgagaugggcuuccucgagaagaccaagaaggacuucgggcugggcuccaucgucgcccagcagcccgagagcaacauccuggacaucgaccuccgccccgccagcgccuggacccuguacgccguggcgacgaccuucaucacccccaugcugcggcacuccaucgagaacagcuccgugaacgucagccucaccgccaucgccaaccaggccacggugcugaugggccuggggaagggcuggccgcucuccaagauggacaucggggugccccugcuggcgaucggcugcuacagccaggucaaccccaucacccucaccgccgcccugcugcuccugguggcccacuacgccaucaucgggcccggccugcaggcgaaggccacccgcgaggcccagaagcgggccgccgcgggcaucaugaagaucccgacgguggacgggaucaccgucaucgaccucgaccccauccccuacgaccccaaguucgagaagcagcugggccaggugaugcugcucgugcugugcgucacccaggugcugaugaugcgcaccacgugggcccucugcgaggcccugacccuggccaccgggccgaucuccacccucugggagggcaaccccgggcgguucuggaacacgaccaucgccgugagcauggcgaacaucuuccgcggcuccuaccuggccggcgccgggcuccuguucagcaucaugaagaacaccaccaacacgcgccggggcaccgggaacaccggcgagacccugggcgagaaguggaagaaccgccugaacucccucggcaagagcgaguuccagaucuacaagcgguccggcauccaggaggucgaccgcacgcuggccaaggaggggaucaagcggggcgagaccgaccaccacgcggugagccgcggguccgccaagcugcggugguucguggagcgcaaccucgucacccccgagggcaaggugauggaccugggcugcgggcggggcggguggagcuacuacugcggcgggcugaagaacgugcgcgaggucaagggccucaccaagggcgggcccggccacgaggagccgauccccauguccacguacggguggaaccuggugcggcugcagagcggcguggacgucuucuucacgccgcccgagaagugcgacacccuccugugcgacaucggggaguccagcccgaaccccaccguggaggccggccgcacgcugcgggugcucaaccuggucgagaacuggcugaacaacaacacccaguucugcaucaaggugcucaaccccuacaugccgagcgugaucgagaagauggagacccugcagcgcaaguacggcggggcccugguccggaacccccugucccgcaacagcacccacgagauguacuggguguccaacgccagcggcaacaucguguccagcgucaacaugaucucccggaugcucaucaaccgcuucaccaugcggcacaagaaggcgacguacgagcccgacguggaccuggggagcggcacccgcaacaucgggaucgaguccgagacccccaaccuggacaucaucggcaagcgcaucgagaagaucaagcaggagcacgagaccagcuggcacuacgaccaggaccacccguacaagacgugggccuaccacggcuccuacgagaccaagcagaccgggagcgccuccagcauggugaacggcgucgugcggcuccugaccaagcccugggacgugauccccauggucacgcagauggccaugaccgacaccacccccuucgggcagcagcgcguguucaaggagaagguggacacgcggacccaggagccgaaggagggcaccaagaagcugaugaagaucaccgccgaguggcucuggaaggagcugggcaagaagaagacgccccgcaugugcacccgggaggaguucacccgcaagguccgguccaacgcggcccugggggccaucuucaccgacgagaacaaguggaaguccgcccgcgaggccguggaggacucccgguucugggagcucgucgacaaggagcgcaaccugcaccuggagggcaagugcgagacgugcguguacaacaugauggggaagcgggagaagaagaucggcgaguucgggcgcgcgaagggcagccgggccaucugguacauguggcucggcgcccgcuuccuggaguucgaggcccugggguuccucaacgaggaccacugguucucccgggagaacagccugagcggcguggagggggagggccugcacaagcucggguacauccugcgcgaggucuccaagaaggagggcggcgcgauguacgccgacgacaccgccgggugggacacccggaucacccuggaggaccucaagaacgaggagauggugacgaaccacauggagggcgagcacaagaagcuggccgaggccaucuucaagcugaccuaccagaacaaggugguccgcgugcagcggcccacgccccgggggaccgugauggacaucaucagccggcgcgaccagcgcggcuccgggcaggucggcacguacggccucaacaccuucaccaacaugggggcgcagcugauccggcagauggagggcgaggggguguucaagagcauccagcaccugaccacgaccgaggagguggccguccaggacuggcucgcccgcgugggccgggagcgccugucccggauggccaucagcggcgacgacugcguggucaagccgcuggacgaccgcuucgccuccgcgcucaccgcccugaacgacauggggaaggugcggaaggacauccagcagugggagcccagcaagggcuggaacgacuggacccaggugcccuucugcucccaccacuuccacgagcugaucaugaaggacgggcgcguccucguggugcccugccggaaccaggacgagcugaucggccgcgcccggaucagccagggggccggcuggucccugcgcgagacggccugccucggcaagagcuacgcgcagauguggucccugauguacuuccaccggcgcgaccugcggcucgccgccaacgccaucugcagcgccgucccgucccacugggugcccaccagccgcaccaccugguccauccacgcgcggcacgaguggaugaccacggaggacaugcugaccguguggaaccgcgucuggauccaggagaaccccuggauggaggacaagacccccguggagagcugggaggagaucccguaccuggggaagcgggaggaccaguggugcggcagccucaucgggcugaccucccgcgccacgugggccaagaacauccagaccgccaucaaccaggugcgcagccugaucggcuccgaggaguacaccgacuacaugcccagcaugaagcgguuccgccgggaggaggaggaggcggggguccucugguga

SEQ ID NO: 9056 - RNA, 9876 nt, Artificial Sequence
  derived and/or modified CDS sequence (opt1) from DENV-2__KX380829__SS-prME
accgcgggcgugaucaucaugcugauccccaccgccauggcguuccaccucaccacccgcaacggggagccccacaugaucgugagccggcaggagaagggcaagagccugcuguucaagaccgaggacggggugaacaugugcacccucauggccauggaccugggcgagcugugcgaggacaccaucaccuacaacugcccccuccugcgccagaacgagcccgaggacaucgacugcuggugcaacagcaccuccaccugggugaccuacgggaccugcaccgccaccggcgagcaccggcgcgagaagcggagcgucgcccuggugccccacgugggcauggggcucgagacccgcaccgagaccuggauguccagcgagggcgccuggaagcacgcgcagcggaucgagaccuggauccugcgccaccccggguucacgaucauggccgccauccuggccuacaccaucggcaccaccuacuuccagcggguccucaucuucauccugcugacggcgguggcccccuccaugaccaugcgcugcaucgggaucagcaaccgggacuucguggagggcgucuccggcgggagcuggguggacaucgugcucgagcacggcuccugcgucaccaccauggccaagaacaagcccacgcuggacuucgagcugaucaagaccgaggccaagcagcccgccacccuccgcaaguacugcaucgaggcgaagcugaccaacacgaccaccgccagccggugcccgacccagggggagcccucccugaacgaggagcaggacaagcgcuucgugugcaagcacagcaugguggaccggggcuggggcaacgggugcggccucuucgggaagggcgggaucgucacgugcgccauguucacgugcaagaagaacauggagggcaagaucgugcagcccgagaaccuggaguacaccaucguggucacgccccacuccggcgaggagaacgccguggggaacgacacgggcaagcacgggaaggagaucaaggugaccccgcagagcuccaucaccgaggccgagcugaccggcuacgggaccgucacgauggagugcagcccccgcaccggccucgacuucaacgagauggugcugcugcagauggagaacaaggcguggcucgugcaccggcagugguuccuggaccugccccuccccuggcugccgggcgccgacacccagggguccaacuggauccagaaggagaugcuggucaccuucaagaacccccacgccaagaagcaggacguggucgugcucggcagccaggagggggccaugcacacggcccugaccggcgcgaccgagauccagaugagcuccgggaaccuccuguucaccggccaccugaagugccgccugcggauggacaagcuccagcugaagggcaugagcuacuccaugugcacggggaaguucaagguggucaaggagaucgccgagacccagcacggcaccaucguggugcgcguccaguacgagggggacggcagccccugcaagauccccuucgagaucauggaccuggagaagcggcacgugcucggccgccugaucaccgugaacccgaucgucacggagaaggacucccccgugaacaucgaggccgagccgcccuucggggacagcuacaucaucaucggcguggagccggggcagcugaagcucuccugguucaagaagggcagcuccaucgggcagauguucgagaccaccaugcgcggcgccaagcggauggccauccugggcgacaccgcgugggacuucgggagccugggcggggucuucacguccaucggcaaggcccuccaccagguguucggggccaucuacggcgccgcguucagcggcguguccuggaccaugaagauccugaucggggucgugaucaccuggaucggcaugaacagccgcuccaccagccuguccgugagccugguccucguggggguggucacgcuguaccugggcgugauggugcaggccgacuccgggugcgucgugagcuggaagaacaaggagcucaagugcggcagcggcaucuucaucaccgacaacgugcacaccuggaccgagcaguacaaguuccagcccgagucccccagcaagcuggccuccgccauccagaaggcccacgaggaggggaucugcggcauccggagcgucacgcgccuggagaaccucauguggaagcagaucacccccgagcugaaccacauccuguccgagaacgaggugaagcucaccaucaugaccggggacaucaagggcaucaugcaggcggggaagcggagccugcgcccgcagcccacggagcugaaguacuccuggaagaccuggggcaaggccaagaugcucagcaccgagccccacaaccagaccuuccugaucgacggcccggagacggccgagugccccaacaccaaccgggccuggaacucccuggagguggaggacuacggguucggcgucuucaccaccaacaucuggcucaagcugaaggagcgccaggacguguucugcgacagcaagcugauguccgccgcgaucaaggacaaccgggccgugcacgccgacaugggguacuggaucgagagcgcccucaacgacacguggaagaucgagaaggccuccuucaucgaggucaagagcugccacuggcccaagucccacacccuguggagcaacggcgugcuggaguccgagaugaucauccccaagaacuucgcgggcccggugagccagcacaacuaccgccccggguaccacacccagaccgccggccccuggcaccucgggaagcuggagauggacuucgacuucugcgagggcaccacggucguggugaccgaggacugcgggaaccggggccccagccugcgcaccaccacggccuccggcaagcucaucaccgaguggugcugccggagcugcacccugccgccccugcgcuacaagggggaggacggcugcugguacgggauggagauccggccccucaaggagaaggaggagaaccuggucaacucccuggugaccgccggccacgggcagaucgacaacuucagccucggcgugcugggcauggcgcuguuccucgaggagaugcugcgcacgcgggucgggaccaagcacgccgugcugcucguggccgucuccuucaugacccugaucaccggcaacaugagcuuccgcgaccuggggcgggugauggugauggucggcgccgccaugacggacgacaucgggaugggcgugaccuaccucgcgcugcuggccgccuucaaggugcgccccaccuucgccgccggccuccugcugcgcaagcucaccuccaaggagcugaugaugacgaccaucgggaucguccugcucagccaguccaccaucccggagaccauccuggagcugacggacgcgcucgcccugggcaugaugauccugaagaucgugcggaacauggagaaguaccagcucgccgucaccaucauggccauccugugcgcccccaacgcggugauccugcagaacgccuggaaggugagcugcaccauccucgccgucguguccgugagcccccugcugcucaccuccagccagcagaaggccgacuggaucccccuggcgcugacgaucaaggggcucaacccgaccgccaucuuccugaccacccugucccgcacgaacaagaagcggagcuggccccucaacgaggccaucauggccgucggcaugguguccauccuggccagcucccugcucaagaacgacauccccaugaccggcccccugguggccggcgggcugcucaccgucugcuacgugcugaccgggcgcagcgccgaccuggagcucgagcgggccgccgacgugcgcugggaggaccaggccgagaucagcggguccagcccgauccuguccaucacgaucagcgaggacggguccaugagcaucaagaacgaggaggaggagcagacccugaccauccucauccggaccggccugcuggucaucuccggccucuuccccgugagcauccccaucacggcggccgccugguaccugugggaggugaagaagcagcgcgccgggguccugugggacgugcccuccccgccgcccgugggcaaggccgagcucgaggacggggcguaccggaucaagcagaagggcauccugggguacagccagaucggcgccggcgucuacaaggaggggaccuuccacaccauguggcacgugacccgcggcgccgugcugaugcacaaggggaagcggaucgagccguccugggccgacguccgcaaggaccucaucagcuacggcgggggcuggaagcuggagggcgaguggaaggagggggaggagguccaggugcuggcccucgagcccggcaagaacccccgggcgguccagaccaagcccgggcuguucaagacgaacaccggcaccaucggggccgugucccuggacuucagcccgggcaccuccggcagccccaucguggacaagaaggggaaggucgugggccucuacgggaacggcguggucacgcgcuccggcaccuacgugagcgccaucgcccagaccgagaaguccaucgaggacaaccccgagaucgaggacgacaucuuccggaagaagcgccugaccaucauggaccugcaccccggggcgggcaagacgaagcgguaccugccggccaucgugcgcgaggccaucaagcgggggcuccgcacccugauccuggcccccacccgggucguggccgcggagauggaggaggcccuccgcggccugcccauccgcuaccagacccccgccauccgggccgagcacacggggcgcgagaucguggaccugaugugccacgccaccuucaccaugcggcuccugagcccgguccgcgugcccaacuacaaccugaucaucauggacgaggcgcacuucaccgaccccgccagcaucgccgcccggggcuacaucuccacgcgcguggagaugggcgaggccgcggggaucuucaugaccgccacgccgcccggcagccgggaccccuucccccaguccaacgcccccaucauggacgaggagcgcgagauccccgagcggagcuggaacuccgggcacgagugggucaccgacuucaagggcaagacggugugguucgugcccagcaucaaggccgggaacgacaucgcggccugccuccgcaagaacggcaagaaggucauccagcugucccggaagaccuucgacagcgaguacaucaagacccgcaccaacgacugggacuucguggugacgaccgacaucuccgagaugggcgccaacuucaaggccgagcgggucaucgacccccgccggugcaugaagcccgugauccugaccgacggggaggagcgcgugauccucgccggcccgaugcccgucacccacagcuccgcggcccagcggcgcgggcggaucggccgcaaccccaagaacgagaacgaccaguacaucuacaugggggagccccuggagaacgacgaggacugcgcccacuggaaggaggccaagaugcugcucgacaacaucaacacgccggagggcaucauccccagcauguucgagcccgagcgcgagaagguggacgccaucgacggcgaguaccggcugcgcggggaggcgcggaagaccuucguggagcugaugcgccggggcgaccucccggucuggcuggccuaccgcguggccgccgaggggaucaacuacgccgaccggcgcuggugcuucgacggcaucaagaacaaccagauccuggaggagaacgucgagguggagaucuggaccaaggagggggagaagaagaagcucaagccccgguggcuggacgcgcgcaucuacuccgacccccuggcccucaaggaguucaaggaguucgccgccggccgcaagagccugaccaugaaccugaucacggagaugggccgccuccccaccuucaugacccagaaggcgcggaacgcccuggacaaccuggccgugcuccacaccgccgaggccgggggccgcgcguacaaccacgcccuguccgagcugccggagacgcucgagacccugcugcuccugacccugcucgccaccgucaccgggggcaucuuccuguuccugaugagcggcaaggggaucggcaagaugacccucgggaugugcugcaucaucaccgccuccauccugcugugguacgcccagauccagccccacuggaucgcggccagcaucauccucgaguucuuccugaucgugcugcucauccccgagcccgagaagcagcggaccccgcaggacaaccagcugaccuacguggucaucgccauccugacggugguggccgccaccauggcgaacgagaugggcuuccucgagaagaccaagaaggacuucgggcugggcuccaucgucgcccagcagcccgagagcaacauccuggacaucgaccuccgccccgccagcgccuggacccuguacgccguggcgacgaccuucaucacccccaugcugcggcacuccaucgagaacagcuccgugaacgucagccucaccgccaucgccaaccaggccacggugcugaugggccuggggaagggcuggccgcucuccaagauggacaucggggugccccugcuggcgaucggcugcuacagccaggucaaccccaucacccucaccgccgcccugcugcuccugguggcccacuacgccaucaucgggcccggccugcaggcgaaggccacccgcgaggcccagaagcgggccgccgcgggcaucaugaagaacccgacgguggacgggaugaccgucaucgaccucgaccccauccccuacgaccccaaguucgagaagcagcugggccaggugaugcugcucgugcugugcgucacccaggugcugaugaugcgcaccacgugggcccucugcgaggcccugacccuggccaccgggccgaucuccacccucugggagggcaaccccgggcgguucuggaacacgaccaucgccgugagcauggcgaacaucuuccgcggcuccuaccuggccggcgccgggcuccuguucagcaucaugaagaacaccaccaacacgcgccggggcaccgggaacaccggcgagacccugggcgagaaguggaagaaccgccugaacucccucggcaagagcgaguuccagaucuacaagcgguccggcauccaggaggucgaccgcacgcuggccaaggaggggaucaagcggggcgagaccgaccaccacgcggugagccgcggguccgccaagcugcggugguucguggagcgcaaccucgucacccccgagggcaaggugauggaccugggcugcgggcggggcggguggagcuacuacugcggcgggcugaagaacgugcgcgaggucaagggccucaccaagggcgggcccggccacgaggagccgauccccauguccacguacggguggaaccuggugcggcugcagagcggcguggacgucuucuucacgccgcccgagaagugcgacacccuccugugcgacaucggggaguccagcccgaaccccaccguggaggccggccgcacgcugcgggugcucaaccuggucgagaacuggcugaacaacaacacccaguucugcaucaaggugcucaaccccuacaugccgagcgugaucgagaagauggagacccugcagcgcaaguacggcggggcccugguccggaacccccugucccgcaacagcacccacgagauguacuggguguccaacgccagcggcaacaucguguccagcgucaacaugaucucccggaugcucaucaaccgcuucaccaugcggcacaagaaggcgacguacgagcccgacguggaccuggggagcggcacccgcaacaucgggaucgaguccgagacccccaaccuggacaucaucggcaagcgcaucgagaagaucaagcaggagcacgagaccagcuggcacuacgaccaggaccacccguacaagacgugggccuaccacggcuccuacgagaccaagcagaccgggagcgccuccagcauggugaacggcgucgugcggcuccugaccaagcccugggacgugauccccauggucacgcagauggccaugaccgacaccacccccuucgggcagcagcgcguguucaaggagaagguggacacgcggacccaggagccgaaggagggcaccaagaagcugaugaagaucaccgccgaguggcucuggaaggagcugggcaagaagaagacgccccgcaugugcacccgggaggaguucacccgcaagguccgguccaacgcggcccugggggccaucuucaccgacgagaacaaguggaaguccgcccgcgaggccguggaggacucccgguucugggagcucgucgacaaggagcgcaaccugcaccuggagggcaagugcgagacgugcguguacaacaugauggggaagcgggagaagaagaucggcgaguucgggcgcgcgaagggcagccgggccaucugguacauguggcucggcgcccgcuuccuggaguucgaggcccugggguuccucaacgaggaccacugguucucccgggagaacagccugagcggcguggagggggagggccugcacaagcucggguacauccugcgcgaggucuccaagaaggagggcggcgcgauguacgccgacgacaccgccgggugggacacccggaucacccuggaggaccucaagaacgaggagauggugacgaaccacauggagggcgagcacaagaagcuggccgaggccaucuucaagcugaccuaccagaacaaggugguccgcgugcagcggcccacgccccgggggaccgugauggacaucaucagccggcgcgaccagcgcggcuccgggcaggucggcacguacggccucaacaccuucaccaacaugggggcgcagcugauccggcagauggagggcgaggggguguucaagagcauccagcaccugaccacgaccgaggagguggccguccaggacuggcucgcccgcgugggccgggagcgccugucccggauggccaucagcggcgacgacugcguggucaagccgcuggacgaccgcuucgccuccgcgcucaccgcccugaacgacauggggaaggugcggaaggacauccagcagugggagcccagcaagggcuggaacgacuggacccaggugcccuucugcucccaccacuuccacgagcugaucaugaaggacgggcgcguccucguggugcccugccggaaccaggacgagcugaucggccgcgcccggaucagccagggggccggcuggucccugcgcgagacggccugccucggcaagagcuacgcgcagauguggucccugauguacuuccaccggcgcgaccugcggcucgccgccaacgccaucugcagcgccgucccgucccacugggugcccaccagccgcaccaccugguccauccacgcgcggcacgaguggaugaccacggaggacaugcugaccguguggaaccgcgucuggauccaggagaaccccuggauggaggacaagacccccguggagagcugggaggagaucccguaccuggggaagcgggaggaccaguggugcggcagccucaucgggcugaccucccgcgccacgugggccaagaacauccagaccgccaucaaccaggugcgcagccugaucggcuccgaggaguacaccgacuacaugcccagcaugaagcgguuccgccgggaggaggaggaggcggggguccucugguga

SEQ ID NO: 9057 - RNA, 9876 nt, Artificial Sequence
  derived and/or modified CDS sequence (opt1) from DENV-2__KX380830__SS-prME
accgccgggaucaucaucaugaugauccccaccgugauggccuuccaccugaccacccggaacggggagccccacaugaucgugagccggcaggagaagggcaagagccuccuguucaagaccgagaacggggugaacaugugcacccugauggcgauggaccucggcgagcugugcgaggacaccaucaccuacaacugcccccugcuccgccagaacgagcccgaggacaucgacugcuggugcaacagcaccagcaccugggugaccuacgggaccugcaccgccaccggcgagcaccggcgcgagaagcggagcgucgcccuggugccccacgugggcauggggcuggagacccgcaccgagaccuggauguccagcgagggcgccuggaagcacgcccagcggaucgagaccuggguccuccgccaccccggguucaccgugauggcggccauccuggccuacaccaucggcaccaccuacuuccagcgggugcugaucuucauccuccugaccgccgucgcgcccuccaugaccaugcgcugcaucgggaucagcaaccgggacuucguggagggcguguccggcgggagcugggucgacaucgugcuggagcacggcuccugcgugaccaccauggccaagaacaagcccacgcucgacuucgagcugaucaagaccgaggccaagcaccccgccacccugcgcaaguacugcaucgaggccaagcucaccaacacgaccaccgcgagccggugcccgacccagggggagcccucccugaacgaggagcaggacaagcgcuucgucugcaagcacagcaugguggaccggggcuggggcaacgggugcggccuguucgggaagggcgggaucgugacgugcgccauguucacgugcaagaagaacauggagggcaagaucguccagcccgagaaccucgaguacaccaucgugaucacgccccacuccggcgaggagaacgccguggggaacgacacgggcaagcacgggaaggagaucaaggucaccccgcagagcuccaucaccgaggccgagcugaccggcuacgggaccgccacgauggagugcagcccccgcaccggccuggacuucaacgagauggugcuccugcagauggagaacaaggcguggcuggugcaccggcagugguuccucgaccugccccugcccuggcucccgggcgccgacacccagggguccaacuggauccagaaggagacccuggucacguucaagaacccccacgccaagaagcaggacguggucgugcugggcagccaggagggggccaugcacaccgcccucaccggcgcgaccgagauccagaugagcuccgggaaccugcuguucacgggccaccucaagugccgccugcggauggacaagcugcagcucaagggcaugagcuacuccaugugcaccgggaaguucaagguggucaaggagaucgccgagacccagcacggcaccaucgugauccgcgugcaguacgagggggacggcagccccugcaagauccccuucgagaucauggaccuggagaagcggcacguccugggccgccucaucacggugaacccgaucgugaccgagaaggacucccccgucaacaucgaggccgagccgcccuucggggacagcuacaucaucaucggcguggagccggggcagcugaagcuguccugguucaagaagggcagcuccaucgggcagauguucgagaccaccaugcgcggcgccaagcggauggccauccucggcgacacggcgugggacuucgggagccugggcgggguguucaccuccaucggcaaggcccugcaccaggucuucggggccaucuacggcgccgcguucagcggcguguccuggaccaugaagauccucaucgggguggucaucaccuggaucggcaugaacagccgcuccacgagccuguccgugagccuggugcuggucgggaucgugacccucuaccugggcgugaugguccaggccgacuccgggugcguggugagcuggaagaacaaggagcugaagugcggcagcggcaucuucaucaccgacaacguccacaccuggacggagcaguacaaguuccagcccgagucccccagcaagcucgccuccgccauccagaaggcccacgaggaggggaucugcggcauccggagcgugacccgccuggagaaccugauguggaagcagaucacccccgagcucaaccacauccuguccgagaacgaggugaagcugaccaucaugacgggggacaucaagggcaucaugcaggcggggaagcggagccuccgcccgcagcccaccgagcugaaguacuccuggaaggccuggggcaaggccaagaugcugagcaccgagcuccacaaccacaccuuccugaucgacggccccgagacggccgagugcccgaacaccaaccgggccuggaacucccuggaggucgaggacuacggguucggcguguucaccaccaacaucuggcucaagcugaaggagcgccaggacguguucugcgacagcaagcugauguccgcggccaucaaggacaaccgggccguccacgccgacaugggguacuggaucgagagcgcccucaacgacacguggaagaucgagaaggcguccuucaucgaggucaagagcugccacuggcccaagucccacacccuguggagcaacggcgugcuggaguccgagaugaucauccccaagaacuucgccggccccgugagccagcacaacuaccgcccgggguaccacacccagaccgccggccccuggcaccucgggcggcuggagauggacuucgacuucugcgagggcaccacggugguggucaccgaggacugcgggaaccgcggccccagccugcggaccaccacggccuccggcaagcucaucaccgaguggugcugccgcagcugcacccugcccccgcugcgguaccgcggggaggacggcugcugguacgggauggagauccggccccucaaggagaaggaggagaaccuggugaacucccuggugaccgcgggccacgggcagaucgacaacuucagccucggcguccugggcauggcccuguuccucgaggagaugcugcgcacgcggguggggaccaagcacgccauccugcucguggccgucuccuucgugacccugaucaccggcaacaugagcuuccgcgaccuggggcgcgugauggucauggugggcgccacgaugaccgacgacaucgggaugggcgugaccuaccucgcgcugcuggccgccuucaagguccggcccaccuucgccgccggccuccugcugcgcaagcucacguccaaggagcugaugaugaccaccaucgggaucgugcugcucagccaguccaccauccccgagacgauccuggagcugaccgacgcgcucgcccugggcaugauggugcugaagaucguccggaacauggagaaguaccagcucgccgugaccaucauggccauccugugcgucccgaacgccgugauccugcagaacgcguggaaggugagcugcaccauccucgccgucguguccgugagcccccugcugcucacguccagccagcagaaggccgacuggaucccccuggcccugaccaucaaggggcucaaccccaccgcgaucuuccugaccacgcugucccgcaccagcaagaagcgguccuggccgcucaacgaggccaucauggccgucggcauggugagcauccuggccuccagccugcucaagaacgacauccccaugaccggcccccugguggccgggggccugcucaccgucugcuacgugcugacggggcgcagcgcggaccuggagcucgagcgggccgccgacgugcgcugggaggagcaggccgagaucuccggcagcucccccauccugagcaucaccaucuccgaggacgggagcauguccaucaagaacgaggaggaggagcagacccugaccauccucauccggacgggccugcuggucaucagcggccucuucccgguguccauccccaucaccgccgcggccugguaccugugggaggugaagaagcagcgcgccgggguccugugggacgugcccagcccgccgcccgugggcaaggccgagcucgaggacggggccuaccggaucaagcagaagggcauccugggguacucccagaucggcgcgggcgucuacaaggaggggaccuuccacaccauguggcacgugacccgcggcgccgugcugaugcacaaggggaagcggaucgagcccagcugggccgacgucaagaaggaccucaucuccuacggcgggggcuggaagcuggagggcgaguggaaggagggggaggagguccaggugcuggcccucgagcccggcaagaacccccgcgccguccagacgaagcccgggcuguucaagaccaacaccggcaccaucggggcggugagccuggacuucucccccggcacgagcggcucccccaucguggacaagaaggggaaggucgugggccucuacgggaacggcguggucacccggagcggcaccuacguguccgccaucgcccagaccgagaaguccaucgaggacaaccccgagaucgaggacgacaucuuccgcaagaagcggcugacgaucauggaccugcaccccggggccggcaagaccaagcgcuaccugcccgcgaucgugcgggaggccaucaagcgcgggcuccggacccugauccuggccccgacccgcgucguggccgccgagauggaggaggcgcuccgcggccugcccauccgguaccagacgcccgccauccgcgccgagcacaccgggcgggagaucguggaccugaugugccacgccaccuucaccaugcgccuccugagccccauccgggucccgaacuacaaccugaucaucauggacgaggcccacuucacggaccccgcguccaucgccgcccgcggcuacaucagcacccggguggagaugggcgaggccgccgggaucuucaugaccgcgacgccgcccggcucccgcgacccguucccccagagcaacgcccccaucauggacgaggagcgggagauccccgagcgcuccuggaacagcgggcacgagugggugacggacuucaagggcaagaccgucugguucgugccguccaucaaggccgggaacgacaucgccgcgugccuccggaagaacggcaagaaggugauccagcugagccgcaagaccuucgacuccgaguacaucaagacccggacgaacgacugggacuucgucgugaccaccgacaucagcgagaugggcgccaacuucaaggccgagcgcgugaucgacccccggcgcugcaugaagcccgucauccugaccgacggggaggagcgggugauccucgccggccccaugccggugacgcacuccagcgccgcgcagcgccgggggcgcgucggccgcaaccccaagaacgagaacgaccaguacaucuacaugggggagccccuggagaacgacgaggacugcgcccacuggaaggaggccaagaugcugcucgacaacaucaacacccccgagggcaucaucccguccauguucgagcccgagcgggagaagguggacgccaucgacggcgaguaccgccugcgcggggaggcccgcaagaccuucguggaccugaugcggcgcggcgaccuccccgucuggcuggcguaccggguggccgccgaggggaucaacuacgccgaccgccgguggugcuucgacggcgucaagaacaaccagauccuggaggagaacguggagguggagaucuggaccaaggagggggagcgcaagaagcucaagccgcgguggcuggacgcccgcaucuacagcgacccccuggcgcucaaggaguucaaggaguucgccgccggccggaagucccugacgcugaaccucaucaccgagaugggccgccugcccaccuucaugacccagaaggcccggaacgcgcuggacaaccucgccguccugcacacggccgaggccgggggccgcgccuacaaccacgcgcugagcgagcuccccgagacccuggagacccugcuccugcugacccuccuggccacggugaccgggggcaucuuccuguuccucauguccggcaaggggaucggcaagaugacccuggggaugugcugcaucaucaccgccagcauccugcucugguacgcccagauccagccgcacuggaucgccgcguccaucauccuggaguucuuccugaucgugcuccugauccccgagcccgagaagcagcggacgccccaggacaaccagcugacguacgucgugaucgccauccucaccguggucgccgccaccauggccaacgagaugggcuuccuggagaagaccaagaaggacuucgggcugggcagcaucacgacccagcagccggacagcaacauccucgacaucgaccugcgccccgcguccgccuggacccuguacgccguggccaccacguucaucacccccaugcuccggcacagcaucgagaacuccagcgugaacgucucccugaccgccaucgcgaaccaggccaccgugcugaugggccucgggaagggcuggccccugagcaagauggacaucggggugccgcugcucgccaucggcugcuacucccaggucaaccccaucacgcugaccgccgcgcugcuccugcugguggcccacuacgccaucaucgggcccggccuccaggccaaggccacccgcgaggcgcagaagcgggccgccgccggcaucaugaagauccccgccgcggacgggaugaccgugaucgaccuggacccgauccccuacgaccccaaguucgagaagcagcugggccaggucaugcuccuggugcugugcgugacgcagguccucaugaugcgcaccaccugggcccugugcgaggcccugacccucgccacggggcccaucagcacccugugggagggcaacccggggcgcuucuggaacaccaccaucgccguguccauggcgaacaucuuccggggcagcuaccuggccggcgccgggcuccuguucuccaucaugaagaacacggccaacacccgccggggcaccgggaacaccggcgagacgcugggcgagaaguggaagaaccgccucaacgcgcugggcaagagcgaguuccagaucuacaagaaguccggcauccaggagguggaccggacccuggccaaggaggggaucaagcgcggcgagaccgaccaccacgccgucagccggggguccgccaagcuccgcugguucguggagcggaaccuggugacccccgagggcaaggucguggaccugggcugcgggcgcggcggguggagcuacuacugcggcgggcucaagaacgugaaggaggucaagggccugacgaagggcgggcccggccacgaggagcccaucccgauguccaccuacggguggaaccuggugcggcuccagagcggcguggacgucuucuucacgccgcccgagaagugcgacacccugcugugcgacaucggggaguccagccccaacccgacgguggaggccggccgcacccuccgggugcugaaccuggucgagaacuggcucaacaacaacacccaguucugcaucaaggugcugaaccccuacaugcccagcgugaucgagaagauggaggcgcugcagcgcaaguacggcggggcccugguccggaacccgcucucccgcaacagcacccacgagauguacuggguguccaacgccagcggcaacaucguguccagcgucaacaugaucucccggaugcugaucaaccgcuucaccaugaagcacaagaaggccacguacgagcccgacguggaccuggggagcggcacccggaacaucgggaucgaguccgagacccccaaccucgacaucaucggcaagcgcaucgagaagaucaagcaggagcacgagaccagcuggcacuacgaccaggaccaccccuacaagacgugggccuaccacggcuccuacgagaccaagcagaccgggagcgcguccagcauggugaacggcgucgugcgccugcugaccaagccgugggacgugauccccauggucacgcagauggccaugaccgacaccacccccuucgggcagcagcggguguucaaggagaagguggacacgcgcacccaggagcccaaggagggcaccaagaagcucaugaagaucaccgccgaguggcuguggaaggagcugggcaagaagaagacgccgcggaugugcacccgcgaggaguucacccggaagguccgcuccaacgccgcccucggggcgaucuucaccgacgagaacaaguggaaguccgcccgggaggccguggaggacuccggcuucugggagcuggucgacaaggagcgcaaccugcaccucgaggggaagugcgagacgugcguguacaacaugaugggcaagcgggagaagaagcugggggaguucggcaaggccaagggcagccgcgcgaucugguacauguggcugggggcccgguuccucgaguucgaggcccugggcuuccugaacgaggaccacugguucucccgcgagaacagccucagcgggguggagggcgaggggcugcacaagcugggcuacauccuccgggacgucuccaagaaggagggcggggccauguacgccgacgacaccgcgggcugggacacccgcaucacccuggaggaccugaagaacgaggagauggugacgaaccacauggagggggagcaccggaagcucgccgaggccaucuuccgccugaccuaccagaacaaggugguccgggugcagcgccccacgccccggggcaccgugauggacaucaucagccgccgggaccagcgcggguccggccaggucgugacguacggccugaacaccuucaccaacauggaggcccagcucauccgccagauggagggggagggcguguucaagagcauccagcaccugaccgucacggaggagaucgccgugaagaacuggcuggagcggguggggcgcgagcggcucucccgcauggcgaucagcggcgacgacugcgucgugaagccccuggacgaccgguucgccuccgcccugaccgcccucaacgacaugggcaaggugcgcaaggacauccagcagugggagccgagccggggguggaacgacuggacccagguccccuucugcucccaccacuuccacgagcugaucaugaaggacggccgcgugcuggugguccccugccggaaccaggacgagcucaucgggcgcgcccggaucagccagggcgcgggguggucccugcgcgagaccgccugccugggcaagagcuacgcccagauguggucccucauguacuuccaccggcgcgaccugcggcuggccgccaacgcgaucugcagcgccgugcccucccacugggugccgaucagccgcacgaccugguccauccacgccacccacgaguggaugaccaccgaggacaugcucacggucuggaaccggguguggauccaggagaaccccuggauggaggacaagacccccguggagagcugggaggagauccccuaccugggcaagcgcgaggaccaguggugcgggagccugaucggccucaccucccgggccaccugggcgaagaacauccagacggccaucaaccagguccgcagccugaucgggaacgaggaguacaccgacuacaugccguccaugaagcgcuuccggcgcgaggaggaggaggccggcgugcugugguga

SEQ ID NO: 9058 - RNA, 9876 nt, Artificial Sequence
  derived and/or modified CDS sequence (opt1) from DENV-2__KX380831__SS-prME
accgcggggaucaucaucaugaugauccccaccgugauggccuuccaccugaccacccggaacggggagccccacaugaucgucagccggcaggagaagggcaagagccuccuguucaagaccgagaacggggugaacaugugcacccugauggcgauggaccucggcgagcugugcgaggacaccaucaccuacaacugcccccugcuccgccagaacgagcccgaggacaucgacugcuggugcaacagcaccagcaccugggugaccuacgggaccugcaccgccaccggcgagcaccggcgcgagaagcggagcgucgcccuggugccccacgugggcauggggcuggagacccgcaccgagaccuggaugagcagcgagggcgccuggaagcacgcccagcggaucgagaccuggauccuccgccaccccggguucacgaucauggcggccauccuggccuacaccaucggcaccaccuacuuccagcggguccugaucuucauccuccugacggccgugacccccuccauggcgaugcgcugcaucgggaucagcaaccgggacuucguggagggcgucuccggcgggagcuggguggacaucgugcuggagcacggcuccugcgucaccaccauggccaagaacaagcccacgcucgacuucgagcugaucaagaccgaggccaagcaccuggccacccuccgcaaguacugcguggaggccaagcugaccaacacgaccaccgcgagccggugccccacccagggggagcccucccugaacgaggagcaggacaagcgcuucgugugcaagcacagcauggucgaccggggcuggggcaacgggugcggccucuucgggaagggcgggaucgugacgugcgccauguucacgugcaagaagaacauggagggcaaggugguccagcccgagaaccuggaguacaccaucgugaucacgccccacuccggcgaggagaacgccguggggaacgacacgggcaagcacgggaaggagaucaaggucacgccccagagcuccaucaccgaggccgagcugaccggcuacgggaccgugacgauggagugcagcccgcgcaccggccucgacuucaacgagauggugcugcugcagauggagaacaaggccuggcucguccaccggcagugguuccuggaccugccccuccccuggcugcccggcgcggacacccagggguccaacuggauccagaaggagacccuggugacguucaagaacccgcacgccaagaagcaggacgucguggugcucggcagccaggagggggccaugcacaccgcccugaccggcgccaccgagauccagaugagcuccgggaaccuccuguucacgggccaccugaagugccgccugcggauggacaagcuccagcugaagggcaugagcuacuccaugugcaccgggaaguucaaggucgugaaggagaucgcggagacccagcacggcaccaucgugauccgcguccaguacgagggggacggcagccccugcaagauccccuucgagaucauggaccuggagaagcggcacgugcucggccgccugaucacggugaaccccaucgucaccgagaaggacuccccggugaacaucgaggccgagccgcccuucggggacagcuacaucaucaucggcguggagcccgggcagcugaagcucuccugguucaagaagggcagcuccaucgggcagauguucgagaccaccaugcgcggcgccaagcggauggccauccugggcgacacggccugggacuucgggagccugggcggggucuucaccuccaucggcaaggcgcuccaccagguguucggggccaucuacggcgccgccuucagcggcguguccuggaccaugaagauccugaucggggucgugaucaccuggaucggcaugaacagccgcuccacgagccuguccgugagccugguccucguggggguggucacccuguaccugggcgugauggugcaggcggacuccgggugcgucgugagcuggaagaacaaggagcucaagugcggcagcggcaucuucaucaccgacaacgugcacaccuggacggagcaguacaaguuccagccggagucccccagcaagcuggccuccgccauccagaaggcccacgaggaggggaucugcggcauccggagcgucacccgccuggagaaccucauguggaagcagaucacccccgagcugaaccacauccugaccgagaacgaggugaagcucacgaucaugaccggggacaucaagggcaucaugcaggccgggaagcggucccugcgcccccagccgaccgagcugaaguacagcuggaaggcguggggcaaggccaagaugcucuccaccgagcugcacaaccacacguuccugaucgacggccccgagaccgccgagugccccaacaccaaccgggccuggaacagccucgagguggaggacuacggguucggcgucuucaccacgaacaucuggcugaagcugaaggagcgccaggacguguucugcgacuccaaccucaugagcgccgcgaucaaggacaaccgggccgugcacgccgacaugggguacuggaucgaguccgcccugaacgacaccuggaagaucgagaaggccagcuucaucgaggucaaguccugccacuggcccaagagccacacccugugguccaacggcgugcucgagagcgagaugaucauccccaagaacuucgcgggccccgugucccagcacaacuaccgccccggguaccacacccagaccgccggcccguggcaccuggggcggcuggagauggacuucgacuucugcgagggcacgaccgucguggugaccgaggacugcgggaaccgcggccccagccuccggaccacgaccgccagcggcaagcugaucaccgaguggugcugccgcuccugcacccugccgccccuccgguaccgcggggaggacggcugcugguacgggauggagauccggccgcugaaggagaaggaggagaaccuggucaacagccucgugacggccggccacgggcagaucgacaacuucucccugggcgugcugggcauggcccucuuccuggaggagaugcugcgcacccgggucgggaccaagcacgccauccuccugguggccgugagcuucgucacccugaucacgggcaacauguccuuccgcgaccucgggcgcgugauggugauggucggcgccaccaugaccgacgacaucgggaugggcgugaccuaccuggcccugcucgcggccuucaaggugcggcccacguucgccgccggccugcugcuccgcaagcugaccagcaaggagcugaugaugaccaccaucgggaucguccuccugucccagagcacgauccccgaguccauccuggagcucaccgacgcccuggcgcugggcaugauggugcucaagaucguccggaacauggagaaguaccagcuggccgugaccaucauggccauccugugcgugcccaacgccgucauccuccagaacgccuggaaggugagcugcaccacgcuggcgguggucuccgugagcccgcugcuccugaccuccagccagcagaaggccgacuggaucccccuggcccucaccaucaaggggcugaaccccaccgccaucuuccugacgacccucucccgcaccagcaagaagcgguccuggccccugaacgaggcgaucauggccgugggcauggucagcauccuggccuccagccuccugaagaacgacaucccgaugaccggcccccugguggccgggggccuccugacggugugcuacguccugaccgggcgcagcgccgaccucgagcuggagcgggcggccgacgugcgcugggaggagcaggccgagaucuccggcagcucccccauccugagcaucaccaucuccgaggacgggagcauguccaucaagaacgaggaggaggagcagacccucacgauccugauccggaccggccugcucgugaucagcggccuguuccccgucuccaucccgaucaccgccgccgcgugguaccugugggaggugaagaagcagcgcgccggggugcucugggacguccccuccccgccgcccgugggcaaggccgagcuggaggacggggccuaccggaucaagcagaagggcauccugggguacucccagaucggcgccggcguguacaaggaggggaccuuccacaccauguggcacgucacgcgcggcgcggugcucaugcacaaggggaagcggaucgagcccagcugggccgacgugaagaaggaccugaucuccuacggcgggggcuggaagcuggagggcgaguggaaggagggggaggagguccaggugcucgcccuggagcccggcaagaacccgcgcgccgugcagaccaagcccgggcuguucaagaccaacaccggcacgaucggggccgucagccucgacuucucccccggcaccagcggcucccccaucguggacaagaaggggaagguggucggccuguacgggaacggcguggugacccggagcggcaccuacgucuccgcgaucgcccagacggagaaguccaucgaggacaacccggagaucgaggacgacaucuuccgcaagaagcggcugaccaucauggaccugcaccccggggccggcaagaccaagcgcuaccuccccgccaucgugcgggaggcgaucaagcgcgggcugcggacccugauccucgcccccacgcgcguggucgccgccgagauggaggaggcccugcgcggccugccgauccgguaccagacccccgcgauccgcgccgagcacaccgggcgggagaucguggaccucaugugccacgccaccuucacgaugcgccugcugagccccauccgggugcccaacuacaaccucaucaucauggacgaggcccacuucaccgacccggccuccaucgcggcccgcggcuacaucagcacccgggucgagaugggcgaggccgccgggaucuucaugaccgccacgccgcccggcucccgcgaccccuucccgcagagcaacgcgcccaucauggacgaggagcgggagauccccgagcgcuccuggaacagcgggcacgagugggugaccgacuucaagggcaagaccgugugguucguccccuccaucaaggccgggaacgacaucgccgccugccugcggaagaacggcaagaaggugauccagcugagccgcaagaccuucgacuccgaguacaucaagacgcggaccaacgacugggacuucguggucaccaccgacaucagcgagaugggcgcgaacuucaaggccgagcgcgugaucgacccgcggcgcugcaugaagcccgugauccucacggacggggaggagcgggucauccuggccggccccaugcccgugacccacuccagcgccgcccagcgccgggggcgcgugggccgcaacccgaagaacgagaacgaccaguacaucuacaugggggagccccuggagaacgacgaggacugcgcgcacuggaaggaggccaagaugcuccuggacaacaucaacacccccgagggcaucauccccuccauguucgagccggagcgggagaaggucgacgccaucgacggcgaguaccgccugcgcggggaggcccgcaagaccuucguggaccucaugcggcgcggcgaccugcccgucuggcuggccuaccggguggcggccgaggggaucaacuacgccgaccgccgguggugcuucgacggcgugaagaacaaccagauccucgaggagaacgucgagguggagaucuggacgaaggagggggagcgcaagaagcugaagccccgguggcuggacgcccgcaucuacagcgacccgcucgcccugaaggaguucaaggaguucgcggccggccggaagucccugacccucaaccugaucaccgagaugggccgccugcccaccuucaugacgcagaaggccaagaacgcccucgacaaccuggcggugcugcacaccgccgaggccgggggccgggccuacaaccacgcccucagcgagcugcccgagacccuggagacccuccugcugcucacgcugcuggcgaccgucaccgggggcaucuuccucuuccugauguccggcaaggggaucggcaagaugacccuggggaugugcugcaucaucaccgccagcauccuccugugguacgcccagauccagccccacuggaucgccgccuccaucauccuggaguucuuccucaucgugcugcugaucccggagcccgagaagcagcgcacgccccaggacaaccagcucaccuacguggucaucgcgauccugaccgugguggccgccaccauggccaacgagaugggcuuccuggagaagacgaagaaggacuucgggcucggcagcaucaccacccagcagcccgagagcaacauccuggacaucgaccugcggccggccuccgcguggacccucuacgccgucgccacgaccuucaucacccccaugcugcgccacagcaucgagaacuccagcgugaacgugucccugaccgccaucgccaaccaggcgacgguccucaugggccuggggaagggcuggccccugagcaagauggacaucggggugccccuccuggccaucggcugcuacucccaggugaacccgaucacccugaccgccgcccuccugcugcucgucgcgcacuacgccaucaucgggcccggccugcaggccaaggccacccgggaggcccagaagcgcgcggccgccggcaucaugaagaaccccacgguggacgggaugaccgugaucgaccuggaccccaucccguacgaccccaaguucgagaagcagcucggccaggucaugcugcuggugcucugcgugacccagguccugaugaugcggaccacgugggcccugugcgaggcccucacccuggcgaccgggcccaucagcacccugugggagggcaaccccgggcgcuucuggaacacgaccaucgccguguccauggccaacaucuuccgcggcagcuaccucgccggcgccgggcugcuguucuccaucaugaagaacaccgcgaacacccggcgcggcacggggaacaccggcgagacccucggcgagaaguggaagaaccggcugaacgcccugggcaagagcgaguuccagaucuacaagaaguccggcauccaggagguggaccgcacccucgccaaggaggggaucaagcggggcgagacggaccaccacgccgucagccgcggguccgcgaagcugcggugguucguggagcgcaaccuggugaccccggagggcaaggucguggaccucggcugcgggcggggcggguggagcuacuacugcggcgggcugaagaacgugaaggaggucaagggccugaccaagggcgggcccggccacgaggagcccauccccauguccaccuacggguggaaccucgugcgccugcagagcggcguggacgucuucuucacgccgcccgagaagugcgacacccugcucugcgacaucggggaguccagccccaaccccaccguggaggccggccggacccugcgcgugcugaaccucgucgagaacuggcugaacaacaacacccaguucugcaucaaggugcugaacccguacaugcccagcgugaucgagaagauggaggcccugcagcggaaguacggcggggcccucguccgcaacccccugucccggaacagcacgcacgagauguacuggguguccaacgccagcggcaacaucguguccagcgucaacaccaucucccgcaugcugaucaaccgguucaccaugcgccacaagaaggcgaccuacgagccggacguggaccucgggagcggcacgcggaacaucgggaucgaguccgagacccccaaccuggacaucaucggcaagcgcaucgagaagaucaagcaggagcacgagaccagcuggcacuacgaccaggaccaccccuacaagaccugggccuaccacggcuccuacgagacgaagcagaccgggagcgccuccagcauggugaacggcgucgugcgccugcucaccaagcccugggacgugaucccgauggucacccagauggccaugacggacaccacccccuucgggcagcagcggguguucaaggagaaggucgacacccgcacgcaggagcccaaggagggcaccaagaagcugaugaagaucaccgccgaguggcuguggaaggagcucggcaagaagaagacgccccggaugugcacgcgcgaggaguucacccggaaggugcgcuccaacgcggcccugggggccaucuucaccgacgagaacaaguggaaguccgcccgggaggccguggaggacuccggcuucugggagcuggucgacaaggagcgcaaccuccaccuggaggggaagugcgagaccugcguguacaacaugaugggcaagcgggagaagaagcugggggaguucggcaaggcgaagggcagccgcgccaucugguacauguggcucggggcccgguuccuggaguucgaggcccugggcuuccucaacgaggaccacugguucucccgcgagaacagccugagcgggguggagggcgaggggcugcacaagcucggcuacauccugcgggacgucuccaagaaggagggcggggcgauguacgccgacgacacggccggcugggacacccgcaucacccuggaggaccucaagaacgaggagauggugaccaaccacauggagggggagcacaagaagcuggccgaggccaucuucaagcugacguaccagaacaaggugguccgggugcagcgcccgacgccccggggcaccgugauggacaucaucagccgccgggaccagcgcggguccggccaggucgugaccuacggccucaacaccuucaccaacauggaggcgcagcugauccggcagauggagggggagggcguguucaagagcauccagcagcugaccgucaaggaggagaucgccgugaagaacuggcucauccgcguggggcgcgagcggcugucccgcauggccaucagcggcgacgacugcgucgugaagccccuggacgaccgguucgccuccgcccucaccgcgcugaacgacaugggcaaggugcgcaaggacauccagcagugggagcccagccggggguggaacgacuggacgcaggucccguucugcucccaccacuuccacgagcugaucaugaaggacggccgcgugcucgugguccccugccggaaccaggacgagcugaucgggcgcgcccggaucagccagggcgccggguggucccugcgcgagaccgccugccucggcaagagcuacgcccagauguggucccugauguacuuccaccggcgcgaccugcggcucgcggccaacgccaucugcagcgccgugcccucccacuggauccccaccagccgcaccaccugguccauccacgccacgcacgaguggaugaccaccgaggacaugcugaccguguggaaccgggucuggauccaggagaacccguggauggaggacaagacgcccguggagagcugggaggagauccccuaccugggcaagcgcgaggaccaguggugcgggagccucaucggccugaccucccgggcgaccugggccaagaacauccagaccgccaucaaccaggugcgcagccugaucgggaacgaggaguacacggacuacaugcccuccaugaagcgguuccgccgcgaggaggaggaggccggcguccucugguga

SEQ ID NO: 9059 - RNA, 9876 nt, Artificial Sequence
  derived and/or modified CDS sequence (opt1) from DENV-2__KX380808__SS-prME
accgccggcaucaucaucaugaugauccccaccgugauggccuuccaccugaccacccgcaacggggagccccacaugaucgucagccggcaggagaagggcaagagccuccuguucaagaccgagaacggggugaacaugugcacccugauggcgauggaccucggcgagcugugcgaggacaccaucaccuacaacugcccccugcucaagcagaacgagcccgaggacaucgacugcuggugcaacagcaccagcaccugggugaccuacgggaccugcaccgccaccggcgagcaccgccgggagaagcgcagcgucgcccuggugccccacgugggcauggggcuggagacccggaccgagaccuggauguccagcgagggcgccuggaagcacgcccagcgcaucgagaccuggguccuccggcaccccggguucaccaucauggcggccauccuggccuacaccaucggcaccaccuacuuccagcgcgugcugaucuucauccuccugacggccaucgcgcccuccaugaccaugcggugcaucgggaucagcaaccgcgacuucguggagggcgucuccggcgggagcuggguggacaucgugcuggagcacggcuccugcgucaccaccauggccaagaacaagcccacgcucgacuucgagcugaucaagaccgaggccaagcaccccgccacccugcggaaguacugcaucgaggccaagcucaccaacacgaccaccgcgagccgcugcccgacccagggggagcccucccugaacgaggagcaggacaagcgguucgugugcaagcacagcaugguggaccgcggcuggggcaacgggugcggccuguucgggaagggcgggaucgucacgugcgccauguucacgugcaagaagaacauggagggcaagaucgugcagcccgagaaccucgaguacaccaucgugaucacgccccacuccggcgaggagaacgccgucgggaacgacacgggcaagcacgggaaggagaucaaggugaccccgcagagcuccaucaccgaggccgagcugaccggcuacgggaccgugacgauggagugcagcccccggaccggccuggacuucaacgagaugguccuccugcagauggagaacaaggccuggcuggugcaccgccagugguuccucgaccugccccugcccuggcucccgggcgcggacacccagggguccaacuggauccagaaggagacccuggugacguucaagaacccccacgccaagaagcaggacgucgugguccugggcagccaggagggggccaugcacaccgcccucaccggcgccaccgagauccagaugagcuccgggaaccugcuguucacgggccaccucaagugccggcugcgcauggacaagcugcagcucaagggcaugagcuacuccaugugcaccgggaaguucaagguggugaaggagaucgcggagacccagcacggcaccaucgucauccgggugcaguacgagggggacggcagccccugcaagauccccuucgagaucauggaccuggagaagcgccacgugcugggccggcucaucacggucaacccgaucgugaccgagaaggacucccccgugaacaucgaggccgagccgcccuucggggacagcuacaucaucaucggcgucgagccggggcagcugaagcuguccugguucaagaagggcagcuccaucgggcagauguucgagaccaccaugcgcggcgccaagcgcauggccauccucggcgacacggccugggacuucgggagccugggcgggguguucaccuccaucggcaaggcgcugcaccagguguucggggccaucuacggcgccgccuucagcggcgucuccuggaccaugaagauccucaucgggguggugaucaccuggaucggcaugaacagccgguccacgagccuguccgucagccuggugcuggugggggucgugacccucuaccugggcgugaugguccaggcggacuccgggugcguggugagcuggaagaacaaggagcugaagugcggcagcggcaucuucaucaccgacaacguccacaccuggacggagcaguacaaguuccagcccgagucccccagcaagcucgccuccgccauccagaaggcccacgaggaggggaucugcggcauccgcagcgugacccggcuggagaaccugauguggaagcagaucacccccgagcucaaccacauccuguccgagaacgaggugaagcugaccaucaugacgggggacaucaagggcaucaugcaggccgggaagcgcagccuccggccgcagcccaccgagcugaaguacuccuggaaggcguggggcaaggccaagaugcugagcaccgagcuccacaaccacaccuuccugaucgacggccccgagacggccgagugcccgaacaccaaccgcgccuggaacucccuggaggucgaggacuacggguucggcguguucaccaccaacaucuggcucaagcugaaggagcggcaggacguguucugcgacagcaagcugauguccgccgcgaucaaggacaaccgcgccguccacgccgacaugggguacuggaucgagagcgcccucaacgacacguggaagaucgagaaggccuccuucaucgagaucaagagcugccacuggcccaagucccacacccuguggagcaacggcgugcuggaguccgagaugaucauccccaagaacuucgcgggccccgugagccagcacaacuaccggccgggguaccacacccagaccgccggccccuggcaccucgggcgccuggagauggacuucgacuucugcgagggcaccacggucguggugaccgaggacugcgggaaccggggccccagccugcgcaccaccacggccuccggcaagcucaucaccgaguggugcugccggagcugcacccugcccccgcugcgcuaccgcggggaggacggcugcugguacgggauggagauccgcccccucaaggagaaggaggagaaccuggucaacucccuggugaccgccggccacgggcagaucgacaacuucagccucggcgugcugggcauggcgcuguuccucgaggagaugcugcggacgcgcgucgggaccaagcacgccauccugcucguggccguguccuucgucacccugaucaccggcaacaugagcuuccgggaccuggggcgcgugauggugauggucggcgccacgaugaccgacgacaucgggaugggcgugaccuaccucgcccugcuggcggccuucaaggugcgccccaccuucgccgccggccuccugcugcggaagcucacguccaaggagcugaugaugaccaccaucgggaucguccugcucagccaguccaccauccccgagacgauccuggagcugaccgacgcccucgcgcugggcaugauggugcugaagaucgugcgcaacauggagaaguaccagcucgccgucaccaucauggccauccugugcgugccgaacgccgucauccugcagaacgccuggaaggugagcugcaccacgcucgcgguggucuccgugagcccccugcugcucaccuccagccagcagaaggccgacuggaucccccuggcccugaccaucaaggggcucaaccccaccgccaucuuccugacgacccugucccggaccagcaagaagcgcuccuggccgcucaacgaggcgaucauggccgugggcauggucagcauccuggccuccagccugcucaagaacgacauccccaugaccggcccccugguggccgggggccugcucacggugugcuacguccugaccgggcggagcgccgaccuggagcucgagcgcgcggccgacgugcggugggaggagcaggccgagaucuccggcagcucccccauccugagcaucaccaucuccgaggacgggagcauguccaucaagaacgaggaggaggagcagacccugacgauccucauccgcaccggccugcuggugaucagcggccucuucccggucuccauccccaucaccgccgccgcgugguaccugugggaggugaagaagcagcgggccggggugcugugggacguccccagcccgccgcccgugggcaaggccgagcucgaggacggggccuaccgcaucaagcagaagggcauccugggguacucccagaucggcgccggcguguacaaggaggggaccuuccacaccauguggcacgucacgcggggcgcggugcugaugcacaaggggaagcgcaucgagcccagcugggccgacgugaagaaggaccucaucuccuacggcgggggcuggaagcuggagggcgaguggaaggagggggaggagguccaggugcuggcccucgagcccggcaagaacccccgggccgugcagaccaagcccgggcuguucaagaccaacaccggcacgaucggggccgucagccuggacuucucccccggcaccagcggcucccccaucguggacaagaaggggaagguggucggccucuacgggaacggcguggugacccgcagcggcaccuacgucuccgcgaucgcccagacggagaaguccaucgaggacaaccccgagaucgaggacgacaucuuccggaagaagcgccugaccaucauggaccugcaccccggggccggcaagaccaagcgguaccugcccgccaucgugcgcgaggcgaucaagcgggggcuccgcacccugauccuggccccgacgcggguggucgccgccgagauggaggaggcccuccgcggccugcccauccgcuaccagacccccgcgauccgggccgagcacaccgggcgcgagaucguggaccugaugugccacgccaccuucacgaugcggcuccugagccccauccgcgugccgaacuacaaccugaucaucauggacgaggcccacuucaccgaccccgccuccaucgcggcccggggcuacaucagcacccgcgucgagaugggcgaggccgccgggaucuucaugaccgccacgccgcccggcucccgggacccguucccccagagcaacgcgcccaucauggacgaggagcgcgagauccccgagcgguccuggaacagcgggcacgagugggugaccgacuucaagggcaagaccgugugguucgucccguccaucaaggccgggaacgacaucgccgccugccuccgcaagaacggcaagaaggugauccagcugagccggaagaccuucgacacggaguacaucaagacccgcaccaacgacugggacuucguggucaccacggacaucuccgagaugggcgcgaacuucaaggccgagcgggugaucgacccccgccggugcaugaagcccgugauccugaccgacggggaggagcgcgucauccucgccggccccaugccggugacccacagcuccgccgcccagcggcgcgggcgggugggccgcaaccccaagaacgagaacgaccaguacaucuacaugggggagccccuggagaacgacgaggacugcgcgcacuggaaggaggccaagaugcugcucgacaacaucaacacccccgagggcaucaucccgagcauguucgagcccgagcgcgagaaggucgacgccaucgacggcgaguaccggcugcgcggggaggcccggaagacguucguggaccugaugcgccggggcgaccuccccguguggcuggccuaccgcgucgcggccgaggggaucaacuacgccgaccggcgcuggugcuucgacggcgugaagaacaaccagauccuggaggagaacgucgagguggagaucuggaccaaggagggggagcggaagaagcucaagccgcgcuggcuggacgcccggaucuacuccgacccccuggcccucaaggaguucaaggaguucgcggccggccgcaagagccugacccugaaccucaucaccgagaugggccggcugcccacguucaugacccagaaggcccgcaacgcccuggacaaccucgcggugcugcacaccgccgaggccgggggccgggccuacaaccacgcccuguccgagcuccccgagacccuggagacgcugcuccugcugacccuccuggcgaccgucaccgggggcaucuuccuguuccucaugagcggcaaggggaucggcaagaugacccuggggaugugcugcaucaucacggccuccauccugcucugguacgcccagauccagccgcacuggaucgccgccagcaucauccuggaguucuuccugaucgugcuccugauccccgagcccgagaagcagcgcacgccccaggacaaccagcugaccuacguggucaucgcgauccucaccgugguggccgccacgauggccaacgagaugggcuuccuggagaagaccaagaaggacuucgggcugggcuccaucaccacccagcagccggagagcaacauccucgacaucgaccugcggcccgccagcgcguggacgcuguacgccgucgccaccaccuucaucacccccaugcuccgccacuccaucgagaacagcuccgugaacgugagccugacggccaucgccaaccaggcgaccguccugaugggccucgggaagggcuggccccuguccaagauggacaucggggugccgcugcucgccaucggcugcuacagccaggugaaccccaucacccugaccgccgcccugcuccugcuggucacgcacuacgcgaucaucgggcccggccuccaggccaaggccacccgggaggcccagaagcgcgccgcggccggcaucaugaagauccccaccguggacgggaucaccgugaucgaccuggacccgauccccuacgaccccaaguucgagaagcagcugggccaggucaugcuccuggugcugugcgugacgcagguccucaugaugcggaccaccugggcccugugcgaggcccugacccucgccacggggcccaucuccacccugugggagggcaacccggggcgcuucuggaacaccaccaucgcggugagcauggccaacaucuuccgcggcuccuaccuggccggcgccgggcuccuguucagcaucaugaagaacacggccaacacccggcgcggcaccgggaacaccggcgagacgcugggcgagaaguggaagaaccggcucaacgcgcuggggaaguccgaguuccagaucuacaagaaguccggcauccaggagguggaccgcacccuggccaaggaggggaucaagcggggcgagaccgaccaccacgccgucucccgcgggagcgccaagcuccggugguucguggagcgcaaccuggugacccccgagggcaaggucguggaccugggcugcgggcggggcgggugguccuacuacugcggcgggcucaagaacgugaaggaggucaagggccugacgaagggcgggcccggccacgaggagcccaucccgaugagcaccuacggguggaaccuggugcgccuccaguccggcguggacgucuucuucacgccgcccgagaagugcgacacccugcugugcgacaucggggagagcucccccaacccgaccguggaggcgggccggacgcuccgcgugcugaaccuggucgagaacuggcucaacaacaacacccaguucugcaucaaggugcugaaccccuacaugcccagcgugaucgagaagauggaggcccugcagcggaaguacggcggggcccugguccgcaacccgcucagccggaacuccacccacgagauguacugggugagcaacgccuccggcaacaucgugagcuccgucaacaugaucagccgcaugcugaucaaccgguucaccaugcgccacaagaaggccacguacgagcccgacguggaccugggguccggcacccggaacaucgggaucgagagcgagacccccaaccucgacaucaucggcaagcgcaucgagaagaucaagcaggagcacgagaccuccuggcacuacgaccaggaccaccccuacaagacgugggcguaccacggcagcuacgagaccaagcagaccggguccgccagcuccauggugaacggcgucgugcgccugcugaccaagccgugggacgugauccccauggucacgcagauggccaugaccgacaccacccccuucgggcagcagcggguguucaaggagaagguggacacgcgcacccaggagcccaaggagggcaccaagaagcucaugaagaucaccgccgaguggcuguggaaggagcugggcaagaagaagacgccgcggaugugcacccgcgaggaguucacccggaagguccgcagcaacgccgcgcucggggccaucuucaccgacgagaacaaguggaaguccgcccgggaggccguggaggacagcggcuucugggagcuggucgacaaggagcgcaaccugcaccucgaggggaagugcgagacgugcguguacaacaugaugggcaagcgggagaagaagcugggggaguucggcaaggccaagggcucccgcgcgaucugguacauguggcugggggcccgguuccucgaguucgaggcccugggcuuccugaacgaggaccacugguucagccgcgagaacucccucagcgggguggagggcgaggggcugcacaagcugggcuacauccuccgggacgucagcaagaaggagggcggggccauguacgcggacgacaccgccggcugggacacccgcaucacccuggaggaccugaagaacgaggagauggugacgaaccacauggagggggagcacaagaagcucgccgaggccaucuuccggcugaccuaccagaacaaggugguccgcgugcagcggcccacgccccggggcaccgugauggacaucaucucccggcgcgaccagcgggggagcggccaggucgugacguacggccugaacaccuucaccaacauggaggcccagcucauccgccagauggagggggagggccuguucaaguccauccagcaccugaccgugacggaggagaucgcggucaagaacuggcucgugcgcguggggcgggagcgccugagccggauggccaucuccggcgacgacugcgucgugaagccccuggacgaccgcuucgccagcgcccucaccgcccugaacgacaugggcaaggugcggaaggacauccagcagugggagccgucccgcggguggaacgacuggacccagguccccuucugcagccaccacuuccacgagcugaucaugaaggacggccgggugcucgugguccccugccgcaaccaggacgagcugaucgggcgggcgcgcaucucccagggcgccggguggagccugcgggagaccgccugccucggcaaguccuacgcccagauguggagccugauguacuuccaccgccgggaccugcgccucgccgcgaacgccaucugcuccgccgugcccagccacugggugccgaccucccggacgaccuggagcauccacgccacccacgaguggaugaccacggaggacaugcugaccgucuggaaccgcguguggauccaggagaaccccuggauggaggacaagacccccguggaguccugggaggagauccccuaccugggcaagcgggaggaccaguggugcgggagccucaucggccugaccagccgcgccacgugggcgaagaacauccagaccgccaucaaccagguccggucccugaucgggaacgaggaguacaccgacuacaugccgagcaugaagcgcuuccgccgggaggaggaggaggccggcgugcucugguga

SEQ ID NO: 9060 - RNA, 9876 nt, Artificial Sequence
  derived and/or modified CDS sequence (opt1) from DENV-2__KX380832__SS-prME
accgccgggaucaucaucaugaugauccccaccgugauggccuuccaccugaccacccggaacggggagccccacaugaucgugagccggcaggagaagggcaagagccuccuguucaagaccgagaacggggugaacaugugcacccugauggcgauggaccucggcgagcugugcgaggacaccaucaccuacaacugcccccugcuccgccagaacgagcccgaggacaucgacugcuggugcaacagcaccagcaccugggugaccuacgggaccugcaccgccaccggcgagcaccggcgcgagaagcggagcgucgcccuggugccccacgugggcauggggcuggagacgcgcaccgagaccuggauguccagcgagggcgccuggaagcacgcccagcggaucgagaccuggguccuccgccaccccggguucacggugauggcggccauccuggccuacaccaucggcaccaccuacuuccagcgggugcugaucuucauccuccugacggccgucgcgcccuccaugaccaugcgcugcaucgggaucagcaaccgggacuucguggagggcguguccggcgggagcugggucgacaucgugcuggagcacggcuccugcgugaccaccauggccaagaacaagcccacgcucgacuucgagcugaucaagaccgaggccaagcaccccgccacccugcgcaaguacugcaucgaggccaagcucaccaacacgaccaccgcgagccggugcccgacccagggggagcccucccugaacgaggagcaggacaagcgcuucgucugcaagcacagcaugguggaccggggcuggggcaacgggugcggccuguucgggaagggcgggaucgugacgugcgccauguucacgugcaagaagaacauggagggcaagaucguccagcccgagaaccucgaguacaccaucgugaucacgccccacuccggcgaggagaacgccguggggaacgacacgggcaagcacgggaaggagaucaaggucaccccgcagagcuccaucaccgaggccgagcugaccggcuacgggaccgccacgauggagugcagcccccgcaccggccuggacuucaacgagauggugcuccugcagauggagaacaaggcguggcuggugcaccggcagugguuccucgaccugccccugcccuggcucccgggcgccgacacccagggguccaacuggauccagaaggagacccuggucacguucaagaacccccacgccaagaagcaggacguggucgugcugggcagccaggagggggccaugcacaccgcccucaccggcgcgaccgagauccagaugagcuccgggaaccugcuguucacgggccaccucaagugccgccugcggauggacaagcugcagcucaagggcaugagcuacuccaugugcaccgggaaguucaagguggucaaggagaucgccgagacccagcacggcaccaucgugauccgcgugcaguacgagggggacggcagccccugcaagauccccuucgagaucauggaccuggagaagcggcacguccugggccgccucaucacggugaacccgaucgugaccgagaaggacucccccgucaacaucgaggccgagccgcccuucggggacagcuacaucaucaucggcguggagccggggcagcugaagcuguccugguucaagaagggcagcuccaucgggcagauguucgagaccaccaugcgcggcgccaagcggauggccauccucggcgacacggcgugggacuucgggagccugggcgggguguucaccuccaucggcaaggcccugcaccaggucuucggggccaucuacggcgccgcguucagcggcguguccuggaccaugaagauccucaucgggguggucaucaccuggaucggcaugaacagccgcuccacgagccuguccgugagccuggugcuggucgggaucgugacccucuaccugggcgugaugguccaggccgacuccgggugcguggugagcuggaagaacaaggagcugaagugcggcagcggcaucuucaucaccgacaacguccacaccuggacggagcaguacaaguuccagcccgagucccccagcaagcucgccuccgccauccagaaggcccacgaggaggggaucugcggcauccggagcgugacccgccuggagaaccugauguggaagcagaucacccccgagcucaaccacauccuguccgagaacgaggugaagcugaccaucaugacgggggacaucaagggcaucaugcaggcggggaagcggagccuccgcccgcagcccaccgagcugaaguacuccuggaaggccuggggcaaggccaagaugcugagcaccgagcuccacaaccacaccuuccugaucgacggccccgagacggccgagugcccgaacaccaaccgggccuggaacucccuggaggucgaggacuacggguucggcguguucaccaccaacaucuggcucaagcugaaggagcgccaggacguguucugcgacagcaagcugauguccgcggccaucaaggacaaccgggccguccacgccgacaugggguacuggaucgagagcgcccucaacgacacguggaagaucgagaaggcguccuucaucgaggucaagagcugccacuggcccaagucccacacccuguggagcaacggcgugcuggaguccgagaugaucauccccaagaacuucgccggccccgugagccagcacaacuaccgcccgggguaccacacccagaccgccggccccuggcaccucgggcggcuggagauggacuucgacuucugcgagggcaccacggugguggucaccgaggacugcgggaaccgcggccccagccugcggaccaccacggccuccggcaagcucaucaccgaguggugcugccgcagcugcacccugcccccgcugcgguaccgcggggaggacggcugcugguacgggauggagauccggccccucaaggagaaggaggagaaccuggugaacucccuggugaccgcgggccacgggcagaucgacaacuucagccucggcguccugggcauggcccuguuccucgaggagaugcugcgcacgcggguggggaccaagcacgccauccugcucguggccgucuccuucgugacccugaucaccggcaacaugagcuuccgcgaccuggggcgcgugauggucauggugggcgccacgaugaccgacgacaucgggaugggcgugaccuaccucgcgcugcuggccgccuucaagguccggcccaccuucgccgccggccuccugcugcgcaagcucacguccaaggagcugaugaugaccaccaucgggaucgugcugcucagccaguccaccauccccgagacgauccuggagcugaccgacgcgcucgcccugggcaugauggugcugaagaucguccggaacauggagaaguaccagcucgccgugaccaucaugaccauccugugcgucccgaacgccgugauccugcagaacgccuggaaggugagcugcacgauccucgcggucguguccgugagcccccugcugcucaccuccagccagcagaaggccgacuggaucccccuggcccugaccaucaaggggcucaaccccaccgccaucuuccugacgacccugucccgcaccagcaagaagcgguccuggccgcucaacgaggcgaucauggccgucggcauggugagcauccuggccuccagccugcucaagaacgacauccccaugaccggcccccugguggccgggggccugcucacggucugcuacgugcugaccgggcgcagcgccgaccuggagcucgagcgggcggccgacgugcgcugggaggagcaggccgagaucuccggcagcucccccauccugagcaucaccaucuccgaggacgggagcauguccaucaagaacgaggaggaggagcagacccugacgauccucauccggaccggccugcuggucaucagcggccucuucccgguguccauccccaucaccgccgccgcgugguaccugugggaggugaagaagcagcgcgccgggguccugugggacgugcccagcccgccgcccgugggcaaggccgagcucgaggacggggccuaccggaucaagcagaagggcauccugggguacucccagaucggcgccggcgucuacaaggaggggaccuuccacaccauguggcacgugacgcgcggcgcggugcugaugcacaaggggaagcggaucgagcccagcugggccgacgucaagaaggaccucaucuccuacggcgggggcuggaagcuggagggcgaguggaaggagggggaggagguccaggugcuggcccucgagcccggcaagaacccccgcgccguccagaccaagcccgggcuguucaagaccaacaccggcacgaucggggccgugagccuggacuucucccccggcaccagcggcucccccaucguggacaagaaggggaaggucgugggccucuacgggaacggcguggucacccggagcggcaccuacguguccgcgaucgcccagacggagaaguccaucgaggacaaccccgagaucgaggacgacaucuuccgcaagaagcggcugaccaucauggaccugcaccccggggccggcaagaccaagcgcuaccugcccgccaucgugcgggaggcgaucaagcgcgggcuccggacccugauccuggccccgacgcgcgucguggccgccgagauggaggaggcccuccgcggccugcccauccgguaccagacccccgcgauccgcgccgagcacaccgggcgggagaucguggaccugaugugccacgccaccuucacgaugcgccuccugagccccauccgggucccgaacuacaaccugaucaucauggacgaggcccacuucaccgaccccgccuccaucgcggcccgcggcuacaucagcacccggguggagaugggcgaggccgccgggaucuucaugaccgccacgccgcccggcucccgcgacccguucccccagagcaacgcgcccaucauggacgaggagcgggagauccccgagcgcuccuggaacagcgggcacgagugggugaccgacuucaagggcaagaccgucugguucgugccguccaucaaggccgggaacgacaucaccgccugccuccggaagaacggcaagaaggugauccagcugagccgcaagacguucgacuccgaguacaucaagacccggaccaacgacugggacuucgucgugaccacggacaucagcgagaugggcgccaacuucaaggcggagcgcgugaucgacccccggcgcugcaugaagcccgucauccugaccgacggggaggagcgggugauccucgccggccccaugccggugacccacuccagcgccgcccagcgccgggggcgcgucggccgcaaccccaagaacgagaacgaccaguacaucuacaugggggagccccuggagaacgacgaggacugcgcccacuggaaggaggcgaagaugcugcucgacaacaucaacacccccgagggcaucaucccguccauguucgagcccgagcgggagaagguggacgccaucgacggcgaguaccgccugcgcggggaggcccgcaagacguucguggaccugaugcggcgcggcgaccuccccgucuggcuggccuaccggguggccgcggaggggaucaacuacgccgaccgccgguggugcuucgacggcgucaagaacaaccagauccuggaggagaacguggagguggagaucuggaccaaggagggggagcgcaagaagcucaagccgcgguggcuggacgcccgcaucuacagcgacccccuggcccucaaggaguucaaggaguucgccgcgggccggaagucccugacccugaaccucaucaccgagaugggccgccugcccacguucaugacccagaaggcccggaacgcccuggacaaccucgccguccugcacaccgcggaggccgggggccgcgccuacaaccacgcccugagcgagcuccccgagacccuggagacgcugcuccugcugacccuccuggccaccgugaccgggggcaucuuccuguuccucauguccggcaaggggaucggcaagaugacccuggggaugugcugcaucaucacggcgagcauccugcucugguacgcccagauccagccgcacuggaucgccgccuccaucauccuggaguucuuccugaucgugcuccugauccccgagcccgagaagcagcggacgccccaggacaaccagcugaccuacgucgugaucgccauccucaccguggucgcggccacgauggccaacgagaugggcuuccuggagaagaccaagaaggacuucgggcugggcagcaucaccacccagcagccggacagcaacauccucgacaucgaccugcgccccgccuccgccuggacgcuguacgcgguggccaccaccuucaucacccccaugcuccggcacagcaucgagaacuccagcgugaacgucucccugacggccaucgccaaccaggccaccgugcugaugggccucgggaagggcuggccccugagcaagauggacaucggggugccgcugcucgcgaucggcugcuacucccaggucaaccccaucacccugaccgccgcccugcuccugcugguggcccacuacgcgaucaucgggcccggccuccaggccaaggccacgcgcgaggcccagaagcgggccgcggccggcaucaugaagauccccgccgccgacgggaucaccgugaucgaccuggacccgauccccuacgaccccaaguucgagaagcagcugggccaggucaugcuccuggugcugugcgugacccagguccucaugaugcgcaccacgugggcccugugcgaggcgcugacccucgccaccgggcccaucagcacccugugggagggcaacccggggcgcuucuggaacacgaccaucgccguguccauggccaacaucuuccggggcagcuaccuggccggcgcggggcuccuguucuccaucaugaagaacaccgccaacacccgccggggcacggggaacaccggcgagacccugggcgagaaguggaagaaccgccucaacgcccugggcaagagcgaguuccagaucuacaagaaguccggcauccaggagguggaccggacccuggccaaggaggggaucaagcgcggcgagacggaccaccacgcggucagccggggguccgccaagcuccgcugguucguggagcggaaccuggugacccccgagggcaaggucguggaccugggcugcgggcgcggcggguggagcuacuacugcggcgggcucaagaacgugaaggaggucaagggccugaccaagggcgggcccggccacgaggagcccaucccgauguccaccuacggguggaaccuggugcggcuccagagcggcguggacgucuucuucacgccgcccgagaagugcgacacccugcugugcgacaucggggaguccagccccaacccgaccguggaggccggccgcacccuccgggugcugaaccuggucgagaacuggcucaacaacaacacccaguucugcaucaaggugcugaaccccuacaugcccagcgugaucgagaagauggaggcccugcagcgcaaguacggcggggcccugguccggaacccgcucucccgcaacagcacgcacgagauguacuggguguccaacgcgagcggcaacaucguguccagcgucaacaugaucucccggaugcugaucaaccgcuucaccaugaagcacaagaaggccaccuacgagcccgacguggaccuggggagcggcacccggaacaucgggaucgaguccgagacgcccaaccucgacaucaucggcaagcgcaucgagaagaucaagcaggagcacgagaccagcuggcacuacgaccaggaccaccccuacaagaccugggccuaccacggcuccuacgagaccaagcagacggggagcgccuccagcauggugaacggcgucgugcgccugcugaccaagccgugggacgugauccccauggucacccagauggccaugaccgacacgacccccuucgggcagcagcggguguucaaggagaagguggacacccgcacccaggagcccaaggagggcacgaagaagcucaugaagaucaccgcggaguggcuguggaaggagcugggcaagaagaagaccccgcggaugugcacccgcgaggaguucacgcggaagguccgcuccaacgccgcccucggggccaucuucaccgacgagaacaaguggaaguccgcccgggaggcgguggaggacuccggcuucugggagcuggucgacaaggagcgcaaccugcaccucgaggggaagugcgagaccugcguguacaacaugaugggcaagcgggagaagaagcugggggaguucggcaaggccaagggcagccgcgccaucugguacauguggcugggggcccgguuccucgaguucgaggcgcugggcuuccugaacgaggaccacugguucucccgcgagaacagccucagcgggguggagggcgaggggcugcacaagcugggcuacauccuccgggacgucuccaagaaggagggcggggccauguacgccgacgacaccgccggcugggacacgcgcaucacccuggaggaccugaagaacgaggagauggugaccaaccacauggagggggagcaccggaagcucgccgaggcgaucuuccgccugaccuaccagaacaaggugguccgggugcagcgccccacgccccggggcaccgugauggacaucaucagccgccgggaccagcgcggguccggccaggucgugaccuacggccugaacaccuucacgaacauggaggcccagcucauccgccagauggagggggagggcguguucaagagcauccagcaccugaccgucaccgaggagaucgccgugaagaacuggcuggagcggguggggcgcgagcggcucucccgcauggccaucagcggcgacgacugcgucgugaagccccuggacgaccgguucgccuccgcgcugaccgcccucaacgacaugggcaaggugcgcaaggacauccagcagugggagccgagccggggguggaacgacuggacgcagguccccuucugcucccaccacuuccacgagcugaucaugaaggacggccgcgugcuggugguccccugccggaaccaggacgagcucaucgggcgcgcccggaucagccagggcgccggguggucccugcgcgagaccgccugccugggcaagagcuacgcgcagauguggucccucauguacuuccaccggcgcgaccugcggcuggccgccaacgccaucugcagcgccgugcccucccacugggugccgaccagccgcaccaccugguccauccacgcgacgcacgaguggaugaccaccgaggacaugcucaccgucuggaaccggguguggauccaggagaaccccuggauggaggacaagacgcccguggagagcugggaggagauccccuaccugggcaagcgcgaggaccaguggugcgggagccugaucggccucaccucccgggccaccugggccaagaacauccagaccgccaucaaccagguccgcagccugaucgggaacgaggaguacacggacuacaugccguccaugaagcgcuuccggcgcgaggaggaggaggcgggcgugcugugguga

SEQ ID NO: 9061 - RNA, 9876 nt, Artificial Sequence
  derived and/or modified CDS sequence (opt1) from DENV-2__KX380833__SS-prME
accgccgggaucaucaucaugaugauccccaccgugauggccuuccaccugaccacccggaacggggagccccacaugaucgugagccggcaggagaagggcaagagccuccuguucaagaccgagaacggggugaacaugugcacccugauggcgauggaccucggcgagcugugcgaggacaccaucaccuacaacugcccccugcuccgccagaacgagcccgaggacaucgacugcuggugcaacagcaccagcaccugggugaccuacgggaccugcaccgccaccggcgagcaccggcgcgagaagcggagcgucgcccuggugccccacgugggcauggggcuggagacccgcaccgagaccuggauguccagcgagggcgccuggaagcacgcccagcggaucgagaccuggguccuccgccaccccggguucaccgugauggcggccauccuggccuacaccaucggcaccaccuacuuccagcgggugcugaucuucauccuccugaccgccgucgcgcccuccaugaccaugcgcugcaucgggaucagcaaccgggacuucguggagggcguguccggcgggagcugggucgacaucgugcuggagcacggcuccugcgugaccaccauggccaagaacaagcccacgcucgacuucgagcugaucaagaccgaggccaagcaccccgccacccugcgcaaguacugcaucgaggccaagcucaccaacacgaccaccgcgagccggugcccgacccagggggagcccucccugaacgaggagcaggacaagcgcuucgucugcaagcacagcaugguggaccggggcuggggcaacgggugcggccuguucgggaagggcgggaucgugacgugcgccauguucacgugcaagaagaacauggagggcaagaucguccagcccgagaaccucgaguacaccaucgugaucacgccccacuccggcgaggagaacgccguggggaacgacacgggcaagcacgggaaggagaucaaggucaccccgcagagcuccaucaccgaggccgagcugaccggcuacgggaccgccacgauggagugcagcccccgcaccggccuggacuucaacgagauggugcuccugcagauggagaacaaggcguggcuggugcaccggcagugguuccucgaccugccccugcccuggcucccgggcgccgacacccagggguccaacuggauccagaaggagacccuggucacguucaagaacccccacgccaagaagcaggacguggucgugcugggcagccaggagggggccaugcacaccgcccucaccggcgcgaccgagauccagaugagcuccgggaaccugcuguucacgggccaccucaagugccgccugcggauggacaagcugcagcucaagggcaugagcuacuccaugugcaccgggaaguucaagguggucaaggagaucgccgagacccagcacggcaccaucgugauccgcgugcaguacgagggggacggcagccccugcaagauccccuucgagaucauggaccuggagaagcggcacguccugggccgccucaucacggugaacccgaucgugaccgagaaggacucccccgucaacaucgaggccgagccgcccuucggggacagcuacaucaucaucggcguggagccggggcagcugaagcuguccugguucaagaagggcagcuccaucgggcagauguucgagaccaccaugcgcggcgccaagcggauggccauccucggcgacacggcgugggacuucgggagccugggcgggguguucaccuccaucggcaaggcccugcaccaggucuucggggccaucuacggcgccgcguucagcggcguguccuggaccaugaagauccucaucgggguggucaucaccuggaucggcaugaacagccgcuccacgagccuguccgugagccuggugcuggucgggaucgugacccucuaccugggcgugaugguccaggccgacuccgggugcguggugagcuggaagaacaaggagcugaagugcggcagcggcaucuucaucaccgacaacguccacaccuggacggagcaguacaaguuccagcccgagucccccagcaagcucgccuccgccauccagaaggcccacgaggaggggaucugcggcauccggagcgugacccgccuggagaaccugauguggaagcagaucacccccgagcucaaccacauccuguccgagaacgaggugaagcugaccaucaugacgggggacaucaagggcaucaugcaggcggggaagcggagccuccgcccgcagcccaccgagcugaaguacuccuggaaggccuggggcaaggccaagaugcugagcaccgagcuccacaaccacaccuuccugaucgacggccccgagacggccgagugcccgaacaccaaccgggccuggaacucccuggaggucgaggacuacggguucggcguguucaccaccaacaucuggcucaagcugaaggagcgccaggacguguucugcgacagcaagcugauguccgcggccaucaaggacaaccgggccguccacgccgacaugggguacuggaucgagagcgcccucaacgacacguggaagaucgagaaggcguccuucaucgaggucaagagcugccacuggcccaagucccacacccuguggagcaacggcgugcuggaguccgagaugaucauccccaagaacuucgccggccccgugagccagcacaacuaccgcccgggguaccacacccagaccgccggccccuggcaccucgggcggcuggagauggacuucgacuucugcgagggcaccacggugguggucaccgaggacugcgggaaccgcggccccagccugcggaccaccacggccuccggcaagcucaucaccgaguggugcugccgcagcugcacccugcccccgcugcgguaccgcggggaggacggcugcugguacgggauggagauccggccccucaaggagaaggaggagaaccuggugaacucccuggugaccgcgggccacgggcagaucgacaacuucagccucggcguccugggcauggcccuguuccucgaggagaugcugcgcacgcggguggggaccaagcacgccauccugcucguggccgucuccuucgugacccugaucaccggcaacaugagcuuccgcgaccuggggcgcgugauggucauggugggcgccacgaugaccgacgacaucgggaugggcgugaccuaccucgcgcugcuggccgccuucaagguccggcccaccuucgccgccggccuccugcugcgcaagcucacguccaaggagcugaugaugaccaccaucgggaucgugcugcucagccaguccaccauccccgagacgauccuggagcugaccgacgcgcucgcccugggcaugauggugcugaagaucguccggaacauggagaaguaccagcucgccgugaccaucauggccauccugugcgucccgaacgccgugauccugcagaacgcguggaaggugagcugcaccauccucgccgucguguccgugagcccccugcugcucacguccagccagcagaaggccgacuggaucccccuggcccugaccaucaaggggcucaaccccaccgcgaucuuccugaccacgcugucccgcaccagcaagaagcgguccuggccgcucaacgaggccaucauggccgucggcauggugagcauccuggccuccagccugcucaagaacgacauccccaugaccggcccccugguggccgggggccugcucaccgucugcuacgugcugacggggcgcagcgcggaccuggagcucgagcgggccgccgacgugcgcugggaggagcaggccgagaucuccggcagcucccccauccugagcaucaccaucuccgaggacgggagcauguccaucaagaacgaggaggaggagcagacccugaccauccucauccggacgggccugcuggucaucagcggccucuucccgguguccauccccaucaccgccgcggccugguaccugugggaggugaagaagcagcgcgccgggguccugugggacgugcccagcccgccgcccgugggcaaggccgagcucgaggacggggccuaccggaucaagcagaagggcauccugggguacucccagaucggcgcgggcgucuacaaggaggggaccuuccacaccauguggcacgugacccgcggcgccgugcugaugcacaaggggaagcggaucgagcccagcugggccgacgucaagaaggaccucaucuccuacggcgggggcuggaagcuggagggcgaguggaaggagggggaggagguccaggugcuggcccucgagcccggcaagaacccccgcgccguccagacgaagcccgggcuguucaagaccaacaccggcaccaucggggcggugagccuggacuucucccccggcacgagcggcucccccaucguggacaagaaggggaaggucgugggccucuacgggaacggcguggucacccggagcggcaccuacguguccgccaucgcccagaccgagaaguccaucgaggacaaccccgagaucgaggacgacaucuuccgcaagaagcggcugacgaucauggaccugcaccccggggccggcaagaccaagcgcuaccugcccgcgaucgugcgggaggccaucaagcgcgggcuccggacccugauccuggccccgacccgcgucguggccgccgagauggaggaggcgcuccgcggccugcccauccgguaccagacgcccgccauccgcgccgagcacaccgggcgggagaucguggaccugaugugccacgccaccuucaccaugcgccuccugagccccauccgggucccgaacuacaaccugaucaucauggacgaggcccacuucacggaccccgcguccaucgccgcccgcggcuacaucagcacccggguggagaugggcgaggccgccgggaucuucaugaccgcgacgccgcccggcucccgcgacccguucccccagagcaacgcccccaucauggacgaggagcgggagauccccgagcgcuccuggaacagcgggcacgagugggugacggacuucaagggcaagaccgucugguucgugccguccaucaaggccgggaacgacaucgccgcgugccuccggaagaacggcaagaaggugauccagcugagccgcaagaccuucgacuccgaguacaucaagacccggacgaacgacugggacuucgucgugaccaccgacaucagcgagaugggcgccaacuucaaggccgagcgcgugaucgacccccggcgcugcaugaagcccgucauccugaccgacggggaggagcgggugauccucgccggccccaugccggugacgcacuccagcgccgcgcagcgccgggggcgcgucggccgcaaccccaagaacgagaacgaccaguacaucuacaugggggagccccuggagaacgacgaggacugcgcccacuggaaggaggccaagaugcugcucgacaacaucaacacccccgagggcaucaucccguccauguucgagcccgagcgggagaagguggacgccaucgacggcgaguaccgccugcgcggggaggcccgcaagaccuucguggaccugaugcggcgcggcgaccuccccgucuggcuggcguaccggguggccgccgaggggaucaacuacgccgaccgccgguggugcuucgacggcgucaagaacaaccagauccuggaggagaacguggagguggagaucuggaccaaggagggggagcgcaagaagcucaagccgcgguggcuggacgcccgcaucuacagcgacccccuggcgcucaaggaguucaaggaguucgccgccggccggaagucccugacgcugaaccucaucaccgagaugggccgccugcccaccuucaugacccagaaggcccggaacgcgcuggacaaccucgccguccugcacacggccgaggccgggggccgcgccuacaaccacgcgcugagcgagcuccccgagacccuggagacccugcuccugcugacccuccuggccacggugaccgggggcaucuuccuguuccucauguccggcaaggggaucggcaagaugacccuggggaugugcugcaucaucaccgccagcauccugcucugguacgcccagauccagccgcacuggaucgccgcguccaucauccuggaguucuuccugaucgugcuccugauccccgagcccgagaagcagcggacgccccaggacaaccagcugacguacgucgugaucgccauccucaccguggucgccgccaccauggccaacgagaugggcuuccuggagaagaccaagaaggacuucgggcugggcagcaucacgacccagcagccggacagcaacauccucgacaucgaccugcgccccgcguccgccuggacccuguacgccguggccaccacguucaucacccccaugcuccggcacagcaucgagaacuccagcgugaacgucucccugaccgccaucgcgaaccaggccaccgugcugaugggccucgggaagggcuggccccugagcaagauggacaucggggugccgcugcucgccaucggcugcuacucccaggucaaccccaucacgcugaccgccgcgcugcuccugcugguggcccacuacgccaucaucgggcccggccuccaggccaaggccacccgcgaggcgcagaagcgggccgccgccggcaucaugaagauccccgccgcggacgggaucaccgugaucgaccuggacccgauccccuacgaccccaaguucgagaagcagcugggccaggucaugcuccuggugcugugcgugacgcagguccucaugaugcgcaccaccugggcccugugcgaggcccugacccucgccacggggcccaucagcacccugugggagggcaacccggggcgcuucuggaacaccaccaucgccguguccauggcgaacaucuuccggggcagcuaccuggccggcgccgggcuccuguucuccaucaugaagaacacggccaacacccgccggggcaccgggaacaccggcgagacgcugggcgagaaguggaagaaccgccucaacgcgcugggcaagagcgaguuccagaucuacaagaaguccggcauccaggagguggaccggacccuggccaaggaggggaucaagcgcggcgagaccgaccaccacgccgucagccggggguccgccaagcuccgcugguucguggagcggaaccuggugacccccgagggcaaggucguggaccugggcugcgggcgcggcggguggagcuacuacugcggcgggcucaagaacgugaaggaggucaagggccugacgaagggcgggcccggccacgaggagcccaucccgauguccaccuacggguggaaccuggugcggcuccagagcggcguggacgucuucuucacgccgcccgagaagugcgacacccugcugugcgacaucggggaguccagccccaacccgacgguggaggccggccgcacccuccgggugcugaaccuggucgagaacuggcucaacaacaacacccaguucugcaucaaggugcugaaccccuacaugcccagcgugaucgagaagauggaggcgcugcagcgcaaguacggcggggcccugguccggaacccgcucucccgcaacagcacccacgagauguacuggguguccaacgccagcggcaacaucguguccagcgucaacaugaucucccggaugcugaucaaccgcuucaccaugaagcacaagaaggccacguacgagcccgacguggaccuggggagcggcacccggaacaucgggaucgaguccgagacccccaaccucgacaucaucggcaagcgcaucgagaagaucaagcaggagcacgagaccagcuggcacuacgaccaggaccaccccuacaagacgugggccuaccacggcuccuacgagaccaagcagaccgggagcgcguccagcauggugaacggcgucgugcgccugcugaccaagccgugggacgugauccccauggucacgcagauggccaugaccgacaccacccccuucgggcagcagcggguguucaaggagaagguggacacgcgcacccaggagcccaaggagggcaccaagaagcucaugaagaucaccgccgaguggcuguggaaggagcugggcaagaagaagacgccgcggaugugcacccgcgaggaguucacccggaagguccgcuccaacgccgcccucggggcgaucuucaccgacgagaacaaguggaaguccgcccgggaggccguggaggacuccggcuucugggagcuggucgacaaggagcgcaaccugcaccucgaggggaagugcgagacgugcguguacaacaugaugggcaagcgggagaagaagcugggggaguucggcaaggccaagggcagccgcgcgaucugguacauguggcugggggcccgguuccucgaguucgaggcccugggcuuccugaacgaggaccacugguucucccgcgagaacagccucagcgggguggagggcgaggggcugcacaagcugggcuacauccuccgggacgucuccaagaaggagggcggggccauguacgccgacgacaccgcgggcugggacacccgcaucacccuggaggaccugaagaacgaggagauggugacgaaccacauggagggggagcaccggaagcucgccgaggccaucuuccgccugaccuaccagaacaaggugguccgggugcagcgccccacgccccggggcaccgugauggacaucaucagccgccgggaccagcgcggguccggccaggucgugacguacggccugaacaccuucaccaacauggaggcccagcucauccgccagauggagggggagggcguguucaagagcauccagcaccugaccgucacggaggagaucgccgugaagaacuggcuggagcggguggggcgcgagcggcucucccgcauggcgaucagcggcgacgacugcgucgugaagccccuggacgaccgguucgccuccgcccugaccgcccucaacgacaugggcaaggugcgcaaggacauccagcagugggagccgagccggggguggaacgacuggacccagguccccuucugcucccaccacuuccacgagcugaucaugaaggacggccgcgugcuggugguccccugccggaaccaggacgagcucaucgggcgcgcccggaucagccagggcgcgggguggucccugcgcgagaccgccugccugggcaagagcuacgcccagauguggucccucauguacuuccaccggcgcgaccugcggcuggccgccaacgcgaucugcagcgccgugcccucccacugggugccgaucagccgcacgaccugguccauccacgccacccacgaguggaugaccaccgaggacaugcucacggucuggaaccggguguggauccaggagaaccccuggauggaggacaagacccccguggagagcugggaggagauccccuaccugggcaagcgcgaggaccaguggugcgggagccugaucggccucaccucccgggccaccugggcgaagaacauccagacggccaucaaccagguccgcagccugaucgggaacgaggaguacaccgacuacaugccguccaugaagcgcuuccggcgcgaggaggaggaggccggcgugcugugguga

SEQ ID NO: 9062 - RNA, 9876 nt, Artificial Sequence
  derived and/or modified CDS sequence (opt1) from DENV-2__KX380834__SS-prME
accgcggggaucaucaucaugaugauccccaccgugauggccuuccaccugaccacccggaacggggagccccacaugaucgucagccggcaggagaagggcaagagccuccuguucaagaccgagaacggggugaacaugugcacccugauggcgauggaccucggcgagcugugcgaggacaccaucaccuacaacugcccccugcuccgccagaacgagcccgaggacaucgacugcuggugcaacagcaccagcaccugggugaccuacgggaccugcaccgccaccggcgagcaccggcgcgagaagcggagcgucgcccuggugccccacgugggcauggggcuggagacccgcaccgagaccuggaugagcagcgagggcgccuggaagcacgcccagcggaucgagaccuggauccuccgccaccccggguucacgaucauggcggccauccuggccuacaccaucggcaccaccuacuuccagcggguccugaucuucauccuccugacggccgugacccccuccauggcgaugcgcugcaucgggaucagcaaccgggacuucguggagggcgucuccggcgggagcuggguggacaucgugcuggagcacggcuccugcgucaccaccauggccaagaacaagcccacgcucgacuucgagcugaucaagaccgaggccaagcaccuggccacccuccgcaaguacugcguggaggccaagcugaccaacacgaccaccgcgagccggugccccacccagggggagcccucccugaacgaggagcaggacaagcgcuucgugugcaagcacagcauggucgaccggggcuggggcaacgggugcggccucuucgggaagggcgggaucgugacgugcgccauguucacgugcaagaagaacauggagggcaaggugguccagcccgagaaccuggaguacaccaucgugaucacgccccacuccggcgaggagaacgccguggggaacgacacgggcaagcacgggaaggagaucaaggucacgccccagagcuccaucaccgaggccgagcugaccggcuacgggaccgugacgauggagugcagcccgcgcaccggccucgacuucaacgagauggugcugcugcagauggagaacaaggccuggcucguccaccggcagugguuccuggaccugccccuccccuggcugcccggcgcggacacccagggguccaacuggauccagaaggagacccuggugacguucaagaacccgcacgccaagaagcaggacgucguggugcucggcagccaggagggggccaugcacaccgcccugaccggcgccaccgagauccagaugagcuccgggaaccuccuguucacgggccaccugaagugccgccugcggauggacaagcuccagcugaagggcaugagcuacuccaugugcaccgggaaguucaaggucgugaaggagaucgcggagacccagcacggcaccaucgugauccgcguccaguacgagggggacggcagccccugcaagauccccuucgagaucauggaccuggagaagcggcacgugcucggccgccugaucacggugaaccccaucgucaccgagaaggacuccccggugaacaucgaggccgagccgcccuucggggacagcuacaucaucaucggcguggagcccgggcagcugaagcucuccugguucaagaagggcagcuccaucgggcagauguucgagaccaccaugcgcggcgccaagcggauggccauccugggcgacacggccugggacuucgggagccugggcggggucuucaccuccaucggcaaggcgcuccaccagguguucggggccaucuacggcgccgccuucagcggcguguccuggaccaugaagauccugaucggggucgugaucaccuggaucggcaugaacagccgcuccacgagccuguccgugagccugguccucguggggguggucacccuguaccugggcgugauggugcaggcggacuccgggugcgucgugagcuggaagaacaaggagcucaagugcggcagcggcaucuucaucaccgacaacgugcacaccuggacggagcaguacaaguuccagccggagucccccagcaagcuggccuccgccauccagaaggcccacgaggaggggaucugcggcauccggagcgucacccgccuggagaaccucauguggaagcagaucacccccgagcugaaccacauccugaccgagaacgaggugaagcucacgaucaugaccggggacaucaagggcaucaugcaggccgggaagcggucccugcgcccccagccgaccgagcugaaguacagcuggaaggcguggggcaaggccaagaugcucuccaccgagcugcacaaccacacguuccugaucgacggccccgagaccgccgagugccccaacaccaaccgggccuggaacagccucgagguggaggacuacggguucggcgucuucaccacgaacaucuggcugaagcugaaggagcgccaggacguguucugcgacuccaaccucaugagcgccgcgaucaaggacaaccgggccgugcacgccgacaugggguacuggaucgaguccgcccugaacgacaccuggaagaucgagaaggccagcuucaucgaggucaaguccugccacuggcccaagagccacacccugugguccaacggcgugcucgagagcgagaugaucauccccaagaacuucgcgggccccgugucccagcacaacuaccgccccggguaccacacccagaccgccggcccguggcaccuggggcggcuggagauggacuucgacuucugcgagggcacgaccgucguggugaccgaggacugcgggaaccgcggccccagccuccggaccacgaccgccagcggcaagcugaucaccgaguggugcugccgcuccugcacccugccgccccuccgguaccgcggggaggacggcugcugguacgggauggagauccggccgcugaaggagaaggaggagaaccuggucaacagccucgugacggccggccacgggcagaucgacaacuucucccugggcgugcugggcauggcccucuuccuggaggagaugcugcgcacccgggucgggaccaagcacgccauccuccugguggccgugagcuucgucacccugaucacgggcaacauguccuuccgcgaccucgggcgcgugauggugauggucggcgccaccaugaccgacgacaucgggaugggcgugaccuaccuggcccugcucgcggccuucaaggugcggcccacguucgccgccggccugcugcuccgcaagcugaccagcaaggagcugaugaugaccaccaucgggaucguccuccugucccagagcacgauccccgaguccauccuggagcucaccgacgcccuggcgcugggcaugauggugcucaagaucguccggaacauggagaaguaccagcuggccgugaccaucauggccauccugugcgugcccaacgccgucauccuccagaacgccuggaaggugagcugcaccacgcuggcgguggucuccgugagcccgcugcuccugaccuccagccagcagaaggccgacuggaucccccuggcccucaccaucaaggggcugaaccccaccgccaucuuccugacgacccucucccgcaccagcaagaagcgguccuggccccugaacgaggcgaucauggccgugggcauggucagcauccuggccuccagccuccugaagaacgacaucccgaugaccggcccccugguggccgggggccuccugacggugugcuacguccugaccgggcgcagcgccgaccucgagcuggagcgggcggccgacgugcgcugggaggagcaggccgagaucuccggcagcucccccauccugagcaucaccaucuccgaggacgggagcauguccaucaagaacgaggaggaggagcagacccucacgauccugauccggaccggccugcucgugaucagcggccuguuccccgucuccaucccgaucaccgccgccgcgugguaccugugggaggugaagaagcagcgcgccggggugcucugggacguccccuccccgccgcccgugggcaaggccgagcuggaggacggggccuaccggaucaagcagaagggcauccugggguacucccagaucggcgccggcguguacaaggaggggaccuuccacaccauguggcacgucacgcgcggcgcggugcucaugcacaaggggaagcggaucgagcccagcugggccgacgugaagaaggaccugaucuccuacggcgggggcuggaagcuggagggcgaguggaaggagggggaggagguccaggugcucgcccuggagcccggcaagaacccgcgcgccgugcagaccaagcccgggcuguucaagaccaacaccggcacgaucggggccgucagccucgacuucucccccggcaccagcggcucccccaucguggacaagaaggggaagguggucggccuguacgggaacggcguggugacccggagcggcaccuacgucuccgcgaucgcccagacggagaaguccaucgaggacaacccggagaucgaggacgacaucuuccgcaagaagcggcugaccaucauggaccugcaccccggggccggcaagaccaagcgcuaccuccccgccaucgugcgggaggcgaucaagcgcgggcugcggacccugauccucgcccccacgcgcguggucgccgccgagauggaggaggcccugcgcggccugccgauccgguaccagacccccgcgauccgcgccgagcacaccgggcgggagaucguggaccucaugugccacgccaccuucacgaugcgccugcugagccccauccgggugcccaacuacaaccucaucaucauggacgaggcccacuucaccgacccggccuccaucgcggcccgcggcuacaucagcacccgggucgagaugggcgaggccgccgggaucuucaugaccgccacgccgcccggcucccgcgaccccuucccgcagagcaacgcgcccaucauggacgaggagcgggagauccccgagcgcuccuggaacagcgggcacgagugggugaccgacuucaagggcaagaccgugugguucguccccuccaucaaggccgggaacgacaucgccgccugccugcggaagaacggcaagaaggugauccagcugagccgcaagaccuucgacuccgaguacaucaagacgcggaccaacgacugggacuucguggucaccaccgacaucagcgagaugggcgcgaacuucaaggccgagcgcgugaucgacccgcggcgcugcaugaagcccgugauccucacggacggggaggagcgggucauccuggccggccccaugcccgugacccacuccagcgccgcccagcgccgggggcgcgugggccgcaacccgaagaacgagaacgaccaguacaucuacaugggggagccccuggagaacgacgaggacugcgcgcacuggaaggaggccaagaugcuccuggacaacaucaacacccccgagggcaucauccccuccauguucgagccggagcgggagaaggucgacgccaucgacggcgaguaccgccugcgcggggaggcccgcaagaccuucguggaccucaugcggcgcggcgaccugcccgucuggcuggccuaccggguggcggccgaggggaucaacuacgccgaccgccgguggugcuucgacggcgugaagaacaaccagauccucgaggagaacgucgagguggagaucuggacgaaggagggggagcgcaagaagcugaagccccgguggcuggacgcccgcaucuacagcgacccgcucgcccugaaggaguucaaggaguucgcggccggccggaagucccugacccucaaccugaucaccgagaugggccgccugcccaccuucaugacgcagaaggccaagaacgcccucgacaaccuggcggugcugcacaccgccgaggccgggggccgggccuacaaccacgcccucagcgagcugcccgagacccuggagacccuccugcugcucacgcugcuggcgaccgucaccgggggcaucuuccucuuccugauguccggcaaggggaucggcaagaugacccuggggaugugcugcaucaucaccgccagcauccuccugugguacgcccagauccagccccacuggaucgccgccuccaucauccuggaguucuuccucaucgugcugcugaucccggagcccgagaagcagcgcacgccccaggacaaccagcucaccuacguggucaucgcgauccugaccgugguggccgccaccauggccaacgagaugggcuuccuggagaagacgaagaaggacuucgggcucggcagcaucaccacccagcagcccgagagcaacauccuggacaucgaccugcggccggccuccgcguggacccucuacgccgucgccacgaccuucaucacccccaugcugcgccacagcaucgagaacuccagcgugaacgugucccugaccgccaucgccaaccaggcgacgguccucaugggccuggggaagggcuggccccugagcaagauggacaucggggugccccuccuggccaucggcugcuacucccaggugaacccgaucacccugaccgccgcccuccugcugcucgucgcgcacuacgccaucaucgggcccggccugcaggccaaggccacccgggaggcccagaagcgcgcggccgccggcaucaugaagaaccccacgguggacgggaugaccgugaucgaccuggaccccaucccguacgaccccaaguucgagaagcagcucggccaggucaugcugcuggugcucugcgugacccagguccugaugaugcggaccacgugggcccugugcgaggcccucacccuggcgaccgggcccaucagcacccugugggagggcaaccccgggcgcuucuggaacacgaccaucgccguguccauggccaacaucuuccgcggcagcuaccucgccggcgccgggcugcuguucuccaucaugaagaacaccgcgaacacccggcgcggcacggggaacaccggcgagacccucggcgagaaguggaagaaccggcugaacgcccugggcaagagcgaguuccagaucuacaagaaguccggcauccaggagguggaccgcacccucgccaaggaggggaucaagcggggcgagacggaccaccacgccgucagccgcggguccgcgaagcugcggugguucguggagcgcaaccuggugaccccggagggcaaggucguggaccucggcugcgggcggggcggguggagcuacuacugcggcgggcugaagaacgugaaggaggucaagggccugaccaagggcgggcccggccacgaggagcccauccccauguccaccuacggguggaaccucgugcgccugcagagcggcguggacgucuucuucacgccgcccgagaagugcgacacccugcucugcgacaucggggaguccagccccaaccccaccguggaggccggccggacccugcgcgugcugaaccucgucgagaacuggcugaacaacaacacccaguucugcaucaaggugcugaacccguacaugcccagcgugaucgagaagauggaggcccugcagcggaaguacggcggggcccucguccgcaacccccugucccggaacagcacgcacgagauguacuggguguccaacgccagcggcaacaucguguccagcgucaacaugaucucccgcaugcugaucaaccgguucaccaugcgccacaagaaggcgaccuacgagccggacguggaccucgggagcggcacccggaacaucgggaucgaguccgagacgcccaaccuggacaucaucggcaagcgcaucgagaagaucaagcaggagcacgagaccagcuggcacuacgaccaggaccaccccuacaagaccugggccuaccacggcuccuacgagaccaagcagacggggagcgccuccagcauggugaacggcgucgugcgccugcucaccaagcccugggacgugaucccgauggucacccagauggccaugaccgacacgacccccuucgggcagcagcggguguucaaggagaaggucgacacccgcacccaggagcccaaggagggcacgaagaagcugaugaagaucaccgccgaguggcuguggaaggagcucggcaagaagaagacgccccggaugugcacccgcgaggaguucacgcggaaggugcgcuccaacgcggcccugggggccaucuucaccgacgagaacaaguggaaguccgcccgggaggccguggaggacuccggcuucugggagcuggucgacaaggagcgcaaccuccaccuggaggggaagugcgagaccugcguguacaacaugaugggcaagcgggagaagaagcugggggaguucggcaaggcgaagggcagccgcgccaucugguacauguggcucggggcccgguuccuggaguucgaggcccugggcuuccucaacgaggaccacugguucucccgcgagaacagccugagcgggguggagggcgaggggcugcacaagcucggcuacauccugcgggacgucuccaagaaggagggcggggcgauguacgccgacgacaccgccggcugggacacgcgcaucacccuggaggaccucaagaacgaggagauggugaccaaccacauggagggggagcacaagaagcuggccgaggccaucuucaagcugaccuaccagaacaaggugguccgggugcagcgcccgacgccccggggcaccgugauggacaucaucagccgccgggaccagcgcggguccggccaggucgugaccuacggccucaacaccuucacgaacauggaggcgcagcugauccggcagauggagggggagggcguguucaagagcauccagcagcugaccgucaaggaggagaucgccgugaagaacuggcucauccgcguggggcgcgagcggcugucccgcauggccaucagcggcgacgacugcgucgugaagccccuggacgaccgguucgccuccgcccucaccgcgcugaacgacaugggcaaggugcgcaaggacauccagcagugggagcccagccggggguggaacgacuggacccaggucccguucugcucccaccacuuccacgagcugaucaugaaggacggccgcgugcucgugguccccugccggaaccaggacgagcugaucgggcgcgcccggaucagccagggcgccggguggucccugcgcgagacggccugccucggcaagagcuacgcccagauguggucccugauguacuuccaccggcgcgaccugcggcucgcggccaacgccaucugcagcgccgugcccucccacuggauccccaccagccgcaccaccugguccauccacgccacccacgaguggaugacgaccgaggacaugcugaccguguggaaccgggucuggauccaggagaacccguggauggaggacaagacccccguggagagcugggaggagauccccuaccugggcaagcgcgaggaccaguggugcgggagccucaucggccugacgucccgggcgaccugggccaagaacauccagaccgccaucaaccaggugcgcagccugaucgggaacgaggaguacaccgacuacaugcccuccaugaagcgguuccgccgcgaggaggaggaggccggcguccucugguga

SEQ ID NO: 9063 - RNA, 9876 nt, Artificial Sequence
  derived and/or modified CDS sequence (opt1) from DENV-2__KX380835__SS-prME
accgccgggaucaucaucaugaugauccccaccgugauggccuuccaccugaccacccggaacggggagccccacaugaucgugagccggcaggagaagggcaagagccuccuguucaagaccgagaacggggugaacaugugcacccugauggcgauggaccucggcgagcugugcgaggacaccaucaccuacaacugcccccugcuccgccagaacgagcccgaggacaucgacugcuggugcaacagcaccagcaccugggugaccuacgggaccugcaccgccaccggcgagcaccggcgcgagaagcggagcgucgcccuggugccccacgugggcauggggcuggagacccgcaccgagaccuggauguccagcgagggcgccuggaagcacgcccagcggaucgagaccuggguccuccgccaccccggguucaccgugauggcggccauccuggccuacaccaucggcaccaccuacuuccagcgggugcugaucuucauccuccugaccgccgucgcgcccuccaugaccaugcgcugcaucgggaucagcaaccgggacuucguggagggcguguccggcgggagcugggucgacaucgugcuggagcacggcuccugcgugaccaccauggccaagaacaagcccacgcucgacuucgagcugaucaagaccgaggccaagcaccccgccacccugcgcaaguacugcaucgaggccaagcucaccaacacgaccaccgcgagccggugcccgacccagggggagcccucccugaacgaggagcaggacaagcgcuucgucugcaagcacagcaugguggaccggggcuggggcaacgggugcggccuguucgggaagggcgggaucgugacgugcgccauguucacgugcaagaagaacauggagggcaagaucguccagcccgagaaccucgaguacaccaucgugaucacgccccacuccggcgaggagaacgccguggggaacgacacgggcaagcacgggaaggagaucaaggucaccccgcagagcuccaucaccgaggccgagcugaccggcuacgggaccgccacgauggagugcagcccccgcaccggccuggacuucaacgagauggugcuccugcagauggagaacaaggcguggcuggugcaccggcagugguuccucgaccugccccugcccuggcucccgggcgccgacacccagggguccaacuggauccagaaggagacccuggucacguucaagaacccccacgccaagaagcaggacguggucgugcugggcagccaggagggggccaugcacaccgcccucaccggcgcgaccgagauccagaugagcuccgggaaccugcuguucacgggccaccucaagugccgccugcggauggacaagcugcagcucaagggcaugagcuacuccaugugcaccgggaaguucaagguggucaaggagaucgccgagacccagcacggcaccaucgugauccgcgugcaguacgagggggacggcagccccugcaagauccccuucgagaucauggaccuggagaagcggcacguccugggccgccucaucacggugaacccgaucgugaccgagaaggacucccccgucaacaucgaggccgagccgcccuucggggacagcuacaucaucaucggcguggagccggggcagcugaagcuguccugguucaagaagggcagcuccaucgggcagauguucgagaccaccaugcgcggcgccaagcggauggccauccucggcgacacggcgugggacuucgggagccugggcgggguguucaccuccaucggcaaggcccugcaccaggucuucggggccaucuacggcgccgcguucagcggcguguccuggaccaugaagauccucaucgggguggucaucaccuggaucggcaugaacagccgcuccacgagccuguccgugagccuggugcuggucgggaucgugacccucuaccugggcgugaugguccaggccgacuccgggugcguggugagcuggaagaacaaggagcugaagugcggcagcggcaucuucaucaccgacaacguccacaccuggacggagcaguacaaguuccagcccgagucccccagcaagcucgccuccgccauccagaaggcccacgaggaggggaucugcggcauccggagcgugacccgccuggagaaccugauguggaagcagaucacccccgagcucaaccacauccuguccgagaacgaggugaagcugaccaucaugacgggggacaucaagggcaucaugcaggcggggaagcggagccuccgcccgcagcccaccgagcugaaguacuccuggaaggccuggggcaaggccaagaugcugagcaccgagcuccacaaccacaccuuccugaucgacggccccgagacggccgagugcccgaacaccaaccgggccuggaacucccuggaggucgaggacuacggguucggcguguucaccaccaacaucuggcucaagcugaaggagcgccaggacguguucugcgacagcaagcugauguccgcggccaucaaggacaaccgggccguccacgccgacaugggguacuggaucgagagcgcccucaacgacacguggaagaucgagaaggcguccuucaucgaggucaagagcugccacuggcccaagucccacacccuguggagcaacggcgugcuggaguccgagaugaucauccccaagaacuucgccggccccgugagccagcacaacuaccgcccgggguaccacacccagaccgccggccccuggcaccucgggcggcuggagauggacuucgacuucugcgagggcaccacggugguggucaccgaggacugcgggaaccgcggccccagccugcggaccaccacggccuccggcaagcucaucaccgaguggugcugccgcagcugcacccugcccccgcugcgguaccgcggggaggacggcugcugguacgggauggagauccggccccucaaggagaaggaggagaaccuggugaacucccuggugaccgcgggccacgggcagaucgacaacuucagccucggcguccugggcauggcccuguuccucgaggagaugcugcgcacgcggguggggaccaagcacgccauccugcucguggccgucuccuucgugacccugaucaccggcaacaugagcuuccgcgaccuggggcgcgugauggucauggugggcgccacgaugaccgacgacaucgggaugggcgugaccuaccucgcgcugcuggccgccuucaagguccggcccaccuucgccgccggccuccugcugcgcaagcucacguccaaggagcugaugaugaccaccaucgggaucgugcugcucagccaguccaccauccccgagacgauccuggagcugaccgacgcgcucgcccugggcaugauggugcugaagaucguccggaacauggagaaguaccagcucgccgugaccaucauggccauccugugcgucccgaacgccgugauccugcagaacgcguggaaggugagcugcaccauccucgccgucguguccgugagcccccugcugcucacguccagccagcagaaggccgacuggaucccccuggcccugaccaucaaggggcucaaccccaccgcgaucuuccugaccacgcugucccgcaccagcaagaagcgguccuggccgcucaacgaggccaucauggccgucggcauggugagcauccuggccuccagccugcucaagaacgacauccccaugaccggcccccugguggccgggggccugcucaccgucugcuacgugcugacggggcgcagcgcggaccuggagcucgagcgggccgccgacgugcgcugggaggagcaggccgagaucuccggcagcucccccauccugagcaucaccaucuccgaggacgggagcauguccaucaagaacgaggaggaggagcagacccugaccauccucauccggacgggccugcuggucaucagcggccucuucccgguguccauccccaucaccgccgcggccugguaccugugggaggugaagaagcagcgcgccgggguccugugggacgugcccagcccgccgcccgugggcaaggccgagcucgaggacggggccuaccggaucaagcagaagggcauccugggguacucccagaucggcgcgggcgucuacaaggaggggaccuuccacaccauguggcacgugacccgcggcgccgugcugaugcacaaggggaagcggaucgagcccagcugggccgacgucaagaaggaccucaucuccuacggcgggggcuggaagcuggagggcgaguggaaggagggggaggagguccaggugcuggcccucgagcccggcaagaacccccgcgccguccagacgaagcccgggcuguucaagaccaacaccggcaccaucggggcggugagccuggacuucucccccggcacgagcggcucccccaucguggacaagaaggggaaggucgugggccucuacgggaacggcguggucacccggagcggcaccuacguguccgccaucgcccagaccgagaaguccaucgaggacaaccccgagaucgaggacgacaucuuccgcaagaagcggcugacgaucauggaccugcaccccggggccggcaagaccaagcgcuaccugcccgcgaucgugcgggaggccaucaagcgcgggcuccggacccugauccuggccccgacccgcgucguggccgccgagauggaggaggcgcuccgcggccugcccauccgguaccagacgcccgccauccgcgccgagcacaccgggcgggagaucguggaccugaugugccacgccaccuucaccaugcgccuccugagccccauccgggucccgaacuacaaccugaucaucauggacgaggcccacuucacggaccccgcguccaucgccgcccgcggcuacaucagcacccggguggagaugggcgaggccgccgggaucuucaugaccgcgacgccgcccggcucccgcgacccguucccccagagcaacgcccccaucauggacgaggagcgggagauccccgagcgcuccuggaacagcgggcacgagugggugacggacuucaagggcaagaccgucugguucgugccguccaucaaggccgggaacgacaucgccgcgugccuccggaagaacggcaagaaggugauccagcugagccgcaagaccuucgacuccgaguacaucaagacccggacgaacgacugggacuucgucgugaccaccgacaucagcgagaugggcgccaacuucaaggccgagcgcgugaucgacccccggcgcugcaugaagcccgucauccugaccgacggggaggagcgggugauccucgccggccccaugccggugacgcacuccagcgccgcgcagcgccgggggcgcgucggccgcaaccccaagaacgagaacgaccaguacaucuacaugggggagccccuggagaacgacgaggacugcgcccacuggaaggaggccaagaugcugcucgacaacaucaacacccccgagggcaucaucccguccauguucgagcccgagcgggagaagguggacgccaucgacggcgaguaccgccugcgcggggaggcccgcaagaccuucguggaccugaugcggcgcggcgaccuccccgucuggcuggcguaccggguggccgccgaggggaucaacuacgccgaccgccgguggugcuucgacggcgucaagaacaaccagauccuggaggagaacguggagguggagaucuggaccaaggagggggagcgcaagaagcucaagccgcgguggcuggacgcccgcaucuacagcgacccccuggcgcucaaggaguucaaggaguucgccgccggccggaagucccugacgcugaaccucaucaccgagaugggccgccugcccaccuucaugacccagaaggcccggaacgcgcuggacaaccucgccguccugcacacggccgaggccgggggccgcgccuacaaccacgcgcugagcgagcuccccgagacccuggagacccugcuccugcugacccuccuggccacggugaccgggggcaucuuccuguuccucauguccggcaaggggaucggcaagaugacccuggggaugugcugcaucaucaccgccagcauccugcucugguacgcccagauccagccgcacuggaucgccgcguccaucauccuggaguucuuccugaucgugcuccugauccccgagcccgagaagcagcggacgccccaggacaaccagcugacguacgucgugaucgccauccucaccguggucgccgccaccauggccaacgagaugggcuuccuggagaagaccaagaaggacuucgggcugggcagcaucacgacccagcagccggacagcaacauccucgacaucgaccugcgccccgcguccgccuggacccuguacgccguggccaccacguucaucacccccaugcuccggcacagcaucgagaacuccagcgugaacgucucccugaccgccaucgcgaaccaggccaccgugcugaugggccucgggaagggcuggccccugagcaagauggacaucggggugccgcugcucgccaucggcugcuacucccaggucaaccccaucacgcugaccgccgcgcugcuccugcugguggcccacuacgccaucaucgggcccggccuccaggccaaggccacccgcgaggcgcagaagcgggccgccgccggcaucaugaagaaccccaccguggacgggaugacggucaucgaccuggacccgauccccuacgaccccaaguucgagaagcagcugggccaggugaugcuccuggugcugugcgucacccaggugcucaugaugcgcaccaccugggcccugugcgaggcgcugacgcucgccaccgggcccaucagcacccugugggagggcaacccggggcgcuucuggaacaccacgaucgccguguccauggccaacaucuuccggggcagcuaccuggccggcgcggggcuccuguucuccaucaugaagaacaccgccaacacccgccggggcaccgggaacacgggcgagacccugggcgagaaguggaagaaccgccucaacgcccugggcaagagcgaguuccagaucuacaagaaguccggcauccaggaggucgaccggacccuggccaaggaggggaucaagcgcggcgagaccgaccaccacgcggugagccggggguccgccaagcuccgcugguucguggagcggaaccuggucacgcccgagggcaaggugguggaccugggcugcgggcgcggcggguggagcuacuacugcggcgggcucaagaacgucaaggaggugaagggccugaccaagggcgggcccggccacgaggagcccaucccgauguccaccuacggguggaaccuggugcggcuccagagcggcgucgacguguucuucacgccgcccgagaagugcgacacgcugcugugcgacaucggggaguccagccccaacccgaccguggaggccggccgcacccuccggguccugaaccugguggagaacuggcucaacaacaacacccaguucugcaucaaggugcugaaccccuacaugcccagcgucaucgagaagauggaggcccugcagcgcaaguacggcggggcccuggugcggaacccgcucucccgcaacagcacccacgagauguacuggguguccaacgcgagcggcaacaucgucuccagcgugaacaugaucucccggaugcugaucaaccgcuucacgaugaagcacaagaaggccaccuacgagcccgacguggaccuggggagcggcacccggaacaucgggaucgaguccgagacccccaaccucgacaucaucggcaagcgcaucgagaagaucaagcaggagcacgagacgagcuggcacuacgaccaggaccaccccuacaagaccugggccuaccacggcuccuacgagaccaagcagaccgggagcgccuccagcauggucaacggcguggugcgccugcugacgaagccgugggacgucauccccauggugacccagauggccaugaccgacaccacgcccuucgggcagcagcggguguucaaggagaaggucgacacccgcacccaggagcccaaggagggcaccaagaagcucaugaagaucacggcggaguggcuguggaaggagcugggcaagaagaagaccccgcggaugugcacccgcgaggaguucacccggaaggugcgcuccaacgccgcccucggggccaucuucacggacgagaacaaguggaaguccgcccgggaggcggucgaggacuccggcuucugggagcugguggacaaggagcgcaaccugcaccucgaggggaagugcgagaccugcguguacaacaugaugggcaagcgggagaagaagcugggggaguucggcaaggccaagggcagccgcgccaucugguacauguggcugggggcccgguuccucgaguucgaggcgcugggcuuccugaacgaggaccacugguucucccgcgagaacagccucagcggggucgagggcgaggggcugcacaagcugggcuacauccuccgggacguguccaagaaggagggcggggccauguacgccgacgacaccgccggcugggacacccgcaucacgcuggaggaccugaagaacgaggagauggugaccaaccacauggagggggagcaccggaagcucgccgaggcgaucuuccgccugaccuaccagaacaaggucgugcgggugcagcgccccacgccccggggcacggucauggacaucaucagccgccgggaccagcgcggguccggccagguggugaccuacggccugaacaccuucaccaacauggaggcccagcucauccgccagauggagggggagggcgucuucaagagcauccagcaccugacggugaccgaggagaucgccgugaagaacuggcuggagcgggucgggcgcgagcggcucucccgcauggccaucagcggcgacgacugcguggugaagccccuggacgaccgguucgccuccgcgcugaccgcccucaacgacaugggcaagguccgcaaggacauccagcagugggagccgagccggggguggaacgacuggacccaggugcccuucugcucccaccacuuccacgagcugaucaugaaggacggccgcgugcuggucgugcccugccggaaccaggacgagcucaucgggcgcgcccggaucagccagggcgccggguggucccugcgcgagacggccugccugggcaagagcuacgcgcagauguggucccucauguacuuccaccggcgcgaccugcggcuggccgccaacgccaucugcagcgccgugcccucccacugggucccgaucagccgcaccaccugguccauccacgcgacccacgaguggaugaccacggaggacaugcucaccguguggaaccggguguggauccaggagaaccccuggauggaggacaagacccccgucgagagcugggaggagauccccuaccugggcaagcgcgaggaccaguggugcgggagccugaucggccucaccucccgggccacgugggccaagaacauccagaccgccaucaaccaggugcgcagccugaucgggaacgaggaguacaccgacuacaugccguccaugaagcgcuuccggcgcgaggaggaggaggcgggcgugcugugguga

SEQ ID NO: 9064 - RNA, 9876 nt, Artificial Sequence
  derived and/or modified CDS sequence (opt1) from DENV-2__KX380836__SS-prME
accgccgggaucaucaucaugaugauccccaccgugauggccuuccaccugaccacccgcaacggggagccccacaugaucgugagccggcaggagaagggcaagagccuccuguucaagaccgagaacggggugaacaugugcacccugauggcgauggaccucggcgagcugugcgaggacaccaucaccuacaacugcccccugcuccgccagaacgagcccgaggacaucgacugcuggugcaacagcaccagcaccugggugaccuacgggaccugcaccgccaccggcgagcaccggcgcgagaagcggagcgucgcccuggugccccacgugggcauggggcuggagacccgcaccgagaccuggauguccagcgagggcgccuggaagcacgcccagcggaucgagaccuggguccuccgccaccccggguucaccgugauggcggccauccuggccuacaccaucggcaccaccuacuuccagcgggugcugaucuucauccuccugaccgccgucgcgcccuccaugaccaugcgcugcaucgggaucagcaaccgggacuucguggagggcguguccggcgggagcugggucgacaucgugcuggagcacggcuccugcgugaccaccauggccaagaacaagcccacgcucgacuucgagcugaucaagaccgaggccaagcaccccgccacccugcgcaaguacugcaucgaggccaagcucaccaacacgaccaccgcgagccggugcccgacccagggggagcccucccugaacgaggagcaggacaagcgcuucgucugcaagcacagcaugguggaccggggcuggggcaacgggugcggccuguucgggaagggcgggaucgugacgugcgccauguucacgugcaagaagaacauggagggcaagaucguccagcccgagaaccucgaguacaccaucgugaucacgccccacuccggcgaggagaacgccguggggaacgacacgggcaagcacgggaaggagaucaaggucaccccgcagagcuccaucaccgaggccgagcugaccggcuacgggaccgccacgauggagugcagcccccgcaccggccuggacuucaacgagauggugcuccugcagauggagaacaaggcguggcuggugcaccggcagugguuccucgaccugccccugcccuggcucccgggcgccgacacccagggguccaacuggauccagaaggagacccuggucacguucaagaacccccacgccaagaagcaggacguggucgugcugggcagccaggagggggccaugcacaccgcccucaccggcgcgaccgagauccagaugagcuccgggaaccugcuguucacgggccaccucaagugccgccugcggauggacaagcugcagcucaagggcaugagcuacuccaugugcaccgggaaguucaagguggucaaggagaucgccgagacccagcacggcaccaucgugauccgcgugcaguacgagggggacggcagccccugcaagauccccuucgagaucauggaccuggagaagcggcacguccugggccgccucaucacggugaacccgaucgugaccgagaaggacucccccgucaacaucgaggccgagccgcccuucggggacagcuacaucaucaucggcguggagccggggcagcugaagcuguccugguucaagaagggcagcuccaucgggcagauguucgagaccaccaugcgcggcgccaagcggauggccauccucggcgacacggcgugggacuucgggagccugggcgggguguucaccuccaucggcaaggcccugcaccaggucuucggggccaucuacggcgccgcguucagcggcguguccuggaccaugaagauccucaucgggguggucaucaccuggaucggcaugaacagccgcuccacgagccuguccgugagccuggugcuggucgggaucgugacccucuaccugggcgugaugguccaggccgacuccgggugcguggugagcuggaagaacaaggagcugaagugcggcagcggcaucuucaucaccgacaacguccacaccuggacggagcaguacaaguuccagcccgagucccccagcaagcucgccuccgccauccagaaggcccacgaggaggggaucugcggcauccggagcgugacccgccuggagaaccugauguggaagcagaucacccccgagcucaaccacauccuguccgagaacgaggugaagcugaccaucaugacgggggacaucaagggcaucaugcaggcggggaagcggagccuccgcccgcagcccaccgagcugaaguacuccuggaaggccuggggcaaggccaagaugcugagcaccgagcuccacaaccacaccuuccugaucgacggccccgagacggccgagugcccgaacaccaaccgggccuggaacucccuggaggucgaggacuacggguucggcguguucaccaccaacaucuggcucaagcugaaggagcgccaggacguguucugcgacagcaagcugauguccgcggccaucaaggacaaccgggccguccacgccgacaugggguacuggaucgagagcgcccucaacgacacguggaagaucgagaaggcguccuucaucgaggucaagagcugccacuggcccaagucccacacccuguggagcaacggcgugcuggaguccgagaugaucauccccaagaacuucgccggccccgugagccagcacaacuaccgcccgggguaccacacccagaccgccggccccuggcaccucgggcggcuggagauggacuucgacuucugcgagggcaccacggugguggucaccgaggacugcgggaaccgcggccccagccugcggaccaccacggccuccggcaagcucaucaccgaguggugcugccgcagcugcacccugcccccgcugcgguaccgcggggaggacggcugcugguacgggauggagauccggccccucaaggagaaggaggagaaccuggugaacucccuggugaccgcgggccacgggcagaucgacaacuucagccucggcguccugggcauggcccuguuccucgaggagaugcugcgcacgcggguggggaccaagcacgccauccugcucguggccgucuccuucgugacccugaucaccggcaacaugagcuuccgcgaccuggggcgcgugauggucauggugggcgccacgaugaccgacgacaucgggaugggcgugaccuaccucgcgcugcuggccgccuucaagguccggcccaccuucgccgccggccuccugcugcgcaagcucacguccaaggagcugaugaugaccaccaucgggaucgugcugcucagccaguccaccauccccgagacgauccuggagcugaccgacgcgcucgcccugggcaugauggugcugaagaucguccggaacauggagaaguaccagcucgccgugaccaucauggccauccugugcgucccgaacgccgugauccugcagaacgcguggaaggugagcugcaccauccucgccgucguguccgugagcccccugcugcucacguccagccagcagaaggccgacuggaucccccuggcccugaccaucaaggggcucaaccccaccgcgaucuuccugaccacgcugucccgcaccagcaagaagcgguccuggccgcucaacgaggccaucauggccgucggcauggugagcauccuggccuccagccugcucaagaacgacauccccaugaccggcccccugguggccgggggccugcucaccgucugcuacgugcugacggggcgcagcgcggaccuggagcucgagcgggccgccgacgugcgcugggaggagcaggccgagaucuccggcagcucccccauccugagcaucaccaucuccgaggacgggagcauguccaucaagaacgaggaggaggagcagacccugaccauccucauccggacgggccugcuggucaucagcggccucuucccgguguccauccccaucaccgccgcggccugguaccugugggaggugaagaagcagcgcgccgggguccugugggacgugcccagcccgccgcccgugggcaaggccgagcucgaggacggggccuaccggaucaagcagaagggcauccugggguacucccagaucggcgcgggcgucuacaaggaggggaccuuccacaccauguggcacgugacccgcggcgccgugcugaugcacaaggggaagcggaucgagcccagcugggccgacgucaagaaggaccucaucuccuacggcgggggcuggaagcuggagggcgaguggaaggagggggaggagguccaggugcuggcccucgagcccggcaagaacccccgcgccguccagacgaagcccgggcuguucaagaccaacaccggcaccaucggggcggugagccuggacuucucccccggcacgagcggcucccccaucguggacaagaaggggaaggucgugggccucuacgggaacggcguggucacccggagcggcaccuacguguccgccaucgcccagaccgagaaguccaucgaggacaaccccgagaucgaggacgacaucuuccgcaagaagcggcugacgaucauggaccugcaccccggggccggcaagaccaagcgcuaccugcccgcgaucgugcgggaggccaucaagcgcgggcuccggacccugauccuggccccgacccgcgucguggccgccgagauggaggaggcgcuccgcggccugcccauccgguaccagacgcccgccauccgcgccgagcacaccgggcgggagaucguggaccugaugugccacgccaccuucaccaugcgccuccugagccccauccgggucccgaacuacaaccugaucaucauggacgaggcccacuucacggaccccgcguccaucgccgcccgcggcuacaucagcacccggguggagaugggcgaggccgccgggaucuucaugaccgcgacgccgcccggcucccgcgacccguucccccagagcaacgcccccaucauggacgaggagcgggagauccccgagcgcuccuggaacagcgggcacgagugggugacggacuucaagggcaagaccgucugguucgugccguccaucaaggccgggaacgacaucgccgcgugccuccggaagaacggcaagaaggugauccagcugagccgcaagaccuucgacuccgaguacaucaagacccggacgaacgacugggacuucgucgugaccaccgacaucagcgagaugggcgccaacuucaaggccgagcgcgugaucgacccccggcgcugcaugaagcccgucauccugaccgacggggaggagcgggugauccucgccggccccaugccggugacgcacuccagcgccgcgcagcgccgggggcgcgucggccgcaaccccaagaacgagaacgaccaguacaucuacaugggggagccccuggagaacgacgaggacugcgcccacuggaaggaggccaagaugcugcucgacaacaucaacacccccgagggcaucaucccguccauguucgagcccgagcgggagaagguggacgccaucgacggcgaguaccgccugcgcggggaggcccgcaagaccuucguggaccugaugcggcgcggcgaccuccccgucuggcuggcguaccggguggccgccgaggggaucaacuacgccgaccgccgguggugcuucgacggcgucaagaacaaccagauccuggaggagaacguggagguggagaucuggaccaaggagggggagcgcaagaagcucaagccgcgguggcuggacgcccgcaucuacagcgacccccuggcgcucaaggaguucaaggaguucgccgccggccggaagucccugacgcugaaccucaucaccgagaugggccgccugcccaccuucaugacccagaaggccaagaacgcgcuggacaaccucgccguccugcacacggccgaggccgggggccgggccuacaaccacgcgcugagcgagcuccccgagacccuggagacccugcuccugcugacccuccuggccacggugaccgggggcaucuuccuguuccucauguccggcaaggggaucggcaagaugacccuggggaugugcugcaucaucaccgccagcauccugcucugguacgcccagauccagccgcacuggaucgccgcguccaucauccuggaguucuuccugaucgugcuccugauccccgagcccgagaagcagcgcacgccccaggacaaccagcugacguacgucgugaucgccauccucaccguggucgccgccaccauggccaacgagaugggcuuccuggagaagaccaagaaggacuucgggcugggcagcaucacgacccagcagccggagagcaacauccucgacaucgaccugcggcccgcguccgccuggacccuguacgccguggccaccacguucaucacccccaugcuccgccacagcaucgagaacuccagcgugaacgucucccugaccgccaucgcgaaccaggccaccgugcugaugggccucgggaagggcuggccccugagcaagauggacaucggggugccgcugcucgccaucggcugcuacucccaggucaaccccaucacgcugaccgccgcgcugcuccugcugguggcccacuacgccaucaucgggcccggccuccaggccaaggccacccgggaggcgcagaagcgcgccgccgccggcaucaugaagaaccccaccguggacgggaugacggucaucgaccuggacccgauccccuacgaccccaaguucgagaagcagcugggccaggugaugcuccuggugcugugcgucacccaggugcucaugaugcggaccaccugggcccugugcgaggcgcugacgcucgccaccgggcccaucagcacccugugggagggcaacccggggcgcuucuggaacaccacgaucgccguguccauggccaacaucuuccgcggcagcuaccuggccggcgcggggcuccuguucuccaucaugaagaacaccgccaacacccggcgcggcaccgggaacacgggcgagacccugggcgagaaguggaagaaccggcucaacgcccugggcaagagcgaguuccagaucuacaagaaguccggcauccaggaggucgaccgcacccuggccaaggaggggaucaagcggggcgagaccgaccaccacgcggugagccgcggguccgccaagcuccggugguucguggagcgcaaccuggucacgcccgagggcaaggugguggaccugggcugcgggcggggcggguggagcuacuacugcggcgggcucaagaacgucaaggaggugaagggccugaccaagggcgggcccggccacgaggagcccaucccgauguccaccuacggguggaaccuggugcgccuccagagcggcgucgacguguucuucacgccgcccgagaagugcgacacgcugcugugcgacaucggggaguccagccccaacccgaccguggaggccggccggacccuccgcguccugaaccugguggagaacuggcucaacaacaacacccaguucugcaucaaggugcugaaccccuacaugcccagcgucaucgagaagauggaggcccugcagcggaaguacggcggggcccuggugcgcaacccgcucucccggaacagcacccacgagauguacuggguguccaacgcgagcggcaacaucgucuccagcgugaacaugaucucccgcaugcugaucaaccgguucacgaugaagcacaagaaggccaccuacgagcccgacguggaccuggggagcggcacccgcaacaucgggaucgaguccgagacccccaaccucgacaucaucggcaagcggaucgagaagaucaagcaggagcacgagacgagcuggcacuacgaccaggaccaccccuacaagaccugggccuaccacggcuccuacgagaccaagcagaccgggagcgccuccagcauggucaacggcguggugcgccugcugacgaagccgugggacgucauccccauggugacccagauggccaugaccgacaccacgcccuucgggcagcagcgcguguucaaggagaaggucgacacccggacccaggagcccaaggagggcaccaagaagcucaugaagaucacggcggaguggcuguggaaggagcugggcaagaagaagaccccgcgcaugugcacccgggaggaguucacccgcaaggugcgguccaacgccgcccucggggccaucuucacggacgagaacaaguggaaguccgcccgcgaggcggucgaggacuccggcuucugggagcugguggacaaggagcggaaccugcaccucgaggggaagugcgagaccugcguguacaacaugaugggcaagcgcgagaagaagcugggggaguucggcaaggccaagggcagccgggccaucugguacauguggcugggggcccgcuuccucgaguucgaggcgcugggcuuccugaacgaggaccacugguucucccgggagaacagccucagcggggucgagggcgaggggcugcacaagcugggcuacauccuccgcgacguguccaagaaggagggcggggccauguacgccgacgacaccgccggcugggacacccggaucacgcuggaggaccugaagaacgaggagauggugaccaaccacauggagggggagcaccgcaagcucgccgaggcgaucuuccggcugaccuaccagaacaaggucgugcgcgugcagcggcccacgccccggggcacggucauggacaucaucagccggcgcgaccagcggggguccggccagguggugaccuacggccugaacaccuucaccaacauggaggcccagcucauccgccagauggagggggagggcgucuucaagagcauccagcaccugacggugaccgaggagaucgccgugaagaacuggcuggagcgcgucgggcgggagcgccucucccggauggccaucagcggcgacgacugcguggugaagccccuggacgaccgcuucgccuccgcgcugaccgcccucaacgacaugggcaagguccggaaggacauccagcagugggagccgagccgcggguggaacgacuggacccaggugcccuucugcucccaccacuuccacgagcugaucaugaaggacggccgggugcuggucgugcccugccgcaaccaggacgagcucaucgggcgggcccgcaucagccagggcgccggguggucccugcgggagacggccugccugggcaagagcuacgcgcagauguggucccucauguacuuccaccgccgggaccugcgccuggccgccaacgccaucugcagcgccgugcccucccacugggucccgaucagccggaccaccugguccauccacgcgacccacgaguggaugaccacggaggacaugcucaccguguggaaccgcguguggauccaggagaaccccuggauggaggacaagacccccgucgagagcugggaggagauccccuaccugggcaagcgggaggaccaguggugcgggagccugaucggccucaccucccgcgccacgugggccaagaacauccagaccgccaucaaccaggugcggagccugaucgggaacgaggaguacaccgacuacaugccguccaugaagcgcuuccgccgggaggaggaggaggcgggcgugcugugguga

SEQ ID NO: 9065 - RNA, 9876 nt, Artificial Sequence
  derived and/or modified CDS sequence (opt1) from DENV-2__KX380838__SS-prME
accgccgggaucaucaucaugaugauccccaccgugauggccuuccaccugaccacccggaacggggagccccacaugaucgugagccggcaggagaagggcaagagccuccuguucaagaccgagaacggggugaacaugugcacccugauggcgauggaccucggcgagcugugcgaggacaccaucaccuacaacugcccccugcuccgccagaacgagcccgaggacaucgacugcuggugcaacagcaccagcaccugggugaccuacgggaccugcaccgccaccggcgagcaccggcgcgagaagcggagcgucgcccuggugccccacgugggcauggggcuggagacccgcaccgagaccuggauguccagcgagggcgccuggaagcacgcccagcggaucgagaccuggguccuccgccaccccggguucacggugauggcggccauccuggccuacaccaucggcaccaccuacuuccagcgggugcugaucuucauccuccugacggccgucgcgcccuccaugaccaugcgcugcaucgggaucagcaaccgggacuucguggagggcguguccggcgggagcugggucgacaucgugcuggagcacggcuccugcgugaccaccauggccaagaacaagcccacgcucgacuucgagcugaucaagaccgaggccaagcaccccgccacccugcgcaaguacugcaucgaggccaagcucaccaacacgaccaccgcgagccggugcccgacccagggggagcccucccugaacgaggagcaggacaagcgcuucgucugcaagcacagcaugguggaccggggcuggggcaacgggugcggccuguucgggaagggcgggaucgugacgugcgccauguucacgugcaagaagaacauggagggcaagaucguccagcccgagaaccucgaguacaccaucgugaucacgccccacuccggcgaggagaacgccguggggaacgacacgggcaagcacgggaaggagaucaaggucaccccgcagagcuccaucaccgaggccgagcugaccggcuacgggaccgccacgauggagugcagcccccgcaccggccuggacuucaacgagauggugcuccugcagauggagaacaaggcguggcuggugcaccggcagugguuccucgaccugccccugcccuggcucccgggcgccgacacccagggguccaacuggauccagaaggagacccuggucacguucaagaacccccacgccaagaagcaggacguggucgugcugggcagccaggagggggccaugcacaccgcccucaccggcgcgaccgagauccagaugagcuccgggaaccugcuguucacgggccaccucaagugccgccugcggauggacaagcugcagcucaagggcaugagcuacuccaugugcaccgggaaguucaagguggucaaggagaucgccgagacccagcacggcaccaucgugauccgcgugcaguacgagggggacggcagccccugcaagauccccuucgagaucauggaccuggagaagcggcacguccugggccgccucaucacggugaacccgaucgugaccgagaaggacucccccgucaacaucgaggccgagccgcccuucggggacagcuacaucaucaucggcguggagccggggcagcugaagcuguccugguucaagaagggcagcuccaucgggcagauguucgagaccaccaugcgcggcgccaagcggauggccauccucggcgacacggcgugggacuucgggagccugggcgggguguucaccuccaucggcaaggcccugcaccaggucuucggggccaucuacggcgccgcguucagcggcguguccuggaccaugaagauccucaucgggguggucaucaccuggaucggcaugaacagccgcuccacgagccuguccgugagccuggugcuggucgggaucgugacccucuaccugggcgugaugguccaggccgacuccgggugcguggugagcuggaagaacaaggagcugaagugcggcagcggcaucuucaucaccgacaacguccacaccuggacggagcaguacaaguuccagcccgagucccccagcaagcucgccuccgccauccagaaggcccacgaggaggggaucugcggcauccggagcgugacccgccuggagaaccugauguggaagcagaucacccccgagcucaaccacauccuguccgagaacgaggugaagcugaccaucaugacgggggacaucaagggcaucaugcaggcggggaagcggagccuccgcccgcagcccaccgagcugaaguacuccuggaaggccuggggcaaggccaagaugcugagcaccgagcuccacaaccacaccuuccugaucgacggccccgagacggccgagugcccgaacaccaaccgggccuggaacucccuggaggucgaggacuacggguucggcguguucaccaccaacaucuggcucaagcugaaggagcgccaggacguguucugcgacagcaagcugauguccgcggccaucaaggacaaccgggccguccacgccgacaugggguacuggaucgagagcgcccucaacgacacguggaagaucgagaaggcguccuucaucgaggucaagagcugccacuggcccaagucccacacccuguggagcaacggcgugcuggaguccgagaugaucauccccaagaacuucgccggccccgugagccagcacaacuaccgcccgggguaccacacccagaccgccggccccuggcaccucgggcggcuggagauggacuucgacuucugcgagggcaccacggugguggucaccgaggacugcgggaaccgcggccccagccugcggaccaccacggccuccggcaagcucaucaccgaguggugcugccgcagcugcacccugcccccgcugcgguaccgcggggaggacggcugcugguacgggauggagauccggccccucaaggagaaggaggagaaccuggugaacucccuggugaccgcgggccacgggcagaucgacaacuucagccucggcguccugggcauggcccuguuccucgaggagaugcugcgcacgcggguggggaccaagcacgccauccugcucguggccgucuccuucgugacccugaucaccggcaacaugagcuuccgcgaccuggggcgcgugauggucauggugggcgccacgaugaccgacgacaucgggaugggcgugaccuaccucgcgcugcuggccgccuucaagguccggcccaccuucgccgccggccuccugcugcgcaagcucacguccaaggagcugaugaugaccaccaucgggaucgugcugcucagccaguccaccauccccgagacgauccuggagcugaccgacgcgcucgcccugggcaugauggugcugaagaucguccggaacauggagaaguaccagcucgccgugaccaucauggccacccugugcgucccgaacgccgugauccugcagaacgcguggaaggugagcugcacgauccucgccgucguguccgugagcccccugcugcucaccuccagccagcagaaggccgacuggaucccccuggcccugaccaucaaggggcucaaccccaccgcgaucuuccugacgacccugucccgcaccagcaagaagcgguccuggccgcucaacgaggccaucauggccgucggcauggugagcauccuggccuccagccugcucaagaacgacauccccaugaccggcccccugguggccgggggccugcucacggucugcuacgugcugaccgggcgcagcgcggaccuggagcucgagcgggccgccgacgugcgcugggaggagcaggccgagaucuccggcagcucccccauccugagcaucaccaucuccgaggacgggagcauguccaucaagaacgaggaggaggagcagacccugacgauccucauccggaccggccugcuggucaucagcggccucuucccgguguccauccccaucaccgccgcggccugguaccugugggaggugaagaagcagcgcgccgggguccugugggacgugcccagcccgccgcccgugggcaaggccgagcucgaggacggggccuaccggaucaagcagaagggcauccugggguacucccagaucggcgcgggcgucuacaaggaggggaccuuccacaccauguggcacgugacgcgcggcgccgugcugaugcacaaggggaagcggaucgagcccagcugggccgacgucaagaaggaccucaucuccuacggcgggggcuggaagcuggagggcgaguggaaggagggggaggagguccaggugcuggcccucgagcccggcaagaacccccgcgccguccagaccaagcccgggcuguucaagaccaacaccggcacgaucggggcggugagccuggacuucucccccggcaccagcggcucccccaucguggacaagaaggggaaggucgugggccucuacgggaacggcguggucacccggagcggcaccuacguguccgccaucgcccagacggagaaguccaucgaggacaaccccgagaucgaggacgacaucuuccgcaagaagcggcugaccaucauggaccugcaccccggggccggcaagaccaagcgcuaccugcccgcgaucgugcgggaggccaucaagcgcgggcuccggacccugauccuggccccgacgcgcgucguggccgccgagauggaggaggcgcuccgcggccugcccauccgguaccagacccccgccauccgcgccgagcacaccgggcgggagaucguggaccugaugugccacgccaccuucacgaugcgccuccugagccccauccgggucccgaacuacaaccugaucaucauggacgaggcccacuucaccgaccccgcguccaucgccgcccgcggcuacaucagcacccggguggagaugggcgaggccgccgggaucuucaugaccgcgacgccgcccggcucccgcgacccguucccccagagcaacgcccccaucauggacgaggagcgggagauccccgagcgcuccuggaacagcgggcacgagugggugaccgacuucaagggcaagaccgucugguucgugccguccaucaaggccgggaacgacaucgccgcgugccuccggaagaacggcaagaaggugauccagcugagccgcaagaccuucgacuccgaguacaucaagacgcggaccaacgacugggacuucgucgugaccaccgacaucagcgagaugggcgccaacuucaaggccgagcgcgugaucgacccccggcgcugcaugaagcccgucauccugacggacggggaggagcgggugauccucgccggccccaugccggugacccacuccagcgccgcgcagcgccgggggcgcgucggccgcaaccccaagaacgagaacgaccaguacaucuacaugggggagccccuggagaacgacgaggacugcgcccacuggaaggaggccaagaugcugcucgacaacaucaacacccccgagggcaucaucccguccauguucgagcccgagcgggagaagguggacgccaucgacggcgaguaccgccugcgcggggaggcccgcaagaccuucguggaccugaugcggcgcggcgaccuccccgucuggcuggcguaccggguggccgccgaggggaucaacuacgccgaccgccgguggugcuucgacggcgucaagaacaaccagauccuggaggagaacguggagguggagaucuggacgaaggagggggagcgcaagaagcucaagccgcgguggcuggacgcccgcaucuacagcgacccccuggcgcucaaggaguucaaggaguucgccgccggccggaagucccugacccugaaccucaucaccgagaugggccgccugcccaccuucaugacgcagaaggcccggaacgcgcuggacaaccucgccguccugcacaccgccgaggccgggggccgcgccuacaaccacgcgcugagcgagcuccccgagacccuggagacccugcuccugcugacgcuccuggccaccgugaccgggggcaucuuccuguuccucauguccggcaaggggaucggcaagaugacccuggggaugugcugcaucaucaccgccagcauccugcucugguacgcccagauccagccgcacuggaucgccgcguccaucauccuggaguucuuccugaucgugcuccugauccccgagcccgagaagcagcggacgccccaggacaaccagcugaccuacgucgugaucgccauccucaccguggucgccgccaccauggccaacgagaugggcuuccuggagaagacgaagaaggacuucgggcugggcagcaucaccacccagcagccggacagcaacauccucgacaucgaccugcgccccgcguccgccuggacccuguacgccguggccacgaccuucaucacccccaugcuccggcacagcaucgagaacuccagcgugaacgucucccugaccgccaucgcgaaccaggccacggugcugaugggccucgggaagggcuggccccugagcaagauggacaucggggugccgcugcucgccaucggcugcuacucccaggucaaccccaucacccugaccgccgcgcugcuccugcugguggcccacuacgccaucaucgggcccggccuccaggccaaggccacccgcgaggcgcagaagcgggccgccgccggcaucaugaagauccccgccgcggacgggaucacggugaucgaccuggacccgauccccuacgaccccaaguucgagaagcagcugggccaggucaugcuccuggugcugugcgugacccagguccucaugaugcgcaccaccugggcccugugcgaggcccugacgcucgccaccgggcccaucagcacccugugggagggcaacccggggcgcuucuggaacaccacgaucgccguguccauggcgaacaucuuccggggcagcuaccuggccggcgccgggcuccuguucuccaucaugaagaacaccgccaacacccgccggggcaccgggaacacgggcgagacccugggcgagaaguggaagaaccgccucaacgcgcugggcaagagcgaguuccagaucuacaagaaguccggcauccaggagguggaccggacccuggccaaggaggggaucaagcgcggcgagaccgaccaccacgccgucagccggggguccgccaagcuccgcugguucguggagcggaaccuggugacgcccgagggcaaggucguggaccugggcugcgggcgcggcggguggagcuacuacugcggcgggcucaagaacgugaaggaggucaagggccugaccaagggcgggcccggccacgaggagcccaucccgauguccaccuacggguggaaccuggugcggcuccagagcggcguggacgucuucuucacgccgcccgagaagugcgacacgcugcugugcgacaucggggaguccagccccaacccgaccguggaggccggccgcacccuccgggugcugaaccuggucgagaacuggcucaacaacaacacccaguucugcaucaaggugcugaaccccuacaugcccagcgugaucgagaagauggaggcgcugcagcgcaaguacggcggggcccugguccggaacccgcucucccgcaacagcacccacgagauguacuggguguccaacgccagcggcaacaucguguccagcgucaacaugaucucccggaugcugaucaaccgcuucacgaugaagcacaagaaggccaccuacgagcccgacguggaccuggggagcggcacccggaacaucgggaucgaguccgagacccccaaccucgacaucaucggcaagcgcaucgagaagaucaagcaggagcacgagacgagcuggcacuacgaccaggaccaccccuacaagaccugggccuaccacggcuccuacgagaccaagcagaccgggagcgcguccagcauggugaacggcgucgugcgccugcugacgaagccgugggacgugauccccauggucacccagauggccaugaccgacaccacgcccuucgggcagcagcggguguucaaggagaagguggacacccgcacccaggagcccaaggagggcaccaagaagcucaugaagaucacggccgaguggcuguggaaggagcugggcaagaagaagaccccgcggaugugcacccgcgaggaguucacccggaagguccgcuccaacgccgcccucggggcgaucuucacggacgagaacaaguggaaguccgcccgggaggccguggaggacuccggcuucugggagcuggucgacaaggagcgcaaccugcaccucgaggggaagugcgagaccugcguguacaacaugaugggcaagcgggagaagaagcugggggaguucggcaaggccaagggcagccgcgcgaucugguacauguggcugggggcccgguuccucgaguucgaggcccugggcuuccugaacgaggaccacugguucucccgcgagaacagccucagcgggguggagggcgaggggcugcacaagcugggcuacauccuccgggacgucuccaagaaggagggcggggccauguacgccgacgacaccgcgggcugggacacccgcaucacgcuggaggaccugaagaacgaggagauggugaccaaccacauggagggggagcaccggaagcucgccgaggccaucuuccgccugaccuaccagaacaaggugguccgggugcagcgccccacgccccggggcacggugauggacaucaucagccgccgggaccagcgcggguccggccaggucgugaccuacggccugaacaccuucaccaacauggaggcccagcucauccgccagauggagggggagggcguguucaagagcauccagcaccugacggucaccgaggagaucgccgugaagaacuggcuggagcggguggggcgcgagcggcucucccgcauggcgaucagcggcgacgacugcgucgugaagccccuggacgaccgguucgccuccgcccugaccgcccucaacgacaugggcaaggugcgcaaggacauccagcagugggagccgagccggggguggaacgacuggacccagguccccuucugcucccaccacuuccacgagcugaucaugaaggacggccgcgugcuggugguccccugccggaaccaggacgagcucaucgggcgcgcccggaucagccagggcgcgggguggucccugcgcgagacggccugccugggcaagagcuacgcccagauguggucccucauguacuuccaccggcgcgaccugcggcuggccgccaacgcgaucugcagcgccgugcccucccacugggugccgaucagccgcaccaccugguccauccacgccacccacgaguggaugaccacggaggacaugcucaccgucuggaaccggguguggauccaggagaaccccuggauggaggacaagacccccguggagagcugggaggagauccccuaccugggcaagcgcgaggaccaguggugcgggagccugaucggccucaccucccgggccacgugggcgaagaacauccagaccgccaucaaccagguccgcagccugaucgggaacgaggaguacaccgacuacaugccguccaugaagcgcuuccggcgcgaggaggaggaggccggcgugcugugguga

SEQ ID NO: 9066 - RNA, 9876 nt, Artificial Sequence
  derived and/or modified CDS sequence (opt1) from DENV-2__KM279515__SS-prME
accgccgggaucaucaucaugaugauccccaccgugauggccuuccaccugaccacccggaacggggagccccacaugaucgucagccggcaggagaagggcaagagccuccuguucaagaccgagaacggggugaacaugugcacccugauggcgauggaccucggcgagcugugcgaggacaccaucaccuacaacugcccccugcuccgccagaacgagcccgaggacaucgacugcuggugcaacagcaccagcaccugggugaccuacgggaccugcaccgccaccggcgagcaccggcgcgagaagcggagcgucgcccuggugccccacgugggcauggggcuggagacccgcaccgagaccuggaugagcagcgagggcgccuggaagcacgcccagcggaucgagaccuggauccuccgccaccccggguucacgaucauggcggccauccuggccuacaccaucggcaccaccuacuuccagcggguccugaucuucauccuccugacggccgugacccccuccauggcgaugcgcugcaucgggaucagcaaccgggacuucguggagggcgucuccggcgggagcuggguggacaucgugcuggagcacggcuccugcgucaccaccauggccaagaacaagcccacgcucgacuucgagcugaucaagaccgaggccaagcaccuggccacccuccgcaaguacugcguggaggccaagcugaccaacacgaccaccgcgagccggugccccacccagggggagcccucccugaacgaggagcaggacaagcgcuucgugugcaagcacagcauggucgaccggggcuggggcaacgggugcggccucuucgggaagggcgggaucgugacgugcgccauguucacgugcaagaagaacauggagggcaaggugguccagcccgagaaccuggaguacaccaucgugaucacgccccacuccggcgaggagaacgccguggggaacgacacgggcaagcacgggaaggagaucaaggucacgccccagagcuccaucaccgaggccgagcugaccggcuacgggaccgugacgauggagugcagcccgcgcaccggccucgacuucaacgagauggugcugcugcagauggagaacaaggccuggcucguccaccggcagugguuccuggaccugccccuccccuggcugcccggcgcggacacccagggguccaacuggauccagaaggagacccuggugacguucaagaacccgcacgccaagaagcaggacgucguggugcucggcagccaggagggggccaugcacaccgcccugaccggcgccaccgagauccagaugagcuccgggaaccuccuguucacgggccaccugaagugccgccugcggauggacaagcuccagcugaagggcaugagcuacuccaugugcaccgggaaguucaaggucgugaaggagaucgcggagacccagcacggcaccaucgugauccgcguccaguacgagggggacggcagccccugcaagauccccuucgagaucauggaccuggagaagcggcacgcccucggccgccugaucacggugaaccccaucgugaccgagaaggacuccccggucaacaucgaggccgagccgcccuucggggacagcuacaucaucaucggcguggagcccgggcagcugaagcucuccugguucaagaagggcagcuccaucgggcagauguucgagaccaccaugcgcggcgccaagcggauggccauccugggcgacacggcgugggacuucgggagccugggcgggguguucaccuccaucggcaaggcccuccaccaggucuucggggccaucuacggcgccgcguucagcggcguguccuggaccaugaagauccugaucgggguggucaucaccuggaucggcaugaacagccgcuccacgagccuguccgugagccuggugcucgucgggguggugacccuguaccugggcgucauggugcaggccgacuccgggugcguggucagcuggaagaacaaggagcucaagugcggcagcggcaucuucaucaccgacaacgugcacaccuggacggagcaguacaaguuccagccggagucccccagcaagcuggccuccgccauccagaaggcccacgaggaggggaucugcggcauccggagcgugacccgccuggagaaccucauguggaagcagaucacccccgagcugaaccacauccugaccgagaacgaggucaagcucacgaucaugaccggggacaucaagggcaucaugcaggcggggaagcggucccugcgcccccagccgaccgagcugaaguacagcuggaaggccuggggcaaggccaagaugcucuccaccgagcugcacaaccacacguuccugaucgacggccccgagaccgccgagugccccaacaccaaccgggccuggaacagccucgagguggaggacuacggguucggcguguucaccacgaacaucuggcugaagcugaaggagcgccaggacgucuucugcgacuccaagcucaugagcgcggccaucaaggacaaccgggccgugcacgccgacaugggguacuggaucgaguccgcccugaacgacaccuggaagaucgagaaggcgagcuucaucgaggugaaguccugccacuggcccaagagccacacccugugguccaacggcguccucgagagcgagaugaucauccccaagaacuucgccggccccgugucccagcacaacuaccgccccggguaccacacccagaccgccggcccguggcaccuggggcggcuggagauggacuucgacuucugcgagggcacgaccguggucgugaccgaggacugcgggaaccgcggccccagccuccggaccacgaccgccagcggcaagcugaucaccgaguggugcugccgcuccugcacccugccgccccuccgguaccgcggggaggacggcugcugguacgggauggagauccggccgcugaaggagaaggaggagaaccuggugaacagccucgucacggcgggccacgggcagaucgacaacuucucccugggcgugcugggcauggcccucuuccuggaggagaugcugcgcacccggguggggaccaagcacgccauccuccuggucgccgugagcuucgugacccugaucacgggcaacauguccuuccgcgaccucgggcgcgucauggugauggugggcgccaccaugaccgacgacaucgggaugggcgucaccuaccuggcgcugcucgccgccuucaaggugcggcccacguucgccgccggccugcugcuccgcaagcugaccagcaaggagcugaugaugaccaccaucgggaucgugcuccugucccagagcacgauccccgaguccauccuggagcucaccgacgcgcuggcccugggcaugaugguccucaagaucgugcggaacauggagaaguaccagcuggccgucaccaucauggccauccugugcgugcccaacgccgugauccuccagaacgcguggaaggucagcugcaccacgcuggccgugguguccgucagcccgcugcuccugaccuccagccagcagaaggccgacuggaucccccuggcccucaccaucaaggggcugaaccccaccgcgaucuuccugacgacccucucccgcaccagcaagaagcgguccuggccccugaacgaggccaucauggccgugggcauggugagcauccuggccuccagccuccugaagaacgacaucccgaugaccggcccccuggucgccgggggccuccugacggugugcuacgugcugaccgggcgcagcgcggaccucgagcuggagcgggccgccgacguccgcugggaggagcaggccgagaucuccggcagcucccccauccugagcaucaccaucuccgaggacgggagcauguccaucaagaacgaggaggaggagcagacccucacgauccugauccggaccggccugcucgugaucagcggccuguuccccguguccaucccgaucaccgccgcggccugguaccugugggaggucaagaagcagcgcgccggggugcucugggacgugcccuccccgccgcccgucggcaaggccgagcuggaggacggggccuaccggaucaagcagaagggcauccugggguacucccagaucggcgcgggcguguacaaggaggggaccuuccacaccauguggcacgugacgcgcggcgccguccucaugcacaaggggaagcggaucgagcccagcugggccgacgugaagaaggaccugaucuccuacggcgggggcuggaagcuggagggcgaguggaaggagggggaggaggugcagguccucgcccuggagcccggcaagaacccgcgcgccgugcagaccaagcccgggcuguucaagaccaacaccggcacgaucggggcggugagccucgacuucucccccggcaccagcggcucccccaucgucgacaagaaggggaagguggugggccuguacgggaacggcgucgugacccggagcggcaccuacguguccgccaucgcccagacggagaaguccaucgaggacaacccggagaucgaggacgacaucuuccgcaagaagcggcugaccaucauggaccugcaccccggggccggcaagaccaagcgcuaccuccccgcgaucguccgggaggccaucaagcgcgggcugcggacccugauccucgcccccacgcgcgugguggccgccgagauggaggaggcgcugcgcggccugccgauccgguaccagacccccgccauccgcgccgagcacaccgggcgggagaucgucgaccucaugugccacgccaccuucacgaugcgccugcugagccccauccgggugcccaacuacaaccucaucaucauggacgaggcccacuucaccgacccggcguccaucgccgcccgcggcuacaucagcacccggguggagaugggcgaggccgccgggaucuucaugaccgcgacgccgcccggcucccgcgaccccuucccgcagagcaacgcccccaucauggacgaggagcgggagauccccgagcgcuccuggaacagcgggcacgagugggucaccgacuucaagggcaagaccgugugguucgugcccuccaucaaggccgggaacgacaucgccgcgugccugcggaagaacggcaagaaggucauccagcugagccgcaagaccuucgacuccgaguacaucaagacgcggaccaacgacugggacuucguggugaccaccgacaucagcgagaugggcgccaacuucaaggccgagcgcgucaucgacccgcggcgcugcaugaagcccgugauccucacggacggggaggagcgggugauccuggccggccccaugcccgucacccacuccagcgccgcgcagcgccgggggcgcgugggccgcaacccgaagaacgagaacgaccaguacaucuacaugggggagccccuggagaacgacgaggacugcgcccacuggaaggaggccaagaugcuccuggacaacaucaacacccccgagggcaucauccccuccauguucgagccggagcgggagaagguggacgccaucgacggcgaguaccgccugcgcggggaggcccgcaagaccuucgucgaccucaugcggcgcggcgaccugcccguguggcuggcguaccgggucgccgccgaggggaucaacuacgccgaccgccgguggugcuucgacggcgugaagaacaaccagauccucgaggagaacguggaggucgagaucuggacgaaggagggggagcgcaagaagcugaagccccgguggcuggacgcccgcaucuacagcgacccgcucgcgcugaaggaguucaaggaguucgccgccggccggaagucccugacccucaaccugaucaccgagaugggccgccugcccaccuucaugacgcagaaggccaagaacgcgcucgacaaccuggccgugcugcacaccgccgaggccgggggccgggccuacaaccacgcgcucagcgagcugcccgagacccuggagacccuccugcugcucacgcugcuggccaccgugaccgggggcaucuuccucuuccugauguccggcaaggggaucggcaagaugacccuggggaugugcugcaucaucaccgccagcauccuccugugguacgcccagauccagccccacuggaucgccgcguccaucauccuggaguucuuccucaucguccugcugaucccggagcccgagaagcagcgcacgccccaggacaaccagcucaccuacguggugaucgccauccugaccgucguggccgccaccauggccaacgagaugggcuuccuggagaagacgaagaaggacuucgggcucggcagcaucaccacccagcagcccgagagcaacauccuggacaucgaccugcggccggcguccgccuggacccucuacgccguggccacgaccuucaucacccccaugcugcgccacagcaucgagaacuccagcgucaacgugucccugaccgccaucgcgaaccaggccacggugcucaugggccuggggaagggcuggccccugagcaagauggacaucggggucccccuccuggccaucggcugcuacucccaggugaacccgaucacccugaccgccgcgcuccugcugcucguggcccacuacgccaucaucgggcccggccugcaggccaaggccacccgggaggcgcagaagcgcgccgccgccggcaucaugaagaaccccacggucgacgggaugaccgugaucgaccuggaccccaucccguacgaccccaaguucgagaagcagcucggccaggugaugcugcugguccucugcgugacccaggugcugaugaugcggaccacgugggcccugugcgaggcgcucacccuggccaccgggcccaucagcacccugugggagggcaaccccgggcgcuucuggaacacgaccaucgccgucuccauggccaacaucuuccgcggcagcuaccucgccggcgcggggcugcuguucuccaucaugaagaacaccgccaacacccggcgcggcacggggaacaccggcgagacccucggcgagaaguggaagaaccggcugaacgcccugggcaagagcgaguuccagaucuacaagaaguccggcauccaggagguggaccgcacccucgccaaggaggggaucaagcggggcgagacggaccaccacgcggugagccgcggguccgccaagcugcggugguucgucgagcgcaaccuggugaccccggagggcaagguggucgaccucggcugcgggcggggcggguggagcuacuacugcggcgggcugaagaacgugaaggaggugaagggccugaccaagggcgggcccggccacgaggagcccauccccauguccaccuacggguggaaccucguccgccugcagagcggcguggacguguucuucacgccgcccgagaagugcgacacccugcucugcgacaucggggaguccagccccaaccccaccgucgaggccggccggacccugcgcgugcugaaccucguggagaacuggcugaacaacaacacccaguucugcaucaagguccugaacccguacaugcccagcgugaucgagaagauggaggcccugcagcggaaguacggcggggcccucgugcgcaacccccugucccggaacagcacgcacgagauguacugggucuccaacgcgagcggcaacaucguguccagcgugaacaugaucucccgcaugcugaucaaccgguucaccaugcgccacaagaaggccaccuacgagccggacgucgaccucgggagcggcacccggaacaucgggaucgaguccgagacgcccaaccuggacaucaucggcaagcgcaucgagaagaucaagcaggagcacgagaccagcuggcacuacgaccaggaccaccccuacaagaccugggccuaccacggcuccuacgagaccaagcagacggggagcgccuccagcauggugaacggcgugguccgccugcucaccaagcccugggacgugaucccgauggugacccagauggccaugaccgacacgacccccuucgggcagcagcgggucuucaaggagaagguggacacccgcacccaggagcccaaggagggcacgaagaagcugaugaagaucaccgcggaguggcuguggaaggagcucggcaagaagaagacgccccggaugugcacccgcgaggaguucacgcggaagguccgcuccaacgccgcccugggggccaucuucaccgacgagaacaaguggaaguccgcccgggaggcgguggaggacuccggcuucugggagcugguggacaaggagcgcaaccuccaccuggaggggaagugcgagaccugcgucuacaacaugaugggcaagcgggagaagaagcugggggaguucggcaaggccaagggcagccgcgccaucugguacauguggcucggggcccgguuccuggaguucgaggcgcugggcuuccucaacgaggaccacugguucucccgcgagaacagccugagcgggguggagggcgaggggcugcacaagcucggcuacauccugcgggacguguccaagaaggagggcggggccauguacgccgacgacaccgccggcugggacacgcgcaucacccuggaggaccucaagaacgaggagauggucaccaaccacauggagggggagcacaagaagcuggccgaggcgaucuucaagcugaccuaccagaacaagguggugcggguccagcgcccgacgccccggggcaccgugauggacaucaucagccgccgggaccagcgcggguccggccagguggucaccuacggccucaacaccuucacgaacauggaggcccagcugauccggcagauggagggggagggcguguucaagagcauccagcagcugaccgugaaggaggagaucgccgucaagaacuggcucauccgcguggggcgcgagcggcugucccgcauggccaucagcggcgacgacugcguggucaagccccuggacgaccgguucgccuccgcgcucaccgcccugaacgacaugggcaaggugcgcaaggacauccagcagugggagcccagccggggguggaacgacuggacccaggugccguucugcucccaccacuuccacgagcugaucaugaaggacggccgcguccucguggugcccugccggaaccaggacgagcugaucgggcgcgcccggaucagccagggcgccggguggucccugcgcgagacggccugccucggcaagagcuacgcgcagauguggucccugauguacuuccaccggcgcgaccugcggcucgccgccaacgccaucugcagcgccguccccucccacuggauccccaccagccgcaccaccugguccauccacgcgacccacgaguggaugacgaccgaggacaugcugaccguguggaaccggguguggauccaggagaacccguggauggaggacaagacccccgucgagacgugggaggagauccccuaccugggcaagcgcgaggaccaguggugcgggagccucaucggccugaccagccgggccaccugggccaagaacauccagaccgccaucaaccaggugcgcucccugaucgggaacgaggaguacacggacuacaugcccagcaugaagcgguuccgccgcgaggaggaggaggcgggcgugcucugguga

SEQ ID NO: 9067 - RNA, 9876 nt, Artificial Sequence
  derived and/or modified CDS sequence (opt1) from DENV-2__KM279516__SS-prME
accgcgggcaucaucaucaugaugauccccaccgugauggccuuccaccugaccacccggaacggggagccccacaugaucgucagccggcaggagaagggcaagucccuccuguucaagaccgagaacggggugaacaugugcacccugauggcgauggaccucggcgagcugugcgaggacaccaucaccuacaacugcccccugcuccgccagaacgagcccgaggacaucgacugcuggugcaacagcaccuccaccugggugaccuacgggaccugcaccgccaccggcgagcaccggcgcgagaagcggagcgucgcccuggugccccacgugggcauggggcuggagacccgcaccgagaccuggauguccagcgagggcgccuggaagcacgcccagcggaucgagaccuggauccuccgccaccccggguucacgaucauggcggccauccuggccuacaccaucggcaccaccuacuuccagcggguccugaucuucauccuccugacggccgugacccccuccauggcgaugcgcugcaucgggaucagcaaccgggacuucguggagggcgucuccggcgggagcuggguggacaucgugcuggagcacggcuccugcgucaccaccauggccaagaacaagcccacgcucgacuucgagcugaucaagaccgaggccaagcaccuggccacccuccgcaaguacugcguggaggccaagcugaccaacacgaccaccgcgagccggugccccacccagggggagcccucccugaacgaggagcaggacaagcgcuucgugugcaagcacagcauggucgaccggggcuggggcaacgggugcggccucuucgggaagggcgggaucgugacgugcgccauguucacgugcaagaagaacauggagggcaaggugguccagcccgagaaccuggaguacaccaucgugaucacgccccacuccggcgaggagaacgccguggggaacgacacgggcaagcacgggaaggagaucaaggucacgccccagagcuccaucaccgaggccgagcugaccggcuacgggaccgugacgauggagugcagcccgcgcaccggccucgacuucaacgagauggugcugcugcagauggagaacaaggccuggcucguccaccggcagugguuccuggaccugccccuccccuggcugcccggcgcggacacccagggguccaacuggauccagaaggagacccuggugacguucaagaacccgcacgccaagaagcaggacgucguggugcucggcagccaggagggggccaugcacaccgcccugaccggcgccaccgagauccagaugagcuccgggaaccuccuguucacgggccaccugaagugccgccugcggauggacaagcuccagcugaagggcaugagcuacuccaugugcaccgggaaguucaaggucgugaaggagaucgcggagacccagcacggcaccaucgugauccgcguccaguacgagggggacggcagccccugcaagauccccuucgagaucauggaccuggagaagcggcacgugcucggccgccugaucacggugaaccccaucgucaccgagaaggacuccccggugaacaucgaggccgagccgcccuucggggacagcuacaucaucaucggcguggagcccgggcagcugaagcucuccugguucaagaagggcagcuccaucgggcagauguucgagaccaccaugcgcggcgccaagcggauggccauccugggcgacacggccugggacuucgggagccugggcggggucuucaccuccaucggcaaggcgcuccaccagguguucggggccaucuacggcgccgccuucagcggcguguccuggaccaugaagauccugaucggggucgugaucaccuggaucggcaugaacagccgcuccacgagccuguccgugagccugguccucguggggguggucacccuguaccugggcgugauggugcaggcggacuccgggugcgucgugagcuggaagaacaaggagcucaagugcggcagcggcaucuucaucaccgacaacgugcacaccuggacggagcaguacaaguuccagccggagucccccagcaagcuggccuccgccauccagaaggcccacgaggaggggaucugcggcauccggagcgucacccgccuggagaaccucauguggaagcagaucacccccgagcugaaccacauccugaccgagaacgaggugaagcucacgaucaugaccggggacaucaagggcaucaugcaggccgggaagcggucccugcgcccccagccgaccgagcugaaguacagcuggaaggcguggggcaaggccaagaugcucuccaccgagcugcacaaccacacguuccugaucgacggccccgagaccgccgagugccccaacaccaaccgggccuggaacagccucgagguggaggacuacggguucggcgucuucaccacgaacaucuggcugaagcugaaggagcgccaggacguguucugcgacuccaagcucaugagcgccgcgaucaaggacaaccgggccgugcacgccgacaugggguacuggaucgaguccgcccugaacgacaccuggaagaucgagaaggccagcuucaucgaggucaaguccugccacuggcccaagagccacacccugugguccaacggcgugcucgagagcgagaugaucauccccaagaacuucgcgggccccgugucccagcacaacuaccgccccggguaccacacccagaccgccggcccguggcaccuggggcggcuggagauggacuucgacuucugcgagggcacgaccgucguggugaccgaggacugcgggaaccgcggccccagccuccggaccacgaccgccagcggcaagcugaucaccgaguggugcugccgcuccugcacccugccgccccuccgguaccgcggggaggacggcugcugguacgggauggagauccggccgcugaaggagaaggaggagaaccuggucaacagccucgugacggccggccacgggcagaucgacaacuucucccugggcgugcugggcauggcccucuuccuggaggagaugcugcgcacccgggucgggaccaagcacgccauccuccugguggccgugagcuucgucacccugaucacgggcaacauguccuuccgcgaccucgggcgcgugauggugauggucggcgccaccaugaccgacgacaucgggaugggcgugaccuaccuggcccugcucgcggccuucaaggugcggcccacguucgccgccggccugcugcuccgcaagcugaccagcaaggagcugaugaugaccaccaucgggaucguccuccugucccagagcacgauccccgagaacauccuggagcucaccgacgcccuggcgcugggcaugauggugcucaagaucguccggaacauggagaaguaccagcuggccgugaccaucauggccauccugugcgugcccaacgccgucauccuccagaacgccuggaagguguccugcaccacgcuggcgguggucagcguguccccgcugcuccugaccagcucccagcagaaggccgacuggaucccccuggcccucaccaucaaggggcugaaccccaccgccaucuuccugacgacccucagccgcaccuccaagaagcggagcuggccccugaacgaggcgaucauggccgugggcauggucuccauccuggccagcucccuccugaagaacgacaucccgaugaccggcccccugguggccgggggccuccugacggugugcuacguccugaccgggcgcagcgccgaccucgagcuggagcgggcggccgacgugcgcugggaggagcaggccgagaucagcggcuccagccccauccuguccaucaccaucagcgaggacggguccaugagcaucaagaacgaggaggaggagcagacccucacgauccugauccggaccggccugcucgugaucuccggccuguuccccgucagcaucccgaucaccgccgccgcgugguaccugugggaggugaagaagcagcgcgccggggugcucugggacguccccagcccgccgcccgugggcaaggccgagcuggaggacggggccuaccggaucaagcagaagggcauccugggguacagccagaucggcgccggcguguacaaggaggggaccuuccacaccauguggcacgucacgcgcggcgcggugcucaugcacaaggggaagcggaucgagcccuccugggccgacgugaagaaggaccugaucagcuacggcgggggcuggaagcuggagggcgaguggaaggagggggaggagguccaggugcucgcccuggagcccggcaagaacccgcgcgccgugcagaccaagcccgggcuguucaagaccaacaccggcacgaucggggccgucucccucgacuucagccccggcaccuccggcagccccaucguggacaagaaggggaagguggucggccuguacgggaacggcguggugacccgguccggcaccuacgucagcgcgaucgcccagacggagaaguccaucgaggacaacccggagaucgaggacgacaucuuccgcaagaagcggcugaccaucauggaccugcaccccggggccggcaagaccaagcgcuaccuccccgccaucgugcgggaggcgaucaagcgcgggcugcggacccugauccucgcccccacgcgcguggucgccgccgagauggaggaggcccugcgcggccugccgauccgguaccagacccccgcgauccgcgccgagcacaccgggcgggagaucguggaccucaugugccacgccaccuucacgaugcgccugcugagccccauccgggugcccaacuacaaccucaucaucauggacgaggcccacuucaccgacccggccagcaucgcggcccgcggcuacaucuccacccgggucgagaugggcgaggccgccgggaucuucaugaccgccacgccgcccggcagccgcgaccccuucccgcaguccaacgcgcccaucauggacgaggagcgggagauccccgagcgcagcuggaacuccgggcacgagugggugaccgacuucaagggcaagaccgugugguucguccccagcaucaaggccgggaacgacaucgccgccugccugcggaagaacggcaagaaggugauccagcugucccgcaagaccuucgacagcgaguacaucaagacgcggaccaacgacugggacuucguggucaccaccgacaucuccgagaugggcgcgaacuucaaggccgagcgcgugaucgacccgcggcgcugcaugaagcccgugauccucacggacggggaggagcgggucauccuggccggccccaugcccgugacccacagcuccgccgcccagcgccgggggcgcgugggccgcaacccgaagaacgagaacgaccaguacaucuacaugggggagccccuggagaacgacgaggacugcgcgcacuggaaggaggccaagaugcuccuggacaacaucaacacccccgagggcaucauccccagcauguucgagccggagcgggagaaggucgacgccaucgacggcgaguaccgccugcgcggggaggcccgcaagaccuucguggaccucaugcggcgcggcgaccugcccgucuggcuggccuaccggguggcggccgaggggaucaacuacgccgaccgccgguggugcuucgacggcgugaagaacaaccagauccucgaggagaacgucgagguggagaucuggacgaaggagggggagcgcaagaagcugaagccccgguggcuggacgcccgcaucuacuccgacccgcucgcccugaaggaguucaaggaguucgcggccggccgcaagagccugacccucaaccugaucaccgagaugggccggcugcccaccuucaugacgcagaaggccaagaacgcccucgacaaccuggcggugcugcacaccgccgaggccgggggccgggccuacaaccacgcccucuccgagcugcccgagacccuggagacccuccugcugcucacgcugcuggcgaccgucaccgggggcaucuuccucuuccugaugagcggcaaggggaucggcaagaugacccuggggaugugcugcaucaucaccgccuccauccuccugugguacgcccagauccagccccacuggaucgccgccagcaucauccuggaguucuuccucaucgugcugcugaucccggagcccgagaagcagcgcacgccccaggacaaccagcucaccuacguggucaucgcgauccugaccgugguggccgccaccauggccaacgagaugggcuuccuggagaagacgaagaaggacuucgggcucggcuccaucaccacccagcagcccgagagcaacauccuggacaucgaccugcggccggccagcgcguggacccucuacgccgucgccacgaccuucaucacccccaugcugcgccacuccaucgagaacagcuccgugaacgugagccugaccgccaucgccaaccaggcgacgguccucaugggccuggggaagggcuggccccuguccaagauggacaucggggugccccuccuggccaucggcugcuacagccaggugaacccgaucacccugaccgccgcccuccugcugcucgucgcgcacuacgccaucaucgggcccggccugcaggccaaggccacccgggaggcccagaagcgcgcggccgccggcaucaugaagaaccccacgguggacgggaugaccgugaucgaccuggaccccaucccguacgaccccaaguucgagaagcagcucggccaggucaugcugcuggugcucugcgugacccagguccugaugaugcggaccacgugggcccugugcgaggcccucacccuggcgaccgggcccaucuccacccugugggagggcaaccccgggcgcuucuggaacacgaccaucgccgugagcauggccaacaucuuccgcggcuccuaccucgccggcgccgggcugcuguucagcaucaugaagaacaccgcgaacacccggcgcggcacggggaacaccggcgagacccucggcgagaaguggaagaaccggcugaacgcccuggggaaguccgaguuccagaucuacaagaaguccggcauccaggagguggaccgcacccucgccaaggaggggaucaagcggggcgagacggaccaccacgccgucucccgcgggagcgcgaagcugcggugguucguggagcgcaaccuggugaccccggagggcaaggucguggaccucggcugcgggcggggcgggugguccuacuacugcggcgggcugaagaacgugaaggaggucaagggccugaccaagggcgggcccggccacgaggagcccauccccaugagcaccuacggguggaaccucgugcgccugcaguccggcguggacgucuucuucacgccgcccgagaagugcgacacccugcucugcgacaucggggagagcucccccaaccccaccguggaggccggccggacccugcgcgugcugaaccucgucgagaacuggcugaacaacaacacccaguucugcaucaaggugcugaacccguacaugcccagcgugaucgagaagauggaggcccugcagcggaaguacggcggggcccucguccgcaacccccugagccggaacuccacgcacgagauguacugggugagcaacgccuccggcaacaucgugagcuccgucaacaugaucagccgcaugcugaucaaccgguucaccaugcgccacaagaaggcgaccuacgagccggacguggaccucggguccggcacccggaacaucgggaucgagagcgagacgcccaaccuggacaucaucggcaagcgcaucgagaagaucaagcaggagcacgagaccuccuggcacuacgaccaggaccaccccuacaagaccugggccuaccacggcagcuacgagaccaagcagacgggguccgccagcuccauggugaacggcgucgugcgccugcucaccaagcccugggacgugaucccgauggucacccagauggccaugaccgacacgacccccuucgggcagcagcggguguucaaggagaaggucgacacccgcacccaggagcccaaggagggcacgaagaagcugaugaagaucaccgccgaguggcuguggaaggagcucggcaagaagaagacgccccggaugugcacccgcgaggaguucacgcggaaggugcgcagcaacgcggcccugggggccaucuucaccgacgagaacaaguggaaguccgcccgggaggccguggaggacagcggcuucugggagcuggucgacaaggagcgcaaccuccaccuggaggggaagugcgagaccugcguguacaacaugaugggcaagcgggagaagaagcugggggaguucggcaaggcgaagggcucccgcgccaucugguacauguggcucggggcccgguuccuggaguucgaggcccugggcuuccucaacgaggaccacugguucagccgcgagaacucccugagcgggguggagggcgaggggcugcacaagcucggcuacauccugcgggacgucagcaagaaggagggcggggcgauguacgccgacgacaccgccggcugggacacgcgcaucacccuggaggaccucaagaacgaggagauggugaccaaccacauggagggggagcacaagaagcuggccgaggccaucuucaagcugaccuaccagaacaaggugguccgggugcagcgcccgacgccccggggcaccgugauggacaucaucucccgccgggaccagcgcgggagcggccaggucgugaccuacggccucaacaccuucacgaacauggaggcgcagcugauccggcagauggagggggagggcguguucaaguccauccagcagcugaccgucaaggaggagaucgccgugaagaacuggcucauccgcguggggcgcgagcggcugagccgcauggccaucuccggcgacgacugcgucgugaagccccuggacgaccgguucgccagcgcccucaccgcgcugaacgacaugggcaaggugcgcaaggacauccagcagugggagcccucccggggguggaacgacuggacccaggucccguucugcagccaccacuuccacgagcugaucaugaaggacggccgcgugcucgugguccccugccggaaccaggacgagcugaucgggcgcgcccggaucucccagggcgccggguggagccugcgcgagacggccugccucggcaaguccuacgcccagauguggagccugauguacuuccaccggcgcgaccugcggcucgcggccaacgccaucugcuccgccgugcccagccacuggauccccaccucccgcaccaccuggagcauccacgccacccacgaguggaugacgaccgaggacaugcugaccguguggaaccgggucuggauccaggagaacccguggauggaggacaagacccccguggaguccugggaggagauccccuaccugggcaagcgcgaggaccaguggugcgggagccucaucggccugacgagccgggcgaccugggccaagaacauccagaccgccaucaaccaggugcgcucccugaucgggaacgaggaguacaccgacuacaugcccagcaugaagcgguuccgccgcgaggaggaggaggccggcguccucugguga

SEQ ID NO: 9068 - RNA, 9876 nt, Artificial Sequence
  derived and/or modified CDS sequence (opt1) from DENV-2__KM279517__SS-prME
accgcgggcaucaucaucaugaugauccccaccgugauggccuuccaccugaccacccggaacggggagccccacaugaucgucucccggcaggagaagggcaagucccuccuguucaagaccgagaacggggugaacaugugcacccugauggcgauggaccucggcgagcugugcgaggacaccaucaccuacaacugcccccugcuccgccagaacgagcccgaggacaucgacugcuggugcaacagcaccuccaccugggugaccuacgggaccugcaccgccaccggcgagcaccggcgcgagaagcggagcgucgcccuggugccccacgugggcauggggcuggagacccgcaccgagaccuggauguccagcgagggcgccuggaagcacgcccagcggaucgagaccuggauccuccgccaccccggguucacgaucauggcggccauccuggccuacaccaucggcaccaccuacuuccagcggguccugaucuucauccuccugacggccgugacccccuccauggcgaugcgcugcaucgggaucagcaaccgggacuucguggagggcgucuccggcgggagcuggguggacaucgugcuggagcacggcuccugcgucaccaccauggccaagaacaagcccacgcucgacuucgagcugaucaagaccgaggccaagcaccuggccacccuccgcaaguacugcguggaggccaagcugaccaacacgaccaccgcgagccggugccccacccagggggagcccucccugaacgaggagcaggacaagcgcuucgugugcaagcacagcauggucgaccggggcuggggcaacgggugcggccucuucgggaagggcgggaucgugacgugcgccauguucacgugcaagaagaacauggagggcaaggugguccagcccgagaaccuggaguacaccaucgugaucacgccccacuccggcgaggagaacgccguggggaacgacacgggcaagcacgggaaggagaucaaggucacgccccagagcuccaucaccgaggccgagcugaccggcuacgggaccgugacgauggagugcagcccgcgcaccggccucgacuucaacgagauggugcugcugcagauggagaacaaggccuggcucguccaccggcagugguuccuggaccugccccuccccuggcugcccggcgcggacacccagggguccaacuggauccagaaggagacccuggugacguucaagaacccgcacgccaagaagcaggacgucguggugcucggcagccaggagggggccaugcacaccgcccugaccggcgccaccgagauccagaugagcuccgggaaccuccuguucacgggccaccugaagugccgccugcggauggacaagcuccagcugaagggcaugagcuacuccaugugcaccgggaaguucaaggucgugaaggagaucgcggagacccagcacggcaccaucgugauccgcguccaguacgagggggacggcagccccugcaagauccccuucgagaucauggaccuggagaagcggcacgugcucggccgccugaucacggugaaccccaucgucaccgagaaggacuccccggugaacaucgaggccgagccgcccuucggggacagcuacaucaucaucggcguggagcccgggcagcugaagcucuccugguucaagaagggcagcuccaucgggcagauguucgagaccaccaugcgcggcgccaagcggauggccauccugggcgacacggccugggacuucgggagccugggcggggucuucaccuccaucggcaaggcgcuccaccagguguucggggccaucuacggcgccgccuucagcggcguguccuggaccaugaagauccugaucggggucgugaucaccuggaucggcaugaacagccgcuccacgagccuguccgugagccugguccucguggggguggucacccuguaccugggcgugauggugcaggcggacuccgggugcgucgugagcuggaagaacaaggagcucaagugcggcagcggcaucuucaucaccgacaacgugcacaccuggacggagcaguacaaguuccagccggagagcccgcccaagcuggccagcgccauccagaaggcccacgaggaggggaucugcggcauccgguccgucacccgccuggagaaccucauguggaagcagaucacccccgagcugaaccacauccugaccgagaacgaggugaagcucacgaucaugaccggggacaucaagggcaucaugcaggccgggaagcggagccugcgcccgcagcccaccgagcugaaguacuccuggaaggcguggggcaaggccaagaugcucagcaccgagcugcacaaccacacguuccugaucgacggccccgagaccgccgagugcccgaacaccaaccgggccuggaacucccucgagguggaggacuacggguucggcgucuucaccacgaacaucuggcugaagcugaaggagcgccaggacguguucugcgacagcaagcucauguccgccgcgaucaaggacaaccgggccgugcacgccgacaugggguacuggaucgagagcgcccugaacgacaccuggaagaucgagaaggccuccuucaucgaggucaagagcugccacuggcccaagucccacacccuguggagcaacggcgugcucgaguccgagaugaucauccccaagaacuucgcgggccccgugagccagcacaacuaccgcccgggguaccacacccagaccgccggccccuggcaccuggggcggcuggagauggacuucgacuucugcgagggcacgaccgucguggugaccgaggacugcgggaaccgcggccccucccuccggaccacgaccgccagcggcaagcugaucaccgaguggugcugccgcagcugcacccugcccccgcuccgguaccgcggggaggacggcugcugguacgggauggagauccggccccugaaggagaaggaggagaaccuggucaacucccucgugacggccggccacgggcagaucgacaacuucagccugggcgugcugggcauggcccucuuccuggaggagaugcugcgcacccgggucgggaccaagcacgccauccuccugguggccguguccuucgucacccugaucacgggcaacaugagcuuccgcgaccucgggcgcgugauggugauggucggcgccaccaugaccgacgacaucgggaugggcgugaccuaccuggcccugcucgcggccuucaaggugcggcccacguucgccgccggccugcugcuccgcaagcugaccuccaaggagcugaugaugaccaccaucgggaucguccuccugagccaguccacgauccccgagagcauccuggagcucaccgacgcccuggcgcugggcaugauggugcucaagaucguccggaacauggagaaguaccagcuggccgugaccaucauggccauccugugcgugccgaacgccgucauccuccagaacgccuggaagguguccugcaccacgcuggcgguggucagcgugagcccccugcuccugaccagcucccagcagaaggccgacuggaucccccuggcccucaccaucaaggggcugaaccccaccgccaucuuccugacgacccucagccgcaccuccaagaagcggagcuggccgcugaacgaggcgaucauggccgugggcauggucuccauccuggccagcucccuccugaagaacgacauccccaugaccggcccccugguggccgggggccuccugacggugugcuacguccugaccgggcgcagcgccgaccucgagcuggagcgggcggccgacgugcgcugggaggagcaggccgagaucagcggcuccagccccauccuguccaucaccaucagcgaggacggguccaugagcaucaagaacgaggaggaggagcagacccucacgauccugauccggaccggccugcucgugaucuccggccuguucccggucagcauccccaucaccgccgccgcgugguaccugugggaggugaagaagcagcgcgccggggugcucugggacguccccagcccgccgcccgugggcaaggccgagcuggaggacggggccuaccggaucaagcagaagggcauccugggguacagccagaucggcgccggcguguacaaggaggggaccuuccacaccauguggcacgucacgcgcggcgcggugcucaugcacaaggggaagcggaucgagcccuccugggccgacgugaagaaggaccugaucagcuacggcgggggcuggaagcuggagggcgaguggaaggagggggaggagguccaggugcucgcccuggagcccggcaagaacccccgcgccgugcagaccaagcccgggcuguucaagaccaacaccggcacgaucggggccgucucccucgacuucagccccggcaccuccggcagccccaucguggacaagaaggggaagguggucggccuguacgggaacggcguggugacccgguccggcaccuacgucagcgcgaucgcccagacggagaaguccaucgaggacaaccccgagaucgaggacgacaucuuccgcaagaagcggcugaccaucauggaccugcaccccggggccggcaagaccaagcgcuaccuccccgccaucgugcgggaggcgaucaagcgcgggcugcggacccugauccucgccccgacgcgcguggucgccgccgagauggaggaggcccugcgcggccugcccauccgguaccagacccccgcgauccgcgccgagcacaccgggcgggagaucguggaccucaugugccacgccaccuucacgaugcgccugcugagccccauccgggugccgaacuacaaccucaucaucauggacgaggcccacuucaccgaccccgccagcaucgcggcccgcggcuacaucuccacccgggucgagaugggcgaggccgccgggaucuucaugaccgccacgccgcccggcagccgcgacccguucccccaguccaacgcgcccaucauggacgaggagcgggagauccccgagcgcagcuggaacuccgggcacgagugggugaccgacuucaagggcaagaccgugugguucgucccgagcaucaaggccgggaacgacaucgccgccugccugcggaagaacggcaagaaggugauccagcugucccgcaagaccuucgacagcgaguacaucaagacgcggaccaacgacugggacuucguggucaccaccgacaucuccgagaugggcgcgaacuucaaggccgagcgcgugaucgacccccggcgcugcaugaagcccgugauccucacggacggggaggagcgggucauccuggccggccccaugccggugacccacagcuccgccgcccagcgccgggggcgcgugggccgcaaccccaagaacgagaacgaccaguacaucuacaugggggagccccuggagaacgacgaggacugcgcgcacuggaaggaggccaagaugcuccuggacaacaucaacacccccgagggcaucaucccgagcauguucgagcccgagcgggagaaggucgacgccaucgacggcgaguaccgccugcgcggggaggcccgcaagaccuucguggaccucaugcggcgcggcgaccugcccgucuggcuggccuaccggguggcggccgaggggaucaacuacgccgaccgccgguggugcuucgacggcgugaagaacaaccagauccucgaggagaacgucgagguggagaucuggacgaaggagggggagcgcaagaagcugaagccgcgguggcuggacgcccgcaucuacuccgacccccucgcccugaaggaguucaaggaguucgcggccggccggaagucccugacccucaaccugaucaccgagaugggccgccugcccaccuucaugacgcagaaggccaagaacgcccucgacaaccuggcggugcugcacaccgccgaggccgggggccgggccuacaaccacgcccucuccgagcugcccgagacccuggagacccuccugcugcucacgcugcuggcgaccgucaccgggggcaucuuccucuuccugaugagcggcaaggggaucggcaagaugacccuggggaugugcugcaucaucaccgccuccauccuccugugguacgcccagauccagccgcacuggaucgccgccagcaucauccuggaguucuuccucaucgugcugcugauccccgagcccgagaagcagcgcacgccccaggacaaccagcucaccuacguggucaucgcgauccugaccgugguggccgccaccauggccaacgagaugggcuuccuggagaagacgaagaaggacuucgggcucggcuccaucaccacccagcagccggagagcaacauccuggacaucgaccugcggcccgccagcgcguggacccucuacgccgucgccacgaccuucaucacccccaugcugcgccacuccaucgagaacagcuccgugaacgugagccugaccgccaucgccaaccaggcgacgguccucaugggccuggggaagggcuggccccuguccaagauggacaucggggugccgcuccuggccaucggcugcuacagccaggugaaccccaucacccugaccgccgcccuccugcugcucgucgcgcacuacgccaucaucgggcccggccugcaggccaaggccacccgggaggcccagaagcgcgcggccgccggcaucaugaagaaccccacgguggacgggaugaccgugaucgaccuggacccgauccccuacgaccccaaguucgagaagcagcucggccaggucaugcugcuggugcucugcgugacccagguccugaugaugcggaccacgugggcccugugcgaggcccucacccuggcgaccgggcccaucuccacccugugggagggcaacccggggcgcuucuggaacacgaccaucgccgugagcauggccaacaucuuccgcggcuccuaccucgccggcgccgggcugcuguucagcaucaugaagaacaccgcgaacacccggcgcggcacggggaacaccggcgagacccucggcgagaaguggaagaaccggcugaacgcccuggggaaguccgaguuccagaucuacaagaaguccggcauccaggagguggaccgcacccucgccaaggaggggaucaagcggggcgagacggaccaccacgccgucucccgcgggagcgcgaagcugcggugguucguggagcgcaaccuggugacccccgagggcaaggucguggaccucggcugcgggcggggcgggugguccuacuacugcggcgggcugaagaacgugaaggaggucaagggccugaccaagggcgggcccggccacgaggagcccaucccgaugagcaccuacggguggaaccucgugcgccugcaguccggcguggacgucuucuucacgccgcccgagaagugcgacacccugcucugcgacaucggggagagcucccccaacccgaccguggaggccggccggacccugcgcgugcugaaccucgucgagaacuggcugaacaacaacacccaguucugcaucaaggugcugaaccccuacaugcccagcgugaucgagaagauggagacgcugcagcggaaguacggcggggcccucguccgcaacccgcugagccggaacuccacccacgagauguacugggugagcaacgccuccggcaacaucgugagcuccgucaacaugaucagccgcaugcugaucaaccgguucaccaugcgccacaagaaggccaccuacgagcccgacguggaccucggguccggcacgcggaacaucgggaucgagagcgagacccccaaccuggacaucaucggcaagcgcaucgagaagaucaagcaggagcacgagaccuccuggcacuacgaccaggaccaccccuacaagaccugggcguaccacggcagcuacgagacgaagcagaccggguccgccagcuccauggugaacggcgucgugcgccugcucaccaagccgugggacgugauccccauggucacccagauggccaugacggacaccacccccuucgggcagcagcggguguucaaggagaaggucgacacccgcacgcaggagcccaaggagggcaccaagaagcugaugaagaucaccgccgaguggcuguggaaggagcucggcaagaagaagaccccgcggaugugcacgcgcgaggaguucacccggaaggugcgcagcaacgccgcgcugggggccaucuucaccgacgagaacaaguggaaguccgcccgggaggccguggaggacagcggcuucugggagcuggucgacaaggagcgcaaccuccaccuggaggggaagugcgagaccugcguguacaacaugaugggcaagcgggagaagaagcugggggaguucggcaaggccaagggcucccgcgcgaucugguacauguggcucggggcccgguuccuggaguucgaggcccugggcuuccucaacgaggaccacugguucagccgcgagaacucccugagcgggguggagggcgaggggcugcacaagcucggcuacauccugcgggacgucagcaagaaggagggcggggccauguacgcggacgacacggccggcugggacacccgcaucacccuggaggaccucaagaacgaggagauggugaccaaccacauggagggggagcacaagaagcuggccgaggccaucuucaagcugacguaccagaacaaggugguccgggugcagcgccccacgccccggggcaccgugauggacaucaucucccgccgggaccagcgcgggagcggccaggucgugaccuacggccucaacacguucaccaacauggaggcccagcugauccggcagauggagggggagggcguguucaaguccauccagcagcugaccgucaaggaggagaucgcggugaagaacuggcucauccgcguggggcgcgagcggcugagccgcauggccaucuccggcgacgacugcgucgugaagccccuggacgaccgguucgccagcgcccucaccgcccugaacgacaugggcaaggugcgcaaggacauccagcagugggagccgucccggggguggaacgacuggacgcagguccccuucugcagccaccacuuccacgagcugaucaugaaggacggccgcgugcucgugguccccugccggaaccaggacgagcugaucgggcgcgcgcggaucucccagggcgccggguggagccugcgcgagaccgccugccucggcaaguccuacgcccagauguggagccugauguacuuccaccggcgcgaccugcggcucgccgcgaacgccaucugcuccgccgugcccagccacuggaucccgaccucccgcaccaccuggagcauccacgccacgcacgaguggaugaccaccgaggacaugcugaccguguggaaccgggucuggauccaggagaaccccuggauggaggacaagacgcccguggaguccugggaggagauccccuaccugggcaagcgcgaggaccaguggugcgggagccucaucggccugaccagccgggccaccugggcgaagaacauccagaccgccaucaaccaggugcgcucccugaucgggaacgaggaguacacggacuacaugccgagcaugaagcgguuccgccgcgaggaggaggaggccggcguccucugguga

SEQ ID NO: 9069 - RNA, 9876 nt, Artificial Sequence
  derived and/or modified CDS sequence (opt1) from DENV-2__KM279518__SS-prME
accgcggggaucaucaucaugaugauccccaccgugauggccuuccaccugaccacccggaacggggagccccacaugaucgucagccggcaggagaagggcaagagccuccuguucaagaccgagaacggggugaacaugugcacccugauggcgauggaccucggcgagcugugcgaggacaccaucaccuacaacugcccccugcuccgccagaacgagcccgaggacaucgacugcuggugcaacagcaccagcaccugggugaccuacgggaccugcaccgccaccggcgagcaccggcgcgagaagcggagcgucgcccuggugccccacgugggcauggggcuggagacccgcaccgagaccuggaugagcagcgagggcgccuggaagcacgcccagcggaucgagaccuggauccuccgccaccccggguucacgaucauggcggccauccuggccuacaccaucggcaccaccuacuuccagcggguccugaucuucauccuccugacggccgugacccccuccauggcgaugcgcugcaucgggaucagcaaccgggacuucguggagggcgucuccggcgggagcuggguggacaucgugcuggagcacggcuccugcgucaccaccauggccaagaacaagcccacgcucgacuucgagcugaucaagaccgaggccaagcaccuggccacccuccgcaaguacugcguggaggccaagcugaccaacacgaccaccgcgagccggugccccacccagggggagcccucccugaacgaggagcaggacaagcgcuucgugugcaagcacagcauggucgaccggggcuggggcaacgggugcggccucuucgggaagggcgggaucgugacgugcgccauguucacgugcaagaagaacauggagggcaaggugguccagcccgagaaccuggaguacaccaucgugaucacgccccacuccggcgaggagaacgccguggggaacgacacgggcaagcacgggaaggagaucaaggucacgccccagagcuccaucaccgaggccgagcugaccggcuacgggaccgugacgauggagugcagcccgcgcaccggccucgacuucaacgagauggugcugcugcagauggagaacaaggccuggcucguccaccggcagugguuccuggaccugccccuccccuggcugcccggcgcggacacccagggguccaacuggauccagaaggagacccuggugacguucaagaacccgcacgccaagaagcaggacgucguggugcucggcagccaggagggggccaugcacaccgcccugaccggcgccaccgagauccagaugagcuccgggaaccuccuguucacgggccaccugaagugccgccugcggauggacaagcuccagcugaagggcaugagcuacuccaugugcaccgggaaguucaaggucgugaaggagaucgcggagacccagcacggcaccaucgugauccgcguccaguacgagggggacggcagccccugcaagauccccuucgagaucauggaccuggagaagcggcacgugcucggccgccugaucacggugaaccccaucgucaccgagaaggacuccccggugaacaucgaggccgagccgcccuucggggacagcuacaucaucaucggcguggagcccgggcagcugaagcucuccugguucaagaagggcagcuccaucgggcagauguucgagaccaccaugcgcggcgccaagcggauggccauccugggcgacacggccugggacuucgggagccugggcggggucuucaccuccaucggcaaggcgcuccaccagguguucggggccaucuacggcgccgccuucagcggcguguccuggaccaugaagauccugaucggggucgugaucaccuggaucggcaugaacagccgcuccacgagccuguccgugagccugguccucguggggguggucacccuguaccugggcgugauggugcaggcggacuccgggugcgucgugagcuggaagaacaaggagcucaagugcggcagcggcaucuucaucaccgacaacgugcacaccuggacggagcaguacaaguuccagccggagucccccagcaagcuggccuccgccauccagaaggcccacgaggaggggaucugcggcauccggagcgucacccgccuggagaaccucauguggaagcagaucacccccgagcugaaccacauccugaccgagaacgaggugaagcucacgaucaugaccggggacaucaagggcaucaugcaggccgggaagcggucccugcgcccccagccgaccgagcugaaguacagcuggaaggcguggggcaaggccaagaugcucuccaccgagcugcacaaccacacguuccugaucgacggccccgagaccgccgagugccccaacaccaaccgggccuggaacagccucgagguggaggacuacggguucggcgucuucaccacgaacaucuggcugaagcugaaggagcgccaggacguguucugcgacuccaagcucaugagcgccgcgaucaaggacaaccgggccgugcacgccgacaugggguacuggaucgaguccgcccugaacgacaccuggaagaucgagaaggccagcuucaucgaggucaaguccugccacuggcccaagagccacacccugugguccaacggcgugcucgagagcgagaugaucauccccaagaacuucgcgggccccgugucccagcacaacuaccgccccggguaccacacccagaccgccggcccguggcaccuggggcggcuggagauggacuucgacuucugcgagggcacgaccgucguggugaccgaggacugcgggaaccgcggccccagccuccggaccacgaccgccagcggcaagcugaucaccgaguggugcugccgcuccugcacccugccgccccuccgguaccgcggggaggacggcugcugguacgggauggagauccggccgcugaaggagaaggaggagaaccuggucaacagccucgugacggccggccacgggcagaucgacaacuucucccugggcgugcugggcauggcccucuuccuggaggagaugcugcgcacccgggucgggaccaagcacgccauccuccugguggccgugagcuucgucacccugaucacgggcaacauguccuuccgcgaccucgggcgcgugauggugauggucggcgccaccaugaccgacgacaucgggaugggcgugaccuaccuggcccugcucgcggccuucaaggugcggcccacguucgccgccggccugcugcuccgcaagcugaccagcaaggagcugaugaugaccaccaucgggaucguccuccugucccagagcacgauccccgaguccauccuggagcucaccgacgcccuggcgcugggcaugauggugcucaagaucguccggaacauggagaaguaccagcuggccgugaccaucauggccauccugugcgugcccaacgccgucauccuccagaacgccuggaaggugagcugcaccacgcuggcgguggucuccgugagcccgcugcuccugaccuccagccagcagaaggccgacuggaucccccuggcccucaccaucaaggggcugaaccccaccgccaucuuccugacgacccucucccgcaccagcaagaagcgguccuggccccugaacgaggcgaucauggccgugggcauggucagcauccuggccuccagccuccugaagaacgacaucccgaugaccggcccccugguggccgggggccuccugacggugugcuacguccugaccgggcgcagcgccgaccucgagcuggagcgggcggccgacgugcgcugggaggagcaggccgagaucuccggcagcucccccauccugagcaucaccaucuccgaggacgggagcauguccaucaagaacgaggaggaggagcagacccucacgauccugauccggaccggccugcucgugaucagcggccuguuccccgucuccaucccgaucaccgccgccgcgugguaccugugggaggugaagaagcagcgcgccggggugcucugggacguccccuccccgccgcccgugggcaaggccgagcuggaggacggggccuaccggaucaagcagaagggcauccugggguacucccagaucggcgccggcguguacaaggaggggaccuuccacaccauguggcacgucacgcgcggcgcggugcucaugcacaaggggaagcggaucgagcccagcugggccgacgugaagaaggaccugaucuccuacggcgggggcuggaagcuggagggcgaguggaaggagggggaggagguccaggugcucgcccuggagcccggcaagaacccgcgcgccgugcagaccaagcccgggcuguucaagaccaacaccggcacgaucggggccgucagccucgacuucucccccggcaccagcggcucccccaucguggacaagaaggggaagguggucggccuguacgggaacggcguggugacccggagcggcaccuacgucuccgcgaucgcccagacggagaaguccaucgaggacaacccggagaucgaggacgacaucuuccgcaagaagcggcugaccaucauggaccugcaccccggggccggcaagaccaagcgcuaccuccccgccaucgugcgggaggcgaucaagcgcgggcugcggacccugauccucgcccccacgcgcguggucgccgccgagauggaggaggcccugcgcggccugccgauccgguaccagacccccgcgauccgcgccgagcacaccgggcgggagaucguggaccucaugugccacgccaccuucacgaugcgccugcugagccccauccgggugcccaacuacaaccucaucaucauggacgaggcccacuucaccgacccggccuccaucgcggcccgcggcuacaucagcacccgggucgagaugggcgaggccgccgggaucuucaugaccgccacgccgcccggcucccgcgaccccuucccgcagagcaacgcgcccaucauggacgaggagcgggagauccccgagcgcuccuggaacagcgggcacgagugggugaccgacuucaagggcaagaccgugugguucguccccuccaucaaggccgggaacgacaucgccgccugccugcggaagaacggcaagaaggugauccagcugagccgcaagaccuucgacuccgaguacaucaagacgcggaccaacgacugggacuucguggucaccaccgacaucagcgagaugggcgcgaacuucaaggccgagcgcgugaucgacccgcggcgcugcaugaagcccgugauccucacggacggggaggagcgggucauccuggccggccccaugcccgugacccacuccagcgccgcccagcgccgggggcgcgugggccgcaacccgaagaacgagaacgaccaguacaucuacaugggggagccccuggagaacgacgaggacugcgcgcacuggaaggaggccaagaugcuccuggacaacaucaacacccccgagggcaucauccccuccauguucgagccggagcgggagaaggucgacgccaucgacggcgaguaccgccugcgcggggaggcccgcaagaccuucguggaccucaugcggcgcggcgaccugcccgucuggcuggccuaccggguggcggccgaggggaucaacuacgccgaccgccgguggugcuucgacggcgugaagaacaaccagauccucgaggagaacgucgagguggagaucuggacgaaggagggggagcgcaagaagcugaagccccgguggcuggacgcccgcaucuacagcgacccgcucgcccugaaggaguucaaggaguucgcggccggccggaagucccugacccucaaccugaucaccgagaugggccgccugcccaccuucaugacgcagaaggccaagaacgcccucgacaaccuggcggugcugcacaccgccgaggccgggggccgggccuacaaccacgcccucagcgagcugcccgagacccuggagacccuccugcugcucacgcugcuggcgaccgucaccgggggcaucuuccucuuccugauguccggcaaggggaucggcaagaugacccuggggaugugcugcaucaucaccgccagcauccuccugugguacgcccagauccagccccacuggaucgccgccuccaucauccuggaguucuuccucaucgugcugcugaucccggagcccgagaagcagcgcacgccccaggacaaccagcucaccuacguggucaucgcgauccugaccgugguggccgccaccauggccaacgagaugggcuuccuggagaagacgaagaaggacuucgggcucggcagcaucaccacccagcagcccgagagcaacauccuggacaucgaccugcggccggccuccgcguggacccucuacgccgucgccacgaccuucaucacccccaugcugcgccacagcaucgagaacuccagcgugaacgugucccugaccgccaucgccaaccaggcgacgguccucaugggccuggggaagggcuggccccugagcaagauggacaucggggugccccuccuggccaucggcugcuacucccaggugaacccgaucacccugaccgccgcccuccugcugcucgucgcgcacuacgccaucaucgggcccggccugcaggccaaggccacccgggaggcccagaagcgcgcggccgccggcaucaugaagaaccccacgguggacgggaugaccgugaucgaccuggaccccaucccguacgaccccaaguucgagaagcagcucggccaggucaugcugcuggugcucugcgugacccagguccugaugaugcggaccacgugggcccugugcgaggcccucacccuggcgaccgggcccaucagcacccugugggagggcaaccccgggcgcuucuggaacacgaccaucgccguguccauggccaacaucuuccgcggcagcuaccucgccggcgccgggcugcuguucuccaucaugaagaacaccgcgaacacccggcgcggcacggggaacaccggcgagacccucggcgagaaguggaagaaccggcugaacgcccugggcaagagcgaguuccagaucuacaagaaguccggcauccaggagguggaccgcacccucgccaaggaggggaucaagcggggcgagacggaccaccacgccgucagccgcggguccgcgaagcugcggugguucguggagcgcaaccuggugaccccggagggcaaggucguggaccucggcugcgggcggggcggguggagcuacuacugcggcgggcugaagaacgugaaggaggucaagggccugaccaagggcgggcccggccacgaggagcccauccccauguccaccuacggguggaaccucgugcgccugcagagcggcguggacgucuucuucacgccgcccgagaagugcgacacccugcucugcgacaucggggaguccagccccaaccccaccguggaggccggccggacccugcgcgugcugaaccucgucgagaacuggcugaacaacaacacccaguucugcaucaaggugcugaacccguacaugcccagcgugaucgagaagauggaggcccugcagcggaaguacggcggggcccucguccgcaacccccugucccggaacagcacgcacgagauguacuggguguccaacgccagcggcaacaucguguccagcgucaacaugaucucccgcaugcugaucaaccgguucaccaugcgccacaagaaggcgaccuacgagccggacguggaccucgggagcggcacccggaacaucgggaucgaguccgagacgcccaaccuggacaucaucggcaagcgcaucgagaagaucaagcaggagcacgagaccagcuggcacuacgaccaggaccaccccuacaagaccugggccuaccacggcuccuacgagaccaagcagacggggagcgccuccagcauggugaacggcgucgugcgccugcucaccaagcccugggacgugaucccgauggucacccagauggccaugaccgacacgacccccuucgggcagcagcggguguucaaggagaaggucgacacccgcacccaggagcccaaggagggcacgaagaagcugaugaagaucaccgccgaguggcuguggaaggagcucggcaagaagaagacgccccggaugugcacccgcgaggaguucacgcggaaggugcgcuccaacgcggcccugggggccaucuucaccgacgagaacaaguggaaguccgcccgggaggccguggaggacuccggcuucugggagcuggucgacaaggagcgcaaccuccaccuggaggggaagugcgagaccugcguguacaacaugaugggcaagcgggagaagaagcugggggaguucggcaaggcgaagggcagccgcgccaucugguacauguggcucggggcccgguuccuggaguucgaggcccugggcuuccucaacgaggaccacugguucucccgcgagaacagccugagcgggguggagggcgaggggcugcacaagcucggcuacauccugcgggacgucuccaagaaggagggcggggcgauguacgccgacgacaccgccggcugggacacgcgcaucacccuggaggaccucaagaacgaggagauggugaccaaccacauggagggggagcacaagaagcuggccgaggccaucuucaagcugaccuaccagaacaaggugguccgggugcagcgccagacgccgcggggcaccgugauggacaucaucagccgccgggaccagcgcggguccggccaggucgugaccuacggccucaacaccuucacgaacauggaggcgcagcugauccggcagauggagggggagggcguguucaagagcauccagcagcugaccgucaaggaggagaucgccgugaagaacuggcucauccgcguggggcgcgagcggcugucccgcauggccaucagcggcgacgacugcgucgugaagccccuggacgaccgguucgccuccgcccucaccgcgcugaacgacaugggcaaggugcgcaaggacauccagcagugggagcccagccggggguggaacgacuggacccagguccccuucugcucccaccacuuccacgagcugaucaugaaggacggccgcgugcucguggucccgugccggaaccaggacgagcugaucgggcgcgcccggaucagccagggcgccggguggucccugcgcgagacggccugccucggcaagagcuacgcccagauguggucccugauguacuuccaccggcgcgaccugcggcucgcggccaacgccaucugcagcgccgugcccucccacuggauccccaccagccgcaccaccugguccauccacgccacccacgaguggaugacgaccgaggacaugcugaccguguggaaccgggucuggauccaggagaaccccuggauggaggacaagaccccgguggagagcugggaggagauccccuaccugggcaagcgcgaggaccaguggugcgggagccucaucggccugacgucccgggcgaccugggccaagaacauccagaccgccaucaaccaggugcgcagccugaucgggaacgaggaguacaccgacuacaugcccuccaugaagcgguuccgccgcgaggaggaggaggccggcguccucugguga

SEQ ID NO: 9070 - RNA, 9876 nt, Artificial Sequence
  derived and/or modified CDS sequence (opt1) from DENV-2__KM279519__SS-prME
accgcggggaucaucaucaugaugauccccaccgugauggccuuccaccugaccacccgcaacggggagccccacaugaucgucagccggcaggagaagggcaagagccuccuguucaagaccgagaacggggugaacaugugcacccugauggcgauggaccucggcgagcugugcgaggacaccaucaccuacaacugcccccugcuccgccagaacgagcccgaggacaucgacugcuggugcaacagcaccagcaccugggugaccuacgggaccugcaccgccaccggcgagcaccggcgcgagaagcggagcgucgcccuggugccccacgugggcauggggcuggagacccgcaccgagaccuggaugagcagcgagggcgccuggaagcacgcccagcggaucgagaccuggauccuccgccaccccggguucacgaucauggcggccauccuggccuacaccaucggcaccaccuacuuccagcggguccugaucuucauccuccugacggccgugacccccuccauggcgaugcgcugcaucgggaucagcaaccgggacuucguggagggcgucuccggcgggagcuggguggacaucgugcuggagcacggcuccugcgucaccaccauggccaagaacaagcccacgcucgacuucgagcugaucaagaccgaggccaagcaccuggccacccuccgcaaguacugcguggaggccaagcugaccaacacgaccaccgcgagccggugccccacccagggggagcccucccugaacgaggagcaggacaagcgcuucgugugcaagcacagcauggucgaccggggcuggggcaacgggugcggccucuucgggaagggcgggaucgugacgugcgccauguucacgugcaagaagaacauggagggcaaggugguccagcccgagaaccuggaguacaccaucgugaucacgccccacuccggcgaggagaacgccguggggaacgacacgggcaagcacgggaaggagaucaaggucacgccccagagcuccaucaccgaggccgagcugaccggcuacgggaccgugacgauggagugcagcccgcgcaccggccucgacuucaacgagauggugcugcugcagauggagaacaaggccuggcucguccaccggcagugguuccuggaccugccccuccccuggcugcccggcgcggacacccagggguccaacuggauccagaaggagacccuggugacguucaagaacccgcacgccaagaagcaggacgucguggugcucggcagccaggagggggccaugcacaccgcccugaccggcgccaccgagauccagaugagcuccgggaaccuccuguucacgggccaccugaagugccgccugcggauggacaagcuccagcugaagggcaugagcuacuccaugugcaccgggaaguucaaggucgugaaggagaucgcggagacccagcacggcaccaucgugauccgcguccaguacgagggggacggcagccccugcaagauccccuucgagaucauggaccuggagaagcggcacgugcucggccgccugaucacggugaaccccaucgucaccgagaaggacuccccggugaacaucgaggccgagccgcccuucggggacagcuacaucaucaucggcguggagcccgggcagcugaagcucuccugguucaagaagggcagcuccaucgggcagauguucgagaccaccaugcgcggcgccaagcggauggccauccugggcgacacggccugggacuucgggagccugggcggggucuucaccuccaucggcaaggcgcuccaccagguguucggggccaucuacggcgccgccuucagcggcguguccuggaccaugaagauccugaucggggucgugaucaccuggaucggcaugaacagccgcuccacgagccuguccgugagccugguccucguggggguggucacccuguaccugggcgugauggugcaggcggacuccgggugcgucgugagcuggaagaacaaggagcucaagugcggcagcggcaucuucaucaccgacaacgugcacaccuggacggagcaguacaaguuccagccggagucccccagcaagcuggccuccgccauccagaaggcccacgaggaggggaucugcggcauccggagcgucacccgccuggagaaccucauguggaagcagaucacccccgagcugaaccacauccugaccgagaacgaggugaagcucacgaucaugaccggggacaucaagggcaucaugcaggccgggaagcggucccugcgcccccagccgaccgagcugaaguacagcuggaaggcguggggcaaggccaagaugcucuccaccgagcugcacaaccacacguuccugaucgacggccccgagaccgccgagugccccaacaccaaccgggccuggaacagccucgagguggaggacuacggguucggcgucuucaccacgaacaucuggcugaagcugaaggagcgccaggacguguucugcgacuccaagcucaugagcgccgcgaucaaggacaaccgggccgugcacgccgacaugggguacuggaucgaguccgcccugaacgacaccuggaagaucgagaaggccagcuucaucgaggucaaguccugccacuggcccaagagccacacccugugguccaacggcgugcucgagagcgagaugaucauccccaagaacuucgcgggccccgugucccagcacaacuaccgccccggguaccacacccagaccgccggcccguggcaccuggggcggcuggagauggacuucgacuucugcgagggcacgaccgucguggugaccgaggacugcgggaaccgcggccccagccuccggaccacgaccgccagcggcaagcugaucaccgaguggugcugccgcuccugcacccugccgccccuccgguaccgcggggaggacggcugcugguacgggauggagauccggccgcugaaggagaaggaggagaaccuggucaacagccucgugacggccggccacgggcagaucgacaacuucucccugggcgugcugggcauggcccucuuccuggaggagaugcugcgcacccgggucgggaccaagcacgccauccuccugguggccgugagcuucgucacccugaucacgggcaacauguccuuccgcgaccucgggcgcgugauggugauggucggcgccaccaugaccgacgacaucgggaugggcgugaccuaccuggcccugcucgcggccuucaaggugcggcccacguucgccgccggccugcugcuccgcaagcugaccagcaaggagcugaugaugaccaccaucgggaucguccuccugucccagagcacgauccccgaguccauccuggagcucaccgacgcccuggcgcugggcaugauggugcucaagaucguccggaacauggagaaguaccagcuggccgugaccaucauggccauccugugcgugcccaacgccgucauccuccagaacgccuggaaggugagcugcaccacgcuggcgguggucuccgugagcccgcugcuccugaccuccagccagcagaaggccgacuggaucccccuggcccucaccaucaaggggcugaaccccaccgccaucuuccugacgacccucucccgcaccagcaagaagcgguccuggccccugaacgaggcgaucauggccgugggcauggucagcauccuggccuccagccuccugaagaacgacaucccgaugaccggcccccugguggccgggggccuccugacggugugcuacguccugaccgggcgcagcgccgaccucgagcuggagcgggcggccgacgugcgcugggaggagcaggccgagaucuccggcagcucccccauccugagcaucaccaucuccgaggacgggagcauguccaucaagaacgaggaggaggagcagacccucacgauccugauccggaccggccugcucgugaucagcggccuguuccccgucuccaucccgaucaccgccgccgcgugguaccugugggaggugaagaagcagcgcgccggggugcucugggacguccccuccccgccgcccgugggcaaggccgagcuggaggacggggccuaccggaucaagcagaagggcauccugggguacucccagaucggcgccggcguguacaaggaggggaccuuccacaccauguggcacgucacgcgcggcgcggugcucaugcacaaggggaagcggaucgagcccagcugggccgacgugaagaaggaccugaucuccuacggcgggggcuggaagcuggagggcgaguggaaggagggggaggagguccaggugcucgcccuggagcccggcaagaacccgcgcgccgugcagaccaagcccgggcuguucaagaccaacaccggcacgaucggggccgucagccucgacuucucccccggcaccagcggcucccccaucguggacaagaaggggaagguggucggccuguacgggaacggcguggugacccggagcggcaccuacgucuccgcgaucgcccagacggagaaguccaucgaggacaacccggagaucgaggacgacaucuuccgcaagaagcggcugaccaucauggaccugcaccccggggccggcaagaccaagcgcuaccuccccgccaucgugcgggaggcgaucaagcgcgggcugcggacccugauccucgcccccacgcgcguggucgccgccgagauggaggaggcccugcgcggccugccgauccgguaccagacccccgcgauccgcgccgagcacaccgggcgggagaucguggaccucaugugccacgccaccuucacgaugcgccugcugagccccauccgggugcccaacuacaaccucaucaucauggacgaggcccacuucaccgacccggccuccaucgcggcccgcggcuacaucagcacccgggucgagaugggcgaggccgccgggaucuucaugaccgccacgccgcccggcucccgcgaccccuucccgcagagcaacgcgcccaucauggacgaggagaaggagauccccgagcgguccuggaacagcgggcacgagugggugaccgacuucaagggcaagaccgugugguucguccccuccaucaaggccgggaacgacaucgccgccugccugcgcaagaacggcaagaaggugauccagcugagccggaagaccuucgacuccgaguacaucaagacgcgcaccaacgacugggacuucguggucaccaccgacaucagcgagaugggcgcgaacuucaaggccgagcgggugaucgacccgcgccggugcaugaagcccgugauccucacggacggggaggagcgcgucauccuggccggccccaugcccgugacccacuccagcgccgcccagcggcgcgggcgggugggccgcaacccgaagaacgagaacgaccaguacaucuacaugggggagccccuggagaacgacgaggacugcgcgcacuggaaggaggccaagaugcuccuggacaacaucaacacccccgagggcaucauccccuccauguucgagccggagcgcgagaaggucgacgccaucgacggcgaguaccggcugcgcggggaggcccggaagaccuucguggaccucaugcgccggggcgaccugcccgucuggcuggccuaccgcguggcggccgaggggaucaacuacgccgaccggcgcuggugcuucgacggcgugaagaacaaccagauccucgaggagaacgucgagguggagaucuggacgaaggagggggagcggaagaagcugaagccccgcuggcuggacgcccggaucuacagcgacccgcucgcccugaaggaguucaaggaguucgcggccggccgcaagucccugacccucaaccugaucaccgagaugggccggcugcccaccuucaugacgcagaaggccaagaacgcccucgacaaccuggcggugcugcacaccgccgaggccgggggccgcgccuacaaccacgcccucagcgagcugcccgagacccuggagacccuccugcugcucacgcugcuggcgaccgucaccgggggcaucuuccucuuccugauguccggcaaggggaucggcaagaugacccuggggaugugcugcaucaucaccgccagcauccuccugugguacgcccagauccagccccacuggaucgccgccuccaucauccuggaguucuuccucaucgugcugcugaucccggagcccgagaagcagcggacgccccaggacaaccagcucaccuacguggucaucgcgauccugaccgugguggccgccaccauggccaacgagaugggcuuccuggagaagacgaagaaggacuucgggcucggcagcaucaccacccagcagcccgagagcaacauccuggacaucgaccugcgcccggccuccgcguggacccucuacgccgucgccacgaccuucaucacccccaugcugcggcacagcaucgagaacuccagcgugaacgugucccugaccgccaucgccaaccaggcgacgguccucaugggccuggggaagggcuggccccugagcaagauggacaucggggugccccuccuggccaucggcugcuacucccaggugaacccgaucacccugaccgccgcccuccugcugcucgucgcgcacuacgccaucaucgggcccggccugcaggccaaggccacccgcgaggcccagaagcgggcggccgccggcaucaugaagaaccccacgguggacgggaugaccgugaucgaccuggaccccaucccguacgaccccaaguucgagaagcagcucggccaggucaugcugcuggugcucugcgugacccagguccugaugaugcgcaccacgugggcccugugcgaggcccucacccuggcgaccgggcccaucagcacccugugggagggcaaccccgggcgguucuggaacacgaccaucgccguguccauggccaacaucuuccgcggcagcuaccucgccggcgccgggcugcuguucuccaucaugaagaacaccgcgaacacccgccggggcacggggaacaccggcgagacccucggcgagaaguggaagaaccgccugaacgcccugggcaagagcgaguuccagaucuacaagaaguccggcauccaggagguggaccggacccucgccaaggaggggaucaagcgcggcgagacggaccaccacgccgucagccggggguccgcgaagcugcgcugguucguggagcggaaccuggugaccccggagggcaaggucguggaccucggcugcgggcgcggcggguggagcuacuacugcggcgggcugaagaacgugaaggaggucaagggccugaccaagggcgggcccggccacgaggagcccauccccauguccaccuacggguggaaccucgugcggcugcagagcggcguggacgucuucuucacgccgcccgagaagugcgacacccugcucugcgacaucggggaguccagccccaaccccaccguggaggccggccgcacccugcgggugcugaaccucgucgagaacuggcugaacaacaacacccaguucugcaucaaggugcugaacccguacaugcccagcgugaucgagaagauggaggcccugcagcgcaaguacggcggggcccucguccggaacccccugucccgcaacagcacgcacgagauguacuggguguccaacgccagcggcaacaucguguccagcgucaacaugaucucccggaugcugaucaaccgcuucaccaugcggcacaagaaggcgaccuacgagccggacguggaccucgggagcggcacccgcaacaucgggaucgaguccgagacgcccaaccuggacaucaucggcaagcggaucgagaagaucaagcaggagcacgagaccagcuggcacuacgaccaggaccaccccuacaagaccugggccuaccacggcuccuacgagaccaagcagacggggagcgccuccagcauggugaacggcgucgugcgccugcucaccaagcccugggacgugaucccgauggucacccagauggccaugaccgacacgacccccuucgggcagcagcgcguguucaaggagaaggucgacacccggacccaggagcccaaggagggcacgaagaagcugaugaagaucaccgccgaguggcuguggaaggagcucggcaagaagaagacgccccgcaugugcacccgggaggaguucacgcgcaaggugcgguccaacgcggcccugggggccaucuucaccgacgagaacaaguggaaguccgcccgcgaggccguggaggacuccggcuucugggagcuggucgacaaggagcggaaccuccaccuggaggggaagugcgagaccugcguguacaacaugaugggcaagcgcgagaagaagcugggggaguucggcaaggcgaagggcagccgggccaucugguacauguggcucggggcccgcuuccuggaguucgaggcccugggcuuccucaacgaggaccacugguucucccgggagaacagccugagcgggguggagggcgaggggcugcacaagcucggcuacauccugcgcgacgucuccaagaaggagggcggggcgauguacgccgacgacaccgccggcugggacacgcggaucacccuggaggaccucaagaacgaggagauggugaccaaccacauggagggggagcacaagaagcuggccgaggccaucuucaagcugaccuaccagaacaaggugguccgcgugcagcggccgacgccccgcggcaccgugauggacaucaucagccggcgcgaccagcggggguccggccaggucgugaccuacggccucaacaccuucacgaacauggaggcgcagcugauccgccagauggagggggagggcguguucaagagcauccagcagcugaccgucaaggaggagaucgccgugaagaacuggcucauccggguggggcgcgagcgccugucccggauggccaucagcggcgacgacugcgucgugaagccccuggacgaccgcuucgccuccgcccucaccgcgcugaacgacaugggcaaggugcggaaggacauccagcagugggagcccagccgcggguggaacgacuggacccaggucccguucugcucccaccacuuccacgagcugaucaugaaggacggccgggugcucgccgugcccugccgcaaccaggacgagcugaucgggcgggcccgcaucagccagggcgccggguggucccugcgggagacggccugccucggcaagagcuacgcgcagauguggucccugauguacuuccaccgccgggaccugcgccucgccgccaacgccaucugcagcgccguccccucccacuggauccccaccagccggaccaccugguccauccacgcgacccacgaguggaugacgaccgaggacaugcugaccguguggaaccgcguguggauccaggagaacccguggauggaggacaagacccccgucgagagcugggaggagauccccuaccugggcaagcgggaggaccaguggugcgggagccucaucggccugacgucccgcgccaccugggccaagaacauccagaccgccaucaaccaggugcggagccugaucgggaacgaggaguacaccgacuacaugcccuccaugaagcgcuuccggcgcgaggaggaggaggcgggcgugcucugguga

SEQ ID NO: 9071 - RNA, 9876 nt, Artificial Sequence
  derived and/or modified CDS sequence (opt1) from DENV-2__KM279520__SS-prME
accgccgggaucaucaucaugaugauccccaccgugauggccuuccaccugaccacccgcaacggggagccccacaugaucgucagccggcaggagaagggcaagagccuccuguucaagaccgagaacggggugaacaugugcacccugauggcgauggaccucggcgagcugugcgaggacaccaucaccuacaacugcccccugcuccgccagaacgagcccgaggacaucgacugcuggugcaacagcaccagcaccugggugaccuacgggaccugcaccgccaccggcgagcaccggcgcgagaagcggagcgucgcccuggugccccacgugggcauggggcuggagacccgcaccgagaccuggaugagcagcgagggcgccuggaagcacgcccagcggaucgagaccuggauccuccgccaccccggguucacgaucauggcggccauccuggccuacaccaucggcaccaccuacuuccagcggguccugaucuucauccuccugacggccgugacccccuccauggcgaugcgcugcaucgggaucagcaaccgggacuucguggagggcgucuccggcgggagcuggguggacaucgugcuggagcacggcuccugcgucaccaccauggcccgcaacaagcccacgcucgacuucgagcugaucaagaccgaggccaagcaccuggccacccuccggaaguacugcguggaggccaagcugaccaacacgaccaccgcgagccgcugccccacccagggggagcccucccugaacgaggagcaggacaagcgguucgugugcaagcacagcauggucgaccgcggcuggggcaacgggugcggccucuucgggaagggcgggaucgugacgugcgccauguucacgugcaagaagaacauggagggcaaggugguccagcccgagaaccuggaguacaccaucgugaucacgccccacuccggcgaggagaacgccguggggaacgacacgggcaagcacgggaaggagaucaaggucacgccccagagcuccaucaccgaggccgagcugaccggcuacgggaccgugacgauggagugcagcccgcggaccggccucgacuucaacgagauggugcugcugcagauggagaacaaggccuggcucguccaccgccagugguuccuggaccugccccuccccuggcugcccggcgcggacacccagggguccaacuggauccagaaggagacccuggugacguucaagaacccgcacgccaagaagcaggacgucguggugcucggcagccaggagggggccaugcacaccgcccugaccggcgccaccgagauccagaugagcuccgggaaccuccuguucacgggccaccugaagugccggcugcgcauggacaagcuccagcugaagggcaugagcuacuccaugugcaccgggaaguucaaggucgugaaggagaucgcggagacccagcacggcaccaucgugauccggguccaguacgagggggacggcagccccugcaagauccccuucgagaucauggaccuggagaagcgccacgcccucggccgccugaucacggugaaccccaucgugaccgagaaggacuccccggucaacaucgaggccgagccgcccuucggggacagcuacaucaucaucggcguggagcccgggcagcugaagcucuccugguucaagaagggcagcuccaucgggcagauguucgagaccaccaugcggggcgccaagcgcauggccauccugggcgacacggcgugggacuucgggagccugggcgggguguucaccuccaucggcaaggcccuccaccaggucuucggggccaucuacggcgccgcguucagcggcguguccuggaccaugaagauccugaucgggguggucaucaccuggaucggcaugaacagccgguccacgagccuguccgugagccuggugcucgucgggguggugacccuguaccugggcgucauggugcaggccgacuccgggugcguggucagcuggaagaacaaggagcucaagugcggcagcggcaucuucaucaccgacaacgugcacaccuggacggagcaguacaaguuccagccggagucccccagcaagcuggccuccgccauccagaaggcccacgaggaggggaucugcggcauccgcagcgugacccggcuggagaaccucauguggaagcagaucacccccgagcugaaccacauccugaccgagaacgaggucaagcucacgaucaugaccggggacaucaagggcaucaugcaggcggggaagcgcucccugcggccccagccgaccgagcugaaguacagcuggaaggccuggggcaaggccaagaugcucuccaccgagcugcacaaccacacguuccugaucgacggccccgagaccgccgagugccccaacaccaaccgcgccuggaacagccucgagguggaggacuacggguucggcguguucaccacgaacaucuggcugaagcugaaggagcggcaggacgucuucugcgacuccaagcucaugagcgcggccaucaaggacaaccgcgccgugcacgccgacaugggguacuggaucgaguccgcccugaacgacaccuggaagaucgagaaggcgagcuucaucgaggugaaguccugccacuggcccaagagccacacccugugguccaacggcguccucgagagcgagaugaucauccccaagaacuucgccggccccgugucccagcacaacuaccggcccggguaccacacccagaccgccggcccguggcaccuggggcgccuggagauggacuucgacuucugcgagggcacgaccguggucgugaccgaggacugcgggaaccggggccccagccuccgcaccacgaccgccagcggcaagcugaucaccgaguggugcugccgguccugcacccugccgccccuccgcuaccgcggggaggacggcugcugguacgggauggagauccgcccgcugaaggagaaggaggagaaccuggugaacagccucgucacggcgggccacgggcagaucgacaacuucucccugggcgugcugggcauggcccucuuccuggaggagaugcugcggacccgcguggggaccaagcacgccauccuccuggucgccgugagcuucgugacccugaucacgggcaacauguccuuccgcgaccucgggcgggucauggugauggugggcgccaccaugaccgacgacaucgggaugggcgucaccuaccuggcgcugcucgccgccuucaaggugcgccccacguucgccgccggccugcugcuccggaagcugaccagcaaggagcugaugaugaccaccaucgggaucgugcuccugucccagagcacgauccccgaguccauccuggagcucaccgacgcgcuggcccugggcaugaugguccucaagaucgugcgcaacauggagaaguaccagcuggccgucaccaucauggccauccugugcgugcccaacgccgugauccuccagaacgcguggaaggucagcugcaccacgcuggccgugguguccgucagcccgcugcuccugaccuccagccagcagaaggccgacuggaucccccuggcccucaccaucaaggggcugaaccccaccgcgaucuuccugacgacccucucccggaccagcaagaagcgcuccuggccccugaacgaggccaucauggccgugggcauggugagcauccuggccuccagccuccugaagaacgacaucccgaugaccggcccccuggucgccgggggccuccugacggugugcuacgugcugaccgggcggagcgcggaccucgagcuggagcgcgccgccgacguccggugggaggagcaggccgagaucuccggcagcucccccauccugagcaucaccaucuccgaggacgggagcauguccaucaagaacgaggaggaggagcagacccucacgauccugauccgcaccggccugcucgugaucagcggccuguuccccguguccaucccgaucaccgccgcggccugguaccugugggaggucaagaagcagcgggccggggugcucugggacgugcccuccccgccgcccgucggcaaggccgagcuggaggacggggccuaccgcaucaagcagaagggcauccugggguacucccagaucggcgcgggcguguacaaggaggggaccuuccacaccauguggcacgugacgcggggcgccguccucaugcacaaggggaagcgcaucgagcccagcugggccgacgugaagaaggaccugaucuccuacggcgggggcuggaagcuggagggcgaguggaaggagggggaggaggugcagguccucgcccuggagcccggcaagaacccgcgggccgugcagaccaagcccgggcuguucaagaccaacaccggcacgaucggggcggugagccucgacuucucccccggcaccagcggcucccccaucgucgacaagaaggggaagguggugggccuguacgggaacggcgucgugacccgcagcggcaccuacguguccgccaucgcccagacggagaaguccaucgaggacaacccggagaucgaggacgacaucuuccggaagaagcgccugaccaucauggaccugcaccccggggccggcaagaccaagcgguaccuccccgcgaucguccgcgaggccaucaagcgggggcugcgcacccugauccucgcccccacgcgcgugguggccgccgagauggaggaggcgcugcggggccugccgauccgcuaccagacccccgccauccgggccgagcacaccgggcgcgagaucgucgaccucaugugccacgccaccuucacgaugcggcugcugagccccauccgcgugcccaacuacaaccucaucaucauggacgaggcccacuucaccgacccggcguccaucgccgcccggggcuacaucagcacccgcguggagaugggcgaggccgccgggaucuucaugaccgcgacgccgcccggcucccgggaccccuucccgcagagcaacgcccccaucauggacgaggagcgcgagauccccgagcgguccuggaacagcgggcacgagugggucaccgacuucaagggcaagaccgugugguucgugcccuccaucaaggccgggaacgacaucgccgcgugccugcgcaagaacggcaagaaggucauccagcugagccggaagaccuucgacuccgaguacaucaagacgcgcaccaacgacugggacuucguggugaccaccgacaucagcgagaugggcgccaacuucaaggccgagcgggucaucgacccgcgccggugcaugaagcccgugauccucacggacggggaggagcgcgugauccuggccggccccaugcccgucacccacuccagcgccgcgcagcggcgcgggcgcgugggccggaacccgaagaacgagaacgaccaguacaucuacaugggggagccccuggagaacgacgaggacugcgcccacuggaaggaggccaagaugcuccuggacaacaucaacacccccgagggcaucauccccuccauguucgagccggagcgcgagaagguggacgccaucgacggcgaguaccggcugcgcggggaggcccggaagaccuucgucgaccucaugcgccggggcgaccugcccguguggcuggcguaccgcgucgccgccgaggggaucaacuacgccgaccggcgcuggugcuucgacggcgugaagaacaaccagauccucgaggagaacguggaggucgagaucuggacgaaggagggggagcggaagaagcugaagccccgcuggcuggacgcccggaucuacagcgacccgcucgcgcugaaggaguucaaggaguucgccgccggccgcaagucccugacccucaaccugaucaccgagaugggccggcugcccaccuucaugacgcagaaggccaagaacgcgcucgacaaccuggccgugcugcacaccgccgaggccgggggccgcgccuacaaccacgcgcucagcgagcugcccgagacccuggagacccuccugcugcucacgcugcuggccaccgugaccgggggcaucuuccucuuccugauguccggcaaggggaucggcaagaugacccuggggaugugcugcaucaucaccgccagcauccuccugugguacgcccagauccagccccacuggaucgccgcguccaucauccuggaguucuuccucaucguccugcugaucccggagcccgagaagcagcggacgccccaggacaaccagcucaccuacguggugaucgccauccugaccgucguggccgccaccauggccaacgagaugggcuuccuggagaagacgaagaaggacuucgggcucggcagcaucaccacccagcagcccgagagcaacauccuggacaucgaccugcgcccggcguccgccuggacccucuacgccguggccacgaccuucaucacccccaugcugcggcacagcaucgagaacuccagcgucaacgugucccugaccgccaucgcgaaccaggccacggugcucaugggccuggggaagggcuggccccugagcaagauggacaucggggucccccuccuggccaucggcugcuacucccaggugaacccgaucacccugaccgccgcgcuccugcugcucguggcccacuacgccaucaucgggcccggccugcaggccaaggccacccgcgaggcgcagaagcgggccgccgccggcaucaugaagaaccccacggucgacgggaugaccgugaucgaccuggaccccaucccguacgaccccaaguucgagaagcagcucggccaggugaugcugcugguccucugcgugacccaggugcugaugaugcgcaccacgugggcccugugcgaggcgcucacccuggccaccgggcccaucagcacccugugggagggcaaccccgggcgcuucuggaacacgaccaucgccgucuccauggccaacaucuuccggggcagcuaccucgccggcgcggggcugcuguucuccaucaugaagaacaccgccaacacccgccggggcacggggaacaccggcgagacccucggcgagaaguggaagaaccgccugaacgcccugggcaagagcgaguuccagaucuacaagaaguccggcauccaggagguggaccggacccucgccaaggaggggaucaagcgcggcgagacggaccaccacgcggugagccggggguccgccaagcugcgcugguucgucgagcggaaccuggugaccccggagggcaagguggucgaccucggcugcgggcgcggcggguggagcuacuacugcggcgggcugaagaacgugaaggaggugaagggccugaccaagggcgggcccggccacgaggagcccauccccauguccaccuacggguggaaccucguccggcugcagagcggcguggacguguucuucacgccgcccgagaagugcgacacccugcucugcgacaucggggaguccagccccaaccccaccgucgaggccggccgcacccugcgggugcugaaccucguggagaacuggcugaacaacaacacccaguucugcaucaagguccugaacccguacaugcccagcgugaucgagaagauggaggcccugcagcgcaaguacggcggggcccucgugcggaacccccugucccgcaacagcacgcacgagauguacugggucuccaacgcgagcggcaacaucguguccagcgugaacaugaucucccggaugcugaucaaccgcuucaccaugcggcacaagaaggccaccuacgagccggacgucgaccucgggagcggcacccgcaacaucgggaucgaguccgagacgcccaaccuggacaucaucggcaagcgcaucgagaagaucaagcaggagcacgagaccagcuggcacuacgaccaggaccaccccuacaagaccugggccuaccacggcuccuacgagaccaagcagacggggagcgccuccagcauggugaacggcgugguccggcugcucaccaagcccugggacgugaucccgauggugacccagauggccaugaccgacacgacccccuucgggcagcagcgcgucuucaaggagaagguggacacccggacccaggagcccaaggagggcacgaagaagcugaugaagaucaccgcggaguggcuguggaaggagcucggcaagaagaagacgccccggaugugcacccgggaggaguucacgcgcaagguccgguccaacgccgcccugggggccaucuucaccgacgagaacaaguggaaguccgcccgcgaggcgguggaggacuccggcuucugggagcugguggacaaggagcggaaccuccaccuggaggggaagugcgagaccugcgucuacaacaugaugggcaagcgcgagaagaagcugggggaguucggcaaggccaagggcagccgggccaucugguacauguggcucggggcccgcuuccuggaguucgaggcgcugggcuuccucaacgaggaccacugguucucccgggagaacagccugagcgggguggagggcgaggggcugcacaagcucggcuacauccugcgcgacguguccaagaaggagggcggggccauguacgccgacgacaccgccggcugggacacgcggaucacccuggaggaccucaagaacgaggagauggucaccaaccacauggagggggagcacaagaagcuggccgaggcgaucuucaagcugaccuaccagaacaagguggugcgcguccagcggccgacgccccgcggcaccgugauggacaucaucagccggcgcgaccagcggggguccggccagguggucaccuacggccucaacaccuucacgaacauggaggcccagcugauccgccagauggagggggagggcguguucaagagcauccagcagcugaccgugaaggaggagaucgccgucaagaacuggcucauccgcguggggcgggagcgccugucccggauggccaucagcggcgacgacugcguggucaagccccuggacgaccgcuucgccuccgcgcucaccgcccugaacgacaugggcaaggugcggaaggacauccagcagugggagcccagccgcggguggaacgacuggacccaggugccguucugcucccaccacuuccacgagcugaucaugaaggacggccggguccucguggugcccugccgcaaccaggacgagcugaucgggcgggcccgcaucagccagggcgccggguggucccugcgggagacggccugccucggcaagagcuacgcgcagauguggucccugauguacuuccaccgccgggaccugcgccucgccgccaacgccaucugcagcgccguccccucccacuggauccccaccagccggaccaccugguccauccacgcgacccacgaguggaugacgaccgaggacaugcugaccguguggaaccgcguguggauccaggagaacccguggauggaggacaagacccccgucgagacgugggaggagauccccuaccugggcaagcgggaggaccaguggugcgggagccucaucggccugaccagccgcgccaccugggccaagaacauccagaccgccaucaaccaggugcggucccugaucgggaacgaggaguacacggacuacaugcccagcaugaagcgcuuccgccgggaggaggaggaggcgggcgugcucugguga

SEQ ID NO: 9072 - RNA, 9876 nt, Artificial Sequence
  derived and/or modified CDS sequence (opt1) from DENV-2__KM279521__SS-prME
accgcggggaucaucaucaugaugauccccaccgugauggccuuccaccugaccacccggaacggggagccccacaugaucgucagccggcaggagaagggcaagagccuccuguucaagaccgagaacggggugaacaugugcacccugauggcgauggaccucggcgagcugugcgaggacaccaucaccuacaacugcccccugcuccgccagaacgagcccgaggacaucgacugcuggugcaacagcaccagcaccugggugaccuacgggaccugcaccgccaccggcgagcaccggcgcgagaagcggagcgucgcccuggugccccacgugggcauggggcuggagacccgcaccgagaccuggaugagcagcgagggcgccuggaagcacgcccagcggaucgagaccuggauccuccgccaccccggguucaccaucauggcggccauccuggccuacaccaucggcaccaccuacuuccagcggguccugaucuucauccuccugaccgccgugacccccuccauggcgaugcgcugcaucgggaucagcaaccgggacuucguggagggcgucuccggcgggagcuggguggacaucgugcuggagcacggcuccugcgucaccaccauggccaagaacaagcccacgcucgacuucgagcugaucaagaccgaggccaagcaccuggccacccuccgcaaguacugcguggaggccaagcugaccaacacgaccaccgcgagccggugccccacccagggggagccgucccugaacgaggagcaggacaagcgcuucgugugcaagcacagcauggucgaccggggcuggggcaacgggugcggccucuucgggaagggcgggaucgugacgugcgccauguucacgugcaagaagaacauggagggcaaggugguccagcccgagaaccuggaguacaccaucgugaucacgccccacuccggcgaggagaacgccguggggaacgacacgggcaagcacgggaaggagaucaaggucacgccccagagcuccaucaccgaggccgagcugaccggcuacgggaccgugacgauggagugcagcccgcgcaccggccucgacuucaacgagauggugcugcugcagauggagaacaaggccuggcucguccaccggcagugguuccuggaccugccccuccccuggcugcccggcgcggacacccagggguccaacuggauccagaaggagacccuggugacguucaagaacccgcacgccaagaagcaggacgucguggugcucggcagccaggagggggccaugcacaccgcccugaccggcgccaccgagauccagaugagcuccgggaaccuccuguucacgggccaccugaagugccgccugcggauggacaagcuccagcugaagggcaugagcuacuccaugugcaccgggaaguucaaggucgugaaggagaucgcggagacccagcacggcaccaucgugauccgcguccaguacgagggggacggcagccccugcaagauccccuucgagaucauggaccuggagaagcggcacgugcucggccgccugaucacggugaaccccaucgucaccgagaaggacuccaccgugaacaucgaggccgagccgcccuucggggacagcuacaucaucaucggcguggagcccgggcagcugaagcucuccugguucaagaagggcagcuccaucgggcagauguucgagaccacgaugcgcggcgccaagcggauggccauccugggcgacaccgccugggacuucgggagccugggcggggucuucaccuccaucggcaaggcgcuccaccagguguucggggccaucuacggcgccgccuucagcggcguguccuggaccaugaagauccugaucggggucgugaucacguggaucggcaugaacagccgcuccaccagccuguccgugagccugguccucguggggguggucacccuguaccugggcgugauggugcaggcggacuccgggugcgucgugagcuggaagaacaaggagcucaagugcggcagcggcaucuucaucaccgacaacgugcacacguggaccgagcaguacaaguuccagcccgaguccccgagcaagcuggccuccgccauccagaaggcccacgaggaggggaucugcggcauccggagcgucacccgccuggagaaccucauguggaagcagaucacccccgagcugaaccacauccugacggagaacgaggugaagcucaccaucaugaccggggacaucaagggcaucaugcaggccgggaagcggucccugcgcccccagcccaccgagcugaaguacagcuggaaggcguggggcaaggccaagaugcucuccacggagcugcacaaccacaccuuccugaucgacggcccggagaccgccgagugccccaacaccaaccgggccuggaacagccucgagguggaggacuacggguucggcgucuucacgaccaacaucuggcugaagcugaaggagcgccaggacguguucugcgacuccaagcucaugagcgccgcgaucaaggacaaccgggccgugcacgccgacaugggguacuggaucgaguccgcccugaacgacaccuggaagaucgagaaggccagcuucaucgaggucaaguccugccacuggcccaagagccacacccugugguccaacggcgugcucgagagcgagaugaucaucccgaagaacuucgcgggccccgugucccagcacaacuaccgccccggguaccacacccagacggccggccccuggcaccuggggcggcuggagauggacuucgacuucugcgagggcaccaccgucguggugaccgaggacugcgggaaccgcggcccgagccuccggacgaccaccgccagcggcaagcugaucaccgaguggugcugccgcuccugcacgcugccgccccuccgguaccgcggggaggacggcugcugguacgggauggagauccggccccugaaggagaaggaggagaaccuggucaacagccucgugaccgccggccacgggcagaucgacaacuucucccugggcgugcugggcauggcccucuuccuggaggagaugcugcgcacccgggucgggaccaagcacgccauccuccugguggccgugagcuucgucacgcugaucaccggcaacauguccuuccgcgaccucgggcgcgugauggugauggucggcgccaccaugaccgacgacaucgggaugggcgugacguaccuggcccugcucgcggccuucaaggugcggccgaccuucgccgccggccugcugcuccgcaagcugaccagcaaggagcugaugaugaccacgaucgggaucguccuccugucccagagcaccauccccgaguccauccuggagcucaccgacgcccuggcgcugggcaugauggugcucaagaucguccggaacauggagaaguaccagcuggccgugaccaucauggccauccugugcgugcccaacgccgucauccuccagaacgccuggaaggugagcugcacgacccuggcgguggucuccgugagcccccugcuccugaccuccagccagcagaaggccgacuggaucccgcuggcccucaccaucaaggggcugaaccccacggccaucuuccugaccacccucucccgcaccagcaagaagcgguccuggccccugaacgaggcgaucauggccgugggcauggucagcauccuggccuccagccuccugaagaacgacauccccaugacgggcccgcugguggccgggggccuccugaccgugugcuacguccugaccgggcgcagcgccgaccucgagcuggagcgggcggccgacgugcgcugggaggagcaggccgagaucuccggcagcucccccauccugagcaucaccaucuccgaggacgggagcauguccaucaagaacgaggaggaggagcagacgcucaccauccugauccggaccggccugcucgugaucagcggccuguuccccgucuccauccccaucaccgccgccgcgugguaccugugggaggugaagaagcagcgcgccggggugcucugggacgucccguccccgccgcccgugggcaaggccgagcuggaggacggggccuaccggaucaagcagaagggcauccugggguacucccagaucggcgccggcguguacaaggaggggaccuuccacacgauguggcacgucacccgcggcgcggugcucaugcacaaggggaagcggaucgagccgagcugggccgacgugaagaaggaccugaucuccuacggcgggggcuggaagcuggagggcgaguggaaggagggggaggagguccaggugcucgcccuggagcccggcaagaacccccgcgccgugcagaccaagccggggcuguucaagaccaacacgggcaccaucggggccgucagccucgacuucucccccggcaccagcggcucccccaucguggacaagaaggggaagguggucggccuguacgggaacggcguggugacccggagcggcacguacgucuccgcgaucgcccagaccgagaaguccaucgaggacaaccccgagaucgaggacgacaucuuccgcaagaagcggcugaccaucauggaccugcacccgggggccggcaagaccaagcgcuaccuccccgccaucgugcgggaggcgaucaagcgcgggcugcggacgcugauccucgcccccacccgcguggucgccgccgagauggaggaggcccugcgcggccugcccauccgguaccagaccccggcgauccgcgccgagcacaccgggcgggagaucguggaccucaugugccacgccacguucaccaugcgccugcugagccccauccgggugcccaacuacaaccucaucaucauggacgaggcccacuucaccgaccccgccuccaucgcggcccgcggcuacaucagcacccgggucgagaugggcgaggccgccgggaucuucaugacggccaccccgcccggcucccgcgaccccuucccccagagcaacgcgccgaucauggacgaggagcgggagauccccgagcgcuccuggaacagcgggcacgagugggugaccgacuucaagggcaagaccgugugguucguccccuccaucaaggccgggaacgacaucgccgccugccugcggaagaacggcaagaaggugauccagcugagccgcaagacguucgacuccgaguacaucaagacccggaccaacgacugggacuucguggucaccacggacaucagcgagaugggcgcgaacuucaaggccgagcgcgugaucgacccccggcgcugcaugaagccggugauccucaccgacggggaggagcgggucauccuggccggccccaugcccgugacccacuccagcgccgcccagcgccgggggcgcgugggccgcaaccccaagaacgagaacgaccaguacaucuacaugggggagccgcuggagaacgacgaggacugcgcgcacuggaaggaggccaagaugcuccuggacaacaucaacacccccgagggcaucauccccuccauguucgagcccgagcgggagaaggucgacgccaucgacggcgaguaccgccugcgcggggaggcccgcaagacguucguggaccucaugcggcgcggcgaccugccggucuggcuggccuaccggguggcggccgaggggaucaacuacgccgaccgccgguggugcuucgacggcgugaagaacaaccagauccucgaggagaacgucgagguggagaucuggaccaaggagggggagcgcaagaagcugaagccccgguggcuggacgcccgcaucuacagcgacccccucgcccugaaggaguucaaggaguucgcggccggccggaagucccugacccucaaccugaucaccgagaugggccgccugccgacguucaugacccagaaggccaagaacgcccucgacaaccuggcggugcugcacaccgccgaggccgggggccgggccuacaaccacgcccucagcgagcugcccgagacccuggagacgcuccugcugcucacccugcuggcgaccgucaccgggggcaucuuccucuuccugauguccggcaaggggaucggcaagaugacccuggggaugugcugcaucaucacggccagcauccuccugugguacgcccagauccagccccacuggaucgccgccuccaucauccuggaguucuuccucaucgugcugcugauccccgagccggagaagcagcgcacgccccaggacaaccagcucaccuacguggucaucgcgauccugaccgugguggccgccacgauggccaacgagaugggcuuccuggagaagaccaagaaggacuucgggcucggcagcaucaccacccagcagcccgagagcaacauccuggacaucgaccugcggcccgccuccgcguggacgcucuacgccgucgccaccaccuucaucaccccgaugcugcgccacagcaucgagaacuccagcgugaacgugucccugacggccaucgccaaccaggcgaccguccucaugggccuggggaagggcuggccccugagcaagauggacaucggggugccccuccuggccaucggcugcuacucccaggugaaccccaucacccugaccgccgcccuccugcugcucgucgcgcacuacgccaucaucgggccgggccugcaggccaaggccacgcgggaggcccagaagcgcgcggccgccggcaucaugaagaaccccaccguggacgggaugaccgugaucgaccuggaccccauccccuacgacccgaaguucgagaagcagcucggccaggucaugcugcuggugcucugcgugacccagguccugaugaugcggacgaccugggcccugugcgaggcccucacccuggcgaccgggcccaucagcacgcugugggagggcaaccccgggcgcuucuggaacaccaccaucgccguguccauggccaacaucuuccgcggcagcuaccucgccggcgccgggcugcuguucuccaucaugaagaacaccgcgaacacgcggcgcggcaccgggaacaccggcgagacccucggcgagaaguggaagaaccggcugaacgcccugggcaagagcgaguuccagaucuacaagaaguccggcauccaggagguggaccgcacgcucgccaaggaggggaucaagcggggcgagaccgaccaccacgccgucagccgcggguccgcgaagcugcggugguucguggagcgcaaccuggugacccccgagggcaaggucguggaccucggcugcgggcggggcggguggagcuacuacugcggcgggcugaagaacgugaaggaggucaagggccugaccaagggcgggccgggccacgaggagcccauccccauguccacguacggguggaaccucgugcgccugcagagcggcguggacgucuucuucacgccgcccgagaagugcgacacccugcucugcgacaucggggaguccagccccaaccccaccguggaggccggccggacccugcgcgugcugaaccucgucgagaacuggcugaacaacaacacgcaguucugcaucaaggugcugaaccccuacaugcccagcgugaucgagaagauggaggcccugcagcggaaguacggcggggcccucguccgcaacccccugucccggaacagcacccacgagauguacuggguguccaacgccagcggcaacaucguguccagcgucaacaugaucucccgcaugcugaucaaccgguucaccaugcgccacaagaaggcgaccuacgagcccgacguggaccucgggagcggcacgcggaacaucgggaucgaguccgagaccccgaaccuggacaucaucggcaagcgcaucgagaagaucaagcaggagcacgagaccagcuggcacuacgaccaggaccaccccuacaagaccugggccuaccacggcuccuacgagacgaagcagaccgggagcgccuccagcauggugaacggcgucgugcgccugcucaccaagcccugggacgugauccccauggucacccagauggccaugacggacaccaccccguucgggcagcagcggguguucaaggagaaggucgacacccgcacgcaggagcccaaggagggcaccaagaagcugaugaagaucaccgccgaguggcuguggaaggagcucggcaagaagaagacgccccggaugugcacgcgcgaggaguucacccggaaggugcgcuccaacgcggcccugggggccaucuucaccgacgagaacaaguggaaguccgcccgggaggccguggaggacuccggcuucugggagcuggucgacaaggagcgcaaccuccaccuggaggggaagugcgagaccugcguguacaacaugaugggcaagcgggagaagaagcugggggaguucggcaaggcgaagggcagccgcgccaucugguacauguggcucggggcccgguuccuggaguucgaggcccugggcuuccucaacgaggaccacugguucucccgcgagaacagccugagcgggguggagggcgaggggcugcacaagcucggcuacauccugcgggacgucuccaagaaggagggcggggcgauguacgccgacgacacggccggcugggacacccgcaucacccuggaggaccucaagaacgaggagauggugaccaaccacauggagggggagcacaagaagcuggccgaggccaucuucaagcugacguaccagaacaaggugguccgggugcagcgccccaccccgcggggcaccgugauggacaucaucagccgccgggaccagcgcggguccggccaggucgugaccuacggccucaacacguucaccaacauggaggcgcagcugauccggcagauggagggggagggcguguucaagagcauccagcagcugaccgucaaggaggagaucgccgugaagaacuggcucauccgcguggggcgcgagcggcugucccgcauggccaucagcggcgacgacugcgucgugaagccccuggacgaccgguucgccuccgcccucaccgcgcugaacgacaugggcaaggugcgcaaggacauccagcagugggagcccagccggggguggaacgacuggacgcagguccccuucugcucccaccacuuccacgagcugaucaugaaggacggccgcgugcucguggucccgugccggaaccaggacgagcugaucgggcgcgcccggaucagccagggcgccggguggucccugcgcgagaccgccugccucggcaagagcuacgcccagauguggucccugauguacuuccaccggcgcgaccugcggcucgcggccaacgccaucugcagcgccgugcccucccacuggauccccaccagccgcaccaccugguccauccacgccacgcacgaguggaugaccaccgaggacaugcugaccguguggaaccgggucuggauccaggagaaccccuggauggaggacaagacgccgguggagagcugggaggagauccccuaccugggcaagcgcgaggaccaguggugcgggagccucaucggccugaccucccgggcgaccugggccaagaacauccagaccgccaucaaccaggugcgcagccugaucgggaacgaggaguacacggacuacaugcccuccaugaagcgguuccgccgcgaggaggaggaggccggcguccucugguga

SEQ ID NO: 9073 - RNA, 9876 nt, Artificial Sequence
  derived and/or modified CDS sequence (opt1) from DENV-2__KM279583__SS-prME
accgccgggaucaucaucaugaugauccccaccgugauggccuuccaccugaccacccggaacggggagccccacaugaucgucagccggcaggagaagggcaagagccuccuguucaagaccgagaacggggugaacaugugcacccugauggcgauggaccucggcgagcugugcgaggacaccaucaccuacaacugcccccugcuccgccagaacgagcccgaggacaucgacugcuggugcaacagcaccagcaccugggugaccuacgggaccugcaccgccaccggcgagcaccggcgcgagaagcggagcgucgcccuggugccccacgugggcauggggcuggagacccgcaccgagaccuggaugagcagcgagggcgccuggaagcacgcccagcggaucgagaccuggauccuccgccaccccggguucacgaucauggcggccauccuggccuacaccaucggcaccaccuacuuccagcggguccugaucuucauccuccugacggccgugacccccuccauggcgaugcgcugcaucgggaucagcaaccgggacuucguggagggcgucuccggcgggagcuggguggacaucgugcuggagcacggcuccugcgucaccaccauggccaagaacaagcccacgcucgacuucgagcugaucaagaccgaggccaagcaccuggccacccuccgcaaguacugcguggaggccaagcugaccaacacgaccaccgcgagccggugccccacccagggggagcccucccugaacgaggagcaggacaagcgcuucgugugcaagcacagcauggucgaccggggcuggggcaacgggugcggccucuucgggaagggcgggaucgugacgugcgccauguucacgugcaagaagaacauggagggcaaggugguccagcccgagaaccuggaguacaccaucgugaucacgccccacuccggcgaggagaacgccguggggaacgacacgggcaagcacgggaaggagaucaaggucacgccccagagcuccaucaccgaggccgagcugaccggcuacgggaccgugacgauggagugcagcccgcgcaccggccucgacuucaacgagauggcccugcugcagauggagaacaaggcguggcucgugcaccggcagugguuccuggaccugccccuccccuggcugcccggcgccgacacccagggguccaacuggauccagaaggagacccuggucacguucaagaacccgcacgccaagaagcaggacguggucgugcucggcagccaggagggggccaugcacaccgcccugaccggcgcgaccgagauccagaugagcuccgggaaccuccuguucacgggccaccugaagugccgccugcggauggacaagcuccagcugaagggcaugagcuacuccaugugcaccgggaaguucaagguggucaaggagaucgccgagacccagcacggcaccaucgugauccgcgugcaguacgagggggacggcagccccugcaagauccccuucgagaucauggaccuggagaagcggcacguccucggccgccugaucacggugaaccccaucgugaccgagaaggacuccccggucaacaucgaggccgagccgcccuucggggacagcuacaucaucaucggcguggagcccgggcagcugaagcucuccugguucaagaagggcagcuccaucgggcagauguucgagaccaccaugcgcggcgccaagcggauggccauccugggcgacacggcgugggacuucgggagccugggcgggguguucaccuccaucggcaaggcccuccaccaggucuucggggccaucuacggcgccgcguucagcggcguguccuggaccaugaagauccugaucgggguggucaucaccuggaucggcaugaacagccgcuccacgagccuguccgugagccuggugcucgucgggguggugacccuguaccugggcgucauggugcaggccgacuccgggugcguggucagcuggaagaacaaggagcucaagugcggcagcggcaucuucaucaccgacaacgugcacaccuggacggagcaguacaaguuccagccggagucccccagcaagcuggccuccgccauccagaaggcccacgaggaggggaucugcggcauccggagcgugacccgccuggagaaccucauguggaagcagaucacccccgagcugaaccacauccugaccgagaacgaggucaagcucacgaucaugaccggggacaucaagggcaucaugcaggcggggaagcggucccugcgcccccagccgaccgagcugaaguacagcuggaaggccuggggcaaggccaagaugcucuccaccgagcugcacaaccacacguuccugaucgacggccccgagaccgccgagugccccaacaccaaccgggccuggaacagccucgagguggaggacuacggguucggcguguucaccacgaacaucuggcugaagcugaaggagcgccaggacgucuucugcgacuccaagcucaugagcgcggccaucaaggacaaccgggccgugcacgccgacaugggguacuggaucgaguccgcccugaacgacaccuggaagaucgagaaggcgagcuucaucgaggugaaguccugccacuggcccaagagccacacccugugguccaacggcguccucgagagcgagaugaucauccccaagaacuucgccggccccgugucccagcacaacuaccgccccggguaccacacccagaccgccggcccguggcaccuggggcggcuggagauggacuucgacuucugcgagggcacgaccguggucgugaccgaggacugcgggaaccgcggccccagccuccggaccacgaccgccagcggcaagcugaucaccgaguggugcugccgcuccugcacccugccgccccuccgguaccgcggggaggacggcugcugguacgggauggagauccggccgcugaaggagaaggaggagaaccuggugaacagccucgucacggcgggccacgggcagaucgacaacuucucccugggcgugcugggcauggcccucuuccuggaggagaugcugcgcacccggguggggaccaagcacgccauccuccuggucgccgugagcuucgugacccugaucacgggcaacauguccuuccgcgaccucgggcgcgucauggugauggugggcgccaccaugaccgacgacaucgggaugggcgucaccuaccuggcgcugcucgccgccuucaaggugcggcccacguucgccgccggccugcugcuccgcaagcugaccagcaaggagcugaugaugaccaccaucgggaucgugcuccugucccagagcacgauccccgaguccauccuggagcucaccgacgcgcuggcccugggcaugaugguccucaagaucgugcggaacauggagaaguaccagcuggccgucaccaucauggccauccugugcgugcccaacgccgugauccuccagaacgcguggaaggucagcugcaccacgcuggccgugguguccgucagcccgcugcuccugaccuccagccagcagaaggccgacuggaucccccuggcccucaccaucaaggggcugaaccccaccgcgaucuuccugacgacccucucccgcaccagcaagaagcgguccuggccccugaacgaggccaucauggccgugggcauggugagcauccuggccuccagccuccugaagaacgacaucccgaugaccggcccccuggucgccgggggccuccugacggugugcuacgugcugaccgggcgcagcgcggaccucgagcuggagcgggccgccgacguccgcugggaggagcaggccgagaucuccggcagcucccccauccugagcaucaccaucuccgaggacgggagcauguccaucaagaacgaggaggaggagcagacccucacgauccugauccggaccggccugcucgugaucagcggccuguuccccguguccaucccgaucaccgccgcggccugguaccugugggaggucaagaagcagcgcgccggggugcucugggacgugcccuccccgccgcccgucggcaaggccgagcuggaggacggggccuaccggaucaagcagaagggcauccugggguacucccagaucggcgcgggcguguacaaggaggggaccuuccacaccauguggcacgugacgcgcggcgccguccucaugcacaaggggaagcggaucgagcccagcugggccgacgugaagaaggaccugaucuccuacggcgggggcuggaagcuggagggcgaguggaaggagggggaggaggugcagguccucgcccuggagcccggcaagaacccgcgcgccgugcagaccaagcccgggcuguucaagaccaacaccggcacgaucggggcggugagccucgacuucucccccggcaccagcggcucccccaucgucgacaagaaggggaagguggugggccuguacgggaacggcgucgugacccggagcggcaccuacguguccgccaucgcccagacggagaaguccaucgaggacaacccggagaucgaggacgacaucuuccgcaagaagcggcugaccaucauggaccugcaccccggggccggcaagaccaagcgcuaccuccccgcgaucguccgggaggccaucaagcgcgggcugcggacccugauccucgcccccacgcgcgugguggccgccgagauggaggaggcgcugcgcggccugccgauccgguaccagacccccgccauccgcgccgagcacaccgggcgggagaucgucgaccucaugugccacgccaccuucacgaugcgccugcugagccccauccgggugcccaacuacaaccucaucaucauggacgaggcccacuucaccgacccggcguccaucgccgcccgcggcuacaucagcacccggguggagaugggcgaggccgccgggaucuucaugaccgcgacgccgcccggcucccgcgaccccuucccgcagagcaacgcccccaucauggacgaggagcgggagauccccgagcgcuccuggaacagcgggcacgagugggucaccgacuucaagggcaagaccgugugguucgugcccuccaucaaggccgggaacgacaucgccgcgugccugcggaagaacggcaagaaggucauccagcugagccgcaagaccuucgacuccgaguacaucaagacgcggaccaacgacugggacuucguggugaccaccgacaucagcgagaugggcgccaacuucaaggccgagcgcgucaucgacccgcggcgcugcaugaagcccgugauccucacggacggggaggagcgggugauccuggccggccccaugcccgucacccacuccagcgccgcgcagcgccgggggcgcgugggccgcaacccgaagaacgagaacgaccaguacaucuacaugggggagccccuggagaacgacgaggacugcgcccacuggaaggaggccaagaugcuccuggacaacaucaacacccccgagggcaucauccccuccauguucgagccggagcgggagaagguggacgccaucgacggcgaguaccgccugcgcggggaggcccgcaagaccuucgucgaccucaugcggcgcggcgaccugcccguguggcuggcguaccgggucgccgccgaggggaucaacuacgccgaccgccgguggugcuucgacggcgugaagaacaaccagauccucgaggagaacguggaggucgagaucuggacgaaggagggggagcgcaagaagcugaagccccgguggcuggacgcccgcaucuacagcgacccgcucgcgcugaaggaguucaaggaguucgccgccggccggaagucccugacccucaaccugaucaccgagaugggccgccugcccaccuucaugacgcagaaggccaagaacgcgcucgacaaccuggccgugcugcacaccgccgaggccgggggccgggccuacaaccacgcgcucagcgagcugcccgagacccuggagacccuccugcugcucacgcugcuggccaccgugaccgggggcaucuuccucuuccugauguccggcaaggggaucggcaagaugacccuggggaugugcugcaucaucaccgccagcauccuccugugguacgcccagauccagccccacuggaucgccgcguccaucauccuggaguucuuccucaucguccugcugaucccggagcccgagaagcagcgcacgccccaggacaaccagcucaccuacguggugaucgccauccugaccgucguggccgccaccauggccaacgagaugggcuuccuggagaagacgaagaaggacuucgggcucggcagcaucaccacccagcagcccgagagcaacauccuggacaucgaccugcggccggcguccgccuggacccucuacgccguggccacgaccuucaucacccccaugcugcgccacagcaucgagaacuccagcgucaacgugucccugaccgccaucgcgaaccaggccacggugcucaugggccuggggaagggcuggccccugagcaagauggacaucggggucccccuccuggccaucggcugcuacucccaggugaacccgaucacccugaccgccgcgcuccugcugcucguggcccacuacgccaucaucgggcccggccugcaggccaaggccacccgggaggcgcagaagcgcgccgccgccggcaucaugaagaaccccacggucgacgggaugaccgugaucgaccuggaccccaucccguacgaccccaaguucgagaagcagcucggccaggugaugcugcugguccucugcgugacccaggugcugaugaugcggaccacgugggcccugugcgaggcgcucacccuggccaccgggcccaucagcacccugugggagggcaaccccgggcgcuucuggaacacgaccaucgccgucuccauggccaacaucuuccgcggcagcuaccucgccggcgcggggcugcuguucuccaucaugaagaacaccgccaacacccggcgcggcacggggaacaccggcgagacccucggcgagaaguggaagaaccggcugaacgcccugggcaagagcgaguuccagaucuacaagaaguccggcauccaggagguggaccgcacccucgccaaggaggggaucaagcggggcgagacggaccaccacgcggugagccgcggguccgccaagcugcggugguucgucgagcgcaaccuggugaccccggagggcaagguggucgaccucggcugcgggcggggcggguggagcuacuacugcggcgggcugaagaacgugaaggaggugaagggccugaccaagggcgggcccggccacgaggagcccauccccauguccaccuacggguggaaccucguccgccugcagagcggcguggacguguucuucacgccgcccgagaagugcgacacccugcucugcgacaucggggaguccagccccaaccccaccgucgaggccggccggacccugcgcgugcugaaccucguggagaacuggcugaacaacaacacccaguucugcaucaagguccugaacccguacaugcccagcgugaucgagaagauggaggcccugcagcggaaguacggcggggcccucgugcgcaacccccugucccggaacagcacgcacgagauguacugggucuccaacgcgagcggcaacaucguguccagcgugaacaugaucucccgcaugcugaucaaccgguucaccaugcgccacaagaaggccaccuacgagccggacgucgaccucgggagcggcacccggaacaucgggaucgaguccgagacgcccaaccuggacaucaucggcaagcgcaucgagaagaucaagcaggagcacgagaccagcuggcacuacgaccaggaccaccccuacaagaccugggccuaccacggcuccuacgagaccaagcagacggggagcgccuccagcauggugaacggcgugguccgccugcucaccaagcccugggacgugaucccgauggugacccagauggccaugaccgacacgacccccuucgggcagcagcgggucuucaaggagaagguggacacccgcacccaggagcccaaggagggcacgaagaagcugaugaagaucaccgcggaguggcuguggaaggagcucggcaagaagaagacgccccggaugugcacccgcgaggaguucacgcggaagguccgcuccaacgccgcccugggggccaucuucaccgacgagaacaaguggaaguccgcccgggaggcgguggaggacuccggcuucugggagcugguggacaaggagcgcaaccuccaccuggaggggaagugcgagaccugcgucuacaacaugaugggcaagcgggagaagaagcugggggaguucggcaaggccaagggcagccgcgccaucugguacauguggcucggggcccgguuccuggaguucgaggcgcugggcuuccucaacgaggaccacugguucucccgcgagaacagccugagcgggguggagggcgaggggcugcacaagcucggcuacauccugcgggacguguccaagaaggagggcggggccauguacgccgacgacaccgccggcugggacacgcgcaucacccuggaggaccucaagaacgaggagauggucaccaaccacauggagggggagcacaagaagcuggccgaggcgaucuucaagcugaccuaccagaacaagguggugcggguccagcgcccgacgccccggggcaccgugauggacaucaucagccgccgggaccagcgcggguccggccagguggucaccuacggccucaacaccuucacgaacauggaggcccagcugauccggcagauggagggggagggcguguucaagagcauccagcagcugaccgugaaggaggagaucgccgucaagaacuggcucauccgcguggggcgcgagcggcugucccgcauggccaucagcggcgacgacugcguggucaagccccuggacgaccgguucgccuccgcgcucaccgcccugaacgacaugggcaaggugcgcaaggacauccagcagugggagcccagccggggguggaacgacuggacccaggugccguucugcucccaccacuuccacgagcugaucaugaaggacggccgcguccucguggugcccugccggaaccaggacgagcugaucgggcgcgcccggaucagccagggcgccggguggucccugcgcgagacggccugccucggcaagagcuacgcgcagauguggucccugauguacuuccaccggcgcgaccugcggcucgccgccaacgccaucugcagcgccguccccucccacuggauccccaccagccgcaccaccugguccauccacgcgacccacgaguggaugacgaccgaggacaugcugaccguguggaaccggguguggauccaggagaacccguggauggaggacaagacccccgucgagagcugggaggagauccccuaccugggcaagcgcgaggaccaguggugcgggagccucaucggccugacgucccgggccaccugggccaagaacauccagaccgccaucaaccaggugcgcagccugaucgggaacgaggaguacaccgacuacaugcccuccaugaagcgguuccgccgcgaggaggaggaggcgggcgugcucugguga

SEQ ID NO: 9074 - RNA, 9876 nt, Artificial Sequence
  derived and/or modified CDS sequence (opt1) from DENV-2__KM279585__SS-prME
accgcggggaucaucaucaugaugauccccaccgugauggccuuccaccugaccacccggaacggggagccccacaugaucgugagccggcaggagaagggcaagagccuccuguucaagaccgagaacggggugaacaugugcacccugauggcgauggaccucggcgagcugugcgaggacaccaucaccuacaacugcccccugcuccgccagaacgagcccgaggacaucgacugcuggugcaacagcaccagcaccugggugaccuacgggaccugcaccgccaccggcgagcaccggcgcgagaagcggagcgucgcccuggugccccacgugggcauggggcuggagacccgcaccgagaccuggaugagcagcgagggcgccuggaagcacgcccagcggaucgagaccuggauccuccgccaccccggguucacgaucauggcggccauccuggccuacaccaucggcaccaccuacuuccagcggguccugaucuucauccuccugacggccgugacccccuccauggcgaugcgcugcaucgggaucagcaaccgggacuucguggagggcgucuccggcgggagcuggguggacaucgugcuggagcacggcuccugcgucaccaccauggccaagaacaagcccacgcucgacuucgagcugaucaagaccgaggccaagcaccuggccacccuccgcaaguacugcguggaggccaagcugaccaacacgaccaccgcgagccggugccccacccagggggagcccucccugaacgaggagcaggacaagcgcuucgugugcaagcacagcauggucgaccggggcuggggcaacgggugcggccucuucgggaagggcgggaucgugacgugcgccauguucacgugcaagaagaacauggagggcaaggugguccagcccgagaaccuggaguacaccaucgugaucacgccccacuccggcgaggagaacgccguggggaacgacacgggcaagcacgggaaggagaucaaggucacgccccagagcuccaucaccgaggccgagcugaccggcuacgggaccgugacgauggagugcagcccgcgcaccggccucgacuucaacgagauggugcugcugcagauggagaacaaggccuggcucguccaccggcagugguuccuggaccugccccuccccuggcugcccggcgcggacacccagggguccaacuggauccagaaggagacccuggugacguucaagaacccgcacgccaagaagcaggacgucguggugcucggcagccaggagggggccaugcacaccgcccugaccggcgccaccgagauccagaugagcuccgggaaccuccuguucacgggccaccugaagugccgccugcggauggacaagcuccagcugaagggcaugagcuacuccaugugcaccgggaaguucaaggucgugaaggagaucgcggagacccagcacggcaccaucgugguccgcgugcaguacgagggggacggcagccccugcaagauccccuucgagaucauggaccuggagaagcggcacgugcucggccgccugaucacggucaaccccaucgugaccgagaaggacuccccggugaacaucgaggccgagccgcccuucggggacagcuacaucaucaucggcgucgagcccgggcagcugaagcucuccugguucaagaagggcagcuccaucgggcagauguucgagaccaccaugcgcggcgccaagcggauggccauccugggcgacacggccugggacuucgggagccugggcgggguguucaccuccaucggcaaggcgcuccaccagguguucggggccaucuacggcgccgccuucagcggcgucuccuggaccaugaagauccugaucgggguggugaucaccuggaucggcaugaacagccgcuccacgagccuguccgucagccuggugcucgugggggucgugacccuguaccugggcgugaugguccaggcggacuccgggugcguggugagcuggaagaacaaggagcucaagugcggcagcggcaucuucaucaccgacaacguccacaccuggacggagcaguacaaguuccagccggagucccccagcaagcuggccuccgccauccagaaggcccacgaggaggggaucugcggcauccggagcgugacccgccuggagaaccucauguggaagcagaucacccccgagcugaaccacauccugaccgagaacgaggugaagcucacgaucaugaccggggacaucaagggcaucaugcaggccgggaagcggucccugcgcccccagccgaccgagcugaaguacagcuggaaggcguggggcaaggccaagaugcucuccaccgagcugcacaaccacacguuccugaucgacggccccgagaccgccgagugccccaacaccaaccgggccuggaacagccucgaggucgaggacuacggguucggcguguucaccacgaacaucuggcugaagcugaaggagcgccaggacguguucugcgacuccaagcucaugagcgccgcgaucaaggacaaccgggccguccacgccgacaugggguacuggaucgaguccgcccugaacgacaccuggaagaucgagaaggccagcuucaucgaggugaaguccugccacuggcccaagagccacacccugugguccaacggcgugcucgagagcgagaugaucauccccaagaacuucgcgggccccgucucccagcacaacuaccgccccggguaccacacccagaccgccggcccguggcaccuggggcggcuggagauggacuucgacuucugcgagggcacgaccgugguggucaccgaggacugcgggaaccgcggccccagccuccggaccacgaccgccagcggcaagcugaucaccgaguggugcugccgcuccugcacccugccgccccuccgguaccgcggggaggacggcugcugguacgggauggagauccggccgcugaaggagaaggaggagaaccuggugaacagccucgugacggccggccacgggcagaucgacaacuucucccugggcguccugggcauggcccucuuccuggaggagaugcugcgcacccggguggggaccaagcacgccauccuccugguggccgucagcuucgugacccugaucacgggcaacauguccuuccgcgaccucgggcgcgugauggucauggugggcgccaccaugaccgacgacaucgggaugggcgugaccuaccuggcccugcucgcggccuucaagguccggcccacguucgccgccggccugcugcuccgcaagcugaccagcaaggagcugaugaugaccaccaucgggaucgugcuccugucccagagcacgauccccgaguccauccuggagcucaccgacgcccuggcgcugggcaugaugguccucaagaucgugcggaacauggagaaguaccagcuggccgugaccaucauggccauccugugcguccccaacgccgugauccuccagaacgccuggaaggugagcugcaccacgcuggcggucguguccgugagcccgcugcuccugaccuccagccagcagaaggccgacuggaucccccuggcccucaccaucaaggggcugaaccccaccgccaucuuccugacgacccucucccgcaccagcaagaagcgguccuggccccugaacgaggcgaucauggccgucggcauggugagcauccuggccuccagccuccugaagaacgacaucccgaugaccggcccccugguggccgggggccuccugacggucugcuacgugcugaccgggcgcagcgccgaccucgagcuggagcgggcggccgacgugcgcugggaggagcaggccgagaucuccggcagcucccccauccugagcaucaccaucuccgaggacgggagcauguccaucaagaacgaggaggaggagcagacccucacgauccugauccggaccggccugcucgucaucagcggccuguuccccguguccaucccgaucaccgccgccgcgugguaccugugggaggugaagaagcagcgcgccgggguccucugggacgugcccuccccgccgcccgugggcaaggccgagcuggaggacggggccuaccggaucaagcagaagggcauccugggguacucccagaucggcgccggcgucuacaaggaggggaccuuccacaccauguggcacgugacgcgcggcgcggugcucaugcacaaggggaagcggaucgagcccagcugggccgacgucaagaaggaccugaucuccuacggcgggggcuggaagcuggagggcgaguggaaggagggggaggagguccaggugcucgcccuggagcccggcaagaacccgcgcgccguccagaccaagcccgggcuguucaagaccaacaccggcacgaucggggccgugagccucgacuucucccccggcaccagcggcucccccaucguggacaagaaggggaaggucgugggccuguacgggaacggcguggucacccggagcggcaccuacguguccgcgaucgcccagacggagaaguccaucgaggacaacccggagaucgaggacgacaucuuccgcaagaagcggcugaccaucauggaccugcaccccggggccggcaagaccaagcgcuaccuccccgccaucgugcgggaggcgaucaagcgcgggcugcggacccugauccucgcccccacgcgcgucguggccgccgagauggaggaggcccugcgcggccugccgauccgguaccagacccccgcgauccgcgccgagcacaccgggcgggagaucguggaccucaugugccacgccaccuucacgaugcgccugcugagccccauccggguccccaacuacaaccucaucaucauggacgaggcccacuucaccgacccggccuccaucgcggcccgcggcuacaucagcacccggguggagaugggcgaggccgccgggaucuucaugaccgccacgccgcccggcucccgcgaccccuucccgcagagcaacgcgcccaucauggacgaggagcgggagauccccgagcgcuccuggaacagcgggcacgagugggugaccgacuucaagggcaagaccgucugguucgugcccuccaucaaggccgggaacgacaucgccgccugccugcggaagaacggcaagaaggugauccagcugagccgcaagaccuucgacuccgaguacaucaagacgcggaccaacgacugggacuucgucgugaccaccgacaucagcgagaugggcgcgaacuucaaggccgagcgcgugaucgacccgcggcgcugcaugaagcccgucauccucacggacggggaggagcgggugauccuggccggccccaugcccgugacccacuccagcgccgcccagcgccgggggcgcgucggccgcaacccgaagaacgagaacgaccaguacaucuacaugggggagccccuggagaacgacgaggacugcgcgcacuggaaggaggccaagaugcuccuggacaacaucaacacccccgagggcaucauccccuccauguucgagccggagcgggagaagguggacgccaucgacggcgaguaccgccugcgcggggaggcccgcaagaccuucgucgaccucaugcggcgcggcgaccugcccguguggcuggccuaccggguggcggccgaggggaucaacuacgccgaccgccgguggugcuucgacggcgucaagaacaaccagauccucgaggagaacguggagguggagaucuggacgaaggagggggagcgcaagaagcugaagccccgguggcuggacgcccgcaucuacagcgacccgcucgcccugaaggaguucaaggaguucgcggccggccggaagucccugacccucaaccugaucaccgagaugggccgccugcccaccuucaugacgcagaaggccaagaacgcccucgacaaccuggcgguccugcacaccgccgaggccgggggccgggccuacaaccacgcccucagcgagcugcccgagacccuggagacccuccugcugcucacgcugcuggcgaccgugaccgggggcaucuuccucuuccugauguccggcaaggggaucggcaagaugacccuggggaugugcugcaucaucaccgccagcauccuccugugguacgcccagauccagccccacuggaucgccgccuccaucauccuggaguucuuccucaucgugcugcugaucccggagcccgagaagcagcgcacgccccaggacaaccagcucaccuacgucgugaucgcgauccugaccguggucgccgccaccauggccaacgagaugggcuuccuggagaagacgaagaaggacuucgggcucggcagcaucaccacccagcagcccgagagcaacauccuggacaucgaccugcggccggccuccgcguggacccucuacgccguggccacgaccuucaucacccccaugcugcgccacagcaucgagaacuccagcgugaacgucucccugaccgccaucgccaaccaggcgacggugcucaugggccuggggaagggcuggccccugagcaagauggacaucggggugccccuccuggccaucggcugcuacucccaggucaacccgaucacccugaccgccgcccuccugcugcucguggcgcacuacgccaucaucgggcccggccugcaggccaaggccacccgggaggcccagaagcgcgcggccgccggcaucaugaagaaccccacgguggacgggaugaccgucaucgaccuggaccccaucccguacgaccccaaguucgagaagcagcucggccaggugaugcugcuggugcucugcgucacccaggugcugaugaugcggaccacgugggcccugugcgaggcccucacccuggcgaccgggcccaucagcacccugugggagggcaaccccgggcgcuucuggaacacgaccaucgccguguccauggccaacaucuuccgcggcagcuaccucgccggcgccgggcugcuguucuccaucaugaagaacaccgcgaacacccggcgcggcacggggaacaccggcgagacccucggcgagaaguggaagaaccggcugaacgcccugggcaagagcgaguuccagaucuacaagaaguccggcauccaggaggucgaccgcacccucgccaaggaggggaucaagcggggcgagacggaccaccacgccgugagccgcggguccgcgaagcugcggugguucguggagcgcaaccuggucaccccggagggcaaggugguggaccucggcugcgggcggggcggguggagcuacuacugcggcgggcugaagaacgucaaggaggugaagggccugaccaagggcgggcccggccacgaggagcccauccccauguccaccuacggguggaaccucgugcgccugcagagcggcgucgacguguucuucacgccgcccgagaagugcgacacccugcucugcgacaucggggaguccagccccaaccccaccguggaggccggccggacccugcgcguccugaaccucguggacaacuggcugaacaacaacacccaguucugcaucaaggugcugaacccguacaugcccagcgucaucgagaagauggaggcccugcagcggaaguacggcggggcccucgugcgcaacccccugucccggaacagcacgcacgagauguacuggguguccaacgccagcggcaacaucgucuccagcgugaacaugaucucccgcaugcugaucaaccgguucaccaugcgccacaagaaggcgaccuacgagccggacguggaccucgggagcggcacccggaacaucgggaucgaguccgagacgcccaaccuggacaucaucggcaagcgcaucgagaagaucaagcaggagcacgagaccagcuggcacuacgaccaggaccaccccuacaagaccugggccuaccacggcuccuacgagaccaagcagacggggagcgccuccagcauggucaacggcguggugcgccugcucaccaagcccugggacgucaucccgauggugacccagauggccaugaccgacacgacccccuucgggcagcagcgggucuucaaggagaagguggacacccgcacccaggagcccaaggagggcacgaagaagcugaugaagaucaccgccgaguggcuguggaaggagcucggcaagaagaagacgccccggaugugcacccgcgaggaguucacgcggaaggugcgcuccaacgcggcccugggggccaucuucaccgacgagaacaaguggaaguccgcccgggaggccgucgaggacuccggcuucugggagcugguggacaaggagcgcaaccuccaccuggaggggaagugcgagaccugcguguacaacaugaugggcaagcgggagaagaagcugggggaguucggcaaggcgaagggcagccgcgccaucugguacauguggcucggggcccgguuccuggaguucgaggcccugggcuuccucaacgaggaccacugguucucccgcgagaacagccugagcggggucgagggcgaggggcugcacaagcucggcuacauccugcgggacguguccaagaaggagggcggggcgauguacgccgacgacaccgccggcugggacacgcgcaucacccuggaggaccucaagaacgaggagauggugaccaaccacauggagggggagcacaagaagcuggccgaggccaucuucaagcugaccuaccagaacaaggucgugcgggugcagcgcccgacgccccggggcaccgucauggacaucaucagccgccgggaccagcgcggguccggccagguggugaccuacggccucaacaccuucacgaacauggaggcgcagcugauccggcagauggagggggagggcgucuucaagagcauccagcagcugaccgugaaggaggagaucgccgugaagaacuggcucauccgcgucgggcgcgagcggcugucccgcauggccaucagcggcgacgacugcguggugaagccccuggacgaccgguucgccuccgcccucaccgcgcugaacgacaugggcaagguccgcaaggacauccagcagugggagcccagccggggguggaacgacuggacccaggugccguucugcucccaccacuuccacgagcugaucaugaaggacggccgcgugcucgucgugcccugccggaaccaggacgagcugaucgggcgcgcccggaucagccagggcgccggguggucccugcgcgagacggccugccucggcaagagcuacgcccagauguggaaccugauguacuuccaccggcgcgaccugcggcucgcggccaacgccaucugcuccgccgugcccagccacuggauccccaccucccgcaccaccuggagcauccacgccacccacgaguggaugacgaccgaggacaugcugaccgucuggaaccggguguggauccaggagaacccguggauggaggacaagacccccguggaguccugggaggagauccccuaccugggcaagcgcgaggaccaguggugcgggagccucaucggccugacgagccgggcgaccugggccaagaacauccagaccgccaucaaccagguccgcucccugaucgggaacgaggaguacaccgacuacaugcccagcaugaagcgguuccgccgcgaggaggaggaggccggcgugcucugguga

SEQ ID NO: 9075 - RNA, 9876 nt, Artificial Sequence
  derived and/or modified CDS sequence (opt1) from DENV-2__KM279525__SS-prME
accgcgggcaucaucaucaugaugauccccaccgugauggccuuccaccugaccacccggaacggggagccccacaugaucgucagccggcaggagaagggcaagucccuccuguucaagaccgagaacggggugaacaugugcacccugauggcgauggaccucggcgagcugugcgaggacaccaucaccuacaacugcccccugcuccgccagaacgagcccgaggacaucgacugcuggugcaacagcaccuccaccugggugaccuacgggaccugcaccgccaccggcgagcaccggcgcgagaagcggagcgucgcccuggugccccacgugggcauggggcuggagacccgcaccgagaccuggauguccagcgagggcgccuggaagcacgcccagcggaucgagaccuggauccuccgccaccccggguucaccaucauggcggccauccuggccuacaccaucggcaccaccuacuuccagcggguccugaucuucauccuccugaccgccgugacccccuccauggcgaugcgcugcaucgggaucagcaaccgggacuucguggagggcgucuccggcgggagcuggguggacaucgugcuggagcacggcuccugcgucaccaccauggccaagaacaagcccacgcucgacuucgagcugaucaagaccgaggccaagcaccuggccacccuccgcaaguacugcguggaggccaagcugaccaacacgaccaccgcgagccggugccccacccagggggagcccucccugaacgaggagcaggacaagcgcuucgugugcaagcacagcauggucgaccggggcuggggcaacgggugcggccucuucgggaagggcgggaucgugacgugcgccauguucacgugcaagaagaacauggagggcaaggugguccagcccgagaaccuggaguacaccaucgugaucacgccccacuccggcgaggagaacgccguggggaacgacacgggcaagcacgggaaggagaucaaggucacgccccagagcuccaucaccgaggccgagcugaccggcuacgggaccgugacgauggagugcagcccgcgcaccggccucgacuucaacgagauggugcugcugcagauggagaacaaggccuggcucguccaccggcagugguuccuggaccugccccuccccuggcugcccggcgcggacacccagggguccaacuggauccagaaggagacccuggugacguucaagaacccgcacgccaagaagcaggacgucguggugcucggcagccaggagggggccaugcacaccgcccugaccggcgccaccgagauccagaugagcuccgggaaccuccuguucacgggccaccugaagugccgccugcggauggacaagcuccagcugaagggcaugagcuacuccaugugcaccgggaaguucaaggucgugaaggagaucgcggagacccagcacggcaccaucgugauccgcguccaguacgagggggacggcagccccugcaagauccccuucgagaucauggaccuggagaagcggcacgugcucggccgccugaucacggugaaccccaucgucaccgagaaggacuccccggugaacaucgaggccgagccgcccuucggggacagcuacaucaucaucggcguggagcccgggcagcugaagcucuccugguucaagaagggcagcuccaucgggcagauguucgagaccaccaugcgcggcgccaagcggauggccauccugggcgacacggccugggacuucgggagccugggcggggucuucaccuccaucggcaaggcgcuccaccagguguucggggccaucuacggcgccgccuucagcggcguguccuggaccaugaagauccugaucggggucgugaucaccuggaucggcaugaacagccgcuccacgagccuguccgugagccugguccucguggggguggucacccuguaccugggcgugauggugcaggcggacuccgggugcgucgugagcuggaagaacaaggagcucaagugcggcagcggcaucuucaucaccgacaacgugcacaccuggacggagcaguacaaguuccagccggagucccccagcaagcuggccuccgccauccagaaggcccacgaggaggggaucugcggcauccggagcgucacccgccuggagaaccucauguggaagcagaucacccccgagcugaaccacauccugaccgagaacgaggugaagcucacgaucaugaccggggacaucaagggcaucaugcaggccgggaagcggucccugcgcccccagccgaccgagcugaaguacagcuggaaggcguggggcaaggccaagaugcucuccaccgagcugcacaaccacacguuccugaucgacggccccgagaccgccgagugccccaacaccaaccgggccuggaacagccucgagguggaggacuacggguucggcgucuucaccacgaacaucuggcugaagcugaaggagcgccaggacguguucugcgacuccaagcucaugagcgccgcgaucaaggacaaccgggccgugcacgccgacaugggguacuggaucgaguccgcccugaacgacaccuggaagaucgagaaggccagcuucaucgaggucaaguccugccacuggcccaagagccacacccugugguccaacggcgugcucgagagcgagaugaucauccccaagaacuucgcgggccccgugucccagcacaacuaccgccccggguaccacacccagaccgccggcccguggcaccuggggcggcuggagauggacuucgacuucugcgagggcacgaccgucguggugaccgaggacugcgggaaccgcggccccagccuccggaccacgaccgccagcggcaagcugaucaccgaguggugcugccgcuccugcacccugccgccccuccgguaccgcggggaggacggcugcugguacgggauggagauccggccgcugaaggagaaggaggagaaccuggucaacagccucgugacggccggccacgggcagaucgacaacuucucccugggcgugcugggcauggcccucuuccuggaggagaugcugcgcacccgggucgggaccaagcacgccauccuccugguggccgugagcuucgucauccugaucaccggcaacauguccuuccgcgaccucgggcgcgugauggugauggucggcgccacgaugaccgacgacaucgggaugggcgugaccuaccuggcccugcucgcggccuucaaggugcggcccaccuucgccgccggccugcugcuccgcaagcugacgagcaaggagcugaugaugaccaccaucgggaucguccuccugucccagagcaccauccccgagaacauccuggagcucacggacgcccuggcgcugggcaugauggugcucaagaucguccggaacauggagaaguaccagcuggccgugaccaucauggccauccugugcgugcccaacgccgucauccuccagaacgccuggaagguguccugcaccacccuggcgguggucagcguguccccgcugcuccugacgagcucccagcagaaggccgacuggaucccccuggcccucaccaucaaggggcugaaccccaccgccaucuuccugaccacgcucagccgcaccuccaagaagcggagcuggccccugaacgaggcgaucauggccgugggcauggucuccauccuggccagcucccuccugaagaacgacaucccgaugaccggcccccugguggccgggggccuccugaccgugugcuacguccugacggggcgcagcgccgaccucgagcuggagcgggcggccgacgugcgcugggaggagcaggccgagaucagcggcuccagccccauccuguccaucaccaucagcgaggacggguccaugagcaucaagaacgaggaggaggagcagacccucaccauccugauccggacgggccugcucgugaucuccggccuguuccccgucagcaucccgaucaccgccgccgcgugguaccugugggaggugaagaagcagcgcgccggggugcucugggacguccccagcccgccgcccgugggcaaggccgagcuggaggacggggccuaccggaucaagcagaagggcauccugggguacagccagaucggcgccggcguguacaaggaggggaccuuccacaccauguggcacgucacccgcggcgcggugcucaugcacaaggggaagcggaucgagcccuccugggccgacgugaagaaggaccugaucagcuacggcgggggcuggaagcuggagggcgaguggaaggagggggaggagguccaggugcucgcccuggagcccggcaagaacccgcgcgccgugcagacgaagcccgggcuguucaagaccaacaccggcaccaucggggccgucucccucgacuucagccccggcacguccggcagccccaucguggacaagaaggggaagguggucggccuguacgggaacggcguggugacccgguccggcaccuacgucagcgcgaucgcccagaccgagaaguccaucgaggacaacccggagaucgaggacgacaucuuccgcaagaagcggcugacgaucauggaccugcaccccggggccggcaagaccaagcgcuaccuccccgccaucgugcgggaggcgaucaagcgcgggcugcggacccugauccucgcccccacccgcguggucgccgccgagauggaggaggcccugcgcggccugccgauccgguaccagacgcccgcgauccgcgccgagcacaccgggcgggagaucguggaccucaugugccacgccaccuucaccaugcgccugcugagccccauccgggugcccaacuacaaccucaucaucauggacgaggcccacuucacggacccggccagcaucgcggcccgcggcuacaucuccacccgggucgagaugggcgaggccgccgggaucuucaugaccgccacgccgcccggcagccgcgaccccuucccgcaguccaacgcgcccaucauggacgaggagcgggagauccccgagcgcagcuggaacuccgggcacgagugggugacggacuucaagggcaagaccgugugguucguccccagcaucaaggccgggaacgacaucgccgccugccugcggaagaacggcaagaaggugauccagcugucccgcaagaccuucgacagcgaguacaucaagacccggacgaacgacugggacuucguggucaccaccgacaucuccgagaugggcgcgaacuucaaggccgagcgcgugaucgacccgcggcgcugcaugaagcccgugauccucaccgacggggaggagcgggucauccuggccggccccaugcccgugacgcacagcuccgccgcccagcgccgggggcgcgugggccgcaacccgaagaacgagaacgaccaguacaucuacaugggggagccccuggagaacgacgaggacugcgcgcacuggaaggaggccaagaugcuccuggacaacaucaacacccccgagggcaucauccccagcauguucgagccggagcgggagaaggucgacgccaucgacggcgaguaccgccugcgcggggaggcccgcaagaccuucguggaccucaugcggcgcggcgaccugcccgucuggcuggccuaccggguggcggccgaggggaucaacuacgccgaccgccgguggugcuucgacggcgugaagaacaaccagauccucgaggagaacgucgagguggagaucuggaccaaggagggggagcgcaagaagcugaagccccgguggcuggacgcccgcaucuacuccgacccgcucgcccugaaggaguucaaggaguucgcggccggccgcaagagccugacgcucaaccugaucaccgagaugggccggcugcccaccuucaugacccagaaggccaagaacgcccucgacaaccuggcggugcugcacacggccgaggccgggggccgggccuacaaccacgcccucuccgagcugcccgagacccuggagacccuccugcugcucacccugcuggcgacggucaccgggggcaucuuccucuuccugaugagcggcaaggggaucggcaagaugacccuggggaugugcugcaucaucaccgccuccauccuccugugguacgcccagauccagccccacuggaucgccgccagcaucauccuggaguucuuccucaucgugcugcugaucccggagcccgagaagcagcgcacgccccaggacaaccagcucacguacguggucaucgcgauccugaccgugguggccgccaccauggccaacgagaugggcuuccuggagaagaccaagaaggacuucgggcucggcuccaucacgacccagcagcccgagagcaacauccuggacaucgaccugcggccggccagcgcguggacccucuacgccgucgccaccacguucaucacccccaugcugcgccacuccaucgagaacagcuccgugaacgugagccugaccgccaucgccaaccaggcgaccguccucaugggccuggggaagggcuggccccuguccaagauggacaucggggugccccuccuggccaucggcugcuacagccaggugaacccgaucacgcugaccgccgcccuccugcugcucgucgcgcacuacgccaucaucgggcccggccugcaggccaaggccacccgggaggcccagaagcgcgcggccgccggcaucaugaagaaccccaccguggacgggaugacggugaucgaccuggaccccaucccguacgaccccaaguucgagaagcagcucggccaggucaugcugcuggugcucugcgugacccagguccugaugaugcggaccaccugggcccugugcgaggcccucacgcuggcgaccgggcccaucuccacccugugggagggcaaccccgggcgcuucuggaacaccacgaucgccgugagcauggccaacaucuuccgcggcuccuaccucgccggcgccgggcugcuguucagcaucaugaagaacaccgcgaacacccggcgcggcaccgggaacacgggcgagacccucggcgagaaguggaagaaccggcugaacgcccuggggaaguccgaguuccagaucuacaagaaguccggcauccaggagguggaccgcacccucgccaaggaggggaucaagcggggcgagaccgaccaccacgccgucucccgcgggagcgcgaagcugcggugguucguggagcgcaaccuggugacgccggagggcaaggucguggaccucggcugcgggcggggcgggugguccuacuacugcggcgggcugaagaacgugaaggaggucaagggccugaccaagggcgggcccggccacgaggagcccauccccaugagcaccuacggguggaaccucgugcgccugcaguccggcguggacgucuucuucaccccgcccgagaagugcgacacgcugcucugcgacaucggggagagcucccccaaccccaccguggaggccggccggacccugcgcgugcugaaccucgucgagaacuggcugaacaacaacacccaguucugcaucaaggugcugaacccguacaugcccagcgugaucgagaagauggaggcccugcagcggaaguacggcggggcccucguccgcaacccccugagccggaacuccacccacgagauguacugggugagcaacgccuccggcaacaucgugagcuccgucaacaugaucagccgcaugcugaucaaccgguucacgaugcgccacaagaaggcgaccuacgagccggacguggaccucggguccggcacccggaacaucgggaucgagagcgagacccccaaccuggacaucaucggcaagcgcaucgagaagaucaagcaggagcacgagacguccuggcacuacgaccaggaccaccccuacaagaccugggccuaccacggcagcuacgagaccaagcagaccggguccgccagcuccauggugaacggcgucgugcgccugcucacgaagcccugggacgugaucccgauggucacccagauggccaugaccgacaccacgcccuucgggcagcagcggguguucaaggagaaggucgacacccgcacccaggagcccaaggagggcaccaagaagcugaugaagaucacggccgaguggcuguggaaggagcucggcaagaagaagacgccccggaugugcacccgcgaggaguucacccggaaggugcgcagcaacgcggcccugggggccaucuucacggacgagaacaaguggaaguccgcccgggaggccguggaggacagcggcuucugggagcuggucgacaaggagcgcaaccuccaccuggaggggaagugcgagaccugcguguacaacaugaugggcaagcgggagaagaagcugggggaguucggcaaggcgaagggcucccgcgccaucugguacauguggcucggggcccgguuccuggaguucgaggcccugggcuuccucaacgaggaccacugguucagccgcgagaacucccugagcgggguggagggcgaggggcugcacaagcucggcuacauccugcgggacgucagcaagaaggagggcggggcgauguacgccgacgacaccgccggcugggacacccgcaucacgcuggaggaccucaagaacgaggagauggugaccaaccacauggagggggagcacaagaagcuggccgaggccaucuucaagcugaccuaccagaacaaggugguccgggugcagcgcccgacgccccggggcaccgugauggacaucaucucccgccgggaccagcgcgggagcggccaggucgugaccuacggccucaacaccuucaccaacauggaggcgcagcugauccggcagauggagggggagggcguguucaaguccauccagcagcugacggucaaggaggagaucgccgugaagaacuggcucauccgcguggggcgcgagcggcugagccgcauggccaucuccggcgacgacugcgucgugaagccccuggacgaccgguucgccagcgcccucaccgcgcugaacgacaugggcaaggugcgcaaggacauccagcagugggagcccucccggggguggaacgacuggacccaggucccguucugcagccaccacuuccacgagcugaucaugaaggacggccgcgugcucgugguccccugccggaaccaggacgagcugaucgggcgcgcccggaucucccagggcgccggguggagccugcgcgagaccgccugccucggcaaguccuacgcccagauguggagccugauguacuuccaccggcgcgaccugcggcucgcggccaacgccaucugcuccgccgugcccagccacuggauccccacgucccgcaccaccuggagcauccacgccacccacgaguggaugaccacggaggacaugcugaccguguggaaccgggucuggauccaggagaacccguggauggaggacaagacccccguggaguccugggaggagauccccuaccugggcaagcgcgaggaccaguggugcgggagccucaucggccugaccagccgggcgacgugggccaagaacauccagaccgccaucaaccaggugcgcucccugaucgggaacgaggaguacaccgacuacaugcccagcaugaagcgguuccgccgcgaggaggaggaggccggcguccucugguga

SEQ ID NO: 9076 - RNA, 9876 nt, Artificial Sequence
  derived and/or modified CDS sequence (opt1) from DENV-2__KM279528__SS-prME
accgcggggaucaucaucaugaugauccccaccgugauggccuuccaccugaccacccggaacggggagccccacaugaucgucagccggcaggagaagggcaagagccuccuguucaagaccgagaacggggugaacaugugcacccugauggcgauggaccucggcgagcugugcgaggacaccaucaccuacaacugcccccugcuccgccagaacgagcccgaggacaucgacugcuggugcaacagcaccagcaccugggugaccuacgggaccugcaccgccaccggcgagcaccggcgcgagaagcggagcgucgcccuggugccccacgugggcauggggcuggagacccgcaccgagaccuggaugagcagcgagggcgccuggaagcacgcccagcggaucgagaccuggauccuccgccaccccggguucacgaucauggcggccauccuggccuacaccaucggcaccaccuacuuccagcggguccugaucuucauccuccugacggccgugacccccuccauggcgaugcgcugcaucgggaucagcaaccgggacuucguggagggcgucuccggcgggagcuggguggacaucgugcuggagcacggcuccugcgucaccaccauggccaagaacaagcccacgcucgacuucgagcugaucaagaccgaggccaagcaccuggccacccuccgcaaguacugcguggaggccaagcugaccaacacgaccaccgcgagccggugccccacccagggggagcccucccugaacgaggagcaggacaagcgcuucgugugcaagcacagcauggucgaccggggcuggggcaacgggugcggccucuucgggaagggcgggaucgugacgugcgccauguucacgugcaagaagaacauggagggcaaggugguccagcccgagaaccuggaguacaccaucgugaucacgccccacuccggcgaggagaacgccguggggaacgacacgggcaagcacgggaaggagaucaaggucacgccccagagcuccaucaccgaggccgagcugaccggcuacgggaccgugacgauggagugcagcccgcgcaccggccucgacuucaacgagauggugcugcugcagauggagaacaaggccuggcucguccaccggcagugguuccuggaccugccccuccccuggcugcccggcgcggacacccagggguccaacuggauccagaaggagacccuggugacguucaagaacccgcacgccaagaagcaggacgucguggugcucggcagccaggagggggccaugcacaccgcccugaccggcgccaccgagauccagaugagcuccgggaaccuccuguucacgggccaccugaagugccgccugcggauggacaagcuccagcugaagggcaugagcuacuccaugugcaccgggaaguucaaggucgugaaggagaucgcggagacccagcacggcaccaucgugauccgcguccaguacgagggggacggcagccccugcaagauccccuucgagaucauggaccuggagaagcggcacgugcucggccgccugaucacggugaaccccaucgucaccgagaaggacuccccggugaacaucgaggccgagccgcccuucggggacagcuacaucaucaucggcguggagcccgggcagcugaagcucuccugguucaagaagggcagcuccaucgggcagauguucgagaccaccaugcgcggcgccaagcggauggccauccugggcgacacggccugggacuucgggagccugggcggggucuucaccuccaucggcaaggcgcuccaccagguguucggggccaucuacggcgccgccuucagcggcguguccuggaccaugaagauccugaucggggucgugaucaccuggaucggcaugaacagccgcuccacgagccuguccgugagccugguccucguggggguggucacccuguaccugggcgugauggugcaggcggacuccgggugcgucgugagcuggaagaacaaggagcucaagugcggcagcggcaucuucaucaccgacaacgugcacaccuggacggagcaguacaaguuccagccggagucccccagcaagcuggccuccgccauccagaaggcccacgaggaggggaucugcggcauccggagcgucacccgccuggagaaccucauguggaagcagaucacccccgagcugaaccacauccugaccgagaacgaggugaagcucacgaucaugaccggggacaucaagggcaucaugcaggccgggaagcggucccugcgcccccagccgaccgagcugaaguacagcuggaaggcguggggcaaggccaagaugcucuccaccgagcugcacaaccacacguuccugaucgacggccccgagaccgccgagugccccaacaccaaccgggccuggaacagccucgagguggaggacuacggguucggcgucuucaccacgaacaucuggcugaagcugaaggagcgccaggacguguucugcgacuccaagcucaugagcgccgcgaucaaggacaaccgggccgugcacgccgacaugggguacuggaucgaguccgcccugaacgacaccuggaagaucgagaaggccagcuucaucgaggucaaguccugccacuggcccaagagccacacccugugguccaacggcgugcucgagagcgagaugaucauccccaagaacuucgcgggccccgugucccagcacaacuaccgccccggguaccacacccagaccgccggcccguggcaccuggggcggcuggagauggacuucgacuucugcgagggcacgaccgucguggugaccgaggacugcgggaaccgcggccccagccuccggaccacgaccgccagcggcaagcugaucaccgaguggugcugccgcuccugcacccugccgccccuccgguaccgcggggaggacggcugcugguacgggauggagauccggccgcugaaggagaaggaggagaaccuggucaacagccucgugacggccggccacgggcagaucgacaacuucucccugggcgugcugggcauggcccucuuccuggaggagaugcugcgcacccgggucgggaccaagcacgccauccuccugguggccgugagcuucgucacccugaucacgggcaacauguccuuccgcgaccucgggcgcgugauggugauggucggcgccaccaugaccgacgacaucgggaugggcgugaccuaccuggcccugcucgcggccuucaaggugcggcccacguucgccgccggccugcugcuccgcaagcugaccagcaaggagcugaugaugaccaccaucgggaucguccuccugucccagagcacgauccccaaguccauccuggagcucaccgacgcccuggcgcugggcaugauggugcucaagaucguccggaacauggagaaguaccagcuggccgugaccaucauggccauccugugcgugcccaacgccgucauccuccagaacgccuggaaggugagcugcaccacgcuggcgguggucuccgugagcccgcugcuccugaccuccagccagcagaaggccgacuggaucccccuggcccucaccaucaaggggcugaaccccaccgccaucuuccugacgacccucucccgcaccagcaagaagcgguccuggccccugaacgaggcgaucauggccgugggcauggucagcauccuggccuccagccuccugaagaacgacaucccgaugaccggcccccugguggccgggggccuccugacggugugcuacguccugaccgggcgcagcgccgaccucgagcuggagcgggcggccgacgugcgcugggaggagcaggccgagaucuccggcagcucccccauccugagcaucaccaucuccgaggacgggagcauguccaucaagaacgaggaggaggagcagacccucacgauccugauccggaccggccugcucgugaucagcggccuguuccccgucuccaucccgaucaccgccgccgcgugguaccugugggaggugaagaagcagcgcgccggggugcucugggacguccccuccccgccgcccgugggcaaggccgagcuggaggacggggccuaccggaucaagcagaagggcauccugggguacucccagaucggcgccggcguguacaaggaggggaccuuccacaccauguggcacgucacgcgcggcgcggugcucaugcacaaggggaagcggaucgagcccagcugggccgacgugaagaaggaccugaucuccuacggcgggggcuggaagcuggagggcgaguggaaggagggggaggagguccaggugcucgcccuggagcccggcaagaacccgcgcgccgugcagaccaagcccgggcuguucaagaccaacaccggcacgaucggggccgucagccucgacuucucccccggcaccagcggcucccccaucguggacaagaaggggaagguggucggccuguacgggaacggcguggugacccggagcggcaccuacgucuccgcgaucgcccagacggagaaguccaucgaggacaacccggagaucgaggacgacaucuuccgcaagaagcggcugaccaucauggaccugcaccccggggccggcaagaccaagcgcuaccuccccgccaucgugcgggaggcgaucaagcgcgggcugcggacccugauccucgcccccacgcgcguggucgccgccgagauggaggaggcccugcgcggccugccgauccgguaccagacccccgcgauccgcgccgagcacaccgggcgggagaucguggaccucaugugccacgccaccuucacgaugcgccugcugagccccauccgggugcccaacuacaaccucaucaucauggacgaggcccacuucaccgacccggccuccaucgcggcccgcggcuacaucagcacccgggucgagaugggcgaggccgccgggaucuucaugaccgccacgccgcccggcucccgcgaccccuucccgcagagcaacgcgcccaucauggacgaggagcgggagauccccgagcgcuccuggaacagcgggcacgagugggugaccgacuucaagggcaagaccgugugguucguccccuccaucaaggccgggaacgacaucgccgccugccugcggaagaacggcaagaaggugauccagcugagccgcaagaccuucgacuccgaguacaucaagacgcggaccaacgacugggacuucguggucaccaccgacaucagcgagaugggcgcgaacuucaaggccgagcgcgugaucgacccgcggcgcugcaugaagcccgugauccucacggacggggaggagcgggucauccuggccggccccaugcccgugacccacuccagcgccgcccagcgccgggggcgcgugggccgcaacccgaagaacgagaacgaccaguacaucuacaugggggagccccuggagaacgacgaggacugcgcgcacuggaaggaggccaagaugcuccuggacaacaucaacacccccgagggcaucauccccuccauguucgagccggagcgggagaaggucgacgccaucgacggcgaguaccgccugcgcggggaggcccgcaagaccuucguggaccucaugcggcgcggcgaccugcccgucuggcuggccuaccggguggcggccgaggggaucaacuacgccgaccgccgguggugcuucgacggcgugaagaacaaccagauccucgaggagaacgucgagguggagaucuggacgaaggagggggagcgcaagaagcugaagccccgguggcuggacgcccgcaucuacagcgacccgcucgcccugaaggaguucaaggaguucgcggccggccggaagucccugacccucaaccugaucaccgagaugggccgccugcccaccuucaugacgcagaaggccaagaacgcccucgacaaccuggcggugcugcacaccgccgaggccgggggccgggccuacaaccacgcccucagcgagcugcccgagacccuggagacccuccugcugcucacgcugcuggcgaccgucaccgggggcaucuuccucuuccugauguccggcaaggggaucggcaagaugacccuggggaugugcugcaucaucaccgccagcauccuccugugguacgcccagauccagccccacuggaucgccgccuccaucauccuggaguucuuccucaucgugcugcugaucccggagcccgagaagcagcgcacgccccaggacaaccagcucaccuacguggucaucgcgauccugaccgugguggccgccaccauggccaacgagaugggcuuccuggagaagacgaagaaggacuucgggcucggcagcaucaccacccagcagcccgagagcaacauccuggacaucgaccugcggccggccuccgcguggacccucuacgccgucgccacgaccuucaucacccccaugcugcgccacagcaucgagaacuccagcgugaacgugucccugaccgccaucgccaaccaggcgacgguccucaugggccuggggaagggcuggccccugagcaagauggacaucggggugccccuccuggccaucggcugcuacucccaggugaacccgaucacccugaccgccgcccuccugcugcucgucgcgcacuacgccaucaucgggcccggccugcaggccaaggccacccgggaggcccagaagcgcgcggccgccggcaucaugaagaaccccacgguggacgggaugaccgugaucgaccuggaccccaucccguacgaccccaaguucgagaagcagcucggccaggucaugcugcuggugcucugcgugacccagguccugaugaugcggaccacgugggcccugugcgaggcccucacccuggcgaccgggcccaucagcacccugugggagggcaaccccgggcgcuucuggaacacgaccaucgccguguccauggccaacaucuuccgcggcagcuaccucgccggcgccgggcugcuguucuccaucaugaagaacaccgcgaacacccggcgcggcacggggaacaccggcgagacccucggcgagaaguggaagaaccggcugaacgcccugggcaagagcgaguuccagaucuacaagaaguccggcauccaggagguggaccgcacccucgccaaggaggggaucaagcggggcgagacggaccaccacgccgucagccgcggguccgcgaagcugcggugguucguggagcgcaaccuggugaccccggagggcaaggucguggaccucggcugcgggcggggcggguggagcuacuacugcggcgggcugaagaacgugaaggaggucaagggccugaccaagggcgggcccggccacgaggagcccauccccauguccaccuacggguggaaccucgugcgccugcagagcggcguggacgucuucuucacgccgcccgagaagugcgacacccugcucugcgacaucggggaguccagccccaaccccaccguggaggccggccggacccugcgcgugcugaaccucgucgagaacuggcugaacaacaacacccaguucugcaucaaggugcugaacccguacaugcccagcgugaucgagaagauggaggcccugcagcggaaguacggcggggcccucguccgcaacccccugucccggaacagcacgcacgagauguacuggguguccaacgccagcggcaacaucguguccagcgucaacaugaucucccgcaugcugaucaaccgguucaccaugcgccacaagaaggcgaccuacgagccggacguggaccucgggagcggcacccggaacaucgggaucgaguccgagacgcccaaccuggacaucaucggcaagcgcaucgagaagaucaagcaggagcacgagaccagcuggcacuacgaccaggaccaccccuacaagaccugggccuaccacggcuccuacgagaccaagcagacggggagcgccuccagcauggugaacggcgucgugcgccugcucaccaagcccugggacgugaucccgauggucacccagauggccaugaccgacacgacccccuucgggcagcagcggguguucaaggagaaggucgacacccgcacccaggagcccaaggagggcacgaagaagcugaugaagaucaccgccgaguggcuguggaaggagcucggcaagaagaagacgccccggaugugcacccgcgaggaguucacgcggaaggugcgcuccaacgcggcccugggggccaucuucaccgacgagaacaaguggaaguccgcccgggaggccguggaggacuccggcuucugggagcuggucgacaaggagcgcaaccuccaccuggaggggaagugcgagaccugcguguacaacaugaugggcaagcgggagaagaagcugggggaguucggcaaggcgaagggcagccgcgccaucugguacauguggcucggggcccgguuccuggaguucgaggcccugggcuuccucaacgaggaccacugguucucccgcgagaacagccugagcgggguggagggcgaggggcugcacaagcucggcuacauccugcgggacgucuccaagaaggagggcggggcgauguacgccgacgacaccgccggcugggacacgcgcaucacccuggaggaccucaagaacgaggagauggugaccaaccacauggagggggagcacaagaagcuggccgaggccaucuucaagcugaccuaccagaacaaggugguccgggugcagcgcccgacgccccggggcaccgugauggacaucaucagccgccgggaccagcgcggguccggccaggucgugaccuacggccucaacaccuucacgaacauggaggcgcagcugauccggcagauggagggggagggcguguucaagagcauccagcagcugaccgucaaggaggagaucgccgugaagaacuggcucauccgcguggggcgcgagcggcugucccgcauggccaucagcggcgacgacugcgucgugaagccccuggacgaccgguucgccuccgcccucaccgcgcugaacgacaugggcaaggugcgcaaggacauccagcagugggagcccagccggggguggaacgacuggacccaggucccguucugcucccaccacuuccacgagcugaucaugaaggacggccgcgugcucgugguccccugccggaaccaggacgagcugaucgggcgcgcccggaucagccagggcgccggguggucccugcgcgagacggccugccucggcaagagcuacgcccagauguggucccugauguacuuccaccggcgcgaccugcggcucgcggccaacgccaucugcagcgccgugcccucccacuggauccccaccagccgcaccaccugguccauccacgccacccacgaguggaugacgaccgaggacaugcugaccguguggaaccgggucuggauccaggagaacccguggauggaggacaagacccccguggagagcugggaggagauccccuaccugggcaagcgcgaggaccaguggugcgggagccucaucggccugacgucccgggcgaccugggccaagaacauccagaccgccaucaaccaggugcgcagccugaucgggaacgaggaguacaccgacuacaugcccuccaugaagcgguuccgccgcgaggaggaggaggccggcguccucugguga

SEQ ID NO: 9077 - RNA, 9876 nt, Artificial Sequence
  derived and/or modified CDS sequence (opt1) from DENV-2__KM279533__SS-prME
accgcggggaucaucaucaugaugauccccaccgugauggccuuccaccugaccacccggaacggggagccccacaugaucgucagccggcaggagaagggcaagagccuccuguucaagaccgagaacggggugaacaugugcacccugauggcgauggaccucggcgagcugugcgaggacaccaucaccuacaacugcccccugcuccgccagaacgagcccgaggacaucgacugcuggugcaacagcaccagcaccugggugaccuacgggaccugcaccgccaccggcgagcaccggcgcgagaagcggagcgucgcccuggugccccacgugggcauggggcuggagacccgcaccgagaccuggaugagcagcgagggcgccuggaagcacgcccagcggaucgagaccuggauccuccgccaccccggguucacgaucauggcggccauccuggccuacaccaucggcaccaccuacuuccagcggguccugaucuucauccuccugacggccgugacccccuccauggcgaugcgcugcaucgggaucagcaaccgggacuucguggagggcgucuccggcgggagcuggguggacaucgugcuggagcacggcuccugcgucaccaccauggccaagaacaagcccacgcucgacuucgagcugaucaagaccgaggccaagcaccuggccacccuccgcaaguacugcguggaggccaagcugaccaacacgaccaccgcgagccggugccccacccagggggagcccucccugaacgaggagcaggacaagcgcuucgugugcaagcacagcauggucgaccggggcuggggcaacgggugcggccucuucgggaagggcgggaucgugacgugcgccauguucacgugcaagaagaacauggagggcaaggugguccagcccgagaaccuggaguacaccaucgugaucacgccccacuccggcgaggagaacgccguggggaacgacacgggcaagcacgggaaggagaucaaggucacgccccagagcuccaucaccgaggccgagcugaccggcuacgggaccgugacgauggagugcagcccgcgcaccggccucgacuucaacgagauggugcugcugcagauggagaacaaggccuggcucguccaccggcagugguuccuggaccugccccuccccuggcugcccggcgcggacacccagggguccaacuggauccagaaggagacccuggugacguucaagaacccgcacgccaagaagcaggacgucguggugcucggcagccaggagggggccaugcacaccgcccugaccggcgccaccgagauccagaugagcuccgggaaccuccuguucacgggccaccugaagugccgccugcggauggacaagcuccagcugaagggcaugagcuacuccaugugcaccgggaaguucaaggucgugaaggagaucgcggagacccagcacggcaccaucgugauccgcguccaguacgagggggacggcagccccugcaagauccccuucgagaucauggaccuggagaagcggcacgugcucggccgccugaucacggugaaccccaucgucaccgagaaggacuccccggugaacaucgaggccgagccgcccuucggggacagcuacaucaucaucggcguggagcccgggcagcugaagcucuccugguucaagaagggcagcuccaucgggcagauguucgagaccaccaugcgcggcgccaagcggauggccauccugggcgacacggccugggacuucgggagccugggcggggucuucaccuccaucggcaaggcgcuccaccagguguucggggccaucuacggcgccgccuucagcggcguguccuggaccaugaagauccugaucggggucgugaucaccuggaucggcaugaacagccgcuccacgagccuguccgugagccugguccucguggggguggucacccuguaccugggcgugauggugcaggcggacuccgggugcgucgugagcuggaagaacaaggagcucaagugcggcagcggcaucuucaucaccgacaacgugcacaccuggacggagcaguacaaguuccagccggagucccccagcaagcuggccuccgccauccagaaggcccacgaggaggggaucugcggcauccggagcgucacccgccuggagaaccucauguggaagcagaucacccccgagcugaaccacauccugaccgagaacgaggugaagcucacgaucaugaccggggacaucaagggcaucaugcaggccgggaagcggucccugcgcccccagccgaccgagcugaaguacagcuggaaggcguggggcaaggccaagaugcucuccaccgagcugcacaaccacacguuccugaucgacggccccgagaccgccgagugccccaacaccaaccgggccuggaacagccucgagguggaggacuacggguucggcgucuucaccacgaacaucuggcugaagcugaaggagcgccaggacguguucugcgacuccaagcucaugagcgccgcgaucaaggacaaccgggccgugcacgccgacaugggguacuggaucgaguccgcccugaacgacaccuggaagaucgagaaggccagcuucaucgaggucaaguccugccacuggcccaagagccacacccugugguccaacggcgugcucgagagcgagaugaucauccccaagaacuucgcgggccccgugucccagcacaacuaccgccccggguaccacacccagaccgccggcccguggcaccuggggcggcuggagauggacuucgacuucugcgagggcacgaccgucguggugaccgaggacugcgggaaccgcggccccagccuccggaccacgaccgccagcggcaagcugaucaccgaguggugcugccgcuccugcacccugccgccccuccgguaccgcggggaggacggcugcugguacgggauggagauccggccgcugaaggagaaggaggagaaccuggucaacagccucgugacggccggccacgggcagaucgacaacuucucccugggcgugcugggcauggcccucuuccuggaggagaugcugcgcacccgggucgggaccaagcacgccauccuccugguggccgugagcuucgucacccugaucacgggcaacauguccuuccgcgaccucgggcgcgugauggugauggucggcgccaccaugaccgacgacaucgggaugggcgugaccuaccuggcccugcucgcggccuucaaggugcggcccacguucgccgccggccugcugcuccgcaagcugaccagcaaggagcugaugaugaccaccaucgggaucguccuccugucccagagcacgauccccgaguccauccuggagcucaccgacgcccuggcgcugggcaugauggugcucaagaucguccggaacauggagaaguaccagcuggccgugaccaucauggccauccugugcgugcccaacgccgucauccuccagaacgccuggaaggugagcugcaccacgcuggcgguggucuccgugagcccgcugcuccugaccuccagccagcagaaggccgacuggaucccccuggcccucaccaucaaggggcugaaccccaccgccaucuuccugacgacccucucccgcaccagcaagaagcgguccuggccccugaacgaggcgaucauggccgugggcauggucagcauccuggccuccagccuccugaagaacgacaucccgaugaccggcccccugguggccgggggccuccugacggugugcuacguccugaccgggcgcagcgccgaccucgagcuggagcgggcggccgacgugcgcugggaggagcaggccgagaucuccggcagcucccccauccugagcaucaccaucuccgaggacgggagcauguccaucaagaacgaggaggaggagcagacccucacgauccugauccggaccggccugcucgugaucagcggccuguuccccgucuccaucccgaucaccgccgccgcgugguaccugugggaggugaagaagcagcgcgccggggugcucugggacguccccuccccgccgcccgugggcaaggccgagcuggaggacggggccuaccggaucaagcagaagggcauccugggguacucccagaucggcgccggcguguacaaggaggggaccuuccacaccauguggcacgucacgcgcggcgcggugcucaugcacaaggggaagcggaucgagcccagcugggccgacgugaagaaggaccugaucuccuacggcgggggcuggaagcuggagggcgaguggaaggagggggaggagguccaggugcucgcccuggagcccggcaagaacccgcgcgccgugcagaccaagcccgggcuguucaagaccaacaccggcacgaucggggccgucagccucgacuucucccccggcaccagcggcucccccaucguggacaagaaggggaagguggucggccuguacgggaacggcguggugacccggagcggcaccuacgucuccgcgaucgcccagacggagaaguccaucgaggacaacccggagaucgaggacgacaucuuccgcaagaagcggcugaccaucauggaccugcaccccggggccggcaagaccaagcgcuaccuccccgccaucgugcgggaggcgaucaagcgcgggcugcggacccugauccucgcccccacgcgcguggucgccgccgagauggaggaggcccugcgcggccugccgauccgguaccagacccccgcgauccgcgccgagcacaccgggcgggagaucguggaccucaugugccacgccaccuucacgaugcgccugcugagccccauccgggugcccaacuacaaccucaucaucauggacgaggcccacuucaccgacccggccuccaucgcggcccgcggcuacaucagcacccgggucgagaugggcgaggccgccgggaucuucaugaccgccacgccgcccggcucccgcgaccccuucccgcagagcaacgcgcccaucauggacgaggagcgggagauccccgagcgcuccuggaacagcgggcacgagugggugaccgacuucaagggcaagaccgugugguucguccccuccaucaaggccgggaacgacaucgccgccugccugcggaagaacggcaagaaggugauccagcugagccgcaagaccuucgacuccgaguacaucaagacgcggaccaacgacugggacuucguggucaccaccgacaucagcgagaugggcgcgaacuucaaggccgagcgcgugaucgacccgcggcgcugcaugaagcccgugauccucacggacggggaggagcgggucauccuggccggccccaugcccgugacccacuccagcgccgcccagcgccgggggcgcgugggccgcaacccgaagaacgagaacgaccaguacaucuacaugggggagccccuggagaacgacgaggacugcgcgcacuggaaggaggccaagaugcuccuggacaacaucaacacccccgagggcaucauccccuccauguucgagccggagcgggagaaggucgacgccaucgacggcgaguaccgccugcgcggggaggcccgcaagaccuucguggaccucaugcggcgcggcgaccugcccgucuggcuggccuaccggguggcggccgaggggaucaacuacgccgaccgccgguggugcuucgacggcgugaagaacaaccagauccucgaggagaacgucgagguggagaucuggacgaaggagggggagcgcaagaagcugaagccccgguggcuggacgcccgcaucuacagcgacccgcucgcccugaaggaguucaaggaguucgcggccggccggaagucccugacccucaaccugaucaccgagaugggccgccugcccaccuucaugacgcagaaggccaagaacgcccucgacaaccuggcggugcugcacaccgccgaggccgggggccgggccuacaaccacgcccucagcgagcugcccgagacccuggagacccuccugcugcucacgcugcuggcgaccgucaccgggggcaucuuccucuuccugauguccggcaaggggaucggcaagaugacccuggggaugugcugcaucaucaccgccagcauccuccugugguacgcccagauccagccccacuggaucgccgccuccaucauccuggaguucuuccucaucgugcugcugaucccggagcccgagaagcagcgcacgccccaggacaaccagcucaccuacguggucaucgcgauccugaccgugguggccgccaccauggccaacgagaugggcuuccuggagaagacgaagaaggacuucgggcucggcagcaucaccacccagcagcccgagagcaacauccuggacaucgaccugcggccggccuccgcguggacccucuacgccgucgccacgaccuucaucacccccaugcugcgccacagcaucgagaacuccagcgugaacgugucccugaccgccaucgccaaccaggcgacgguccucaugggccuggggaagggcuggccccugagcaagauggacaucggggugccccuccuggccaucggcugcuacucccaggugaacccgaucacccugaccgccgcccuccugcugcucgucgcgcacuacgccaucaucgggcccggccugcaggccaaggccacccgggaggcccagaagcgcgcggccgccggcaucaugaagaaccccacgguggacgggaugaccgugaucgaccuggaccccaucccguacgaccccaaguucgagaagcagcucggccaggucaugcugcuggugcucugcgugacccagguccugaugaugcggaccacgugggcccugugcgaggcccucacccuggcgaccgggcccaucagcacccugugggagggcaaccccgggcgcuucuggaacacgaccaucgccguguccauggccaacaucuuccgcggcagcuaccucgccggcgccgggcugcuguucuccaucaugaagaacaccgcgaacacccggcgcggcacggggaacaccggcgagacccucggcgagaaguggaagaaccggcugaacgcccugggcaagagcgaguuccagaucuacaagaaguccggcauccaggagguggaccgcacccucgccaaggaggggaucaagcggggcgagacggaccaccacgccgucagccgcggguccgcgaagcugcggugguucguggagcgcaaccuggugaccccggagggcaaggucguggaccucggcugcgggcggggcggguggagcuacuacugcggcgggcugaagaacgugaaggaggucaagggccugaccaagggcgggcccggccacgaggagcccauccccauguccaccuacggguggaaccucgugcgccugcagagcggcguggacgucuucuucacgccgcccgagaagugcgacacccugcucugcgacaucggggaguccagccccaaccccaccguggaggccggccggacccugcgcgugcugaaccucgucgagaacuggcugaacaacaacacccaguucugcaucaaggugcugaacccguacaugcccagcgugaucgagaagauggaggcccugcagcggaaguacggcggggcccucguccgcaacccccugucccggaacagcacgcacgagauguacuggguguccaacgccagcggcaacaucguguccagcgucaacaugaucucccgcaugcugaucaaccgguucaccaugcgccacaagaaggcgaccuacgagccggacguggaccucgggagcggcacccggaacaucgggaucgaguccgagacgcccaaccuggacaucaucggcaagcgcaucgagaagaucaagcaggagcacgagaccagcuggcacuacgaccaggaccaccccuacaagaccugggccuaccacggcuccuacgagaccaagcagacggggagcgccuccagcauggugaacggcgucgugcgccugcucaccaagcccugggacgugaucccgauggucacccagauggccaugaccgacacgacccccuucgggcagcagcggguguucaaggagaaggucgacacccgcacccaggagcccaaggagggcacgaagaagcugaugaagaucaccgccgaguggcuguggaaggagcucggcaagaagaagacgccccggaugugcacccgcgaggaguucacgcggaaggugcgcuccaacgcggcccugggggccaucuucaccgacgagaacaaguggaaguccgcccgggaggccguggaggacuccggcuucugggagcuggucgacaaggagcgcaaccuccaccuggaggggaagugcgagaccugcguguacaacaugaugggcaagcgggagaagaagcugggggaguucggcaaggcgaagggcagccgcgccaucugguacauguggcucggggcccgguuccuggaguucgaggcccugggcuuccucaacgaggaccacugguucucccgcgagaacagccugagcgggguggagggcgaggggcugcacaagcucggcuacauccugcgggacgucuccaagaaggagggcggggcgauguacgccgacgacaccgccggcugggacacgcgcaucacccuggaggaccucaagaacgaggagauggugaccaaccacauggagggggagcacaagaagcuggccgaggccaucuucaagcugaccuaccagaacaaggugguccgggugcagcgcccgacgccccggggcaccgugauggacaucaucagccgccgggaccagcgcggguccggccaggucgugaccuacggccucaacaccuucacgaacauggaggcgcagcugauccggcagauggagggggagggcguguucaagagcauccagcagcugaccgucaaggaggagaucgccgugaagaacuggcucauccgcguggggcgcgagcggcugucccgcauggccaucagcggcgacgacugcgucgugaagccccuggacgaccgguucgccuccgcccucaccgcgcugaacgacaugggcaaggugcgcaaggacauccagcagugggagcccagccggggguggaacgacuggacccaggucccguucugcucccaccacuuccacgagcugaucaugaaggacggccgcgugcucgugguccccugccggaaccaggacgagcugaucgggcgcgcccggaucagccagggcgccggguggucccugcgcgagacggccugccucggcaagagcuacgcccagauguggucccugauguacuuccaccggcgcgaccugcggcucgcggccaacgccaucugcagcgccgugcccucccacuggauccccaccagccgcaccaccugguccauccacgccacccacgaguggaugacgaccgagaacaugcugaccguguggaaccgggucuggauccaggagaacccguggauggaggacaagacccccguggagagcugggaggagauccccuaccugggcaagcgcgaggaccaguggugcgggagccucaucggccugacgucccgggcgaccugggccaagaacauccagaccgccaucaaccaggugcgcagccugaucgggaacgaggaguacaccgacuacaugcccuccaugaagcgguuccgccgcgaggaggaggaggccggcguccucugguga

SEQ ID NO: 9078 - RNA, 9876 nt, Artificial Sequence
  derived and/or modified CDS sequence (opt1) from DENV-2__KM279535__SS-prME
accgcgggcaucaucaucaugaugauccccaccgugauggccuuccaccugaccacccggaacggggagccccacaugaucgucagccggcaggagaagggcaagagccuccuguucaagaccgagaacggggugaacaugugcacccugauggcgauggaccucggcgagcugugcgaggacaccaucaccuacaacugcccccugcuccgccagaacgagcccgaggacaucgacugcuggugcaacagcaccuccaccugggugaccuacgggaccugcaccgccaccggcgagcaccggcgcgagaagcggagcgucgcccuggugccccacgugggcauggggcuggagacccgcaccgagaccuggauguccagcgagggcgccuggaagcacgcccagcggaucgagaccuggauccuccgccaccccggguucacgaucauggcggccauccuggccuacaccaucggcaccaccuacuuccagcggguccugaucuucauccuccugacggccgugacccccuccauggcgaugcgcugcaucgggaucagcaaccgggacuucguggagggcgucuccggcgggagcuggguggacaucgugcuggagcacggcuccugcgucaccaccauggccaagaacaagcccacgcucgacuucgagcugaucaagaccgaggccaagcaccuggccacccuccgcaaguacugcguggaggccaagcugaccaacacgaccaccgcgagccggugccccacccagggggagcccucccugaacgaggagcaggacaagcgcuucgugugcaagcacagcauggucgaccggggcuggggcaacgggugcggccucuucgggaagggcgggaucgugacgugcgccauguucacgugcaagaagaacauggagggcaaggugguccagcccgagaaccuggaguacaccaucgugaucacgccccacuccggcgaggagaacgccguggggaacgacacgggcaagcacgggaaggagaucaaggucacgccccagagcuccaucaccgaggccgagcugaccggcuacgggaccgugacgauggagugcagcccgcgcaccggccucgacuucaacgagauggugcugcugcagauggagaacaaggccuggcucguccaccggcagugguuccuggaccugccccuccccuggcugcccggcgcggacacccagggguccaacuggauccagaaggagacccuggugacguucaagaacccgcacgccaagaagcaggacgucguggugcucggcagccaggagggggccaugcacaccgcccugaccggcgccaccgagauccagaugagcuccgggaaccuccuguucacgggccaccugaagugccgccugcggauggacaagcuccagcugaagggcaugagcuacuccaugugcaccgggaaguucaaggucgugaaggagaucgcggagacccagcacggcaccaucgugauccgcguccaguacgagggggacggcagccccugcaagauccccuucgagaucauggaccuggagaagcggcacgugcucggccgccugaucacggugaaccccaucgucaccgagaaggacuccccggugaacaucgaggccgagccgcccuucggggacagcuacaucaucaucggcguggagcccgggcagcugaagcucuccugguucaagaagggcagcuccaucgggcagauguucgagaccaccaugcgcggcgccaagcggauggccauccugggcgacacggccugggacuucgggagccugggcggggucuucaccuccaucggcaaggcgcuccaccagguguucggggccaucuacggcgccgccuucagcggcguguccuggaccaugaagauccugaucggggucgugaucaccuggaucggcaugaacagccgcuccacgagccuguccgugagccugguccucguggggguggucacccuguaccugggcgugauggugcaggcggacuccgggugcgucgugagcuggaagaacaaggagcucaagugcggcagcggcaucuucaucaccgacaacgugcacaccuggacggagcaguacaaguuccagccggagucccccagcaagcuggccuccgccauccagaaggcccacgaggaggggaucugcggcauccggagcgucacccgccuggagaaccucauguggaagcagaucacccccgagcugaaccacauccugaccgagaacgaggugaagcucacgaucaugaccggggacaucaagggcaucaugcaggccgggaagcggucccugcgcccccagccgaccgagcugaaguacagcuggaaggcguggggcaaggccaagaugcucuccaccgagcugcacaaccacacguuccugaucgacggccccgagaccgccgagugccccaacaccaaccgggccuggaacagccucgagguggaggacuacggguucggcgucuucaccacgaacaucuggcugaagcugaaggagcgccaggacguguucugcgacuccaagcucaugagcgccgcgaucaaggacaaccgggccgugcacgccgacaugggguacuggaucgaguccgcccugaacgacaccuggaagaucgagaaggccagcuucaucgaggucaaguccugccacuggcccaagagccacacccugugguccaacggcgugcucgagagcgagaugaucauccccaagaacuucgcgggccccgugucccagcacaacuaccgccccggguaccacacccagaccgccggcccguggcaccuggggcggcuggagauggacuucgacuucugcgagggcacgaccgucguggugaccgaggacugcgggaaccgcggccccagccuccggaccacgaccgccagcggcaagcugaucaccgaguggugcugccgcuccugcacccugccgccccuccgguaccgcggggaggacggcugcugguacgggauggagauccggccgcugaaggagaaggaggagaaccuggucaacagccucgugacggccggccacgggcagaucgacaacuucucccugggcgugcugggcauggcccucuuccuggaggagaugcugcgcacccgggucgggaccaagcacgccauccuccugguggccgugagcuucgucacccugaucacgggcaacauguccuuccgcgaccucgggcgcgugauggugauggucggcgccaccaugaccgacgacaucgggaugggcgugaccuaccuggcccugcucgcggccuucaaggugcggcccacguucgccgccggccugcugcuccgcaagcugaccagcaaggagcugaugaugaccaccaucgggaucguccuccugucccagagcacgauccccgaguccauccuggagcucaccgacgcccuggcgcugggcaugauggugcucaagaucguccggaacauggagaaguaccagcuggccgugaccaucauggccaucagcugcgugcccaacgccgucauccugcagaacgccuggaagguguccugcaccacgcucgcgguggucagcguguccccgcugcugcucaccagcucccagcagaaggccgacuggaucccccuggcccugaccaucaaggggcucaaccccaccgccaucuuccugacgacccugagccgcaccuccaagaagcggagcuggccccucaacgaggcgaucauggccgugggcauggucuccauccuggccagcagccugcucaagaacgacaucccgaugaccggcccccugguggccgggggccugcucacggugugcuacguccugaccgggcgcuccgccgaccuggagcucgagcgggcggccgacgugcgcugggaggagcaggccgagaucagcggcuccagccccauccuguccaucaccaucagcgaggacggguccaugagcaucaagaacgaggaggaggagcagacccugacgauccucauccggaccggccugcuggugaucuccggccucuuccccgucagcaucccgaucaccgccgccgcgugguaccugugggaggugaagaagcagcgcgccggggugcugugggacguccccagcccgccgcccgugggcaaggccgagcucgaggacggggccuaccggaucaagcagaagggcauccugggguacagccagaucggcgccggcguguacaaggaggggaccuuccacaccauguggcacgucacgcgcggcgcggugcugaugcacaaggggaagcggaucgagcccuccugggccgacgugaagaaggaccucaucagcuacggcgggggcuggaagcuggagggcgaguggaaggagggggaggagguccaggugcuggcccucgagcccggcaagaacccgcgcgccgugcagaccaagcccgggcuguucaagaccaacaccggcacgaucggggccgucucccuggacuucagccccggcaccuccggcagccccaucguggacaagaaggggaagguggucggccucuacgggaacggcguggugacccgguccggcaccuacgucagcgcgaucgcccagacggagaaguccaucgaggacaacccggagaucgaggacgacaucuuccgcaagaagcggcugaccaucauggaccugcaccccggggccggcaagaccaagcgcuaccugcccgccaucgugcgggaggcgaucaagcgcgggcuccggacccugauccuggcccccacgcgcguggucgccgccgagauggaggaggcccuccgcggccugccgauccgguaccagacccccgcgauccgcgccgagcacaccgggcgggagaucguggaccugaugugccacgccaccuucacgaugcgccuccugagccccauccgggugcccaacuacaaccugaucaucauggacgaggcccacuucaccgacccggccagcaucgcggcccgcggcuacaucuccacccgggucgagaugggcgaggccgccgggaucuucaugaccgccacgccgcccggcagccgcgaccccuucccgcaguccaacgcgcccaucauggacgaggagcgggagauccccgagcgcagcuggaacuccgggcacgagugggugaccgacuucaagggcaagaccgugugguucguccccagcaucaaggccgggaacgacaucgccgccugccuccggaagaacggcaagaaggugauccagcugucccgcaagaccuucgacagcgaguacaucaagacgcggaccaacgacugggacuucguggucaccaccgacaucuccgagaugggcgcgaacuucaaggccgagcgcgugaucgacccgcggcgcugcaugaagcccgugauccugacggacggggaggagcgggucauccucgccggccccaugcccgugacccacagcuccgccgcccagcgccgggggcgcgugggccgcaacccgaagaacgagaacgaccaguacaucuacaugggggagccccuggagaacgacgaggacugcgcgcacuggaaggaggccaagaugcugcucgacaacaucaacacccccgagggcaucauccccagcauguucgagccggagcgggagaaggucgacgccaucgacggcgaguaccgccugcgcggggaggcccgcaagaccuucguggaccugaugcggcgcggcgaccuccccgucuggcuggccuaccggguggcggccgaggggaucaacuacgccgaccgccgguggugcuucgacggcgugaagaacaaccagauccuggaggagaacgucgagguggagaucuggacgaaggagggggagcgcaagaagcucaagccccgguggcuggacgcccgcaucuacuccgacccgcuggcccucaaggaguucaaggaguucgcggccggccggaagucccugacccugaaccucaucaccgagaugggccgccugcccaccuucaugacgcagaaggccaagaacgcccuggacaaccucgcggugcugcacaccgccgaggccgggggccgggccuacaaccacgcccuguccgagcuccccgagacccuggagacccugcuccugcugacgcuccuggcgaccgucaccgggggcaucuuccuguuccucaugagcggcaaggggaucggcaagaugacccuggggaugugcugcaucaucaccgccuccauccugcucugguacgcccagauccagccccacuggaucgccgccagcaucauccuggaguucuuccugaucgugcuccugaucccggagcccgagaagcagcgcacgccccaggacaaccagcugaccuacguggucaucgcgauccucaccgugguggccgccaccauggccaacgagaugggcuuccuggagaagacgaagaaggacuucgggcugggcagcaucaccacccagcagcccgaguccaacauccucgacaucgaccugcggccggccagcgcguggacccuguacgccgucgccacgaccuucaucacccccaugcuccgccacuccaucgagaacagcuccgugaacgugagccugaccgccaucgccaaccaggcgacgguccugaugggccucgggaagggcuggccccuguccaagauggacaucggggugccccugcucgccaucggcugcuacagccaggugaacccgaucacccugaccgccgcccugcuccugcuggucgcgcacuacgccaucaucgggcccggccuccaggccaaggccacccgggaggcccagaagcgcgcggccgccggcaucaugaagaaccccacgguggacgggaugaccgugaucgaccuggaccccaucccguacgaccccaaguucgagaagcagcugggccaggucaugcuccuggugcugugcgugacccagguccucaugaugcggaccacgugggcccugugcgaggcccugacccucgcgaccgggcccaucuccacccugugggagggcaaccccgggcgcuucuggaacacgaccaucgccgugagcauggccaacaucuuccgcggcuccuaccuggccggcgccgggcuccuguucagcaucaugaagaacaccgcgaacacccggcgcggcacggggaacaccggcgagacccugggcgagaaguggaagaaccggcucaacgcccuggggaaguccgaguuccagaucuacaagaaguccggcauccaggagguggaccgcacccuggccaaggaggggaucaagcggggcgagacggaccaccacgccgucucccgcgggagcgcgaagcuccggugguucguggagcgcaaccuggugaccccggagggcaaggucguggaccugggcugcgggcggggcgggugguccuacuacugcggcgggcucaagaacgugaaggaggucaagggccugaccaagggcgggcccggccacgaggagcccauccccaugagcaccuacggguggaaccuggugcgccuccaguccggcguggacgucuucuucacgccgcccgagaagugcgacacccugcugugcgacaucggggagagcagccccaaccccaccguggaggccggccggacccuccgcgugcugaaccuggucgagaacuggcucaacaacaacacccaguucugcaucaaggugcugaacccguacaugcccuccgugaucgagaagauggaggcccugcagcggaaguacggcggggcccugguccgcaacccccucagccggaacuccacgcacgagauguacugggugagcaacgccuccggcaacaucgugagcuccgucaacaugaucagccgcaugcugaucaaccgguucaccaugcgccacaagaaggcgaccuacgagccggacguggaccugggguccggcacccggaacaucgggaucgagagcgagacgcccaaccucgacaucaucggcaagcgcaucgagaagaucaagcaggagcacgagaccuccuggcacuacgaccaggaccaccccuacaagaccugggccuaccacggcagcuacgagaccaagcagacgggguccgccagcuccauggugaacggcgucgugcgccugcugaccaagcccugggacgugaucccgauggucacccagauggccaugaccgacacgacccccuucgggcagcagcggguguucaaggagaaggucgacacccgcacccaggagcccaaggagggcacgaagaagcucaugaagaucaccgccgaguggcuguggaaggagcugggcaagaagaagacgccccggaugugcacccgcgaggaguucacgcggaaggugcgcagcaacgcggcccucggggccaucuucaccgacgagaacaaguggaaguccgcccgggaggccguggaggacagcggcuucugggagcuggucgacaaggagcgcaaccugcaccucgaggggaagugcgagaccugcguguacaacaugaugggcaagcgggagaagaagcugggggaguucggcaaggcgaagggcucccgcgccaucugguacauguggcugggggcccgguuccucgaguucgaggcccugggcuuccugaacgaggaccacugguucagccgcgagaacagccucuccgggguggagggcgaggggcugcacaagcugggcuacauccuccgggacgucagcaagaaggagggcggggcgauguacgccgacgacaccgccggcugggacacgcgcaucacccuggaggaccugaagaacgaggagauggugaccaaccacauggagggggagcacaagaagcucgccgaggccaucuucaagcugaccuaccagaacaaggugguccgggugcagcgcccgacgccccggggcaccgugauggacaucaucucccgccgggaccagcgcgggagcggccaggucgugaccuacggccugaacaccuucacgaacauggaggcgcagcucauccggcagauggagggggagggcguguucaaguccauccagcagcugaccgucaaggaggagaucgccgugaagaacuggcugauccgcguggggcgcgagcggcucagccgcauggccaucuccggcgacgacugcgucgugaagccccuggacgaccgguucgccagcgcccugaccgcgcucaacgacaugggcaaggugcgcaaggacauccagcagugggagcccucccggggguggaacgacuggacccaggucccguucugcagccaccacuuccacgagcugaucaugaaggacggccgcgugcuggugguccccugccggaaccaggacgagcucaucgggcgcgcccggaucucccagggcgccggguggagccugcgcgagacggccugccugggcaaguccuacgcccagauguggagccucauguacuuccaccggcgcgaccugcggcuggcggccaacgccaucugcuccgccgugcccagccacuggauccccaccucccgcaccaccuggagcauccacgccacccacgaguggaugacgaccgaggacaugcucaccguguggaaccgggucuggauccaggagaacccguggauggaggacaagacccccguggagagcugggaggagauccccuaccugggcaagcgcgaggaccaguggugcgggucccugaucggccucacgagccgggcgaccugggccaagaacauccagaccgccaucaaccaggugcgcucccugaucgggaacgaggaguacaccgacuacaugcccagcaugaagcgguuccgccgcgaggaggaggaggccggcguccugugguga

SEQ ID NO: 9079 - RNA, 9876 nt, Artificial Sequence
  derived and/or modified CDS sequence (opt1) from DENV-2__KM279539__SS-prME
accgcggggaucaucaucaugaugauccccaccgugauggccuuccaccugaccacccggaacggggagccccacaugaucgucagccggcaggagaagggcaagagccuccuguucaagaccgagaacggggugaacaugugcacccugauggcgauggaccucggcgagcugugcgaggacaccaucaccuacaacugcccccugcuccgccagaacgagcccgaggacaucgacugcuggugcaacagcaccagcaccugggugaccuacgggaccugcaccgccaccggcgagcaccggcgcgagaagcggagcgucgcccuggugccccacgugggcauggggcuggagacccgcaccgagaccuggauguccagcgagggcgccuggaagcacgcccagcggaucgagaccuggauccuccgccaccccggguucacgaucauggcggccauccuggccuacaccaucggcaccaccuacuuccagcggguccugaucuucauccuccugacggccgugacccccuccauggcgaugcgcugcaucgggaucagcaaccgggacuucguggagggcgucuccggcgggagcuggguggacaucgugcuggagcacggcuccugcgucaccaccauggccaagaacaagcccacgcucgacuucgagcugaucaagaccgaggccaagcaccuggccacccuccgcaaguacugcguggaggccaagcugaccaacacgaccaccgcgagccggugccccacccagggggagcccucccugaacgaggagcaggacaagcgcuucgugugcaagcacagcauggucgaccggggcuggggcaacgggugcggccucuucgggaagggcgggaucgugacgugcgccauguucacgugcaagaagaacauggagggcaaggugguccagcccgagaaccuggaguacaccaucgugaucacgccccacuccggcgaggagaacgccguggggaacgacacgggcaagcacgggaaggagaucaaggucacgccccagagcuccaucaccgaggccgagcugaccggcuacgggaccgugacgauggagugcagcccgcgcaccggccucgacuucaacgagauggugcugcugcagauggagaacaaggccuggcucguccaccggcagugguuccuggaccugccccuccccuggcugcccggcgcggacacccagggguccaacuggauccagaaggagacccuggugacguucaagaacccgcacgccaagaagcaggacgucguggugcucggcagccaggagggggccaugcacaccgcccugaccggcgccaccgagauccagaugagcuccgggaaccuccuguucacgggccaccugaagugccgccugcggauggacaagcuccagcugaagggcaugagcuacuccaugugcaccgggaaguucaaggucgugaaggagaucgcggagacccagcacggcaccaucgugauccgcguccaguacgagggggacggcagccccugcaagauccccuucgagaucauggaccuggagaagcggcacgugcucggccgccugaucacggugaaccccaucgucaccgagaaggacuccccggugaacaucgaggccgagccgcccuucggggacagcuacaucaucaucggcguggagcccgggcagcugaagcucuccugguucaagaagggcagcuccaucgggcagauguucgagaccaccaugcgcggcgccaagcggauggccauccugggcgacacggccugggacuucgggagccugggcggggucuucaccuccaucggcaaggcgcuccaccagguguucggggccaucuacggcgccgccuucagcggcguguccuggaccaugaagauccugaucggggucgugaucaccuggaucggcaugaacagccgcuccacgagccuguccgugagccugguccucguggggguggucacccuguaccugggcgugauggugcaggcggacuccgggugcgucgugagcuggaagaacaaggagcucaagugcggcagcggcaucuucaucaccgacaacgugcacaccuggacggagcaguacaaguuccagccggagucccccagcaagcuggccuccgccauccagaaggcccacgaggaggggaucugcggcauccggagcgucacccgccuggagaaccucauguggaagcagaucacccccgagcugaaccacauccugaccgagaacgaggugaagcucacgaucaugaccggggacaucaagggcaucaugcaggccgggaagcggucccugcgcccccagccgaccgagcugaaguacagcuggaaggcguggggcaaggccaagaugcucuccaccgagcugcacaaccacacguuccugaucgacggccccgagaccgccgagugccccaacaccaaccgggccuggaacagccucgagguggaggacuacggguucggcgucuucaccacgaacaucuggcugaagcugaaggagcgccaggacguguucugcgacuccaagcucaugagcgccgcgaucaaggacaaccgggccgugcacgccgacaugggguacuggaucgaguccgcccugaacgacaccuggaagaucgagaaggccagcuucaucgaggucaaguccugccacuggcccaagagccacacccugugguccaacggcgugcucgagagcgagaugaucauccccaagaacuucgcgggccccgugucccagcacaacuaccgccccggguaccacacccagaccgccggcccguggcaccuggggcggcuggagauggacuucgacuucugcgagggcacgaccgucguggugaccgaggacugcgggaaccgcggccccagccuccggaccacgaccgccagcggcaagcugaucaccgaguggugcugccgcuccugcacccugccgccccuccgguaccgcggggaggacggcugcugguacgggauggagauccggccgcugaaggagaaggaggagaaccuggucaacagccucgugacggccggccacgggcagaucgacaacuucucccugggcgugcugggcauggcccucuuccuggaggagaugcugcgcacccgggucgggaccaagcacgccauccuccugguggccgugagcuucgucacccugaucacgggcaacauguccuuccgcgaccucgggcgcgugauggugauggucggcgccaccaugaccgacgacaucgggaugggcgugaccuaccuggcccugcucgcggccuucaaggugcggcccacguucgccgccggccugcugcuccgcaagcugaccagcaaggagcugaugaugaccaccaucgggaucguccuccugucccagagcacgauccccgaguccauccuggagcucaccgacgcccuggcgcugggcaugauggugcucaagaucguccggaacauggagaaguaccagcuggccgugaccaucauggccauccugugcgugcccaacgccgucauccuccagaacgccuggaaggugagcugcaccacgcuggcgguggucuccgugagcccgcugcuccugaccuccagccagcagaaggccgacuggaucccccuggcccucaccaucaaggggcugaaccccaccgccaucuuccugacgacccucucccgcaccagcaagaagcgguccuggccccugaacgaggcgaucauggccgugggcauggucagcauccuggccuccagccuccugaagaacgacaucccgaugaccggcccccugguggccgggggccuccugacggugugcuacguccugaccgggcgcagcgccgaccucgagcuggagcgggcggccgacgugcgcugggaggagcaggccgagaucuccggcagcucccccauccugagcaucaccaucuccgaggacgggagcauguccaucaagaacgaggaggaggagcagacccucacgauccugauccggaccggccugcucgugaucagcggccuguuccccgucuccaucccgaucaccgccgccgcgugguaccugugggaggugaagaagcagcgcgccggggugcucugggacguccccuccccgccgcccgugggcaaggccgagcuggaggacggggccuaccggaucaagcagaagggcauccugggguacucccagaucggcgccggcguguacaaggaggggaccuuccacaccauguggcacgucacgcgcggcgcggugcucaugcacaaggggaagcggaucgagcccagcugggccgacgugaagaaggaccugaucuccuacggcgggggcuggaagcuggagggcgaguggaaggagggggaggagguccaggugcucgcccuggagcccggcaagaacccgcgcgccgugcagaccaagcccgggcuguucaagaccaacaccggcacgaucggggccgucagccucgacuucucccccggcaccagcggcucccccaucguggacaagaaggggaagguggucggccuguacgggaacggcguggugacccggagcggcaccuacgucuccgcgaucgcccagacggaggagagcaucgaggacaacccggagaucgaggacgacaucuuccgcaagaagcggcugaccaucauggaccugcaccccggggccggcaagaccaagcgcuaccuccccgccaucgugcgggaggcgaucaagcgcgggcugcggacccugauccucgcccccacgcgcguggucgccgccgagauggaggaggcccugcgcggccugccgauccgguaccagacccccgcgauccgcgccgagcacaccgggcgggagaucguggaccucaugugccacgccaccuucacgaugcgccugcugagccccauccgggugcccaacuacaaccucaucaucauggacgaggcccacuucaccgacccggccuccaucgcggcccgcggcuacaucagcacccgggucgagaugggcgaggccgccgggaucuucaugaccgccacgccgcccggcucccgcgaccccuucccgcagagcaacgcgcccaucauggacgaggagcgggagauccccgagcgcuccuggaacagcgggcacgagugggugaccgacuucaagggcaagaccgugugguucguccccuccaucaaggccgggaacgacaucgccgccugccugcggaagaacggcaagaaggugauccagcugagccgcaagaccuucgacuccgaguacaucaagacgcggaccaacgacugggacuucguggucaccaccgacaucagcgagaugggcgcgaacuucaaggccgagcgcgugaucgacccgcggcgcugcaugaagcccgugauccucacggacggggaggagcgggucauccuggccggccccaugcccgugacccacuccagcgccgcccagcgccgggggcgcgugggccgcaacccgaagaacgagaacgaccaguacaucuacaugggggagccccuggagaacgacgaggacugcgcgcacuggaaggaggccaagaugcuccuggacaacaucaacacccccgagggcaucauccccuccauguucgagccggagcgggagaaggucgacgccaucgacggcgaguaccgccugcgcggggaggcccgcaagaccuucguggaccucaugcggcgcggcgaccugcccgucuggcuggccuaccggguggcggccgaggggaucaacuacgccgaccgccgguggugcuucgacggcgugaagaacaaccagauccucgaggagaacgucgagguggagaucuggacgaaggagggggagcgcaagaagcugaagccccgguggcuggacgcccgcaucuacagcgacccgcucgcccugaaggaguucaaggaguucgcggccggccggaagucccugacccucaaccugaucaccgagaugggccgccugcccaccuucaugacgcagaaggccaagaacgcccucgacaaccuggcggugcugcacaccgccgaggccgggggccgggccuacaaccacgcccucagcgagcugcccgagacccuggagacccuccugcugcucacgcugcuggcgaccgucaccgggggcaucuuccucuuccugauguccggcaaggggaucggcaagaugacccuggggaugugcugcaucaucaccgccagcauccuccugugguacgcccagauccagccccacuggaucgccgccuccaucauccuggaguucuuccucaucgugcugcugaucccggagcccgagaagcagcgcacgccccaggacaaccagcucaccuacguggucaucgcgauccugaccgugguggccgccaccauggccaacgagaugggcuuccuggagaagacgaagaaggacuucgggcucggcagcaucaccacccagcagcccgagagcaacauccuggacaucgaccugcggccggccuccgcguggacccucuacgccgucgccacgaccuucaucacccccaugcugcgccacagcaucgagaacuccagcgugaacgugucccugaccgccaucgccaaccaggcgacgguccucaugggccuggggaagggcuggccccugagcaagauggacaucggggugccccuccuggccaucggcugcuacucccaggugaacccgaucacccugaccgccgcccuccugcugcucgucgcgcacuacgccaucaucgggcccggccugcaggccaaggccacccgggaggcccagaagcgcgcggccgccggcaucaugaagaaccccacgguggacgggaugaccgugaucgaccuggaccccaucccguacgaccccaaguucgagaagcagcucggccaggucaugcugcuggugcucugcgugacccagguccugaugaugcggaccacgugggcccugugcgaggcccucacccuggcgaccgggcccaucagcacccugugggagggcaaccccgggcgcuucuggaacacgaccaucgccguguccauggccaacaucuuccgcggcagcuaccucgccggcgccgggcugcuguucuccaucaugaagaacaccgcgaacacccggcgcggcacggggaacaccggcgagacccucggcgagaaguggaagaaccggcugaacgcccugggcaagagcgaguuccagaucuacaagaaguccggcauccaggagguggaccgcacccucgccaaggaggggaucaagcggggcgagacggaccaccacgccgucagccgcggguccgcgaagcugcggugguucguggagcgcaaccuggugaccccggagggcaaggucguggaccucggcugcgggcggggcggguggagcuacuacugcggcgggcugaagaacgugaaggaggucaagggccugaccaagggcgggcccggccacgaggagcccauccccauguccaccuacggguggaaccucgugcgccugcagagcggcguggacgucuucuucacgccgcccgagaagugcgacacccugcucugcgacaucggggaguccagccccaaccccaccguggaggccggccggacccugcgcgugcugaaccucgucgagaacuggcugaacaacaacacccaguucugcaucaaggugcugaacccguacaugcccagcgugaucgagaagauggaggcccugcagcggaaguacggcggggcccucguccgcaacccccugucccggaacagcacgcacgagauguacuggguguccaacgccagcggcaacaucguguccagcgucaacaugaucucccgcaugcugaucaaccgguucaccaugcgccacaagaaggcgaccuacgagccggacguggaccucgggagcggcacccggaacaucgggaucgaguccgagacgcccaaccuggacaucaucggcaagcgcaucgagaagaucaagcaggagcacgagaccagcuggcacuacgaccaggaccaccccuacaagaccugggccuaccacggcuccuacgagaccaagcagacggggagcgccuccagcauggugaacggcgucgugcgccugcucaccaagcccugggacgugaucccgauggucacccagauggccaugaccgacacgacccccuucgggcagcagcggguguucaaggagaaggucgacacccgcacccaggagcccaaggagggcacgaagaagcugaugaagaucaccgccgaguggcuguggaaggagcucggcaagaagaagacgccccggaugugcacccgcgaggaguucacgcggaaggugcgcuccaacgcggcccugggggccaucuucaccgacgagaacaaguggaaguccgcccgggaggccguggaggacuccggcuucugggagcuggucgacaaggagcgcaaccuccaccuggaggggaagugcgagaccugcguguacaacaugaugggcaagcgggagaagaagcugggggaguucggcaaggcgaagggcagccgcgccaucugguacauguggcucggggcccgguuccuggaguucgaggcccugggcuuccucaacgaggaccacugguucucccgcgagaacagccugagcgggguggagggcgaggggcugcacaagcucggcuacauccugcgggacgucuccaagaaggagggcggggcgauguacgccgacgacaccgccggcugggacacgcgcaucacccuggaggaccucaagaacgaggagauggugaccaaccacauggagggggagcacaagaagcuggccgaggccaucuucaagcugaccuaccagaacaaggugguccgggugcagcgcccgacgccccggggcaccgugauggacaucaucagccgccgggaccagcgcggguccggccaggucgugaccuacggccucaacaccuucacgaacauggaggcgcagcugauccggcagauggagggggagggcguguucaagagcauccagcagcugaccgucaaggaggagaucgccgugaagaacuggcucauccgcguggggcgcgagcggcugucccgcauggccaucagcggcgacgacugcgucgugaagccccuggacgaccgguucgccuccgcccucaccgcgcugaacgacaugggcaaggugcgcaaggacauccagcagugggagcccagccggggguggaacgacuggacccaggucccguucugcucccaccacuuccacgagcugaucaugaaggacggccgcgugcucgugguccccugccggaaccaggacgagcugaucgggcgcgcccggaucagccagggcgccggguggucccugcgcgagacggccugccucggcaagagcuacgcccagauguggucccugauguacuuccaccggcgcgaccugcggcucgcggccaacgccaucugcagcgccgugcccucccacuggauccccaccagccgcaccaccugguccauccacgccacccacgaguggaugacgaccgaggacaugcugaccguguggaaccgggucuggauccaggagaacccguggauggaggacaagacccccguggagagcugggaggagauccccuaccugggcaagcgcgaggaccaguggugcgggagccucaucggccugacgucccgggcgaccugggccaagaacauccagaccgccaucaaccaggugcgcagccugaucgggaacgaggaguacaccgacuacaugcccuccaugaagcgguuccgccgcgaggaggaggaggccggcguccucugguga

SEQ ID NO: 9080 - RNA, 9876 nt, Artificial Sequence
  derived and/or modified CDS sequence (opt1) from DENV-2__KM279543__SS-prME
accgcggggaucaucaucaugaugauccccaccgugauggccuuccaccugaccacccggaacggggagccccacaugaucgucagccggcaggagaagggcaagagccuccuguucaagaccgagaacggggugaacaugugcacccugauggcgauggaccucggcgagcugugcgaggacaccaucaccuacaacugcccccugcuccgccagaacgagcccgaggacaucgacugcuggugcaacagcaccagcaccugggugaccuacgggaccugcaccgccaccggcgagcaccggcgcgagaagcggagcgucgcccuggugccccacgugggcauggggcuggagacccgcaccgagaccuggaugagcagcgagggcgccuggaagcacgcccagcggaucgagaccuggauccuccgccaccccggguucacgaucauggcggccauccuggccuacaccaucggcaccaccuacuuccagcggguccugaucuucauccuccugacggccgugacccccuccauggcgaugcgcugcaucgggaucagcaaccgggacuucguggagggcgucuccggcgggagcuggguggacaucgugcuggagcacggcuccugcgucaccaccauggccaagaacaagcccacgcucgacuucgagcugaucaagaccgaggccaagcaccuggccacccuccgcaaguacugcguggaggccaagcugaccaacacgaccaccgcgagccggugccccacccagggggagcccucccugaacgaggagcaggacaagcgcuucgugugcaagcacagcauggucgaccggggcuggggcaacgggugcggccucuucgggaagggcgggaucgugacgugcgccauguucacgugcaagaagaacauggagggcaaggugguccagcccgagaaccuggaguacaccaucgugaucacgccccacuccggcgaggagaacgccguggggaacgacacgggcaagcacgggaaggagaucaaggucacgccccagagcuccaucaccgaggccgagcugaccggcuacgggaccgugacgauggagugcagcccgcgcaccggccucgacuucaacgagauggugcugcugcagauggagaacaaggccuggcucguccaccggcagugguuccuggaccugccccuccccuggcugcccggcgcggacacccagggguccaacuggauccagaaggagacccuggugacguucaagaacccgcacgccaagaagcaggacgucguggugcucggcagccaggagggggccaugcacaccgcccugaccggcgccaccgagauccagaugagcuccgggaaccuccuguucacgggccaccugaagugccgccugcggauggacaagcuccagcugaagggcaugagcuacuccaugugcaccgggaaguucaaggucgugaaggagaucgcggagacccagcacggcaccaucgugauccgcguccaguacgagggggacggcagccccugcaagauccccuucgagaucauggaccuggagaagcggcacgugcucggccgccugaucacggugaaccccaucgucaccgagaaggacuccccggugaacaucgaggccgagccgcccuucggggacagcuacaucaucaucggcguggagcccgggcagcugaagcucuccugguucaagaagggcagcuccaucgggcagauguucgagaccaccaugcgcggcgccaagcggauggccauccugggcgacacggccugggacuucgggagccugggcgggauguucaccuccaucggcaaggcgcuccaccaggucuucggggccaucuacggcgccgccuucagcggcguguccuggaccaugaagauccugaucgggguggucaucaccuggaucggcaugaacagccgcuccacgagccuguccgugagccuggugcucgucgggguggugacccuguaccugggcgucauggugcaggcggacuccgggugcguggucagcuggaagaacaaggagcucaagugcggcagcggcaucuucaucaccgacaacgugcacaccuggacggagcaguacaaguuccagccggagucccccagcaagcuggccuccgccauccagaaggcccacgaggaggggaucugcggcauccggagcgugacccgccuggagaaccucauguggaagcagaucacccccgagcugaaccacauccugaccgagaacgaggucaagcucacgaucaugaccggggacaucaagggcaucaugcaggccgggaagcggucccugcgcccccagccgaccgagcugaaguacagcuggaaggcguggggcaaggccaagaugcucuccaccgagcugcacaaccacacguuccugaucgacggccccgagaccgccgagugccccaacaccaaccgggccuggaacagccucgagguggaggacuacggguucggcguguucaccacgaacaucuggcugaagcugaaggagcgccaggacgucuucugcgacuccaagcucaugagcgccgcgaucaaggacaaccgggccgugcacgccgacaugggguacuggaucgaguccgcccugaacgacaccuggaagaucgagaaggccagcuucaucgaggugaaguccugccacuggcccaagagccacacccugugguccaacggcguccucgagagcgagaugaucauccccaagaacuucgcgggccccgugucccagcacaacuaccgccccggguaccacacccagaccgccggcccguggcaccuggggcggcuggagauggacuucgacuucugcgagggcacgaccguggucgugaccgaggacugcgggaaccgcggccccagccuccggaccacgaccgccagcggcaagcugaucaccgaguggugcugccgcuccugcacccugccgccccuccgguaccgcggggaggacggcugcugguacgggauggagauccggccgcugaaggagaaggaggagaaccuggugaacagccucgucacggccggccacgggcagaucgacaacuucucccugggcgugcugggcauggcccucuuccuggaggagaugcugcgcacccggguggggaccaagcacgccauccuccuggucgccgugagcuucgugacccugaucacgggcaacauguccuuccgcgaccucgggcgcgucauggugauggugggcgccaccaugaccgacgacaucgggaugggcgucaccuaccuggcccugcucgcggccuucaaggugcggcccacguucgccgccggccugcugcuccgcaagcugaccagcaaggagcugaugaugaccaccaucgggaucgugcuccugucccagagcacgauccccgaguccauccuggagcucaccgacgcccuggcgcugggcaugaugguccucaagaucgugcggaacauggagaaguaccagcuggccgucaccaucauggccauccugugcgugcccaacgccgugauccuccagaacgccuggaaggucagcugcaccacgcuggcggugguguccgucagcccgcugcuccugaccuccagccagcagaaggccgacuggaucccccuggcccucaccaucaaggggcugaaccccaccgccaucuuccugacgacccucucccgcaccagcaagaagcgguccuggccccugaacgaggcgaucauggccgugggcauggugagcauccuggccuccagccuccugaagaacgacaucccgaugaccggcccccuggucgccgggggccuccugacggugugcuacgugcugaccgggcgcagcgccgaccucgagcuggagcgggcggccgacguccgcugggaggagcaggccgagaucuccggcagcucccccauccugagcaucaccaucuccgaggacgggagcauguccaucaagaacgaggaggaggagcagacccucacgauccugauccggaccggccugcucgugaucagcggccuguuccccguguccaucccgaucaccgccgccgcgugguaccugugggaggucaagaagcagcgcgccggggugcucugggacgugcccuccccgccgcccgucggcaaggccgagcuggaggacggggccuaccggaucaagcagaagggcauccugggguacucccagaucggcgccggcguguacaaggaggggaccuuccacaccauguggcacgugacgcgcggcgcgguccucaugcacaaggggaagcggaucgagcccagcugggccgacgugaagaaggaccugaucuccuacggcgggggcuggaagcuggagggcgaguggaaggagggggaggaggugcagguccucgcccuggagcccggcaagaacccgcgcgccgugcagaccaagcccgggcuguucaagaccaacaccggcacgaucggggccgugagccucgacuucucccccggcaccagcggcucccccaucgucgacaagaaggggaagguggugggccuguacgggaacggcgucgugacccggagcggcaccuacguguccgcgaucgcccagacggagaaguccaucgaggacaacccggagaucgaggacgacaucuuccgcaagaagcggcugaccaucauggaccugcaccccggggccggcaagaccaagcgcuaccuccccgccaucguccgggaggcgaucaagcgcgggcugcggacccugauccucgcccccacgcgcgugguggccgccgagauggaggaggcccugcgcggccugccgauccgguaccagacccccgcgauccgcgccgagcacaccgggcgggagaucgucgaccucaugugccacgccaccuucacgaugcgccugcugagccccauccgggugcccaacuacaaccucaucaucauggacgaggcccacuucaccgacccggccuccaucgcggcccgcggcuacaucagcacccggguggagaugggcgaggccgccgggaucuucaugaccgccacgccgcccggcucccgcgaccccuucccgcagagcaacgcgcccaucauggacgaggagcgggagauccccgagcgcuccuggaacagcgggcacgagugggucaccgacuucaagggcaagaccgugugguucgugcccuccaucaaggccgggaacgacaucgccgccugccugcggaagaacggcaagaaggucauccagcugagccgcaagaccuucgacuccgaguacaucaagacgcggaccaacgacugggacuucguggugaccaccgacaucagcgagaugggcgcgaacuucaaggccgagcgcgucaucgacccgcggcgcugcaugaagcccgugauccucacggacggggaggagcgggugauccuggccggccccaugcccgucacccacuccagcgccgcccagcgccgggggcgcgugggccgcaacccgaagaacgagaacgaccaguacaucuacaugggggagccccuggagaacgacgaggacugcgcgcacuggaaggaggccaagaugcuccuggacaacaucaacacccccgagggcaucauccccuccauguucgagccggagcgggagaagguggacgccaucgacggcgaguaccgccugcgcggggaggcccgcaagaccuucgucgaccucaugcggcgcggcgaccugcccguguggcuggccuaccgggucgcggccgaggggaucaacuacgccgaccgccgguggugcuucgacggcgugaagaacaaccagauccucgaggagaacguggaggucgagaucuggacgaaggagggggagcgcaagaagcugaagccccgguggcuggacgcccgcaucuacagcgacccgcucgcccugaaggaguucaaggaguucgcggccggccggaagucccugacccucaaccugaucaccgagaugggccgccugcccaccuucaugacgcagaaggccaagaacgcccucgacaaccuggcggugcugcacaccgccgaggccgggggccgggccuacaaccacgcccucagcgagcugcccgagacccuggagacccuccugcugcucacgcugcuggcgaccgugaccgggggcaucuuccucuuccugauguccggcaaggggaucggcaagaugacccuggggaugugcugcaucaucaccgccagcauccuccugugguacgcccagauccagccccacuggaucgccgccuccaucauccuggaguucuuccucaucguccugcugaucccggagcccgagaagcagcgcacgccccaggacaaccagcucaccuacguggugaucgcgauccugaccgucguggccgccaccauggccaacgagaugggcuuccuggagaagacgaagaaggacuucgggcucggcagcaucaccacccagcagcccgagagcaacauccuggacaucgaccugcggccggccuccgcguggacccucuacgccguggccacgaccuucaucacccccaugcugcgccacagcaucgagaacuccagcgucaacgugucccugaccgccaucgccaaccaggcgacggugcucaugggccuggggaagggcuggccccugagcaagauggacaucggggucccccuccuggccaucggcugcuacucccaggugaacccgaucacccugaccgccgcccuccugcugcucguggcgcacuacgccaucaucgggcccggccugcaggccaaggccacccgggaggcccagaagcgcgcggccgccggcaucaugaagaaccccacggucgacgggaugaccgugaucgaccuggaccccaucccguacgaccccaaguucgagaagcagcucggccaggugaugcugcugguccucugcgugacccaggugcugaugaugcggaccacgugggcccugugcgaggcccucacccuggcgaccgggcccaucagcacccugugggagggcaaccccgggcgcuucuggaacacgaccaucgccgucuccauggccaacaucuuccgcggcagcuaccucgccggcgccgggcugcuguucuccaucaugaagaacaccgcgaacacccggcgcggcacggggaacaccggcgagacccucggcgagaaguggaagaaccggcugaacgcccugggcaagagcgaguuccagaucuacaagaaguccggcauccaggagguggaccgcacccucgccaaggaggggaucaagcggggcgagacggaccaccacgccgugagccgcggguccgcgaagcugcggugguucgucgagcgcaaccuggugaccccggagggcaagguggucgaccucggcugcgggcggggcggguggagcuacuacugcggcgggcugaagaacgugaaggaggugaagggccugaccaagggcgggcccggccacgaggagcccauccccauguccaccuacggguggaaccucguccgccugcagagcggcguggacguguucuucacgccgcccgagaagugcgacacccugcucugcgacaucggggaguccagccccaaccccaccgucgaggccggccggacccugcgcgugcugaaccucguggagaacuggcugaacaacaacacccaguucugcaucaagguccugaacccguacaugcccagcgugaucgagaagauggaggcccugcagcggaaguacggcggggcccucgugcgcaacccccugucccggaacagcacgcacgagauguacugggucuccaacgccagcggcaacaucguguccagcgugaacaugaucucccgcaugcugaucaaccgguucaccaugcgccacaagaaggcgaccuacgagccggacgucgaccucgggagcggcacccggaacaucgggaucgaguccgagacgcccaaccuggacaucaucggcaagcgcaucgagaagaucaagcaggagcacgagaccagcuggcacuacgaccaggaccaccccuacaagaccugggccuaccacggcuccuacgagaccaagcagacggggagcgccuccagcauggugaacggcgugguccgccugcucaccaagcccugggacgugaucccgauggugacccagauggccaugaccgacacgacccccuucgggcagcagcgggucuucaaggagaagguggacacccgcacccaggagcccaaggagggcacgaagaagcugaugaagaucaccgccgaguggcuguggaaggagcucggcaagaagaagacgccccggaugugcacccgcgaggaguucacgcggaagguccgcuccaacgcggcccugggggccaucuucaccgacgagaacaaguggaaguccgcccgggaggccguggaggacuccggcuucugggagcugguggacaaggagcgcaaccuccaccuggaggggaagugcgagaccugcgucuacaacaugaugggcaagcgggagaagaagcugggggaguucggcaaggcgaagggcagccgcgccaucugguacauguggcucggggcccgguuccuggaguucgaggcccugggcuuccucaacgaggaccacugguucucccgcgagaacagccugagcgggguggagggcgaggggcugcacaagcucggcuacauccugcgggacguguccaagaaggagggcggggcgauguacgccgacgacaccgccggcugggacacgcgcaucacccuggaggaccucaagaacgaggagauggucaccaaccacauggagggggagcacaagaagcuggccgaggccaucuucaagcugaccuaccagaacaagguggugcggguccagcgcccgacgccccggggcaccgugauggacaucaucagccgccgggaccagcgcggguccggccagguggucaccuacggccucaacaccuucacgaacauggaggcgcagcugauccggcagauggagggggagggcguguucaagagcauccagcagcugaccgugaaggaggagaucgccgucaagaacuggcucauccgcguggggcgcgagcggcugucccgcauggccaucagcggcgacgacugcguggucaagccccuggacgaccgguucgccuccgcccucaccgcgcugaacgacaugggcaaggugcgcaaggacauccagcagugggagcccagccggggguggaacgacuggacccaggugccguucugcucccaccacuuccacgagcugaucaugaaggacggccgcguccucguggugcccugccggaaccaggacgagcugaucgggcgcgcccggaucagccagggcgccggguggucccugcgcgagacggccugccucggcaagagcuacgcccagauguggucccugauguacuuccaccggcgcgaccugcggcucgcggccaacgccaucugcagcgccguccccucccacuggauccccaccagccgcaccaccugguccauccacgccacccacgaguggaugacgaccgaggacaugcugaccguguggaaccggguguggauccaggagaacccguggauggaggacaagacccccgucgagagcugggaggagauccccuaccugggcaagcgcgaggaccaguggugcgggagccucaucggccugacgucccgggcgaccugggccaagaacauccagaccgccaucaaccaggugcgcagccugaucgggaacgaggaguacaccgacuacaugcccuccaugaagcgguuccgccgcgaggaggaggaggccggcgugcucugguga

SEQ ID NO: 9081 - RNA, 9876 nt, Artificial Sequence
  derived and/or modified CDS sequence (opt1) from DENV-2__KM279571__SS-prME
accgcgggcaucaucaucaugaugauccccaccgugauggccuuccaccugaccacccgcaacggggagccccacaugaucgucucccggcaggagaagggcaagucccuccuguucaagaccgagaacggggugaacaugugcacccugauggcgauggaccucggcgagcugugcgaggacaccaucaccuacaacugcccccugcuccgccagaacgagcccgaggacaucgacugcuggugcaacagcaccuccaccugggugaccuacgggaccugcaccgccaccggcgagcaccggcgcgagaagcggagcgucgcccuggugccccacgugggcauggggcuggagacccgcaccgagaccuggauguccagcgagggcgccuggaagcacgcccagcggaucgagaccuggauccuccgccaccccggguucaccaucauggcggccauccuggccuacaccaucggcaccaccuacuuccagcggguccugaucuucauccuccugacggccgugacccccuccauggcgaugcgcugcaucgggaucagcaaccgggacuucguggagggcgucuccggcgggagcuggguggacaucgugcuggagcacggcuccugcgucaccaccauggccaagaacaagcccacgcucgacuucgagcugaucaagaccgaggccaagcaccuggccacccuccgcaaguacugcguggaggccaagcugaccaacacgaccaccgcgagccggugccccacccagggggagcccucccugaacgaggagcaggacaagcgcuucgugugcaagcacagcauggucgaccggggcuggggcaacgggugcggccucuucgggaagggcgggaucgugacgugcgccauguucacgugcaagaagaacauggagggcaaggugguccagcccgagaaccuggaguacaccaucgugaucacgccccacuccggcgaggagaacgccguggggaacgacacgggcaagcacgggaaggagaucaaggucacgccccagagcuccaucaccgaggccgagcugaccggcuacgggaccgugacgauggagugcagcccgcgcaccggccucgacuucaacgagauggugcugcugcagauggagaacaaggccuggcucguccaccggcagugguuccuggaccugccccuccccuggcugcccggcgcggacacccagggguccaacuggauccagaaggagacccuggugacguucaagaacccgcacgccaagaagcaggacgucguggugcucggcagccaggagggggccaugcacaccgcccugaccggcgccaccgagauccagaugagcuccgggaaccuccuguucacgggccaccugaagugccgccugcggauggacaagcuccagcugaagggcaugagcuacuccaugugcaccgggaaguucaaggucgugaaggagaucgcggagacccagcacggcaccaucgugauccgcguccaguacgagggggacggcagccccugcaagauccccuucgagaucauggaccuggagaagcggcacgugcucggccgccugaucacggugaaccccaucgucaccgagaaggacuccccggugaacaucgaggccgagccgcccuucggggacagcuacaucaucaucggcguggagcccgggcagcugaagcucuccugguucaagaagggcagcuccaucgggcagauguucgagaccaccaugcgcggcgccaagcggauggccauccugggcgacacggccugggacuucgggagccugggcggggucuucaccuccaucggcaaggcgcuccaccagguguucggggccaucuacggcgccgccuucagcggcguguccuggaccaugaagauccugaucggggucgugaucaccuggaucggcaugaacagccgcuccacgagccuguccgugagccugguccucguggggguggucacccuguaccugggcgugauggugcaggcggacuccgggugcgucgugagcuggaagaacaaggagcucaagugcggcagcggcaucuucaucaccgacaacgugcacaccuggacggagcaguacaaguuccagccggagucccccagcaagcuggccuccgccauccagaaggcccacgaggaggggaucugcggcauccggagcgucacccgccuggagaaccucauguggaagcagaucacccccgagcugaaccacauccugaccgagaacgaggugaagcucacgaucaugaccggggacaucaagggcaucaugcaggccgggaagcggacccugcgcccccagccgaccgagcugaaguacuccuggaaggcguggggcaaggccaagaugcucagcacggagcugcacaaccacaccuuccugaucgacggccccgagaccgccgagugccccaacaccaaccgggccuggaacucccucgagguggaggacuacggguucggcgucuucacgaccaacaucuggcugaagcugaaggagcgccaggacguguucugcgacagcaagcucauguccgccgcgaucaaggacaaccgggccgugcacgccgacaugggguacuggaucgagagcgcccugaacgacaccuggaagaucgagaaggccuccuucaucgaggucaagagcugccacuggccgaagucccacacccuguggagcaacggcgugcucgaguccgagaugaucauccccaagaacuucgcgggccccgugagccagcacaacuaccgccccggguaccacacccagacggccggcccguggcaccuggggcggcuggagauggacuucgacuucugcgagggcaccaccgucguggugaccgaggacugcgggaaccgcggccccucccuccggacgaccaccgccagcggcaagcugaucaccgaguggugcugccgcagcugcacgcugccgccccuccgguaccgcggggaggacggcugcugguacgggauggagauccggccgcugaaggagaaggaggagaaccuggucaacucccucgugaccgccggccacgggcagaucgacaacuucagccugggcgugcugggcauggcccucuuccuggaggagaugcugcgcacccgggucgggaccaagcacgccauccuccugguggccguguccuucgucacgcugaucaccggcaacaugagcuuccgcgaccucgggcgcgugauggugauggucggcgccaccaugaccgacgacaucgggaugggcgugacguaccuggcccugcucgcggccuucaagauccggcccaccuucgccgccggccugcugcuccgcaagcugaccuccaaggagcugaugaugaccacgaucgggaucgugcuccugagccaguccaccauccccgagagcauccuggagcucaccgacgcccuggcgcugggcaugaugguccucaagaucgugcggaacauggagaaguaccagcuggccgucaccaucauggccauccugugcgugcccaacgccgugauccuccagaacgccuggaaggucuccugcacgacccuggcgguggugagcgucuccccgcugcuccugaccagcucccagcagaaggccgacuggaucccccuggcccucaccaucaaggggcugaaccccacggccaucuuccugaccacccucagccgcaccuccaagaagcggagcuggccccugaacgaggcgaucauggccgugggcaugguguccauccuggccagcucccuccugaagaacgacaucccgaugacgggcccccuggucgccgggggccuccugaccgugugcuacgugcugaccgggcgcagcgccgaccucgagcuggagcgggcggccgacguccgcugggaggagcaggccgagaucagcggcuccagccccauccuguccaucaccaucagcgaggacggguccaugagcaucaagaacgaggaggaggagcagacgcucaccauccugauccggaccggccugcucgugaucuccggccuguuccccgugagcaucccgaucaccgccgccgcgugguaccugugggaggucaagaagcagcgcgccggggugcucugggacgugcccagcccgccgcccgucggcaaggccgagcuggaggacggggccuaccggaucaagcagaagggcauccugggguacagccagaucggcgccggcguguacaaggaggggaccuuccacacgauguggcacgugacccgcggcgcgguccucaugcacaaggggaagcggaucgagcccuccugggccgacgugaagaaggaccugaucagcuacggcgggggcuggaagcuggagggcgaguggaaggagggggaggaggugcagguccucgcccuggagcccggcaagaacccccgcgccgugcagaccaagcccgggcuguucaagaccaacacgggcaccaucggggccgugucccucgacuucagccccggcaccuccggcagccccaucgucgacaagaaggggaagguggugggccuguacgggaacggcgucgugacccgguccggcacguacgugagcgcgaucgcccagaccgagaaguccaucgaggacaacccggagaucgaggacgacaucuuccgcaagaagcggcugaccaucauggaccugcaccccggggccggcaagaccaagcgcuaccuccccgccaucguccgggaggcgaucaagcgcgggcugcggacgcugauccucgcccccacccgcgugguggccgccgagauggaggaggcccugcgcggccugccgauccgguaccagacccccgcgauccgcgccgagcacaccgggcgggagaucgucgaccucaugugccacgccacguucaccaugcgccugcugagccccauccgggugcccaacuacaaccucaucaucauggacgaggcccacuucaccgacccggccagcaucgcggcccgcggcuacaucuccacccggguggagaugggcgaggccgccgggaucuucaugacggccacgccgcccggcagccgcgaccccuucccgcaguccaacgcgcccaucauggacgaggagaaggagauccccgagcggagcuggaacuccgggcacgagugggucaccgacuucaagggcaagaccgugugguucgugcccagcaucaaggccgggaacgacaucgccgccugccugcgcaagaacggcaagaaggucauccagcugucccggaagacguucgacagcgaguacaucaagacccgcaccaacgacugggacuucguggugaccacggacaucuccgagaugggcgcgaacuucaaggccgagcgggucaucgacccgcgccggugcaugaagcccgugauccucaccgacggggaggagcgcgugauccuggccggccccaugcccgucacccacagcuccgccgcccagcggcgcgggcgggugggccgcaacccgaagaacgagaacgaccaguacaucuacaugggggagccccuggagaacgacgaggacugcgcgcacuggaaggaggccaagaugcuccuggacaacaucaacacccccgagggcaucauccccagcauguucgagccggagcgcgagaagguggacgccaucgacggcgaguaccggcugcgcggggaggcccggaagacguucgucgaccucaugcgccggggcgaccugcccguguggcuggccuaccgcgucgcggccgaggggaucaacuacgccgaccggcgcuggugcuucgacggcgugaagaacaaccagauccucgaggagaacguggaggucgagaucuggaccaaggagggggagcggaagaagcugaagccccgcuggcuggacgcccggaucuacuccgacccgcucgcccugaaggaguucaaggaguucgcggccggccgcaagagccugacccucaaccugaucaccgagaugggccggcugcccacguucaugacccagaaggccaagaacgcccucgacaaccuggcggugcugcacaccgccgaggccgggggccgcgccuacaaccacgcccucuccgagcugcccgagacccuggagacgcuccugcugcucacccugcuggcgaccgugaccgggggcaucuuccucuuccugaugagcggcaaggggaucggcaagaugacccuggggaugugcugcaucaucacggccuccauccuccugugguacgcccagauccagccccacuggaucgccgccagcaucauccuggaguucuuccucaucguccugcugaucccggagcccgagaagcagcggacgccccaggacaaccagcucaccuacguggugaucgcgauccugaccgucguggccgccacgauggccaacgagaugggcuuccuggagaagaccaagaaggacuucgggcucggcuccaucaccacccagcagcccgagagcaacauccuggacaucgaccugcgcccggccagcgcguggacgcucuacgccguggccaccaccuucaucacccccaugcugcggcacuccaucgagaacagcuccgucaacgugagccugacggccaucgccaaccaggcgaccgugcucaugggccuggggaagggcuggccccuguccaagauggacaucggggucccccuccuggccaucggcugcuacagccaggugaacccgaucacccugaccgccgcccuccugcugcucguggcgcacuacgccaucaucgggcccggccugcaggccaaggccacgcgcgaggcccagaagcgggcggccgccggcaucaugaagaaccccaccgucgacgggaugaccgugaucgaccuggaccccaucccguacgaccccaaguucgagaagcagcucggccaggugaugcugcugguccucugcgugacccaggugcugaugaugcgcacgaccugggcccugugcgaggcccucacccuggcgaccgggcccaucuccacgcugugggagggcaaccccgggcgguucuggaacaccaccaucgccgucagcauggccaacaucuuccgcggcuccuaccucgccggcgccgggcugcuguucagcaucaugaagaacaccgcgaacacgcgccggggcaccgggaacaccggcgagacccucggcgagaaguggaagaaccgccugaacgcccuggggaaguccgaguuccagaucuacaagaaguccggcauccaggagguggaccggacgcucgccaaggaggggaucaagcgcggcgagaccgaccaccacgccgugagccgggggagcgcgaagcugcgcugguucgucgagcggaaccuggugaccccggagggcaagguggucgaccucggcugcgggcgcggcgggugguccuacuacugcggcgggcugaagaacgugaaggaggugaagggccugaccaagggcgggcccggccacgaggagcccauccccaugagcacguacggguggaaccucguccggcugcaguccggcguggacguguucuucaccccgcccgagaagugcgacacccugcucugcgacaucggggagagcucccccaaccccaccgucgaggccggccgcacccugcgggugcugaaccucguggagaacuggcugaacaacaacacgcaguucugcaucaagguccugaacccguacaugcccagcgugaucgagaagauggaggcccugcagcgcaaguacggcggggcccucgugcggaacccccugagccgcaacuccacccacgagauguacugggucagcaacgccuccggcaacaucgugagcuccgugaacaugaucagccggaugcugaucaaccgcuucaccaugcggcacaagaaggcgaccuacgagccggacgucgaccucggguccggcacgcgcaacaucgggaucgagagcgagacccccaaccuggacaucaucggcaagcggaucgagaagaucaagcaggagcacgagaccuccuggcacuacgaccaggaccaccccuacaagaccugggccuaccacggcagcuacgagacgaagcagaccggguccgccagcuccauggugaacggcgugguccgccugcucaccaagcccugggacgugaucccgauggugacccagauggccaugacggacaccacccccuucgggcagcagcgcgucuucaaggagaagguggacacccggacgcaggagcccaaggagggcaccaagaagcugaugaagaucaccgccgaguggcuguggaaggagcucggcaagaagaagacgccccgcaugugcacgcgggaggaguucacccgcaagguccggagcaacgcggcccugggggccaucuucaccgacgagaacaaguggaaguccgcccgcgaggccguggaggacagcggcuucugggagcugguggacaaggagcggaaccuccaccuggaggggaagugcgagaccugcgucuacaacaugaugggcaagcgcgagaagaagcugggggaguucggcaaggcgaagggcucccgggccaucugguacauguggcucggggcccgcuuccuggaguucgaggcccugggcuuccucaacgaggaccacugguucagccgggagaacucccugagcgggguggagggcgaggggcugcacaagcucggcuacauccugcgcgacgugagcaagaaggagggcggggcgauguacgccgacgacacggccggcugggacacccggaucacccuggaggaccucaagaacgaggagauggucaccaaccacauggagggggagcacaagaagcuggccgaggccaucuucaagcugacguaccagaacaagguggugcgcguccagcggccgacgccccgcggcaccgugauggacaucaucucccggcgcgaccagcgggggagcggccagguggucaccuacggccucaacaccuucaccaacauggaggcgcagcugauccgccagauggagggggagggcguguucaaguccauccagcagcugaccgugaaggaggagaucgccgucaagaacuggcucauccggguggggcgcgagcgccugagccggauggccaucuccggcgacgacugcguggucaagccccuggacgaccgcuucgccagcgcccucaccgcgcugaacgacaugggcaaggugcggaaggacauccagcagugggagcccucccgcggguggaacgacuggacccaggugccguucugcagccaccacuuccacgagcugaucaugaaggacggccggguccucguggugcccugccgcaaccaggacgagcugaucgggcgggcccgcaucucccagggcgccggguggagccugcgggagaccgccugccucggcaaguccuacgcccagauguggagccugauguacuuccaccgccgggaccugcgccucgcggccaacgccaucugcuccgccguccccagccacuggauccccaccucccggaccaccuggagcauccacgccacgcacgaguggaugaccaccgaggacaugcugaccguguggaaccgcguguggauccaggagaacccguggauggaggacaagacgcccgucgaguccugggaggagauccccuaccugggcaagcgggaggaccaguggugcgggagccucaucggccugaccagccgcgcgaccugggccaagaacauccagaccgccaucaaccaggugcggucccugaucgggaacgaggaguacacggacuacaugcccagcaugaagcgcuuccggcgcgaggaggaggaggccggcgugcucugguga

SEQ ID NO: 9082 - RNA, 9876 nt, Artificial Sequence
  derived and/or modified CDS sequence (opt1) from DENV-2__KM279544__SS-prME
accgcggggaucaucaucaugaugauccccaccgugauggccuuccaccugaccacccggaacggggagccccacaugaucgucagccggcaggagaagggcaagagccuccuguucaagaccgagaacggggugaacaugugcacccugauggcgauggaccucggcgagcugugcgaggacaccaucaccuacaacugcccccugcuccgccagaacgagcccgaggacaucgacugcuggugcaacagcaccagcaccugggugaccuacgggaccugcaccgccaccggcgagcaccggcgcgagaagcggagcgucgcccuggugccccacgugggcauggggcuggagacccgcaccgagaccuggaugagcagcgagggcgccuggaagcacgcccagcggaucgagaccuggauccuccgccaccccggguucacgaucauggcggccauccuggccuacaccaucggcaccaccuacuuccagcggguccugaucuucauccuccugacggccgugacccccuccauggcgaugcgcugcaucgggaccagcaaccgggacuucguggagggcgucuccggcgggagcuggguggacaucgugcuggagcacggcuccugcgucaccacgauggccaagaacaagcccacccucgacuucgagcugaucaagaccgaggccaagcaccuggccacccuccgcaaguacugcguggaggccaagcugacgaacaccaccaccgcgagccggugccccacgcagggggagcccucccugaacgaggagcaggacaagcgcuucgugugcaagcacagcauggucgaccggggcuggggcaacgggugcggccucuucgggaagggcgggaucgugaccugcgccauguucacgugcaagaagaacauggagggcaaggugguccagcccgagaaccuggaguacaccaucgugaucacgccccacuccggcgaggagaacgccguggggaacgacaccggcaagcacgggaaggagaucaaggucacgccccagagcuccaucaccgaggccgagcugaccggcuacgggacggugaccauggagugcagcccgcgcaccggccucgacuucaacgagauggugcugcugcagauggagaacaaggccuggcucguccaccggcagugguuccuggaccugccccuccccuggcugcccggcgcggacacccagggguccaacuggauccagaaggagacgcuggugaccuucaagaacccgcacgccaagaagcaggacgucguggugcucggcagccaggagggggccaugcacaccgcccugaccggcgccacggagauccagaugagcuccgggaaccuccuguucaccggccaccugaagugccgccugcggauggacaagcuccagcugaagggcaugagcuacuccaugugcaccgggaaguucaaggucgugaaggagaucgcggagacccagcacggcacgaucgugauccgcguccaguacgagggggacggcagccccugcaagauccccuucgagaucauggaccuggagaagcggcacgugcucggccgccugaucaccgugaaccccaucgucaccgagaaggacuccccggugaacaucgaggccgagccgcccuucggggacagcuacaucaucaucggcguggagcccgggcagcugaagcucuccugguucaagaagggcagcuccaucgggcagauguucgagaccacgaugcgcggcgccaagcggauggccauccugggcgacaccgccugggacuucgggagccugggcgggauguucaccuccaucggcaaggcgcuccaccaggucuucggggccaucuacggcgccgccuucagcggcguguccuggaccaugaagauccugaucgggguggucaucacguggaucggcaugaacagccgcuccaccagccuguccgugagccuggugcucgucgggguggugacccuguaccugggcgucauggugcaggcggacuccgggugcguggucagcuggaagaacaaggagcucaagugcggcagcggcaucuucaucaccgacaacgugcacacguggaccgagcaguacaaguuccagccggagucccccagcaagcuggccuccgccauccagaaggcccacgaggaggggaucugcggcauccggagcgugacccgccuggagaaccucauguggaagcagaucacccccgagcugaaccacauccugacggagaacgaggucaagcucaccaucaugaccggggacaucaagggcaucaugcaggccgggaagcggucccugcgcccccagccgaccgagcugaaguacagcuggaaggcguggggcaaggccaagaugcucuccacggagcugcacaaccacaccuuccugaucgacggccccgagaccgccgagugccccaacaccaaccgggccuggaacagccucgagguggaggacuacggguucggcguguucacgaccaacaucuggcugaagcugaaggagcgccaggacgucuucugcgacuccaagcucaugagcgccgcgaucaaggacaaccgggccgugcacgccgacaugggguacuggaucgaguccgcccugaacgacaccuggaagaucgagaaggccagcuucaucgaggugaaguccugccacuggcccaagagccacacccugugguccaacggcguccucgagagcgagaugaucauccccaagaacuucgcgggccccgugucccagcacaacuaccgccccggguaccacacccagacggccggcccguggcaccuggggcggcuggagauggacuucgacuucugcgagggcaccaccguggucgugaccgaggacugcgggaaccgcggccccagccuccggacgaccaccgccagcggcaagcugaucaccgaguggugcugccgcuccugcacgcugccgccccuccgguaccgcggggaggacggcugcugguacgggauggagauccggccgcugaaggagaaggaggagaaccuggugaacagccucgucaccgccggccacgggcagaucgacaacuucucccugggcgugcugggcauggcccucuuccuggaggagaugcugcgcacccggguggggaccaagcacgccauccuccuggucgccgugagcuucgugacgcugaucaccggcaacauguccuuccgcgaccucgggcgcgucauggugauggugggcgccaccaugaccgacgacaucgggaugggcgucacguaccuggcccugcucgcggccuucaaggugcggcccaccuucgccgccggccugcugcuccgcaagcugaccagcaaggagcugaugaugaccacgaucgggaucgugcuccugucccagagcaccauccccgaguccauccuggagcucaccgacgcccuggcgcugggcaugaugguccucaagaucgugcggaacauggagaaguaccagcuggccgucaccaucauggccauccugugcgugcccaacgccgugauccuccagaacgccuggaaggucagcugcacgacccuggcggugguguccgucagcccgcugcuccugaccuccagccagcagaaggccgacuggaucccccuggcccucaccaucaaggggcugaaccccacggccaucuuccugaccacccucucccgcaccagcaagaagcgguccuggccccugaacgaggcgaucauggccgugggcauggugagcauccuggccuccagccuccugaagaacgacaucccgaugacgggcccccuggucgccgggggccuccugaccgugugcuacgugcugaccgggcgcagcgccgaccucgagcuggagcgggcggccgacguccgcugggaggagcaggccgagaucuccggcagcucccccauccugagcaucaccaucuccgaggacgggagcauguccaucaagaacgaggaggaggagcagacgcucaccauccugauccggaccggccugcucgugaucagcggccuguuccccguguccaucccgaucaccgccgccgcgugguaccugugggaggucaagaagcagcgcgccggggugcucugggacgugcccuccccgccgcccgucggcaaggccgagcuggaggacggggccuaccggaucaagcagaagggcauccugggguacucccagaucggcgccggcguguacaaggaggggaccuuccacacgauguggcacgugacccgcggcgcgguccucaugcacaaggggaagcggaucgagcccagcugggccgacgugaagaaggaccugaucuccuacggcgggggcuggaagcuggagggcgaguggaaggagggggaggaggugcagguccucgcccuggagcccggcaagaacccgcgcgccgugcagaccaagcccgggcuguucaagaccaacacgggcaccaucggggccgugagccucgacuucucccccggcaccagcggcucccccaucgucgacaagaaggggaagguggugggccuguacgggaacggcgucgugacccggagcggcacguacguguccgcgaucgcccagaccgagaaguccaucgaggacaacccggagaucgaggacgacaucuuccgcaagaagcggcugaccaucauggaccugcaccccggggccggcaagaccaagcgcuaccuccccgccaucguccgggaggcgaucaagcgcgggcugcggacgcugauccucgcccccacccgcgugguggccgccgagauggaggaggcccugcgcggccugccgauccgguaccagacccccgcgauccgcgccgagcacaccgggcgggagaucgucgaccucaugugccacgccacguucaccaugcgccugcugagccccauccgggugcccaacuacaaccucaucaucauggacgaggcccacuucaccgacccggccuccaucgcggcccgcggcuacaucagcacccggguggagaugggcgaggccgccgggaucuucaugacggccacgccgcccggcucccgcgaccccuucccgcagagcaacgcgcccaucauggacgaggagcgggagauccccgagcgcuccuggaacagcgggcacgagugggucaccgacuucaagggcaagaccgugugguucgugcccuccaucaaggccgggaacgacaucgccgccugccugcggaagaacggcaagaaggucauccagcugagccgcaagacguucgacuccgaguacaucaagacccggaccaacgacugggacuucguggugaccacggacaucagcgagaugggcgcgaacuucaaggccgagcgcgucaucgacccgcggcgcugcaugaagcccgugauccucaccgacggggaggagcgggugauccuggccggccccaugcccgucacccacuccagcgccgcccagcgccgggggcgcgugggccgcaacccgaagaacgagaacgaccaguacaucuacaugggggagccccuggagaacgacgaggacugcgcgcacuggaaggaggccaagaugcuccuggacaacaucaacacccccgagggcaucauccccuccauguucgagccggagcgggagaagguggacgccaucgacggcgaguaccgccugcgcggggaggcccgcaagacguucgucgaccucaugcggcgcggcgaccugcccguguggcuggccuaccgggucgcggccgaggggaucaacuacgccgaccgccgguggugcuucgacggcgugaagaacaaccagauccucgaggagaacguggaggucgagaucuggaccaaggagggggagcgcaagaagcugaagccccgguggcuggacgcccgcaucuacagcgacccgcucgcccugaaggaguucaaggaguucgcggccggccggaagucccugacccucaaccugaucaccgagaugggccgccugcccacguucaugacccagaaggccaagaacgcccucgacaaccuggcggugcugcacaccgccgaggccgggggccgggccuacaaccacgcccucagcgagcugcccgagacccuggagacgcuccugcugcucacccugcuggcgaccgugaccgggggcaucuuccucuuccugauguccggcaaggggaucggcaagaugacccuggggaugugcugcaucaucacggccagcauccuccugugguacgcccagauccagccccacuggaucgccgccuccaucauccuggaguucuuccucaucguccugcugaucccggagcccgagaagcagcgcacgccccaggacaaccagcucaccuacguggugaucgcgauccugaccgucguggccgccacgauggccaacgagaugggcuuccuggagaagaccaagaaggacuucgggcucggcagcaucaccacccagcagcccgagagcaacauccuggacaucgaccugcggccggccuccgcguggacgcucuacgccguggccaccaccuucaucacccccaugcugcgccacagcaucgagaacuccagcgucaacgugucccugacggccaucgccaaccaggcgaccgugcucaugggccuggggaagggcuggccccugagcaagauggacaucggggucccccuccuggccaucggcugcuacucccaggugaacccgaucacccugaccgccgcccuccugcugcucguggcgcacuacgccaucaucgggcccggccugcaggccaaggccacgcgggaggcccagaagcgcgcggccgccggcaucaugaagaaccccaccgucgacgggaugaccgugaucgaccuggaccccaucccguacgaccccaaguucgagaagcagcucggccaggugaugcugcugguccucugcgugacccaggugcugaugaugcggacgaccugggcccugugcgaggcccucacccuggcgaccgggcccaucagcacgcugugggagggcaaccccgggcgcuucuggaacaccaccaucgccgucuccauggccaacaucuuccgcggcagcuaccucgccggcgccgggcugcuguucuccaucaugaagaacaccgcgaacacgcggcgcggcaccgggaacaccggcgagacccucggcgagaaguggaagaaccggcugaacgcccugggcaagagcgaguuccagaucuacaagaaguccggcauccaggagguggaccgcacgcucgccaaggaggggaucaagcggggcgagaccgaccaccacgccgugagccgcggguccgcgaagcugcggugguucgucgagcgcaaccuggugaccccggagggcaagguggucgaccucggcugcgggcggggcggguggagcuacuacugcggcgggcugaagaacgugaaggaggugaagggccugaccaagggcgggcccggccacgaggagcccauccccauguccacguacggguggaaccucguccgccugcagagcggcguggacguguucuucaccccgcccgagaagugcgacacccugcucugcgacaucggggaguccagccccaaccccaccgucgaggccggccggacccugcgcgugcugaaccucguggagaacuggcugaacaacaacacgcaguucugcaucaagguccugaacccguacaugcccagcgugaucgagaagauggaggcccugcagcggaaguacggcggggcccucgugcgcaacccccugucccggaacagcacccacgagauguacugggucuccaacgccagcggcaacaucguguccagcgugaacaugaucucccgcaugcugaucaaccgguucaccaugcgccacaagaaggcgaccuacgagccggacgucgaccucgggagcggcacgcggaacaucgggaucgaguccgagacccccaaccuggacaucaucggcaagcgcaucgagaagaucaagcaggagcacgagaccagcuggcacuacgaccaggaccaccccuacaagaccugggccuaccacggcuccuacgagacgaagcagaccgggagcgccuccagcauggugaacggcgugguccgccugcucaccaagcccugggacgugaucccgauggugacccagauggccaugacggacaccacccccuucgggcagcagcgggucuucaaggagaagguggacacccgcacgcaggagcccaaggagggcaccaagaagcugaugaagaucaccgccgaguggcuguggaaggagcucggcaagaagaagacgccccggaugugcacgcgcgaggaguucacccggaagguccgcuccaacgcggcccugggggccaucuucaccgacgagaacaaguggaaguccgcccgggaggccguggaggacuccggcuucugggagcugguggacaaggagcgcaaccuccaccuggaggggaagugcgagaccugcgucuacaacaugaugggcaagcgggagaagaagcugggggaguucggcaaggcgaagggcagccgcgccaucugguacauguggcucggggcccgguuccuggaguucgaggcccugggcuuccucaacgaggaccacugguucucccgcgagaacagccugagcgggguggagggcgaggggcugcacaagcucggcuacauccugcgggacguguccaagaaggagggcggggcgauguacgccgacgacacggccggcugggacacccgcaucacccuggaggaccucaagaacgaggagauggucaccaaccacauggagggggagcacaagaagcuggccgaggccaucuucaagcugacguaccagaacaagguggugcggguccagcgcccgacgccccggggcaccgugauggacaucaucagccgccgggaccagcgcggguccggccagguggucaccuacggccucaacaccuucaccaacauggaggcgcagcugauccggcagauggagggggagggcguguucaagagcauccagcagcugaccgugaaggaggagaucgccgucaagaacuggcucauccgcguggggcgcgagcggcugucccgcauggccaucagcggcgacgacugcguggucaagccccuggacgaccgguucgccuccgcccucaccgcgcugaacgacaugggcaaggugcgcaaggacauccagcagugggagcccagccggggguggaacgacuggacccaggugccguucugcucccaccacuuccacgagcugaucaugaaggacggccgcguccucguggugcccugccggaaccaggacgagcugaucgggcgcgcccggaucagccagggcgccggguggucccugcgcgagaccgccugccucggcaagagcuacgcccagauguggucccugauguacuuccaccggcgcgaccugcggcucgcggccaacgccaucugcagcgccguccccucccacuggauccccaccagccgcaccaccugguccauccacgccacgcacgaguggaugaccaccgaggacaugcugaccguguggaaccggguguggauccaggagaacccguggauggaggacaagacgcuggucgagagcugggaggagauccccuaccucggcaagcgcgaggaccaguggugcgggagccugaucggccugaccucccgggcgaccugggccaagaacauccagaccgccaucaaccaggugcgcagccucaucgggaacgaggaguacacggacuacaugcccuccaugaagcgguuccgccgcgaggaggaggaggccggcgugcugugguga

SEQ ID NO: 9083 - RNA, 9876 nt, Artificial Sequence
  derived and/or modified CDS sequence (opt1) from DENV-2__KM279549__SS-prME
accgcggggaucaucaucaugaugauccccaccgugauggccuuccaccugaccacccggaacggggagccccacaugaucgucagccggcaggagaagggcaagagccuccuguucaagaccgagaacggggugaacaugugcacccugauggcgauggaccucggcgagcugugcgaggacaccaucaccuacaacugcccccugcuccgccagaacgagcccgaggacaucgacugcuggugcaacagcaccagcaccugggugaccuacgggaccugcaccgccaccggcgagcaccggcgcgagaagcggagcgucgcccuggugccccacgugggcauggggcuggagacccgcaccgagaccuggaugagcagcgagggcgccuggaagcacgcccagcggaucgagaccuggauccuccgccaccccggguucacgaucauggcggccauccuggccuacaccaucggcaccaccuacuuccagcggguccugaucuucauccuccugacggccgugacccccuccauggcgaugcgcugcaucgggaucagcaaccgggacuucguggagggcgucuccggcgggagcuggguggacaucgugcuggagcacggcuccugcgucaccaccauggccaagaacaagcccacgcucgacuucgagcugaucaagaccgaggccaagcaccuggccacccuccgcaaguacugcguggaggccaagcugaccaacacgaccaccgcgagccggugccccacccagggggagcccucccugaacgaggagcaggacaagcgcuucgugugcaagcacagcauggucgaccggggcuggggcaacgggugcggccucuucgggaagggcgggaucgugacgugcgccauguucacgugcaagaagaacauggagggcaaggugguccagcccgagaaccuggaguacaccaucgugaucacgccccacuccggcgaggagaacgccguggggaacgacacgggcaagcacgggaaggagaucaaggucacgccccagagcuccaucaccgaggccgagcugaccggcuacgggaccgugacgauggagugcagcccgcgcaccggccucgacuucaacgagauggugcugcugcagauggagaacaaggccuggcucguccaccggcagugguuccuggaccugccccuccccuggcugcccggcgcggacacccagggguccaacuggauccagaaggagacccuggugacguucaagaacccgcacgccaagaagcaggacgucguggugcucggcagccaggagggggccaugcacaccgcccugaccggcgccaccgagauccagaugagcuccgggaaccuccuguucacgggccaccugaagugccgccugcggauggacaagcuccagcugaagggcaugagcuacuccaugugcaccgggaaguucaaggucgugaaggagaucgcggagacccagcacggcaccaucgugauccgcguccaguacgagggggacggcagccccugcaagauccccuucgagaucauggaccuggagaagcggcacgugcucggccgccugaucacggugaaccccaucgucaccgagaaggacuccccggugaacaucgaggccgagccgcccuucggggacagcuacaucaucaucggcguggagcccgggcagcugaagcucuccugguucaagaagggcagcuccaucgggcagauguucgagaccaccaugcgcggcgccaagcggauggccauccugggcgacacggccugggacuucgggagccugggcggggucuucaccuccaucggcaaggcgcuccaccagguguucggggccaucuacggcgccgccuucagcggcguguccuggaccaugaagauccugaucggggucgugaucaccuggaucggcaugaacagccgcuccacgagccuguccgugagccugguccucguggggguggucacccuguaccugggcgugauggugcaggcggacuccgggugcgucgugagcuggaagaacaaggagcucaagugcggcagcggcaucuucaucaccgacaacgugcacaccuggacggagcaguacaaguuccagccggagucccccagcaagcuggccuccgccauccagaaggcccacgaggaggggaucugcggcauccggagcgucacccgccuggagaaccucauguggaagcagaucacccccgagcugaaccacauccugaccgagaacgaggugaagcucacgaucaugaccggggacaucaagggcaucaugcaggccgggaagcggucccugcgcccccagccgaccgagcugaaguacagcuggaaggcguggggcaaggccaagaugcucuccaccgagcugcacaaccacacguuccugaucgacggccccgagaccgccgagugccccaacaccaaccgggccuggaacagccucgagguggaggacuacggguucggcgucuucaccacgaacaucuggcugaagcugaaggagcgccaggacguguucugcgacuccaagcucaugagcgccgcgaucaaggacaaccgggccgugcacgccgacaugggguacuggaucgaguccgcccugaacgacaccuggaagaucgagaaggccagcuucaucgaggucaaguccugccacuggcccaagagccacacccugugguccaacggcgugcucgagagcgagaugaucauccccaagaacuucgcgggccccgugucccagcacaacuaccgccccggguaccacacccagaccgccggcccguggcaccuggggcggcuggagauggacuucgacuucugcgagggcacgaccgucguggugaccgaggacugcgggaaccgcggccccagccuccggaccacgaccgccagcggcaagcugaucaccgaguggugcugccgcuccugcacccugccgccccuccgguaccgcggggaggacggcugcugguacgggauggagauccggccgcugaaggagaaggaggagaaccuggucaacagccucgugacggccggccacgggcagaucgacaacuucucccugggcgugcugggcauggcccucuuccuggaggagaugcugcgcacccgggucgggaccaagcacgccauccuccugguggccgugagcuucgucacccugaucacgggcaacauguccuuccgcgaccucgggcgcgugauggugauggucggcgccaccaugaccgacgacaucgggaugggcgugaccuaccuggcccugcucgcggccuucaaggugcggcccacguucgccgccggccugcugcuccgcaagcugaccagcaaggagcugaugaugaccaccaucgggaucguccuccugucccagagcacgauccccgaguccauccuggagcucaccgacgcccuggcgcugggcaugauggugcucaagaucguccggaacauggagaaguaccagcuggccgugaccaucauggccauccugugcgugcccaacgccgucauccuccagaacgccuggaaggugagcugcaccacgcuggcgguggucuccgugagcccgcugcuccugaccuccagccagcagaaggccgacuggaucccccuggcccucaccaucaaggggcugaaccccaccgccaucuuccugacgacccucucccgcaccagcaagaagcgguccuggccccugaacgaggcgaucauggccgugggcauggucagcauccuggccuccagccuccugaagaacgacaucccgaugaccggcccccugguggccgggggccuccugacggugugcuacguccugaccgggcgcagcgccgaccucgagcuggagcgggcggccgacgugcgcugggaggagcaggccgagaucuccggcagcucccccauccugagcaucaccaucuccgaggacgggagcauguccaucaagaacgaggaggaggagcagacccucacgauccugauccggaccggccugcucgugaucagcggccuguuccccgucuccaucccgaucaccgccgccgcgugguaccugugggaggugaagaagcagcgcgccggggugcucugggacguccccuccccgccgcccgugggcaaggccgagcuggaggacggggccuaccggaucaagcagaagggcauccugggguacucccagaucggcgccggcguguacaaggaggggaccuuccacaccauguggcacgucacgcgcggcgcggugcucaugcacaaggggaagcggaucgagcccagcugggccgacgugaagaaggaccugaucuccuacggcgggggcuggaagcuggagggcgaguggaaggagggggaggagguccaggugcucgcccuggagcccggcaagaacccgcgcgccgugcagaccaagcccgggcuguucaagaccaacaccggcacgaucggggccgucagccucgacuucucccccggcaccagcggcucccccaucguggacaagaaggggaagguggucggccuguacgggaacggcguggugacccggagcggcaccuacgucuccgcgaucgcccagacggagaaguccaucgaggacaacccggagaucgaggacgacaucuuccgcaagaagcggcugaccaucauggaccugcaccccggggccggcaagaccaagcgcuaccuccccgccaucgugcgggaggcgaucaagcgcgggcugcggacccugauccucgcccccacgcgcguggucgccgccgagauggaggaggcccugcgcggccugccgauccgguaccagacccccgcgauccgcgccgagcacaccgggcgggagaucguggaccucaugugccacgccaccuucacgaugcgccugcugagccccauccgggugcccaacuacaaccucaucaucauggacgaggcccacuucaccgacccggccuccaucgcggcccgcggcuacaucagcacccgggucgagaugggcgaggccgccgggaucuucaugaccgccacgccgcccggcucccgcgaccccuucccgcagagcaacgcgcccaucauggacgaggagcgggagauccccgagcgcuccuggaacagcgggcacgagugggugaccgacuucaagggcaagaccgugugguucguccccuccaucaaggccgggaacgacaucgccgccugccugcggaagaacggcaagaaggugauccagcugagccgcaagaccuucgacuccgaguacaucaagacgcggaccaacgacugggacuucguggucaccaccgacaucagcgagaugggcgcgaacuucaaggccgagcgcgugaucgacccgcggcgcugcaugaagcccgugauccucacggacggggaggagcgggucauccuggccggccccaugcccgugacccacuccagcgccgcccagcgccgggggcgcgugggccgcaacccgaagaacgagaacgaccaguacaucuacaugggggagccccuggagaacgacgaggacugcgcgcacuggaaggaggccaagaugcuccuggacaacaucaacacccccgagggcaucauccccuccauguucgagccggagcgggagaaggucgacgccaucgacggcgaguaccgccugcgcggggaggcccgcaagaccuucguggaccucaugcggcgcggcgaccugcccgucuggcuggccuaccggguggcggccgaggggaucaacuacguggaccgccgguggugcuucgacggcgucaagaacaaccagauccucgaggagaacguggagguggagaucuggacgaaggagggggagcgcaagaagcugaagccccgguggcuggacgcccgcaucuacagcgacccgcucgcccugaaggaguucaaggaguucgccgcgggccggaagucccugacccucaaccugaucaccgagaugggccgccugcccaccuucaugacgcagaaggccaagaacgcccucgacaaccuggccguccugcacaccgcggaggccgggggccgggccuacaaccacgcccucagcgagcugcccgagacccuggagacccuccugcugcucacgcugcuggccaccgugaccgggggcaucuuccucuuccugauguccggcaaggggaucggcaagaugacccuggggaugugcugcaucaucaccgcgagcauccuccugugguacgcccagauccagccccacuggaucgccgccuccaucauccuggaguucuuccucaucgugcugcugaucccggagcccgagaagcagcgcacgccccaggacaaccagcucaccuacgucgugaucgccauccugaccguggucgcggccaccauggccaacgagaugggcuuccuggagaagacgaagaaggacuucgggcucggcagcaucaccacccagcagcccgagagcaacauccuggacaucgaccugcggccggccuccgccuggacccucuacgcgguggccacgaccuucaucacccccaugcugcgccacagcaucgagaacuccagcgugaacgucucccugaccgccaucgccaaccaggccacggugcucaugggccuggggaagggcuggccccugagcaagauggacaucggggugccccuccuggcgaucggcugcuacucccaggucaacccgaucacccugaccgccgcccuccugcugcucguggcccacuacgcgaucaucgggcccggccugcaggccaaggccacccgggaggcccagaagcgcgccgcggccggcaucaugaagaaccccacgguggacgggaugaccgucaucgaccuggaccccaucccguacgaccccaaguucgagaagcagcucggccaggugaugcugcuggugcucugcgucacccaggugcugaugaugcggaccacgugggcccugugcgaggcccucacccuggccaccgggcccaucagcacccugugggagggcaaccccgggcgcuucuggaacacgaccaucgcgguguccauggccaacaucuuccgcggcagcuaccucgccggcgccgggcugcuguucuccaucaugaagaacaccgccaacacccggcgcggcacggggaacaccggcgagacccucggcgagaaguggaagaaccggcugaacgcgcugggcaagagcgaguuccagaucuacaagaaguccggcauccaggaggucgaccgcacccucgccaaggaggggaucaagcggggcgagacggaccaccacgccgugagccgcggguccgccaagcugcggugguucguggagcgcaaccuggucaccccggagggcaaggugguggaccucggcugcgggcggggcggguggagcuacuacugcggcgggcugaagaacgucaaggaggugaagggccugaccaagggcgggcccggccacgaggagcccauccccauguccaccuacggguggaaccucgugcgccugcagagcggcgucgacguguucuucacgccgcccgagaagugcgacacccugcucugcgacaucggggaguccagccccaaccccaccguggaggcgggccggacccugcgcguccugaaccucguggagaacuggcugaacaacaacacccaguucugcaucaaggugcugaacccguacaugcccagcgucaucgagaagauggaggcccugcagcggaaguacggcggggcccucgugcgcaacccccugucccggaacagcacgcacgagauguacuggguguccaacgccagcggcaacaucgucuccagcgugaacaugaucucccgcaugcugaucaaccgguucaccaugcgccacaagaaggccaccuacgagccggacguggaccucgggagcggcacccggaacaucgggaucgaguccgagacgcccaaccuggacaucaucggcaagcgcaucgagaagaucaagcaggagcacgagaccagcuggcacuacgaccaggaccaccccuacaagaccugggcguaccacggcuccuacgagaccaagcagacggggagcgccuccagcauggucaacggcguggugcgccugcucaccaagcccugggacgucaucccgauggugacccagauggccaugaccgacacgacccccuucgggcagcagcgggucuucaaggagaagguggacacccgcacccaggagcccaaggagggcacgaagaagcugaugaagaucaccgccgaguggcuguggaaggagcucggcaagaagaagacgccccggaugugcacccgcgaggaguucacgcggaaggugcgcuccaacgccgcgcugggggccaucuucaccgacgagaacaaguggaaguccgcccgggaggccgucgaggacuccggcuucugggagcugguggacaaggagcgcaaccuccaccuggaggggaagugcgagaccugcguguacaacaugaugggcaagcgggagaagaagcugggggaguucggcaaggccaagggcagccgcgcgaucugguacauguggcucggggcccgguuccuggaguucgaggcccugggcuuccucaacgaggaccacugguucucccgcgagaacagccugagcggggucgagggcgaggggcugcacaagcucggcuacauccugcgggacguguccaagaaggagggcggggccauguacgcggacgacaccgccggcugggacacgcgcaucacccuggaggaccucaagaacgaggagauggugaccaaccacauggagggggagcacaagaagcuggccgaggccaucuucaagcugaccuaccagaacaaggucgugcgggugcagcgcccgacgccccggggcaccgucauggacaucaucagccgccgggaccagcgcggguccggccagguggugaccuacggccucaacaccuucacgaacauggaggcccagcugauccggcagauggagggggagggcgucuucaagagcauccagcagcugaccgugaaggaggagaucgcggugaagaacuggcucauccgcgucgggcgcgagcggcugucccgcauggccaucagcggcgacgacugcguggugaagccccuggacgaccgguucgccuccgcccucaccgcccugaacgacaugggcaagguccgcaaggacauccagcagugggagcccagccggggguggaacgacuggacccaggugccguucugcucccaccacuuccacgagcugaucaugaaggacggccgcgugcucgucgugcccugccggaaccaggacgagcugaucgggcgcgcgcggaucagccagggcgccggguggucccugcgcgagacggccugccucggcaagagcuacgcccagauguggucccugauguacuuccaccggcgcgaccugcggcucgccgcgaacgccaucugcagcgccgugcccucccacuggauccccaccagccgcaccaccugguccauccacgccacccacgaguggaugacgaccgaggacaugcugaccgucuggaaccggguguggauccaggagaacccguggauggaggacaagacccccguggagagcugggaggagauccccuaccugggcaagcgcgaggaccaguggugcgggagccucaucggccugacgucccgggccaccugggcgaagaacauccagaccgccaucaaccagguccgcagccugaucgggaacgaggaguacaccgacuacaugcccuccaugaagcgguuccgccgcgaggaggaggaggccggcgugcucugguga

SEQ ID NO: 9084 - RNA, 9876 nt, Artificial Sequence
  derived and/or modified CDS sequence (opt1) from DENV-2__KM279552__SS-prME
accgcggggaucaucaucaugaugauccccaccgugauggccuuccaccugaccacccggaacggggagccccacaugaucgucagccggcaggagaagggcaagagccuccuguucaagaccgagaacggggugaacaugugcacccugauggcgauggaccucggcgagcugugcgaggacaccaucaccuacaacugcccccugcuccgccagaacgagcccgaggacaucgacugcuggugcaacagcaccagcaccugggugaccuacgggaccugcaccgccaccggcgagcaccggcgcgagaagcggagcgucgcccuggugccccacgugggcauggggcuggagacccgcaccgagaccuggaugagcagcgagggcgccuggaagcacgcccagcggaucgagaccuggauccuccgccaccccggguucacgaucauggcggccauccuggccuacaccaucggcaccaccuacuuccagcggguccugaucuucauccuccugacggccgugacccccuccauggcgaugcgcugcaucgggaucagcaaccgggacuucguggagggcgucuccggcgggagcuggguggacaucgugcuggagcacggcuccugcgucaccaccauggccaagaacaagcccacgcucgacuucgagcugaucaagaccgaggccaagcaccuggccacccuccgcaaguacugcguggaggccaagcugaccaacacgaccaccgcgagccggugccccacccagggggagcccucccugaacgaggagcaggacaagcgcuucgugugcaagcacagcauggucgaccggggcuggggcaacgggugcggccucuucgggaagggcgggaucgugacgugcgccauguucacgugcaagaagaacauggagggcaaggugguccagcccgagaaccuggaguacaccaucgugaucacgccccacuccggcgaggagaacgccguggggaacgacacgggcaagcacgggaaggagaucaaggucacgccccagagcuccaucaccgaggccgagcugaccggcuacgggaccgugacgauggagugcagcccgcgcaccggccucgacuucaacgagauggugcugcugcagauggagaacaaggccuggcucguccaccggcagugguuccuggaccugccccuccccuggcugcccggcgcggacacccagggguccaacuggauccagaaggagacccuggugacguucaagaacccgcacgccaagaagcaggacgucguggugcucggcagccaggagggggccaugcacaccgcccugaccggcgccaccgagauccagaugagcuccgggaaccuccuguucacgggccaccugaagugccgccugcggauggacaagcuccagcugaagggcaugagcuacuccaugugcaccgggaaguucaaggucgugaaggagaucgcggagacccagcacggcaccaucgugauccgcguccaguacgagggggacggcagccccugcaagauccccuucgagaucauggaccuggagaagcggcacgugcucggccgccugaucacggugaaccccaucgucaccgagaaggacuccccggugaacaucgaggccgagccgcccuucggggacagcuacaucaucaucggcguggagcccgggcagcugaagcucuccugguucaagaagggcagcuccaucgggcagauguucgagaccaccaugcgcggcgccaagcggauggccauccugggcgacacggccugggacuucgggagccugggcggggucuucaccuccaucggcaaggcgcuccaccagguguucggggccaucuacggcgccgccuucagcggcguguccuggaccaugaagauccugaucggggucgugaucaccuggaucggcaugaacagccgcuccacgagccuguccgugagccugguccucguggggguggucacccuguaccugggcgugauggugcaggcggacuccgggugcgucgugagcuggaagaacaaggagcucaagugcggcagcggcaucuucaucaccgacaacgugcacaccuggacggagcaguacaaguuccagccggagucccccagcaagcuggccuccgccauccagaaggcccacgaggaggggaucugcggcauccggagcgucacccgccuggagaaccucauguggaagcagaucacccccgagcugaaccacauccugaccgagaacgaggugaagcucacgaucaugaccggggacaucaagggcaucaugcaggccgggaagcggucccugcgcccccagccgaccgagcugaaguacagcuggaaggcguggggcaaggccaagaugcucuccaccgagcugcacaaccacacguuccugaucgacggccccgagaccgccgagugccccaacaccaaccgggccuggaacagccucgagguggaggacuacggguucggcgucuucaccacgaacaucuggcugaagcugaaggagcgccaggacguguucugcgacuccaagcucaugagcgccgcgaucaaggacaaccgggccgugcacgccgacaugggguacuggaucgaguccgcccugaacgacaccuggaagaucgagaaggccagcuucaucgaggucaaguccugccacuggcccaagagccacacccugugguccaacggcgugcucgagagcgagaugaucauccccaagaacuucgcgggccccgugucccagcacaacuaccgccccggguaccacacccagaccgccggcccguggcaccuggggcggcuggagauggacuucgacuucugcgagggcacgaccgucguggugaccgaggacugcgggaaccgcggccccagccuccggaccacgaccgccagcggcaagcugaucaccgaguggugcugccgcuccugcacccugccgccccuccgguaccgcggggaggacggcugcugguacgggauggagauccggccgcugaaggagaaggaggagaaccuggucaacagccucgugacggccggccacgggcagaucgacaacuucucccugggcgugcugggcauggcccucuuccuggaggagaugcugcgcacccgggucgggaccaagcacgccauccuccugguggccgugagcuucgucacccugaucacgggcaacauguccuuccgcgaccucgggcgcgugauggugauggucggcgccaccaugaccgacgacaucgggaugggcgugaccuaccuggcccugcucgcggccuucaaggugcggcccacguucgccgccggccugcugcuccgcaagcugaccagcaaggagcugaugaugaccaccaucgggaucguccuccugucccacagcacgauccccgaguccauccuggagcucaccgacgcccuggcgcugggcaugauggugcucaagaucguccggaacauggagaaguaccagcuggccgugaccaucauggccauccugugcgugcccaacgccgucauccuccagaacgccuggaaggugagcugcaccacgcuggcgguggucuccgugagcccgcugcuccugaccuccagccagcagaaggccgacuggaucccccuggcccucaccaucaaggggcugaaccccaccgccaucuuccugacgacccucucccgcaccagcaagaagcgguccuggccccugaacgaggcgaucauggccgugggcauggucagcauccuggccuccagccuccugaagaacgacaucccgaugaccggcccccugguggccgggggccuccugacggugugcuacguccugaccgggcgcagcgccgaccucgagcuggagcgggcggccgacgugcgcugggaggagcaggccgagaucuccggcagcucccccauccugagcaucaccaucuccgaggacgggagcauguccaucaagaacgaggaggaggagcagacccucacgauccugauccggaccggccugcucgugaucagcggccuguuccccgucuccaucccgaucaccgccgccgcgugguaccugugggaggugaagaagcagcgcgccggggugcucugggacguccccuccccgccgcccgugggcaaggccgagcuggaggacggggccuaccggaucaagcagaagggcauccugggguacucccagaucggcgccggcguguacaaggaggggaccuuccacaccauguggcacgucacgcgcggcgcggugcucaugcacaaggggaagcggaucgagcccagcugggccgacgugaagaaggaccugaucuccuacggcgggggcuggaagcuggagggcgaguggaaggagggggaggagguccaggugcucgcccuggagcccggcaagaacccgcgcgccgugcagaccaagcccgggcuguucaagaccaacaccggcacgaucggggccgucagccucgacuucucccccggcaccagcggcucccccaucguggacaagaaggggaagguggucggccuguacgggaacggcguggugacccggagcggcaccuacgucuccgcgaucgcccagacggagaaguccaucgaggacaacccggagaucgaggacgacaucuuccgcaagaagcggcugaccaucauggaccugcaccccggggccggcaagaccaagcgcuaccuccccgccaucgugcgggaggcgaucaagcgcgggcugcggacccugauccucgcccccacgcgcguggucgccgccgagauggaggaggcccugcgcggccugccgauccgguaccagacccccgcgauccgcgccgagcacaccgggcgggagaucguggaccucaugugccacgccaccuucacgaugcgccugcugagccccauccgggugcccaacuacaaccucaucaucauggacgaggcccacuucaccgacccggccuccaucgcggcccgcggcuacaucagcacccgggucgagaugggcgaggccgccgggaucuucaugaccgccacgccgcccggcucccgcgaccccuucccgcagagcaacgcgcccaucauggacgaggagcgggagauccccgagcgcuccuggaacagcgggcacgagugggugaccgacuucaagggcaagaccgugugguucguccccuccaucaaggccgggaacgacaucgccgccugccugcggaagaacggcaagaaggugauccagcugagccgcaagaccuucgacuccgaguacaucaagacgcggaccaacgacugggacuucguggucaccaccgacaucagcgagaugggcgcgaacuucaaggccgagcgcgugaucgacccgcggcgcugcaugaagcccgugauccucacggacggggaggagcgggucauccuggccggccccaugcccgugacccacuccagcgccgcccagcgccgggggcgcgugggccgcaacccgaagaacgagaacgaccaguacaucuacaugggggagccccuggagaacgacgaggacugcgcgcacuggaaggaggccaagaugcuccuggacaacaucaacacccccgagggcaucauccccuccauguucgagccggagcgggagaaggucgacgccaucgacggcgaguaccgccugcgcggggaggcccgcaagaccuucguggaccucaugcggcgcggcgaccugcccgucuggcuggccuaccggguggcggccgaggggaucaacuacgccgaccgccgguggugcuucgacggcgugaagaacaaccagauccucgaggagaacgucgagguggagaucuggacgaaggagggggagcgcaagaagcugaagccccgguggcuggacgcccgcaucuacagcgacccgcucgcccugaaggaguucaaggaguucgcggccggccggaagucccugacccucaaccugaucaccgagaugggccgccugcccaccuucaugacgcagaaggccaagaacgcccucgacaaccuggcggugcugcacaccgccgaggccgggggccgggccuacaaccacgcccucagcgagcugcccgagacccuggagacccuccugcugcucacgcugcuggcgaccgucaccgggggcaucuuccucuuccugauguccggcaaggggaucggcaagaugacccuggggaugugcugcaucaucaccgccagcauccuccugugguacgcccagauccagccccacuggaucgccgccuccaucauccuggaguucuuccucaucgugcugcugaucccggagcccgagaagcagcgcacgccccaggacaaccagcucaccuacguggucaucgcgauccugaccgugguggccgccaccauggccaacgagaugggcuuccuggagaagacgaagaaggacuucgggcucggcagcaucaccacccagcagcccgagagcaacauccuggacaucgaccugcggccggccuccgcguggacccucuacgccgucgccacgaccuucaucacccccaugcugcgccacagcaucgagaacuccagcgugaacgugucccugaccgccaucgccaaccaggcgacgguccucaugggccuggggaagggcuggccccugagcaagauggacaucggggugccccuccuggccaucggcugcuacucccaggugaacccgaucacccugaccgccgcccuccugcugcucgucgcgcacuacgccaucaucgggcccggccugcaggccaaggccacccgggaggcccagaagcgcgcggccgccggcaucaugaagaaccccacgguggacgggaugaccgugaucgaccuggaccccaucccguacgaccccaaguucgagaagcagcucggccaggucaugcugcuggugcucugcgugacccagguccugaugaugcggaccacgugggcccugugcgaggcccucacccuggcgaccgggcccaucagcacccugugggagggcaaccccgggcgcuucuggaacacgaccaucgccguguccauggccaacaucuuccgcggcagcuaccucgccggcgccgggcugcuguucuccaucaugaagaacaccgcgaacacccggcgcggcacggggaacaccggcgagacccucggcgagaaguggaagaaccggcugaacgcccugggcaagagcgaguuccagaucuacaagaaguccggcauccaggagguggaccgcacccucgccaaggaggggaucaagcggggcgagacggaccaccacgccgucagccgcggguccgcgaagcugcggugguucguggagcgcaaccuggugaccccggagggcaaggucguggaccucggcugcgggcggggcggguggagcuacuacugcggcgggcugaagaacgugaaggaggucaagggccugaccaagggcgggcccggccacgaggagcccauccccauguccaccuacggguggaaccucgugcgccugcagagcggcguggacgucuucuucacgccgcccgagaagugcgacacccugcucugcgacaucggggaguccagccccaaccccaccguggaggccggccggacccugcgcgugcugaaccucgucgagaacuggcugaacaacaacacccaguucugcaucaaggugcugaacccguacaugcccagcgugaucgagaagauggaggcccugcagcggaaguacggcggggcccucguccgcaacccccugucccggaacagcacgcacgagauguacuggguguccaacgccagcggcaacaucguguccagcgucaacaugaucucccgcaugcugaucaaccgguucaccaugcgccacaagaaggcgaccuacgagccggacguggaccucgggagcggcacccggaacaucgggaucgaguccgagacgcccaaccuggacaucaucggcaagcgcaucgagaagaucaagcaggagcacgagaccagcuggcacuacgaccaggaccaccccuacaagaccugggccuaccacggcuccuacgagaccaagcagacggggagcgccuccagcauggugaacggcgucgugcgccugcucaccaagcccugggacgugaucccgauggucacccagauggccaugaccgacacgacccccuucgggcagcagcggguguucaaggagaaggucgacacccgcacccaggagcccaaggagggcacgaagaagcugaugaagaucaccgccgaguggcuguggaaggagcucggcaagaagaagacgccccggaugugcacccgcgaggaguucacgcggaaggugcgcuccaacgcggcccugggggccaucuucaccgacgagaacaaguggaaguccgcccgggaggccguggaggacuccggcuucugggagcuggucgacaaggagcgcaaccuccaccuggaggggaagugcgagaccugcguguacaacaugaugggcaagcgggagaagaagcugggggaguucggcaaggcgaagggcagccgcgccaucugguacauguggcucggggcccgguuccuggaguucgaggcccugggcuuccucaacgaggaccacugguucucccgcgagaacagccugagcgggguggagggcgaggggcugcacaagcucggcuacauccugcgggacgucuccaagaaggagggcggggcgauguacgccgacgacaccgccggcugggacacgcgcaucacccuggaggaccucaagaacgaggagauggugaccaaccacauggagggggagcacaagaagcuggccgaggccaucuucaagcugaccuaccagaacaaggugguccgggugcagcgcccgacgccccggggcaccgugauggacaucaucagccgccgggaccagcgcggguccggccaggucgugaccuacggccucaacaccuucacgaacauggaggcgcagcugauccggcagauggagggggagggcguguucaagagcauccagcagcugaccgucaaggaggagaucgccgugaagaacuggcucauccgcguggggcgcgagcggcugucccgcauggccaucagcggcgacgacugcgucgugaagccccuggacgaccgguucgccuccgcccucaccgcgcugaacgacaugggcaaggugcgcaaggacauccagcagugggagcccagccggggguggaacgacuggacccaggucccguucugcucccaccacuuccacgagcugaucaugaaggacggccgcgugcucgugguccccugccggaaccaggacgagcugaucgggcgcgcccggaucagccagggcgccggguggucccugcgcgagacggccugccucggcaagagcuacgcccagauguggucccugauguacuuccaccggcgcgaccugcggcucgcggccaacgccaucugcagcgccgugcccucccacuggauccccaccagccgcaccaccugguccauccacgccacccacgaguggaugacgaccgaggacaugcugaccguguggaaccgggucuggauccaggagaacccguggauggaggacaagacccccguggagagcugggaggagauccccuaccugggcaagcgcgaggaccaguggugcgggagccucaucggccugacgucccgggcgaccugggccaagaacauccagaccgccaucaaccaggugcgcagccugaucgggaacgaggaguacaccgacuacaugcccuccaugaagcgguuccgccgcgaggaggaggaggccggcguccucugguga

SEQ ID NO: 9085 - RNA, 9876 nt, Artificial Sequence
  derived and/or modified CDS sequence (opt1) from DENV-2__KM279557__SS-prME
accgcggggaucaucaucaugaugauccccaccgugauggccuuccaccugaccacccggaacggggagccccacaugaucgucagccggcaggagaagggcaagagccuccuguucaagaccgagaacggggugaacaugugcacccugauggcgauggaccucggcgagcugugcgaggacaccaucaccuacaacugcccccugcuccgccagaacgagcccgaggacaucgacugcuggugcaacagcaccagcaccugggugaccuacgggaccugcaccgccaccggcgagcaccggcgcgagaagcggagcgucgcccuggugccccacgugggcauggggcuggagacccgcaccgagaccuggaugagcagcgagggcgccuggaagcacgcccagcggaucgagaccuggauccuccgccaccccggguucacgaucauggcggccauccuggccuacaccaucggcaccaccuacuuccagcggguccugaucuucauccuccugacggccgugacccccuccauggcgaugcgcugcaucgggaucagcaaccgggacuucguggagggcgucuccggcgggagcuggguggacaucgugcuggagcacggcuccugcgucaccaccauggccaagaacaagcccacgcucgacuucgagcugaucaagaccgaggccaagcaccuggccacccuccgcaaguacugcguggaggccaagcugaccaacacgaccaccgcgagccggugccccacccagggggagcccucccugaacgaggagcaggacaagcgcuucgugugcaagcacagcauggucgaccggggcuggggcaacgggugcggccucuucgggaagggcgggaucgugacgugcgccauguucacgugcaagaagaacauggagggcaaggugguccagcccgagaaccuggaguacaccaucgugaucacgccccacuccggcgaggagaacgccguggggaacgacacgggcaagcacgggaaggagaucaaggucacgccccagagcuccaucaccgaggccgagcugaccggcuacgggaccgugacgauggagugcagcccgcgcaccggccucgacuucaacgagauggugcugcugcagauggagaacaaggccuggcucguccaccggcagugguuccuggaccugccccuccccuggcugcccggcgcggacacccagggguccaacuggauccagaaggagacccuggugacguucaagaacccgcacgccaagaagcaggacgucguggugcucggcagccaggagggggccaugcacaccgcccugaccggcgccaccgagauccagaugagcuccgggaaccuccuguucacgggccaccugaagugccgccugcggauggacaagcuccagcugaagggcaugagcuacuccaugugcaccgggaaguucaaggucgugaaggagaucgcggagacccagcacggcaccaucgugauccgcguccaguacgagggggacggcagccccugcaagauccccuucgagaucauggaccuggagaagcggcacgugcucggccgccugaucacggugaaccccaucgucaccgagaaggacuccccggugaacaucgaggccgagccgcccuucggggacagcuacaucaucaucggcguggagcccgggcagcugaagcucuccugguucaagaagggcagcuccaucgggcagauguucgagaccaccaugcgcggcgccaagcggauggccauccugggcgacacggccugggacuucgggagccugggcggggucuucaccuccaucggcaaggcgcuccaccagguguucggggccaucuacggcgccgccuucagcggcguguccuggaccaugaagauccugaucggggucgugaucaccuggaucggcaugaacagccgcuccacgagccuguccgugagccugguccucguggggguggucacccuguaccugggcgugauggugcaggcggacuccgggugcgucgugagcuggaagaacaaggagcucaagugcggcagcggcaucuucaucaccgacaacgugcacaccuggacggagcaguacaaguuccagccggagucccccagcaagcuggccuccgccauccagaaggcccacgaggaggggaucugcggcauccggagcgucacccgccuggagaaccucauguggaagcagaucacccccgagcugaaccacauccugaccgagaacgaggugaagcucacgaucaugaccggggacaucaagggcaucaugcaggccgggaagcggucccugcgcccccagccgaccgagcugaaguacagcuggaaggcguggggcaaggccaagaugcucuccaccgagcugcacaaccacacguuccugaucgacggccccgagaccgccgagugccccaacaccaaccgggccuggaacagccucgagguggaggacuacggguucggcgucuucaccacgaacaucuggcugaagcugaaggagcgccaggacguguucugcgacuccaagcucaugagcgccgcgaucaaggacaaccgggccgugcacgccgacaugggguacuggaucgaguccgcccugaacgacaccuggaagaucgagaaggccagcuucaucgaggucaaguccugccacuggcccaagagccacacccugugguccaacggcgugcucgagagcgagaugaucauccccaagaacuucgcgggccccgugucccagcacaacuaccgccccggguaccacacccagaccgccggcccguggcaccuggggcggcuggagauggacuucgacuucugcgagggcacgaccgucguggugaccgaggacugcgggaaccgcggccccagccuccggaccacgaccgccagcggcaagcugaucaccgaguggugcugccgcuccugcacccugccgccccuccgguaccgcggggaggacggcugcugguacgggauggagauccggccgcugaaggagaaggaggagaaccuggucaacagccucgugacggccggccacgggcagaucgacaacuucucccugggcgugcugggcauggcccucuuccuggaggagaugcugcgcacccgggucgggaccaagcacgccauccuccugguggccgugagcuucgucacccugaucacgggcaacauguccuuccgcgaccucgggcgcgugauggugauggucggcgccaccaugaccgacgacaucgggaugggcgugaccuaccuggcccugcucgcggccuucaaggugcggcccacguucgccgccggccugcugcuccgcaagcugaccagcaaggagcugaugaugaccaccaucgggaucguccuccugucccagagcacgauccccgaguccauccuggagcucaccgacgcccuggcgcugggcaugauggugcucaagaucguccggaacauggagaaguaccagcuggccgugaccaucauggccauccugugcgugcccaacgccgucauccuccagaacgccuggaaggugagcugcaccacgcuggcgguggucuccgugagcccgcugcuccugaccuccagccagcagaaggccgacuggaucccccuggcccucaccaucaaggggcugaaccccaccgccaucuuccugacgacccucucccgcaccagcaagaagcgguccuggccccugaacgaggcgaucauggccgugggcauggucagcauccuggccuccagccuccugaagaacgacaucccgaugaccggcccccugguggccgggggccuccugacggugugcuacguccugaccgggcgcagcgccgaccucgagcuggagcgggcggccgacgugcgcugggaggagcaggccgagaucuccggcagcucccccauccugagcaucaccaucuccgaggacgggagcauguccaucaagaacgaggaggaggagcagacccucacgauccugauccggaccggccugcucgugaucagcggccuguuccccgucuccaucccgaucaccgccgccgcgugguaccugugggaggugaagaagcagcgcgccggggugcucugggacguccccuccccgccgcccgugggcaaggccgagcuggaggacggggccuaccggaucaagcagaagggcauccugggguacucccagaucggcgccggcguguacaaggaggggaccuuccacaccauguggcacgucacgcgcggcgcggugcucaugcacaaggggaagcggaucgagcccagcugggccgacgugaagaaggaccugaucuccuacggcgggggcuggaagcuggagggcgaguggaaggagggggaggagguccaggugcucgcccuggagcccggcaagaacccgcgcgccgugcagaccaagcccgggcuguucaagaccaacaccggcacgaucggggccgucagccucgacuucucccccggcaccagcggcucccccaucguggacaagaaggggaagguggucggccuguacgggaacggcguggugacccggagcggcaccuacgucuccgcgaucgcccagacggagaaguccaucgaggacaacccggagaucgaggacgacaucuuccgcaagaagcggcugaccaucauggaccugcaccccggggccggcaagaccaagcgcuaccuccccgccaucgugcgggaggcgaucaagcgcgggcugcggacccugauccucgcccccacgcgcguggucgccgccgagauggaggaggcccugcgcggccugccgauccgguaccagacccccgcgauccgcgccgagcacaccgggcgggagaucguggaccucaugugccacgccaccuucacgaugcgccugcugagccccauccgggugcccaacuacaaccucaucaucauggacgaggcccacuucaccgacccggccuccaucgcggcccgcggcuacaucagcacccgggucgagaugggcgaggccgccgggaucuucaugaccgccacgccgcccggcucccgcgaccccuucccgcagagcaacgcgcccaucauggacgaggagcgggagauccccgagcgcuccuggaacagcgggcacgagugggugaccgacuucaagggcaagaccgugugguucguccccuccaucaaggccgggaacgacaucgccgccugccugcggaagaacggcaagaaggugauccagcugagccgcaagaccuucgacuccgaguacaucaagacgcggaccaacgacugggacuucguggucaccaccgacaucagcgagaugggcgcgaacuucaaggccgagcgcgugaucgacccgcggcgcugcaugaagcccgugauccucacggacggggaggagcgggucauccuggccggccccaugcccgugacccacuccagcgccgcccagcgccgggggcgcgugggccgcaacccgaagaacgagaacgaccaguacaucuacaugggggagccccuggagaacgacgaggacugcgcgcacuggaaggaggccaagaugcuccuggacaacaucaacacccccgagggcaucauccccuccauguucgagccggagcgggagaaggucgacgccaucgacggcgaguaccgccugcgcggggaggcccgcaagaccuucguggaccucaugcggcgcggcgaccugcccgucuggcuggccuaccggguggcggccgaggggaucaacuacgccgaccgccgguggugcuucgacggcgugaagaacaaccagauccucgaggagaacgucgagguggagaucuggacgaaggagggggagcgcaagaagcugaagccccgguggcuggacgcccgcaucuacagcgacccgcucgcccugaaggaguucaaggaguucgcggccggccggaagucccugacccucaaccugaucaccgagaugggccgccugcccaccuucaugacgcagaaggccaagaacgcccucgacaaccuggcggugcugcacaccgccgaggccgggggccgggccuacaaccacgcccucagcgagcugcccgagacccuggagacccuccugcugcucacgcugcuggcgaccgucaccgggggcaucuuccucuuccugauguccggcaaggggaucggcaagaugacccuggggaugugcugcaucaucaccgccagcauccuccugugguacgcccagauccagccccacuggaucgccgccuccaucauccuggaguucuuccucaucgugcugcugaucccggagcccgagaagcagcgcacgccccaggacaaccagcucaccuacguggucaucgcgauccugaccgugguggccgccaccauggccaacgagaugggcuuccuggagaagacgaagaaggacuucgggcucggcagcaucaccacccagcagcccgagagcaacauccuggacaucgaccugcggccggccuccgcguggacccucuacgccgucgccacgaccuucaucacccccaugcugcgccacagcaucgagaacuccagcgugaacgugucccugaccgccaucgccaaccaggcgacgguccucaugggccuggggaagggcuggccccugagcaagauggacaucggggugccccuccuggccaucggcugcuacucccaggugaacccgaucacccugaccgccgcccuccugcugcucgucgcgcacuacgccaucaucgggcccggccugcaggccaaggccacccgggaggcccagaagcgcgcggccgccggcaucaugaagaaccccacgguggacgggaugaccgugaucgaccuggaccccaucccguacgaccccaaguucgagaagcagcucggccaggucaugcugcuggugcucugcgugacccagguccugaugaugcggaccacgugggcccugugcgaggcccucacccuggcgaccgggcccaucagcacccugugggagggcaaccccgggcgcuucuggaacacgaccaucgccguguccauggccaacaucuuccgcggcagcuaccucgccggcgccgggcugcuguucuccaucaugaagaacaccgcgaacacccggcgcggcacggggaacaccggcgagacccucggcgagaaguggaagaaccggcugaacgcccugggcaagagcgaguuccagaucuacaagaaguccggcauccaggagguggaccgcacccucgccaaggaggggaucaagcggggcgagacggaccaccacgccgucagccgcggguccgcgaagcugcggugguucguggagcgcaaccuggugaccccggagggcaaggucguggaccucggcugcgggcggggcggguggagcuacuacugcggcgggcugaagaacgugaaggaggucaagggccugaccaagggcgggcccggccacgaggagcccauccccauguccaccuacggguggaaccucgugcgccugcagagcggcguggacgucuucuucacgccgcccgagaagugcgacacccugcucugcgacaucggggaguccagccccaaccccaccguggaggccggccggacccugcgcgugcugaaccucgucgagaacuggcugaacaacaacacccaguucugcaucaaggugcugaacccguacaugcccagcgugaucgagaagauggaggcccugcagcggaaguacggcggggcccucguccgcaacccccugucccggaacagcacgcacgagauguacuggguguccaacgccagcggcaacaucguguccagcgucaacaugaucucccgcaugcugaucaaccgguucaccaugcgccacaagaaggcgaccuacgagccggacguggaccucgggagcggcacccggaacaucgggaucgaguccgagacgcccaaccuggacaucaucggcaagcgcaucgagaagaucaagcaggagcacgagaccagcuggcacuacgaccaggaccaccccuacaagaccugggccuaccacggcuccuacgagaccaagcagacggggagcgccuccagcauggugaacggcgucgugcgccugcucaccaagcccugggacgugaucccgauggucacccagauggccaugaccgacacgacccccuucgggcagcagcggguguucaaggagaaggucgacacccgcacccaggagcccaaggagggcacgaagaagcugaugaagaucaccgccgaguggcuguggaaggagcucggcaagaagaagacgccccggaugugcacccgcgaggaguucacgcggaaggugcgcuccaacgcggcccugggggccaucuucaccgacgagaacaaguggaaguccgcccgggaggccguggaggacuccggcuucugggagcuggucgacaaggagcgcaaccuccaccuggaggggaagugcgagaccugcguguacaacaugaugggcaagcgggagaagaagcugggggaguucggcaaggcgaagggcagccgcgccaucugguacauguggcucggggcccgguuccuggaguucgaggcccugggcuuccucaacgaggaccacugguucucccgcgagaacagccugagcgggguggagggcgaggggcugcacaagcucggcuacauccugcgggacgucuccaagaaggagggcggggcgauguacgccgacgacaccgccggcugggacacgcgcaucacccuggaggaccucaagaacgaggagauggugaccaaccacauggagggggagcacaagaagcuggccgaggccaucuucaagcugaccuaccagaacaaggugguccgggugcagcgcccgacgccccggggcaccgugauggacaucaucagccgccgggaccagcgcggguccggccaggucgugaccuacggccucaacaccuucacgaacauggaggcgcagcugauccggcagauggagggggagggcguguucaagagcauccagcagcugaccgucaaggaggagaucgccgugaagaacuggcucauccgcguggggcgcgagcggcugucccgcauggccaucagcggcgacgacugcgucgugaagccccuggacgaccgguucgccuccgcccucaccgcgcugaacgacaugggcaaggugcgcaaggacauccagcagugggagcccagccggggguggaacgacuggacccaggucccguucugcucccaccacuuccacgagcugaucaugaaggacggccgcgugcucgugguccccugccggaaccaggacgagcugaucgggcgcgcccggaucagccagggcgccggguggucccugcgcgagacggccugccucggcaagagcuacgcccagauguggucccugauguacuuccaccggcgcgaccugcggcucgcggccaacagcaucugcuccgccgugcccagccacuggauccccaccucccgcaccaccuggagcauccacgccacccacgaguggaugacgaccgaggacaugcugaccguguggaaccgggucuggauccaggagaacccguggauggaggacaagacccccguggagagcugggaggagauccccuaccugggcaagcgcgaggaccaguggugcgggucccucaucggccugacgagccgggccaccugggcgaagaacauccagaccgccaucaaccaggugcgcucccugaucgggaacgaggaguacaccgacuacaugcccagcaugaagcgguuccgccgcgaggaggaggaggccggcguccucugguga

SEQ ID NO: 9086 - RNA, 9876 nt, Artificial Sequence
  derived and/or modified CDS sequence (opt1) from DENV-2__KM279591__SS-prME
accgcgggcaucaucaucaugaugauccccaccgugauggccuuccaccugaccacccggaacggggagccccacaugaucgucagccggcaggagaagggcaagucccuccuguucaagaccgagaacggggugaacaugugcacccugauggcgauggaccucggcgagcugugcgaggacaccaucaccuacaacugcccccugcuccgccagaacgagcccgaggacaucgacugcuggugcaacagcaccuccaccugggugaccuacgggaccugcaccgccaccggcgagcaccggcgcgagaagcggagcgucgcccuggugccccacgugggcauggggcuggagacccgcaccgagaccuggauguccagcgagggcgccuggaagcacgcccagcggaucgagaccuggauccuccgccaccccggguucaccaucauggcggccauccuggccuacaccaucggcaccaccuacuuccagcggguccugaucuucauccuccugacggccgugacccccuccauggcgaugcgcugcaucgggaucagcaaccgggacuucguggagggcgucuccggcgggagcuggguggacaucgugcuggagcacggcuccugcgucaccaccauggccaagaacaagcccacgcucgacuucgagcugaucaagaccgaggccaagcaccuggccacccuccgcaaguacugcguggaggccaagcugaccaacacgaccaccgcgagccggugccccacccagggggagcccucccugaacgaggagcaggacaagcgcuucgugugcaagcacagcauggucgaccggggcuggggcaacgggugcggccucuucgggaagggcgggaucgugacgugcgccauguucacgugcaagaagaacauggagggcaaggugguccagcccgagaaccuggaguacaccaucgugaucacgccccacuccggcgaggagaacgccguggggaacgacacgggcaagcacgggaaggagaucaaggucacgccccagagcuccaucaccgaggccgagcugaccggcuacgggaccgugacgauggagugcagcccgcgcaccggccucgacuucaacgagauggugcugcugcagauggagaacaaggccuggcucguccaccggcagugguuccuggaccugccccuccccuggcugcccggcgcggacacccagggguccaacuggauccagaaggagacccuggugacguucaagaacccgcacgccaagaagcaggacgucguggugcucggcagccaggagggggccaugcacaccgcccugaccggcgccaccgagauccagaugagcuccgggaaccuccuguucacgggccaccugaagugccgccugcggauggacaagcuccagcugaagggcaugagcuacuccaugugcaccgggaaguucaaggucgugaaggagaucgcggagacccagcacggcaccaucgugauccgcguccaguacgagggggacggcagccccugcaagauccccuucgagaucauggaccuggagaagcggcacgugcucggccgccugaucacggugaaccccaucgucaccgagaaggacuccccggugaacaucgaggccgagccgcccuucggggacagcuacaucaucaucggcguggagcccgggcagcugaagcucuccugguucaagaagggcagcuccaucgggcagauguucgagaccaccaugcgcggcgccaagcggauggccauccugggcgacacggccugggacuucgggagccugggcggggucuucaccuccaucggcaaggcgcuccaccagguguucggggccaucuacggcgccgccuucagcggcguguccuggaccaugaagauccugaucggggucgugaucaccuggaucggcaugaacagccgcuccacgagccuguccgugagccugguccucguggggguggucacccuguaccugggcgugauggugcaggcggacuccgggugcgucgugagcuggaagaacaaggagcucaagugcggcagcggcaucuucaucaccgacaacgugcacaccuggacggagcaguacaaguuccagccggagucccccagcaagcuggccuccgccauccagaaggcccacgaggaggggaucugcggcauccggagcgucacccgccuggagaaccucauguggaagcagaucacccccgagcugaaccacauccugaccgagaacgaggugaagcucacgaucaugaccggggacaucaagggcaucaugcaggccgggaagcggacccugcgcccccagccgaccgagcugaaguacuccuggaaggcguggggcaaggccaagaugcucagcacggagcugcacaaccacaccuuccugaucgacggccccgagaccgccgagugccccaacaccaaccgggccuggaacucccucgagguggaggacuacggguucggcgucuucacgaccaacaucuggcugaagcugaaggagcgccaggacguguucugcgacagcaagcucauguccgccgcgaucaaggacaaccgggccgugcacgccgacaugggguacuggaucgagagcgcccugaacgacaccuggaagaucgagaaggccuccuucaucgaggucaagagcugccacuggccgaagucccacacccuguggagcaacggcgugcucgaguccgagaugaucauccccaagaacuucgcgggccccgugagccagcacaacuaccgccccggguaccacacccagacggccggcccguggcaccuggggcggcuggagauggacuucgacuucugcgagggcaccaccgucguggugaccgaggacugcgggaaccgcggccccucccuccggacgaccaccgccagcggcaagcugaucaccgaguggugcugccgcagcugcacgcugccgccccuccgguaccgcggggaggacggcugcugguacgggauggagauccggccgcugaaggagaaggaggagaaccuggucaacucccucgugaccgccggccacgggcagaucgacaacuucagccugggcgugcugggcauggcccucuuccuggaggagaugcugcgcacccgggucgggaccaagcacgccauccuccugguggccguguccuucgucacgcugaucaccggcaacaugagcuuccgcgaccucgggcgcgugauggugauggucggcgccaccaugaccgacgacaucgggaugggcgugacguaccuggcccugcucgcggccuucaaggugcggcccaccuucgccgccggccugcugcuccgcaagcugaccuccaaggagcugaugaugaccacgaucgggaucguccuccugagccaguccaccauccccgagagcauccuggagcucaccgacgcccuggcgcugggcaugauggugcucaagaucguccggaacauggagaaguaccagcuggccgugaccaucauggccauccugugcgugcccaacgccgucauccuccagaacgccuggaagguguccugcacgacccuggcgguggucagcguguccccgcugcuccugaccagcucccagcagaaggccgacuggaucccccuggcccucaccaucaaggggcugaaccccacggccaucuuccugaccacccucagccgcaccuccaagaagcggagcuggccccugaacgaggcgaucauggccgugggcauggucuccauccuggccagcucccuccugaagaacgacaucccgaugacgggcccccugguggccgggggccuccugaccgugugcuacguccugaccgggcgcagcgccgaccucgagcuggagcgggcggccgacgugcgcugggaggagcaggccgagaucagcggcuccagccccauccuguccaucaccaucagcgaggacggguccaugagcaucaagaacgaggaggaggagcagacgcucaccauccugauccggaccggccugcucgugaucuccggccuguuccccgucagcaucccgaucaccgccgccgcgugguaccugugggaggugaagaagcagcgcgccggggugcucugggacguccccagcccgccgcccgugggcaaggccgagcuggaggacggggccuaccggaucaagcagaagggcauccugggguacagccagaucggcgccggcguguacaaggaggggaccuuccacacgauguggcacgucacccgcggcgcggugcucaugcacaaggggaagcggaucgagcccuccugggccgacgugaagaaggaccugaucagcuacggcgggggcuggaagcuggagggcgaguggaaggagggggaggagguccaggugcucgcccuggagcccggcaagaacccccgcgccgugcagaccaagcccgggcuguucaagaccaacacgggcaccaucggggccgucucccucgacuucagccccggcaccuccggcagccccaucguggacaagaaggggaagguggucggccuguacgggaacggcguggugacccgguccggcacguacgucagcgcgaucgcccagaccgagaaguccaucgaggacaacccggagaucgaggacgacaucuuccgcaagaagcggcugaccaucauggaccugcaccccggggccggcaagaccaagcgcuaccuccccgccaucgugcgggaggcgaucaagcgcgggcugcggacgcugauccucgcccccacccgcguggucgccgccgagauggaggaggcccugcgcggccugccgauccgguaccagacccccgcgauccgcgccgagcacaccgggcgggagaucguggaccucaugugccacgccacguucaccaugcgccugcugagccccauccgggugcccaacuacaaccucaucaucauggacgaggcccacuucaccgacccggccagcaucgcggcccgcggcuacaucuccacccgggucgagaugggcgaggccgccgggaucuucaugacggccacgccgcccggcagccgcgaccccuucccgcaguccaacgcgcccaucauggacgaggagcgggagauccccgagcgcagcuggaacuccgggcacgagugggugaccgacuucaagggcaagaccgugugguucguccccagcaucaaggccgggaacgacaucgccgccugccugcggaagaacggcaagaaggugauccagcugucccgcaagacguucgacagcgaguacaucaagacccggaccaacgacugggacuucguggucaccacggacaucuccgagaugggcgcgaacuucaaggccgagcgcgugaucgacccgcggcgcugcaugaagcccgugauccucaccgacggggaggagcgggucauccuggccggccccaugcccgugacccacagcuccgccgcccagcgccgggggcgcgugggccgcaacccgaagaacgagaacgaccaguacaucuacaugggggagccccuggagaacgacgaggacugcgcgcacuggaaggaggccaagaugcuccuggacaacaucaacacccccgagggcaucauccccagcauguucgagccggagcgggagaaggucgacgccaucgacggcgaguaccgccugcgcggggaggcccgcaagacguucguggaccucaugcggcgcggcgaccugcccgucuggcuggccuaccggguggcggccgaggggaucaacuacguggaccgccgguggugcuucgacggcgucaagaacaaccagauccucgaggagaacguggagguggagaucuggaccaaggagggggagcgcaagaagcugaagccccgguggcuggacgcccgcaucuacuccgacccgcucgcccugaaggaguucaaggaguucgccgcgggccgcaagagccugacccucaaccugaucaccgagaugggccggcugcccacguucaugacccagaaggccaagaacgcccucgacaaccuggccguccugcacaccgcggaggccgggggccgggccuacaaccacgcccucuccgagcugcccgagacccuggagacgcuccugcugcucacccugcuggccaccgugaccgggggcaucuuccucuuccugaugagcggcaaggggaucggcaagaugacccuggggaugugcugcaucaucacggcguccauccuccugugguacgcccagauccagccccacuggaucgccgccagcaucauccuggaguucuuccucaucgugcugcugaucccggagcccgagaagcagcgcacgccccaggacaaccagcucaccuacgucgugaucgccauccugaccguggucgcggccacgauggccaacgagaugggcuuccuggagaagaccaagaaggacuucgggcucggcuccaucaccacccagcagcccgagagcaacauccuggacaucgaccugcggccggccagcgccuggacgcucuacgcgguggccaccaccuucaucacccccaugcugcgccacuccaucgagaacagcuccgugaacgucagccugacggccaucgccaaccaggccaccgugcucaugggccuggggaagggcuggccccuguccaagauggacaucggggugccccuccuggcgaucggcugcuacagccaggucaacccgaucacccugaccgccgcccuccugcugcucguggcccacuacgcgaucaucgggcccggccugcaggccaaggccacgcgggaggcccagaagcgcgccgcggccggcaucaugaagaaccccaccguggacgggaugaccgucaucgaccuggaccccaucccguacgaccccaaguucgagaagcagcucggccaggugaugcugcuggugcucugcgucacccaggugcugaugaugcggacgaccugggcccugugcgaggcccucacccuggccaccgggcccaucuccacgcugugggagggcaaccccgggcgcuucuggaacaccaccaucgcggugagcauggccaacaucuuccgcggcuccuaccucgccggcgccgggcugcuguucagcaucaugaagaacaccgccaacacgcggcgcggcaccgggaacaccggcgagacccucggcgagaaguggaagaaccggcugaacgcgcuggggaaguccgaguuccagaucuacaagaaguccggcauccaggaggucgaccgcacgcucgccaaggaggggaucaagcggggcgagaccgaccaccacgccgugucccgcgggagcgccaagcugcggugguucguggagcgcaaccuggucaccccggagggcaaggugguggaccucggcugcgggcggggcgggugguccuacuacugcggcgggcugaagaacgucaaggaggugaagggccugaccaagggcgggcccggccacgaggagcccauccccaugagcacguacggguggaaccucgugcgccugcaguccggcgucgacguguucuucaccccgcccgagaagugcgacacccugcucugcgacaucggggagagcucccccaaccccaccguggaggcgggccggacccugcgcguccugaaccucguggagaacuggcugaacaacaacacgcaguucugcaucaaggugcugaacccguacaugcccagcgucaucgagaagauggaggcccugcagcggaaguacggcggggcccucgugcgcaacccccugagccggaacuccacccacgagauguacugggugagcaacgccuccggcaacaucgucagcuccgugaacaugaucagccgcaugcugaucaaccgguucaccaugcgccacaagaaggccaccuacgagccggacguggaccucggguccggcacgcggaacaucgggaucgagagcgagacccccaaccuggacaucaucggcaagcgcaucgagaagaucaagcaggagcacgagaccuccuggcacuacgaccaggaccaccccuacaagaccugggcguaccacggcagcuacgagacgaagcagaccggguccgccagcuccauggucaacggcguggugcgccugcucaccaagcccugggacgucaucccgauggugacccagauggccaugacggacaccacccccuucgggcagcagcgggucuucaaggagaagguggacacccgcacgcaggagcccaaggagggcaccaagaagcugaugaagaucaccgccgaguggcuguggaaggagcucggcaagaagaagacgccccggaugugcacgcgcgaggaguucacccggaaggugcgcagcaacgccgcgcugggggccaucuucaccgacgagaacaaguggaaguccgcccgggaggccgucgaggacagcggcuucugggagcugguggacaaggagcgcaaccuccaccuggaggggaagugcgagaccugcguguacaacaugaugggcaagcgggagaagaagcugggggaguucggcaaggccaagggcucccgcgcgaucugguacauguggcucggggcccgguuccuggaguucgaggcccugggcuuccucaacgaggaccacugguucagccgcgagaacucccugagcggggucgagggcgaggggcugcacaagcucggcuacauccugcgggacgugagcaagaaggagggcggggccauguacgcggacgacacggccggcugggacacccgcaucacccuggaggaccucaagaacgaggagauggugaccaaccacauggagggggagcacaagaagcuggccgaggccaucuucaagcugacguaccagaacaaggucgugcgggugcagcgcccgacgccccggggcaccgucauggacaucaucucccgccgggaccagcgcgggagcggccagguggugaccuacggccucaacaccuucaccaacauggaggcccagcugauccggcagauggagggggagggcgucuucaaguccauccagcagcugaccgugaaggaggagaucgcggugaagaacuggcucauccgcgucgggcgcgagcggcugagccgcauggccaucuccggcgacgacugcguggugaagccccuggacgaccgguucgccagcgcccucaccgcccugaacgacaugggcaagguccgcaaggacauccagcagugggagcccucccggggguggaacgacuggacccaggugccguucugcagccaccacuuccacgagcugaucaugaaggacggccgcgugcucgucgugcccugccggaaccaggacgagcugaucgggcgcgcgcggaucucccagggcgccggguggagccugcgcgagaccgccugccucggcaaguccuacgcccagauguggagccugauguacuuccaccggcgcgaccugcggcucgccgcgaacgccaucugcuccgccgugcccagccacuggauccccaccucccgcaccaccuggagcauccacgccacgcacgaguggaugaccaccgaggacaugcugaccgucuggaaccggguguggauccaggagaacccguggauggaggacaagacgcccguggaguccugggaggagauccccuaccugggcaagcgcgaggaccaguggugcgggagccucaucggccugaccagccgggccaccugggcgaagaacauccagaccgccaucaaccagguccgcucccugaucgggaacgaggaguacacggacuacaugcccagcaugaagcgguuccgccgcgaggaggaggaggccggcgugcucugguga

SEQ ID NO: 9087 - RNA, 9876 nt, Artificial Sequence
  derived and/or modified CDS sequence (opt1) from DENV-2__KM279558__SS-prME
accgcgggcaucaucaucaugaugauccccaccgugauggccuuccaccugaccacccggaacggggagccccacaugaucgucagccggcaggagaagggcaagagccuccuguucaagaccgagaacggggugaacaugugcacccugauggcgauggaccucggcgagcugugcgaggacaccaucaccuacaacugcccccugcuccgccagaacgagcccgaggacaucgacugcuggugcaacagcaccuccaccugggugaccuacgggaccugcaccgccaccggcgagcaccggcgcgagaagcggagcgucgcccuggugccccacgugggcauggggcuggagacccgcaccgagaccuggauguccagcgagggcgccuggaagcacgcccagcggaucgagaccuggauccuccgccaccccggguucacgaucauggcggccauccuggccuacaccaucggcaccaccuacuuccagcggguccugaucuucauccuccugacggccgugacccccuccauggcgaugcgcugcaucgggaucagcaaccgggacuucguggagggcgucuccggcgggagcuggguggacaucgugcuggagcacggcuccugcgucaccaccauggccaagaacaagcccacgcucgacuucgagcugaucaagaccgaggccaagcaccuggccacccuccgcaaguacugcguggaggccaagcugaccaacacgaccaccgcgagccggugccccacccagggggagcccucccugaacgaggagcaggacaagcgcuucgugugcaagcacagcauggucgaccggggcuggggcaacgggugcggccucuucgggaagggcgggaucgugacgugcgccauguucacgugcaagaagaacauggagggcaaggugguccagcccgagaaccuggaguacaccaucgugaucacgccccacuccggcgaggagaacgccguggggaacgacacgggcaagcacgggaaggagaucaagaucacgccccagagcuccaucaccgaggccgagcugaccggcuacgggaccgucacgauggagugcagcccgcgcaccggccucgacuucaacgagauggugcugcugcagauggagaacaaggccuggcucgugcaccggcagugguuccuggaccugccccuccccuggcugcccggcgcggacacccagggguccaacuggauccagaaggagacccuggucacguucaagaacccgcacgccaagaagcaggacguggucgugcucggcagccaggagggggccaugcacaccgcccugaccggcgccaccgagauccagaugagcuccgggaaccuccuguucacgggccaccugaagugccgccugcggauggacaagcuccagcugaagggcaugagcuacuccaugugcaccgggaaguucaagguggucaaggagaucgcggagacccagcacggcaccaucgugauccgcgugcaguacgagggggacggcagccccugcaagauccccuucgagaucauggaccuggagaagcggcacguccucggccgccugaucacggugaaccccaucgugaccgagaaggacuccccggucaacaucgaggccgagccgcccuucggggacagcuacaucaucaucggcguggagcccgggcagcugaagcucuccugguucaagaagggcagcuccaucgggcagauguucgagaccaccaugcgcggcgccaagcggauggccauccugggcgacacggccugggacuucgggagccugggcgggguguucaccuccaucggcaaggcgcuccaccaggucuucggggccaucuacggcgccgccuucagcggcguguccuggaccaugaagauccugaucgggguggucaucaccuggaucggcaugaacagccgcuccacgagccuguccgugagccuggugcucgucgggguggugacccuguaccugggcgucauggugcaggcggacuccgggugcguggucagcuggaagaacaaggagcucaagugcggcagcggcaucuucaucaccgacaacgugcacaccuggacggagcaguacaaguuccagccggagucccccagcaagcuggccuccgccauccagaaggcccacgaggaggggaucugcggcauccggagcgugacccgccuggagaaccucauguggaagcagaucacccccgagcugaaccacauccugaccgagaacgaggucaagcucacgaucaugaccggggacaucaagggcaucaugcaggccgggaagcggucccugcgcccccagccgaccgagcugaaguacagcuggaaggcguggggcaaggccaagaugcucuccaccgagcugcacaaccacacguuccugaucgacggccccgagaccgccgagugccccaacaccaaccgggccuggaacagccucgagguggaggacuacggguucggcguguucaccacgaacaucuggcugaagcugaaggagcgccaggacgucuucugcgacuccaagcucaugagcgccgcgaucaaggacaaccgggccgugcacgccgacaugggguacuggaucgaguccgcccugaacgacaccuggaagaucgagaaggccagcuucaucgaggugaaguccugccacuggcccaagagccacacccugugguccaacggcguccucgagagcgagaugaucauccccaagaacuucgcgggccccgugucccagcacaacuaccgccccggguaccacacccagaccgccggcccguggcaccuggggcggcuggagauggacuucgacuucugcgagggcacgaccguggucgugaccgaggacugcgggaaccgcggccccagccuccggaccacgaccgccagcggcaagcugaucaccgaguggugcugccgcuccugcacccugccgccccuccgguaccgcggggaggacggcugcugguacgggauggagauccggccgcugaaggagaaggaggagaaccuggugaacagccucgucacggccggccacgggcagaucgacaacuucucccugggcgugcugggcauggcccucuuccuggaggagaugcugcgcacccggguggggaccaagcacgccauccuccuggucgccgugagcuucgugacccugaucacgggcaacauguccuuccgcgaccucgggcgcgucauggugauggugggcgccaccaugaccgacgacaucgggaugggcgucaccuaccuggcccugcucgcggccuucaaggugcggcccacguucgccgccggccugcugcuccgcaagcugaccagcaaggagcugaugaugaccaccaucgggaucgugcuccugucccagagcacgauccccgaguccauccuggagcucaccgacgcccuggcgcugggcaugaugguccucaagaucgugcggaacauggagaaguaccagcuggccgucaccaucauggccaucagcugcgugcccaacgccgugauccugcagaacgccuggaaggucuccugcaccacgcucgcgguggugagcgucuccccgcugcugcucaccagcucccagcagaaggccgacuggaucccccuggcccugaccaucaaggggcucaaccccaccgccaucuuccugacgacccugagccgcaccuccaagaagcggagcuggccccucaacgaggcgaucauggccgugggcaugguguccauccuggccagcagccugcucaagaacgacaucccgaugaccggcccccuggucgccgggggccugcucacggugugcuacgugcugaccgggcgcuccgccgaccuggagcucgagcgggcggccgacguccgcugggaggagcaggccgagaucagcggcuccagccccauccuguccaucaccaucagcgaggacggguccaugagcaucaagaacgaggaggaggagcagacccugacgauccucauccggaccggccugcuggugaucuccggccucuuccccgugagcaucccgaucaccgccgccgcgugguaccugugggaggucaagaagcagcgcgccggggugcugugggacgugcccagcccgccgcccgucggcaaggccgagcucgaggacggggccuaccggaucaagcagaagggcauccugggguacagccagaucggcgccggcguguacaaggaggggaccuuccacaccauguggcacgugacgcgcggcgcgguccugaugcacaaggggaagcggaucgagcccuccugggccgacgugaagaaggaccucaucagcuacggcgggggcuggaagcuggagggcgaguggaaggagggggaggaggugcagguccuggcccucgagcccggcaagaacccgcgcgccgugcagaccaagcccgggcuguucaagaccaacaccggcacgaucggggccgugucccuggacuucagccccggcaccuccggcagccccaucgucgacaagaaggggaagguggugggccucuacgggaacggcgucgugacccgguccggcaccuacgugagcgcgaucgcccagacggagaaguccaucgaggacaacccggagaucgaggacgacaucuuccgcaagaagcggcugaccaucauggaccugcaccccggggccggcaagaccaagcgcuaccugcccgccaucguccgggaggcgaucaagcgcgggcuccggacccugauccuggcccccacgcgcgugguggccgccgagauggaggaggcccuccgcggccugccgauccgguaccagacccccgcgauccgcgccgagcacaccgggcgggagaucgucgaccugaugugccacgccaccuucacgaugcgccuccugagccccauccgggugcccaacuacaaccugaucaucauggacgaggcccacuucaccgacccggccagcaucgcggcccgcggcuacaucuccacccggguggagaugggcgaggccgccgggaucuucaugaccgccacgccgcccggcagccgcgaccccuucccgcaguccaacgcgcccaucauggacgaggagcgggagauccccgagcgcagcuggaacuccgggcacgagugggucaccgacuucaagggcaagaccgugugguucgugcccagcaucaaggccgggaacgacaucgccgccugccuccggaagaacggcaagaaggucauccagcugucccgcaagaccuucgacagcgaguacaucaagacgcggaccaacgacugggacuucguggugaccaccgacaucuccgagaugggcgcgaacuucaaggccgagcgcgucaucgacccgcggcgcugcaugaagcccgugauccugacggacggggaggagcgggugauccucgccggccccaugcccgucacccacagcuccgccgcccagcgccgggggcgcgugggccgcaacccgaagaacgagaacgaccaguacaucuacaugggggagccccuggagaacgacgaggacugcgcgcacuggaaggaggccaagaugcugcucgacaacaucaacacccccgagggcaucauccccagcauguucgagccggagcgggagaagguggacgccaucgacggcgaguaccgccugcgcggggaggcccgcaagaccuucgucgaccugaugcggcgcggcgaccuccccguguggcuggccuaccgggucgcggccgaggggaucaacuacgccgaccgccgguggugcuucgacggcgugaagaacaaccagauccuggaggagaacguggaggucgagaucuggacgaaggagggggagcgcaagaagcucaagccccgguggcuggacgcccgcaucuacuccgacccgcuggcccucaaggaguucaaggaguucgcggccggccggaagucccugacccugaaccucaucaccgagaugggccgccugcccaccuucaugacgcagaaggccaagaacgcccuggacaaccucgcggugcugcacaccgccgaggccgggggccgggccuacaaccacgcccuguccgagcuccccgagacccuggagacccugcuccugcugacgcuccuggcgaccgugaccgggggcaucuuccuguuccucaugagcggcaaggggaucggcaagaugacccuggggaugugcugcaucaucaccgccuccauccugcucugguacgcccagauccagccccacuggaucgccgccagcaucauccuggaguucuuccugaucguccuccugaucccggagcccgagaagcagcgcacgccccaggacaaccagcugaccuacguggugaucgcgauccucaccgucguggccgccaccauggccaacgagaugggcuuccuggagaagacgaagaaggacuucgggcugggcagcaucaccacccagcagcccgaguccaacauccucgacaucgaccugcggccggccagcgcguggacccuguacgccguggccacgaccuucaucacccccaugcuccgccacuccaucgagaacagcuccgucaacgugagccugaccgccaucgccaaccaggcgacggugcugaugggccucgggaagggcuggccccuguccaagauggacaucggggucccccugcucgccaucggcugcuacagccaggugaacccgaucacccugaccgccgcccugcuccugcugguggcgcacuacgccaucaucgggcccggccuccaggccaaggccacccgggaggcccagaagcgcgcggccgccggcaucaugaagaaccccacggucgacgggaugaccgugaucgaccuggaccccaucccguacgaccccaaguucgagaagcagcugggccaggugaugcuccugguccugugcgugacccaggugcucaugaugcggaccacgugggcccugugcgaggcccugacccucgcgaccgggcccaucuccacccugugggagggcaaccccgggcgcuucuggaacacgaccaucgccgucagcauggccaacaucuuccgcggcuccuaccuggccggcgccgggcuccuguucagcaucaugaagaacaccgcgaacacccggcgcggcacggggaacaccggcgagacccugggcgagaaguggaagaaccggcucaacgcccuggggaaguccgaguuccagaucuacaagaaguccggcauccaggagguggaccgcacccuggccaaggaggggaucaagcggggcgagacggaccaccacgccgugucccgcgggagcgcgaagcuccggugguucgucgagcgcaaccuggugaccccggagggcaagguggucgaccugggcugcgggcggggcgggugguccuacuacugcggcgggcucaagaacgugaaggaggugaagggccugaccaagggcgggcccggccacgaggagcccauccccaugagcaccuacggguggaaccugguccgccuccaguccggcguggacguguucuucacgccgcccgagaagugcgacacccugcugugcgacaucggggagagcagccccaaccccaccgucgaggccggccggacccuccgcgugcugaaccugguggagaacuggcucaacaacaacacccaguucugcaucaagguccugaacccguacaugcccuccgugaucgagaagauggaggcccugcagcggaaguacggcggggcccuggugcgcaacccccucagccggaacuccacgcacgagauguacugggucagcaacgccuccggcaacaucgugagcuccgugaacaugaucagccgcaugcugaucaaccgguucaccaugcgccacaagaaggcgaccuacgagccggacgucgaccugggguccggcacccggaacaucgggaucgagagcgagacgcccaaccucgacaucaucggcaagcgcaucgagaagaucaagcaggagcacgagaccuccuggcacuacgaccaggaccaccccuacaagaccugggccuaccacggcagcuacgagaccaagcagacgggguccgccagcuccauggugaacggcgugguccgccugcugaccaagcccugggacgugaucccgauggugacccagauggccaugaccgacacgacccccuucgggcagcagcgggucuucaaggagaagguggacacccgcacccaggagcccaaggagggcacgaagaagcucaugaagaucaccgccgaguggcuguggaaggagcugggcaagaagaagacgccccggaugugcacccgcgaggaguucacgcggaagguccgcagcaacgcggcccucggggccaucuucaccgacgagaacaaguggaaguccgcccgggaggccguggaggacagcggcuucugggagcugguggacaaggagcgcaaccugcaccucgaggggaagugcgagaccugcgucuacaacaugaugggcaagcgggagaagaagcugggggaguucggcaaggcgaagggcucccgcgccaucugguacauguggcugggggcccgguuccucgaguucgaggcccugggcuuccugaacgaggaccacugguucagccgcgagaacagccucuccgggguggagggcgaggggcugcacaagcugggcuacauccuccgggacgugagcaagaaggagggcggggcgauguacgccgacgacaccgccggcugggacacgcgcaucacccuggaggaccugaagaacgaggagauggucaccaaccacauggagggggagcacaagaagcucgccgaggccaucuucaagcugaccuaccagaacaagguggugcggguccagcgcccgacgccccggggcaccgugauggacaucaucucccgccgggaccagcgcgggagcggccagguggucaccuacggccugaacaccuucacgaacauggaggcgcagcucauccggcagauggagggggagggcguguucaaguccauccagcagcugaccgugaaggaggagaucgccgucaagaacuggcugauccgcguggggcgcgagcggcucagccgcauggccaucuccggcgacgacugcguggucaagccccuggacgaccgguucgccagcgcccugaccgcgcucaacgacaugggcaaggugcgcaaggacauccagcagugggagcccucccggggguggaacgacuggacccaggugccguucugcagccaccacuuccacgagcugaucaugaaggacggccgcguccugguggugcccugccggaaccaggacgagcucaucgggcgcgcccggaucucccagggcgccggguggagccugcgcgagacggccugccugggcaaguccuacgcccagauguggagccucauguacuuccaccggcgcgaccugcggcuggcggccaacgccaucugcuccgccguccccagccacuggauccccaccucccgcaccaccuggagcauccacgccacccacgaguggaugacgaccgaggacaugcucaccguguggaaccggguguggauccaggagaacccguggauggaggacaagacccccgucgagagcugggaggagauccccuaccugggcaagcgcgaggaccaguggugcgggucccugaucggccucacgagccgggcgaccugggccaagaacauccagaccgccaucaaccaggugcgcucccugaucgggaacgaggaguacaccgacuacaugcccagcaugaagcgguuccgccgcgaggaggaggaggccggcgugcugugguga

SEQ ID NO: 9088 - RNA, 9876 nt, Artificial Sequence
  derived and/or modified CDS sequence (opt1) from DENV-2__KM279564__SS-prME
accgcgggcaucaucaucaugaugauccccaccgugauggccuuccaccugaccacccggaacggggagccccacaugaucgucagccggcaggagaagggcaagagccuccuguucaagaccgagaacggggugaacaugugcacccugauggcgauggaccucggcgagcugugcgaggacaccaucaccuacaacugcccccugcuccgccagaacgagcccgaggacaucgacugcuggugcaacagcaccuccaccugggugaccuacgggaccugcaccgccaccggcgagcaccggcgcgagaagcggagcgucgcccuggugccccacgugggcauggggcuggagacccgcaccgagaccuggauguccagcgagggcgccuggaagcacgcccagcggaucgagaccuggauccuccgccaccccggguucacgaucauggcggccauccuggccuacaccaucggcaccaccuacuuccagcggguccugaucuucauccuccugacggccgugacccccuccauggcgaugcgcugcaucgggaucagcaaccgggacuucguggagggcgucuccggcgggagcuggguggacaucgugcuggagcacggcuccugcgucaccaccauggccaagaacaagcccacgcucgacuucgagcugaucaagaccgaggccaagcaccuggccacccuccgcaaguacugcguggaggccaagcugaccaacacgaccaccgcgagccggugccccacccagggggagcccucccugaacgaggagcaggacaagcgcuucgugugcaagcacagcauggucgaccggggcuggggcaacgggugcggccucuucgggaagggcgggaucgugacgugcgccauguucacgugcaagaagaacauggagggcaaggugguccagcccgagaaccuggaguacaccaucgugaucacgccccacuccggcgaggagaacgccguggggaacgacacgggcaagcacgggaaggagaucaagaucacgccccagagcuccaucaccgaggccgagcugaccggcuacgggaccgucacgauggagugcagcccgcgcaccggccucgacuucaacgagauggugcugcugcagauggagaacaaggccuggcucgugcaccggcagugguuccuggaccugccccuccccuggcugcccggcgcggacacccagggguccaacuggauccagaaggagacccuggucacguucaagaacccgcacgccaagaagcaggacguggucgugcucggcagccaggagggggccaugcacaccgcccugaccggcgccaccgagauccagaugagcuccgggaaccuccuguucacgggccaccugaagugccgccugcggauggacaagcuccagcugaagggcaugagcuacuccaugugcaccgggaaguucaagguggucaaggagaucgcggagacccagcacggcaccaucgugauccgcgugcaguacgagggggacggcagccccugcaagauccccuucgagaucauggaccuggagaagcggcacguccucggccgccugaucacggugaaccccaucgugaccgagaaggacuccccggucaacaucgaggccgagccgcccuucggggacagcuacaucaucaucggcguggagcccgggcagcugaagcucuccugguucaagaagggcagcuccaucgggcagauguucgagaccaccaugcgcggcgccaagcggauggccauccugggcgacacggccugggacuucgggagccugggcgggguguucaccuccaucggcaaggcgcuccaccaggucuucggggccaucuacggcgccgccuucagcggcguguccuggaccaugaagauccugaucgggguggucaucaccuggaucggcaugaacagccgcuccacgagccuguccgugagccuggugcucgucgggguggugacccuguaccugggcgucauggugcaggcggacuccgggugcguggucagcuggaagaacaaggagcucaagugcggcagcggcaucuucaucaccgacaacgugcacaccuggacggagcaguacaaguuccagccggagucccccagcaagcuggccuccgccauccagaaggcccacgaggaggggaucugcggcauccggagcgugacccgccuggagaaccucauguggaagcagaucacccccgagcugaaccacauccugaccgagaacgaggucaagcucacgaucaugaccggggacaucaagggcaucaugcaggccgggaagcggucccugcgcccccagccgaccgagcugaaguacagcuggaaggcguggggcaaggccaagaugcucuccaccgagcugcacaaccacacguuccugaucgacggccccgagaccgccgagugccccaacaccaaccgggccuggaacagccucgagguggaggacuacggguucggcguguucaccacgaacaucuggcugaagcugaaggagcgccaggacgucuucugcgacuccaagcucaugagcgccgcgaucaaggacaaccgggccgugcacgccgacaugggguacuggaucgaguccgcccugaacgacaccuggaagaucgagaaggccagcuucaucgaggugaaguccugccacuggcccaagagccacacccugugguccaacggcguccucgagagcgagaugaucauccccaagaacuucgcgggccccgugucccagcacaacuaccgccccggguaccacacccagaccgccggcccguggcaccuggggcggcuggagauggacuucgacuucugcgagggcacgaccguggucgugaccgaggacugcgggaaccgcggccccagccuccggaccacgaccgccagcggcaagcugaucaccgaguggugcugccgcuccugcacccugccgccccuccgguaccgcggggaggacggcugcugguacgggauggagauccggccgcugaaggagaaggaggagaaccuggugaacagccucgucacggccggccacgggcagaucgacaacuucucccugggcgugcugggcauggcccucuuccuggaggagaugcugcgcacccggguggggaccaagcacgccauccuccuggucgccgugagcuucgugacccugaucacgggcaacauguccuuccgcgaccucgggcgcgucauggugauggugggcgccaccaugaccgacgacaucgggaugggcgucaccuaccuggcccugcucgcggccuucaaggugcggcccacguucgccgccggccugcugcuccgcaagcugaccagcaaggagcugaugaugaccaccaucgggaucgugcuccugucccagagcacgauccccgaguccauccuggagcucaccgacgcccuggcgcugggcaugaugguccucaagaucgugcggaacauggagaaguaccagcuggccgucaccaucauggccaucagcugcgugcccaacgccgugauccugcagaacgccuggaaggucuccugcaccacgcucgcgguggugagcgucuccccgcugcugcucaccagcucccagcagaaggccgacuggaucccccuggcccugaccaucaaggggcucaaccccaccgccaucuuccugacgacccugagccgcaccuccaagaagcggagcuggccccucaacgaggcgaucauggccgugggcaugguguccauccuggccagcagccugcucaagaacgacaucccgaugaccggcccccuggucgccgggggccugcucacggugugcuacgugcugaccgggcgcuccgccgaccuggagcucgagcgggcggccgacguccgcugggaggagcaggccgagaucagcggcuccagccccauccuguccaucaccaucagcgaggacggguccaugagcaucaagaacgaggaggaggagcagacccugacgauccucauccggaccggccugcuggugaucuccggccucuuccccgugagcaucccgaucaccgccgccgcgugguaccugugggaggucaagaagcagcgcgccggggugcugugggacgugcccagcccgccgcccgucggcaaggccgagcucgaggacggggccuaccggaucaagcagaagggcauccugggguacagccagaucggcgccggcguguacaaggaggggaccuuccacaccauguggcacgugacgcgcggcgcgguccugaugcacaaggggaagcggaucgagcccuccugggccgacgugaagaaggaccucaucagcuacggcgggggcuggaagcuggagggcgaguggaaggagggggaggaggugcagguccuggcccucgagcccggcaagaacccgcgcgccgugcagaccaagcccgggcuguucaagaccaacaccggcacgaucggggccgugucccuggacuucagccccggcaccuccggcagccccaucgucgacaagaaggggaagguggugggccucuacgggaacggcgucgugacccgguccggcaccuacgugagcgcgaucgcccagacggagaaguccaucgaggacaacccggagaucgaggacgacaucuuccgcaagaagcggcugaccaucauggaccugcaccccggggccggcaagaccaagcgcuaccugcccgccaucguccgggaggcgaucaagcgcgggcuccggacccugauccuggcccccacgcgcgugguggccgccgagauggaggaggcccuccgcggccugccgauccgguaccagacccccgcgauccgcgccgagcacaccgggcgggagaucgucgaccugaugugccacgccaccuucacgaugcgccuccugagccccauccgggugcccaacuacaaccugaucaucauggacgaggcccacuucaccgacccggccagcaucgcggcccgcggcuacaucuccacccggguggagaugggcgaggccgccgggaucuucaugaccgccacgccgcccggcagccgcgaccccuucccgcaguccaacgcgcccaucauggacgaggagcgggagauccccgagcgcagcuggaacuccgggcacgagugggucaccgacuucaagggcaagaccgugugguucgugcccagcaucaaggccgggaacgacaucgccgccugccuccggaagaacggcaagaaggucauccagcugucccgcaagaccuucgacagcgaguacaucaagacgcggaccaacgacugggacuucguggugaccaccgacaucuccgagaugggcgcgaacuucaaggccgagcgcgucaucgacccgcggcgcugcaugaagcccgugauccugacggacggggaggagcgggugauccucgccggccccaugcccgucacccacagcuccgccgcccagcgccgggggcgcgugggccgcaacccgaagaacgagaacgaccaguacaucuacaugggggagccccuggagaacgacgaggacugcgcgcacuggaaggaggccaagaugcugcucgacaacaucaacacccccgagggcaucauccccagcauguucgagccggagcgggagaagguggacgccaucgacggcgaguaccgccugcgcggggaggcccgcaagaccuucgucgaccugaugcggcgcggcgaccuccccguguggcuggccuaccgggucgcggccgaggggaucaacuacgccgaccgccgguggugcuucgacggcgugaagaacaaccagauccuggaggagaacguggaggucgagaucuggacgaaggagggggagcgcaagaagcucaagccccgguggcuggacgcccgcaucuacuccgacccgcuggcccucaaggaguucaaggaguucgcggccggccggaagucccugacccugaaccucaucaccgagaugggccgccugcccaccuucaugacgcagaaggccaagaacgcccuggacaaccucgcggugcugcacaccgccgaggccgggggccgggccuacaaccacgcccuguccgagcuccccgagacccuggagacccugcuccugcugacgcuccuggcgaccgugaccgggggcaucuuccuguuccucaugagcggcaaggggaucggcaagaugacccuggggaugugcugcaucaucaccgccuccauccugcucugguacgcccagauccagccccacuggaucgccgccagcaucauccuggaguucuuccugaucguccuccugaucccggagcccgagaagcagcgcacgccccaggacaaccagcugaccuacguggugaucgcgauccucaccgucguggccgccaccauggccaacgagaugggcuuccuggagaagacgaagaaggacuucgggcugggcagcaucaccacccagcagcccgaguccaacauccucgacaucgaccugcggccggccagcgcguggacccuguacgccguggccacgaccuucaucacccccaugcuccgccacuccaucgagaacagcuccgucaacgugagccugaccgccaucgccaaccaggcgacggugcugaugggccucgggaagggcuggccccuguccaagauggacaucggggucccccugcucgccaucggcugcuacagccaggugaacccgaucacccugaccgccgcccugcuccugcugguggcgcacuacgccaucaucgggcccggccuccaggccaaggccacccgggaggcccagaagcgcgcggccgccggcaucaugaagaaccccacggucgacgggaugaccgugaucgaccuggaccccaucccguacgaccccaaguucgagaagcagcugggccaggugaugcuccugguccugugcgugacccaggugcucaugaugcggaccacgugggcccugugcgaggcccugacccucgcgaccgggcccaucuccacccugugggagggcaaccccgggcgcuucuggaacacgaccaucgccgucagcauggccaacaucuuccgcggcuccuaccuggccggcgccgggcuccuguucagcaucaugaagaacaccgcgaacacccggcgcggcacggggaacaccggcgagacccugggcgagaaguggaagaaccggcucaacgcccuggggaaguccgaguuccagaucuacaagaaguccggcauccaggagguggaccgcacccuggccaaggaggggaucaagcggggcgagacggaccaccacgccgugucccgcgggagcgcgaagcuccggugguucgucgagcgcaaccuggugaccccggagggcaagguggucgaccugggcugcgggcggggcgggugguccuacuacugcggcgggcucaagaacgugaaggaggugaagggccugaccaagggcgggcccggccacgaggagcccauccccaugagcaccuacggguggaaccugguccgccuccaguccggcguggacguguucuucacgccgcccgagaagugcgacacccugcugugcgacaucggggagagcagccccaaccccaccgucgaggccggccggacccuccgcgugcugaaccugguggagaacuggcucaacaacaacacccaguucugcaucaagguccugaacccguacaugcccuccgugaucgagaagauggaggcccugcagcggaaguacggcggggcccuggugcgcaacccccucagccggaacuccacgcacgagauguacugggucagcaacgccuccggcaacaucgugagcuccgugaacaugaucagccgcaugcugaucaaccgguucaccaugcgccacaagaaggcgaccuacgagccggacgucgaccugggguccggcacccggaacaucgggaucgagagcgagacgcccaaccucgacaucaucggcaagcgcaucgagaagaucaagcaggagcacgagaccuccuggcacuacgaccaggaccaccccuacaagaccugggccuaccacggcagcuacgagaccaagcagacgggguccgccagcuccauggugaacggcgugguccgccugcugaccaagcccugggacgugaucccgauggugacccagauggccaugaccgacacgacccccuucgggcagcagcgggucuucaaggagaagguggacacccgcacccaggagcccaaggagggcacgaagaagcucaugaagaucaccgccgaguggcuguggaaggagcugggcaagaagaagacgccccggaugugcacccgcgaggaguucacgcggaagguccgcagcaacgcggcccucggggccaucuucaccgacgagaacaaguggaaguccgcccgggaggccguggaggacagcggcuucugggagcugguggacaaggagcgcaaccugcaccucgaggggaagugcgagaccugcgucuacaacaugaugggcaagcgggagaagaagcugggggaguucggcaaggcgaagggcucccgcgccaucugguacauguggcugggggcccgguuccucgaguucgaggcccugggcuuccugaacgaggaccacugguucagccgcgagaacagccucuccgggguggagggcgaggggcugcacaagcugggcuacauccuccgggacgugagcaagaaggagggcggggcgauguacgccgacgacaccgccggcugggacacgcgcaucacccuggaggaccugaagaacgaggagauggucaccaaccacauggagggggagcacaagaagcucgccgaggccaucuucaagcugaccuaccagaacaagguggugcggguccagcgcccgacgccccggggcaccgugauggacaucaucucccgccgggaccagcgcgggagcggccagguggucaccuacggccugaacaccuucacgaacauggaggcgcagcucauccggcagauggagggggagggcguguucaaguccauccagcagcugaccgugaaggaggagaucgccgucaagaacuggcugauccgcguggggcgcgagcggcucagccgcauggccaucuccggcgacgacugcguggucaagccccuggacgaccgguucgccagcgcccugaccgcgcucaacgacaugggcaaggugcgcaaggacauccagcagugggagcccucccggggguggaacgacuggacccaggugccguucugcagccaccacuuccacgagcugaucaugaaggacggccgcguccugguggugcccugccggaaccaggacgagcucaucgggcgcgcccggaucucccagggcgccggguggagccugcgcgagacggccugccugggcaaguccuacgcccagauguggagccucauguacuuccaccggcgcgaccugcggcuggcggccaacgccaucugcuccgccguccccagccacuggauccccaccucccgcaccaccuggagcauccacgccacccacgaguggaugacgaccgaggacaugcucaccguguggaaccggguguggauccaggagaacccguggauggaggacaagacccccgucgagagcugggaggagauccccuaccugggcaagcgcgaggaccaguggugcgggucccugaucggccucacgagccgggcgaccugggccaagaacauccagaccgccaucaaccaggugcgcucccugaucgggaacgaggaguacaccgacuacaugcccagcaugaagcgguuccgcaucgaggaggaggaggccggcgugcugugguga

SEQ ID NO: 9089 - RNA, 9876 nt, Artificial Sequence
  derived and/or modified CDS sequence (opt1) from DENV-2__KM279595__SS-prME
accgcgggcaucaucaucaugaugauccccaccgugauggccuuccaccugaccacccgcaacggggagccccacaugaucgucagccggcaggagaagggcaagucccuccuguucaagaccgagaacggggugaacaugugcacccugauggcgauggaccucggcgagcugugcgaggacaccaucaccuacaacugcccccugcuccgccagaacgagcccgaggacaucgacugcuggugcaacagcaccuccaccugggugaccuacgggaccugcaccgccaccggcgagcaccggcgcgagaagcggagcgucgcccuggugccccacgugggcauggggcuggagacccgcaccgagaccuggauguccagcgagggcgccuggaagcacgcccagcggaucgagaccuggauccuccgccaccccggguucaccaucauggcggccauccuggccuacaccaucggcaccaccuacuuccagcggguccugaucuucauccuccugaccgccgugacccccuccauggcgaugcgcugcaucgggaucagcaaccgggacuucguggagggcgucuccggcgggagcuggguggacaucgugcuggagcacggcuccugcgucaccaccauggccaagaacaagcccacgcucgacuucgagcugaucaagaccgaggccaagcaccuggccacccuccgcaaguacugcguggaggccaagcugaccaacacgaccaccgcgagccggugccccacccagggggagcccucccugaacgaggagcaggacaagcgcuucgugugcaagcacagcauggucgaccggggcuggggcaacgggugcggccucuucgggaagggcgggaucgugacgugcgccauguucacgugcaagaagaacauggagggcaaggugguccagcccgagaaccuggaguacaccaucgugaucacgccccacuccggcgaggagaacgccguggggaacgacacgggcaagcacgggaaggagaucaaggucacgccccagagcuccaucaccgaggccgagcugaccggcuacgggaccgugacgauggagugcagcccgcgcaccggccucgacuucaacgagauggugcugcugcagauggagaacaaggccuggcucguccaccggcagugguuccuggaccugccccuccccuggcugcccggcgcggacacccagggguccaacuggauccagaaggagacccuggugacguucaagaacccgcacgccaagaagcaggacgucguggugcucggcagccaggagggggccaugcacaccgcccugaccggcgccaccgagauccagaugagcuccgggaaccuccuguucacgggccaccugaagugccgccugcggauggacaagcuccagcugaagggcaugagcuacuccaugugcaccgggaaguucaaggucgugaaggagaucgcggagacccagcacggcaccaucgugauccgcguccaguacgagggggacggcagccccugcaagauccccuucgagaucauggaccuggagaagcggcacgugcucggccgccugaucacggugaaccccaucgucaccgagaaggacuccccggugaacaucgaggccgagccgcccuucggggacagcuacaucaucaucggcguggagcccgggcagcugaagcucuccugguucaagaagggcagcuccaucgggcagauguucgagaccaccaugcgcggcgccaagcggauggccauccugggcgacacggccugggacuucgggagccugggcggggucuucaccuccaucggcaaggcgcuccaccagguguucggggccaucuacggcgccgccuucagcggcguguccuggaccaugaagauccugaucggggucgugaucaccuggaucggcaugaacagccgcuccacgagccuguccgugagccugguccucguggggguggucacccuguaccugggcgugauggugcaggcggacuccgggugcgucgugagcuggaagaacaaggagcucaagugcggcagcggcaucuucaucaccgacaacgugcacaccuggacggagcaguacaaguuccagccggagucccccagcaagcuggccuccgccauccagaaggcccacgaggaggggaucugcggcauccggagcgucacccgccuggagaaccucauguggaagcagaucacccccgagcugaaccacauccugaccgagaacgaggugaagcucacgaucaugaccggggacaucaagggcaucaugcaggccgggaagcggacccugcgcccccagccgaccgagcugaaguacuccuggaaggcguggggcaaggccaagaugcucagcacggagcugcacaaccacaccuuccugaucgacggccccgagaccgccgagugccccaacaccaaccgggccuggaacucccucgagguggaggacuacggguucggcgucuucacgaccaacaucuggcugaagcugaaggagcgccaggacguguucugcgacagcaagcucauguccgccgcgaucaaggacaaccgggccgugcacgccgacaugggguacuggaucgagagcgcccugaacgacaccuggaagaucgagaaggccuccuucaucgaggucaagagcugccacuggccgaagucccacacccuguggagcaacggcgugcucgaguccgagaugaucauccccaagaacuucgcgggccccgugagccagcacaacuaccgccccggguaccacacccagacggccggcccguggcaccuggggcggcuggagauggacuucgacuucugcgagggcaccaccgucguggugaccgaggacugcgggaaccgcggccccucccuccggacgaccaccgccagcggcaagcugaucaccgaguggugcugccgcagcugcacgcugccgccccuccgguaccgcggggaggacggcugcugguacgggauggagauccggccgcugaaggagaaggaggagaaccuggucaacucccucgugaccgccggccacgggcagaucgacaacuucagccugggcgugcugggcauggcccucuuccuggaggagaugcugcgcacccgggucgggaccaagcacgccauccuccugguggccguguccuucgucacgcugaucaccggcaacaugagcuuccgcgaccucgggcgcgugauggugauggucggcgccaccaugaccgacgacaucgggaugggcgugacguaccuggcccugcucgcggccuucaaggugcggcccaccuucgccgccggccugcugcuccgcaagcugaccuccaaggagcugaugaugaccacgaucgggaucguccuccugagccaguccaccauccccgagagcauccuggagcucaccgacgcccuggcgcugggcaugauggugcucaagaucguccggaacauggagaaguaccagcuggccgugaccaucauggccauccugugcgugcccaacgccgucauccuccagaacgccuggaagguguccugcacgacccuggcgguggucagcguguccccgcugcuccugaccagcucccagcagaaggccgacuggaucccccuggcccucaccaucaaggggcugaaccccacggccaucuuccugaccacccucagccgcaccuccaagaagcggagcuggccccugaacgaggcgaucauggccgugggcauggucuccauccuggccagcucccuccugaagaacgacaucccgaugacgggcccccugguggccgggggccuccugaccgugugcuacguccugaccgggcgcagcgccgaccucgagcuggagcgggcggccgacgugcgcugggaggagcaggccgagaucagcggcuccagccccauccuguccaucaccaucagcgaggacggguccaugagcaucaagaacgaggaggaggagcagacgcucaccauccugauccggaccggccugcucgugaucuccggccuguuccccgucagcaucccgaucaccgccgccgcgugguaccugugggaggugaagaagcagcgcgccggggugcucugggacguccccagcccgccgcccgugggcaaggccgagcuggaggacggggccuaccggaucaagcagaagggcauccugggguacagccagaucggcgccggcguguacaaggaggggaccuuccacacgauguggcacgucacccgcggcgcggugcucaugcacaaggggaagcggaucgagcccuccugggccgacgugaagaaggaccugaucagcuacggcgggggcuggaagcuggagggcgaguggaaggagggggaggagguccaggugcucgcccuggagcccggcaagaacccccgcgccgugcagaccaagcccgggcuguucaagaccaacacgggcaccaucggggccgucucccucgacuucagccccggcaccuccggcagccccaucguggacaagaaggggaagguggucggccuguacgggaacggcguggugacccgguccggcacguacgucagcgcgaucgcccagaccgagaagaacaucgaggacaacccggagaucgaggacgacaucuuccgcaagaagcggcugaccaucauggaccugcaccccggggccggcaagaccaagcgcuaccuccccgccaucgugcgggaggcgaucaagcgcgggcugcggacgcugauccucgcccccacccgcguggucgccgccgagauggaggaggcccugcgcggccugccgauccgguaccagacccccgcgauccgcgccgagcacaccgggcgggagaucguggaccucaugugccacgccacguucaccaugcgccugcugucccccauccgggugcccaacuacaaccucaucaucauggacgaggcccacuucaccgacccggccagcaucgcggcccgcggcuacaucagcacccgggucgagaugggcgaggccgccgggaucuucaugacggccacgccgcccggcucccgcgaccccuucccgcagagcaacgcgcccaucauggacgaggagaaggagauccccgagcgguccuggaacagcgggcacgagugggugaccgacuucaagggcaagaccgugugguucguccccuccaucaaggccgggaacgacaucgccgccugccugcgcaagaacggcaagaaggugauccagcugagccggaagacguucgacuccgaguacaucaagacccgcaccaacgacugggacuucguggucaccacggacaucagcgagaugggcgcgaacuucaaggccgagcgggugaucgacccgcgccggugcaugaagcccgugauccucaccgacggggaggagcgcgucauccuggccggccccaugcccgugacccacuccagcgccgcccagcggcgcgggcgggugggccgcaacccgaagaacgagaacgaccaguacaucuacaugggggagccccuggagaacgacgaggacugcgcgcacuggaaggaggccaagaugcuccuggacaacaucaacacccccgagggcaucauccccuccauguucgagccggagcgcgagaaggucgacgccaucgacggcgaguaccggcugcgcggggaggcccggaagacguucguggaccucaugcgccggggcgaccugcccgucuggcuggccuaccgcguggcggccgaggggaucaacuacgccgaccggcgcuggugcuucgacggcgugaagaacaaccagauccucgaggagaacgucgagguggagaucuggaccaaggagggggagcggaagaagcugaagccccgcuggcuggacgcccggaucuacagcgacccgcucgcccugaaggaguucaaggaguucgcggccggccgcaagucccugacccucaaccugaucaccgagaugggccggcugcccacguucaugacccagaaggccaagaacgcccucgacaaccuggcggugcugcacaccgccgaggccgggggccgcgccuacaaccacgcccucagcgagcugcccgagacccuggagacgcuccugcugcucacccugcuggcgaccgucaccgggggcaucuuccucuuccugauguccggcaaggggaucggcaagaugacccuggggaugugcugcaucaucacggccagcauccuccugugguacgcccagauccagccccacuggaucgccgccuccaucauccuggaguucuuccucaucgugcugcugaucccggagcccgagaagcagcggacgccccaggacaaccagcucaccuacguggucaucgcgauccugaccgugguggccgccacgauggccaacgagaugggcuuccuggagaagaccaagaaggacuucgggcucggcagcaucaccacccagcagcccgaguccaacauccuggacaucgaccugcgcccggccagcgcguggacgcucuacgccgucgccaccaccuucaucacccccaugcugcggcacagcaucgagaacuccagcgugaacgugucccugacggccaucgccaaccaggcgaccguccucaugggccuggggaagggcuggccccugagcaagauggacaucggggugccccuccuggccaucggcugcuacucccaggugaacccgaucacccugaccgccgcccuccugcugcucgucgcgcacuacgccaucaucgggcccggccugcaggccaaggccacgcgcgaggcccagaagcgggcggccgccggcaucaugaagaaccccaccguggacgggaugaccgugaucgaccuggaccccaucccguacgaccccaaguucgagaagcagcucggccaggucaugcugcuggugcucugcgugacccagguccugaugaugcgcacgaccugggcccugugcgaggcccucacccuggcgaccgggcccaucagcacgcugugggagggcaaccccgggcgguucuggaacaccaccaucgccguguccauggccaacaucuuccgcggcagcuaccucgccggcgccgggcugcuguucuccaucaugaagaacaccgcgaacacgcgccggggcaccgggaacaccggcgagacccucggcgagaaguggaagaaccgccugaacgcccugggcaagagcgaguuccagaucuacaagaaguccgggauccaggagguggaccggacgcucgccaaggaggggaucaagcgcggcgagaccgaccaccacgccgucagccggggguccgcgaagcugcgcugguucguggagcggaaccuggugaccccggagggcaaggucguggaccucggcugcgggcgcggcggguggagcuacuacugcggcgggcugaagaacgugaaggaggucaagggccugaccaagggcgggcccggccacgaggagcccauccccauguccacguacggguggaaccucgugcggcugcagagcggcguggacgucuucuucaccccgcccgagaagugcgacacccugcucugcgacaucggggaguccagccccaaccccaccguggaggccggccgcacccugcgggugcugaaccucgucgagaacuggcugaacaacaacacgcaguucugcaucaaggugcugaacccguacaugcccuccgugaucgagaagauggaggcccugcagcgcaaguacggcggggcccucguccggaacccccugagccgcaacagcacccacgagauguacuggguguccaacgccagcggcaacaucguguccagcgucaacaugaucucccggaugcugaucaaccgcuucaccaugcggcacaagaaggcgaccuacgagccggacguggaccucgggagcggcacgcgcaacaucgggaucgaguccgagacccccaaccuggacaucaucggcaagcggaucgagaagaucaagcaggagcacgagaccagcuggcacuacgaccaggaccaccccuacaagaccugggccuaccacggcuccuacgagacgaagcagaccgggagcgccuccagcauggugaacggcgucgugcgccugcucaccaagcccugggacgugaucccgauggucacccagauggccaugacggacaccacccccuucgggcagcagcgcguguucaaggagaaggucgacacccggacgcaggagcccaaggagggcaccaagaagcugaugaagaucaccgccgaguggcuguggaaggagcucggcaagaagaagacgccccgcaugugcacgcgggaggaguucacccgcaaggugcgguccaacgcggcccugggggccaucuucaccgacgagaacaaguggaaguccgcccgcgaggccguggaggacuccggcuucugggagcuggucgacaaggagcggaaccuccaccuggaggggaagugcgagaccugcguguacaacaugaugggcaagcgcgagaagaagcugggggaguucggcaaggcgaagggcagccgggccaucugguacauguggcucggggcccgcuuccuggaguucgaggcccugggcuuccucaacgaggaccacugguucucccgggagaacagccuguccgggguggagggcgaggggcugcacaagcucggcuacauccugcgcgacgucagcaagaaggagggcggggcgauguacgccgacgacacggccggcugggacacccggaucacccuggaggaccucaagaacgaggagauggugaccaaccacauggagggggagcacaagaagcuggccgaggccaucuucaagcugacguaccagaacaaggugguccgcgugcagcggccgacgccccgcggcaccgugauggacaucaucagccggcgcgaccagcggggguccggccaggucgugaccuacggccucaacaccuucaccaacauggaggcgcagcugauccgccagauggagggggagggcguguucaagagcauccagcagcugaccgucaaggaggagaucgccgugaaggacuggcucauccggguggggcgcgagcgccugucccggauggccaucagcggcgacgacugcgucgugaagccccuggacgaccgcuucgccuccgcccucaccgcgcugaacgacaugggcaaggugcggaaggacauccagcagugggagcccagccgcggguggaacgacuggacgcaggucccguucugcucccaccacuuccacgagcugaucaugaaggacggccgggugcucgugguccccugccgcaaccaggacgagcugaucgggcgggcccgcaucagccagggcgccggguggucccugcgggagaccgccugccucggcaagagcuacgcccagauguggucccugauguacuuccaccgccgggaccugcgccucgcggccaacgccaucugcagcgccgugcccucccacuggauccccaccagccggaccaccugguccauccacgccacgcacgaguggaugaccaccgaggacaugcugaccguguggaaccgcgucuggauccaggagaacccguggauggaggacaagacgcccguggagagcugggaggagauccccuaccugggcaagcgggaggaccaguggugcgggucccucaucggccugaccagccgcgcgaccugggccaagaacauccagaccgccaucaaccaggugcggagccugaucgggaacgaggaguacacggacuacaugcccuccaugaagcgcuuccggcgcgaggaggaggaggccggcguccucugguga

SEQ ID NO: 9090 - RNA, 9876 nt, Artificial Sequence
  derived and/or modified CDS sequence (opt1) from DENV-2__KM279566__SS-prME
accgcgggcaucaucaucaugaugauccccaccgugauggccuuccaccugaccacccgcaacggggagccccacaugaucgucucccggcaggagaagggcaagucccuccuguucaagaccgagaacggggugaacaugugcacccugauggcgauggaccucggcgagcugugcgaggacaccaucaccuacaacugcccccugcuccgccagaacgagcccgaggacaucgacugcuggugcaacagcaccuccaccugggugaccuacgggaccugcaccgccaccggcgagcaccggcgcgagaagcggagcgucgcccuggugccccacgugggcauggggcuggagacccgcaccgagaccuggauguccagcgagggcgccuggaagcacgcccagcggaucgagaccuggauccuccgccaccccggguucaccaucauggcggccauccuggccuacaccaucggcaccaccuacuuccagcggguccugaucuucauccuccugaccgccgugacccccuccauggcgaugcgcugcaucgggaucagcaaccgggacuucguggagggcgucuccggcgggagcuggguggacaucgugcuggagcacggcuccugcgucaccaccauggccaagaacaagcccacgcucgacuucgagcugaucaagaccgaggccaagcaccuggccacccuccgcaaguacugcguggaggccaagcugaccaacacgaccaccgcgagccggugccccacccagggggagcccucccugaacgaggagcaggacaagcgcuucgugugcaagcacagcauggucgaccggggcuggggcaacgggugcggccucuucgggaagggcgggaucgugacgugcgccauguucacgugcaagaagaacauggagggcaaggugguccagcccgagaaccuggaguacaccaucgugaucacgccccacuccggcgaggagaacgccguggggaacgacacgggcaagcacgggaaggagaucaaggucacgccccagagcuccaucaccgaggccgagcugaccggcuacgggaccgugacgauggagugcagcccgcgcaccggccucgacuucaacgagauggugcugcugcagauggagaacaaggccuggcucguccaccggcagugguuccuggaccugccccuccccuggcugcccggcgcggacacccagggguccaacuggauccagaaggagacccuggugacguucaagaacccgcacgccaagaagcaggacgucguggugcucggcagccaggagggggccaugcacaccgcccugaccggcgccaccgagauccagaugagcuccgggaaccuccuguucacgggccaccugaagugccgccugcggauggacaagcuccagcugaagggcaugagcuacuccaugugcaccgggaaguucaaggucgugaaggagaucgcggagacccagcacggcaccaucgugauccgcguccaguacgagggggacggcagccccugcaagauccccuucgagaucauggaccuggagaagcggcacgugcucggccgccugaucacggugaaccccaucgucaccgagaaggacuccccggugaacaucgaggccgagccgcccuucggggacagcuacaucaucaucggcguggagcccgggcagcugaagcucuccugguucaagaagggcagcuccaucgggcagauguucgagaccaccaugcgcggcgccaagcggauggccauccugggcgacacggccugggacuucgggagccugggcggggucuucaccuccaucggcaaggcgcuccaccagguguucggggccaucuacggcgccgccuucagcggcguguccuggaccaugaagauccugaucggggucgugaucaccuggaucggcaugaacagccgcuccacgagccuguccgugagccugguccucguggggguggucacccuguaccugggcgugauggugcaggcggacuccgggugcgucgugagcuggaagaacaaggagcucaagugcggcagcggcaucuucaucaccgacaacgugcacaccuggacggagcaguacaaguuccagccggagucccccagcaagcuggccuccgccauccagaaggcccacgaggaggggaucugcggcauccggagcgucacccgccuggagaaccucauguggaagcagaucacccccgagcugaaccacauccugaccgagaacgaggugaagcucacgaucaugaccggggacaucaagggcaucaugcaggccgggaagcggacccugcgcccccagccgaccgagcugaaguacuccuggaaggcguggggcaaggccaagaugcucagcacggagcugcacaaccacaccuuccugaucgacggccccgagaccgccgagugccccaacaccaaccgggccuggaacucccucgagguggaggacuacggguucggcgucuucacgaccaacaucuggcugaagcugaaggagcgccaggacguguucugcgacagcaagcucauguccgccgcgaucaaggacaaccgggccgugcacgccgacaugggguacuggaucgagagcgcccugaacgacaccuggaagaucgagaaggccuccuucaucgaggucaagagcugccacuggccgaagucccacacccuguggagcaacggcgugcucgaguccgagaugaucauccccaagaacuucgcgggccccgugagccagcacaacuaccgccccggguaccacacccagacggccggcccguggcaccuggggcggcuggagauggacuucgacuucugcgagggcaccaccgucguggugaccgaggacugcgggaaccgcggccccucccuccggacgaccaccgccagcggcaagcugaucaccgaguggugcugccgcagcugcacgcugccgccccuccgguaccgcggggaggacggcugcugguacgggauggagauccggccgcugaaggagaaggaggagaaccuggucaacucccucgugaccgccggccacgggcagaucgacaacuucagccugggcgugcugggcauggcccucuuccuggaggagaugcugcgcacccgggucgggaccaagcacgccauccuccugguggccguguccuucgucacgcugaucaccggcaacaugagcuuccgcgaccucgggcgcgugauggugauggucggcgccaccaugaccgacgacaucgggaugggcgugacguaccuggcccugcucgcggccuucaaggugcggcccaccuucgccgccggccugcugcuccgcaagcugaccuccaaggagcugaugaugaccacgaucgggaucguccuccugagccaguccaccauccccgagagcauccuggagcucaccgacgcccuggcgcugggcaugauggugcucaagaucguccggaacauggagaaguaccagcuggccgugaccaucauggccauccugugcgugcccaacgccgucauccuccagaacgccuggaagguguccugcacgacccuggcgguggucagcguguccccgcugcuccugaccagcucccagcagaaggccgacuggaucccccuggcccucaccaucaaggggcugaaccccacggccaucuuccugaccacccucagccgcaccuccaagaagcggagcuggccccugaacgaggcgaucauggccgugggcauggucuccauccuggccagcucccuccugaagaacgacaucccgaugacgggcccccugguggccgggggccuccugaccgugugcuacguccugaccgggcgcagcgccgaccucgagcuggagcgggcggccgacgugcgcugggaggagcaggccgagaucagcggcuccagccccauccuguccaucaccaucagcgaggacggguccaugagcaucaagaacgaggaggaggagcagacgcucaccauccugauccggaccggccugcucgugaucuccggccuguuccccgucagcaucccgaucaccgccgccgcgugguaccugugggaggugaagaagcagcgcgccggggugcucugggacguccccagcccgccgcccgugggcaaggccgagcuggaggacggggccuaccggaucaagcagaagggcauccugggguacagccagaucggcgccggcguguacaaggaggggaccuuccacacgauguggcacgucacccgcggcgcggugcucaugcacaaggggaagcggaucgagcccuccugggccgacgugaagaaggaccugaucagcuacggcgggggcuggaagcuggagggcgaguggaaggagggggaggagguccaggugcucgcccuggagcccggcaagaacccccgcgccgugcagaccaagcccgggcuguucaagaccaacacgggcaccaucggggccgucucccucgacuucagccccggcaccuccggcagccccaucguggacaagaaggggaagguggucggccuguacgggaacggcguggugacccgguccggcacguacgucagcgcgaucgcccagaccgagaaguccaucgaggacaacccggagaucgaggacgacaucuuccgcaagaagcggcugaccaucauggaccugcaccccggggccggcaagaccaagcgcuaccuccccgccaucgugcgggaggcgaucaagcgcgggcugcggacgcugauccucgcccccacccgcguggucgccgccgagauggaggaggcccugcgcggccugccgauccgguaccagacccccgcgauccgcgccgagcacaccgggcgggagaucguggaccucaugugccacgccacguucaccaugcgccugcugagccccauccgggugcccaacuacaaccucaucaucauggacgaggcccacuucaccgacccggccagcaucgcggcccgcggcuacaucuccacccgggucgagaugggcgaggccgccgggaucuucaugacggccacgccgcccggcagccgcgaccccuucccgcaguccaacgcgcccaucauggacgaggagaaggagauccccgagcggagcuggaacuccgggcacgagugggugaccgacuucaagggcaagaccgugugguucguccccagcaucaaggccgggaacgacaucgccgccugccugcgcaagaacggcaagaaggugauccagcugucccggaagacguucgacagcgaguacaucaagacccgcaccaacgacugggacuucguggucaccacggacaucuccgagaugggcgcgaacuucaaggccgagcgggugaucgacccgcgccggugcaugaagcccgugauccucaccgacggggaggagcgcgucauccuggccggccccaugcccgugacccacagcuccgccgcccagcggcgcgggcgggugggccgcaacccgaagaacgagaacgaccaguacaucuacaugggggagccccuggagaacgacgaggacugcgcgcacuggaaggaggccaagaugcuccuggacaacaucaacacccccgagggcaucauccccagcauguucgagccggagcgcgagaaggucgacgccaucgacggcgaguaccggcugcgcggggaggcccggaagacguucguggaccucaugcgccggggcgaccugcccgucuggcuggccuaccgcguggcggccgaggggaucaacuacgccgaccggcgcuggugcuucgacggcgugaagaacaaccagauccucgaggagaacgucgagguggagaucuggaccaaggagggggagcggaagaagcugaagccccgcuggcuggacgcccggaucuacuccgacccgcucgcccugaaggaguucaaggaguucgcggccggccgcaagagccugacccucaaccugaucaccgagaugggccggcugcccacguucaugacccagaaggccaagaacgcccucgacaaccuggcggugcugcacaccgccgaggccgggggccgcgccuacaaccacgcccucuccgagcugcccgagacccuggagacgcuccugcugcucacccugcuggcgaccgucaccgggggcaucuuccucuuccugaugagcggcaaggggaucggcaagaugacccuggggaugugcugcaucaucacggccuccauccuccugugguacgcccagauccagccccacuggaucgccgccagcaucauccuggaguucuuccucaucgugcugcugaucccggagcccgagaagcagcggacgccccaggacaaccagcucaccuacguggucaucgcgauccugaccgugguggccgccacgauggccaacgagaugggcuuccuggagaagaccaagaaggacuucgggcucggcuccaucaccacccagcagcccgagagcaacauccuggacaucgaccugcgcccggccagcgcguggacgcucuacgccgucgccaccaccuucaucacccccaugcugcggcacuccaucgagaacagcuccgugaacgugagccugacggccaucgccaaccaggcgaccguccucaugggccuggggaagggcuggccccuguccaagauggacaucggggugccccuccuggccaucggcugcuacagccaggugaacccgaucacccugaccgccgcccuccugcugcucgucgcgcacuacgccaucaucgggcccggccugcaggccaaggccacgcgcgaggcccagaagcgggcggccgccggcaucaugaagaaccccaccguggacgggaugaccgugaucgaccuggaccccaucccguacgaccccaaguucgagaagcagcucggccaggucaugcugcuggugcucugcgugacccagguccugaugaugcgcacgaccugggcccugugcgaggcccucacccuggcgaccgggcccaucuccacgcugugggagggcaaccccgggcgguucuggaacaccaccaucgccgugagcauggccaacaucuuccgcggcuccuaccucgccggcgccgggcugcuguucagcaucaugaagaacaccgcgaacacgcgccggggcaccgggaacaccggcgagacccucggcgagaaguggaagaaccgccugaacgcccuggggaaguccgaguuccagaucuacaagaaguccggcauccaggagguggaccggacgcucgccaaggaggggaucaagcgcggcgagaccgaccaccacgccgucagccgggggagcgcgaagcugcgcugguucguggagcggaaccuggugaccccggagggcaaggucguggaccucggcugcgggcgcggcgggugguccuacuacugcggcgggcugaagaacgugaaggaggucaagggccugaccaagggcgggcccggccacgaggagcccauccccaugagcacguacggguggaaccucgugcggcugcaguccggcguggacgucuucuucaccccgcccgagaagugcgacacccugcucugcgacaucggggagagcucccccaaccccaccguggaggccggccgcacccugcgggugcugaaccucgucgagaacuggcugaacaacaacacgcaguucugcaucaaggugcugaacccguacaugcccagcgugaucgagaagauggaggcccugcagcgcaaguacggcggggcccucguccggaacccccugagccgcaacuccacccacgagauguacugggugagcaacgccuccggcaacaucgugagcuccgucaacaugaucagccggaugcugaucaaccgcuucaccaugcggcacaagaaggcgaccuacgagccggacguggaccucggguccggcacgcgcaacaucgggaucgagagcgagacccccaaccuggacaucaucggcaagcggaucgagaagaucaagcaggagcacgagaccuccuggcacuacgaccaggaccaccccuacaagaccugggccuaccacggcagcuacgagacgaagcagaccggguccgccagcuccauggugaacggcgucgugcgccugcucaccaagcccugggacgugaucccgauggucacccagauggccaugacggacaccacccccuucgggcagcagcgcguguucaaggagaaggucgacacccggacgcaggagcccaaggagggcaccaagaagcugaugaagaucaccgccgaguggcuguggaaggagcucggcaagaagaagacgccccgcaugugcacgcgggaggaguucacccgcaaggugcggagcaacgcggcccugggggccaucuucaccgacgagaacaaguggaaguccgcccgcgaggccguggaggacagcggcuucugggagcuggucgacaaggagcggaaccuccaccuggaggggaagugcgagaccugcguguacaacaugaugggcaagcgcgagaagaagcugggggaguucggcaaggcgaagggcucccgggccaucugguacauguggcucggggcccgcuuccuggaguucgaggcccugggcuuccucaacgaggaccacugguucagccgggagaacucccugagcgggguggagggcgaggggcugcacaagcucggcuacauccugcgcgacgucagcaagaaggagggcggggcgauguacgccgacgacacggccggcugggacacccggaucacccuggaggaccucaagaacgaggagauggugaccaaccacauggagggggagcacaagaagcuggccgaggccaucuucaagcugacguaccagaacaaggugguccgcgugcagcggccgacgccccgcggcaccgugauggacaucaucucccggcgcgaccagcgggggagcggccaggucgugaccuacggccucaacaccuucaccaacauggaggcgcagcugauccgccagauggagggggagggcguguucaaguccauccagcagcugaccgucaaggaggagaucgccgugaagaacuggcucauccggguggggcgcgagcgccugagccggauggccaucuccggcgacgacugcgucgugaagccccuggacgaccgcuucgccagcgcccucaccgcgcugaacgacaugggcaaggugcggaaggacauccagcagugggagcccucccgcggguggaacgacuggacgcaggucccguucugcagccaccacuuccacgagcugaucaugaaggacggccgggugcucgugguccccugccgcaaccaggacgagcugaucgggcgggcccgcaucucccagggcgccggguggagccugcgggagaccgccugccucggcaaguccuacgcccagauguggagccugauguacuuccaccgccgggaccugcgccucgcggccaacgccaucugcuccgccgugcccagccacuggauccccaccucccggaccaccuggagcauccacgccacgcacgaguggaugaccaccgaggacaugcugaccguguggaaccgcgucuggauccaggagaacccguggauggaggacaagacgcccguggaguccugggaggagauccccuaccugggcaagcgggaggaccaguggugcgggagccucaucggccugaccagccgcgcgaccugggccaagaacauccagaccgccaucaaccaggugcggucccugaucgggaacgaggaguacacggacuacaugcccagcaugaagcgcuuccggcgcgaggaggaggaggccggcguccucugguga

SEQ ID NO: 9091 - RNA, 9876 nt, Artificial Sequence
  derived and/or modified CDS sequence (opt1) from DENV-2__KM279574__SS-prME
accgcgggcaucaucaucaugaugauccccaccgugauggccuuccaccugaccacccgcaacggggagccccacaugaucgucagccggcaggagaagggcaagucccuccuguucaagaccgagaacggggugaacaugugcacccugauggcgauggaccucggcgagcugugcgaggacaccaucaccuacaacugcccccugcuccgccagaacgagcccgaggacaucgacugcuggugcaacagcaccuccaccugggugaccuacgggaccugcaccgccaccggcgagcaccggcgcgagaagcggagcgucgcccuggugccccacgugggcauggggcuggagacccgcaccgagaccuggauguccagcgagggcgccuggaagcacgcccagcggaucgagaccuggauccuccgccaccccggguucaccaucauggcggccauccuggccuacaccaucggcaccaccuacuuccagcggguccugaucuucauccuccugaccgccgugacccccuccauggcgaugcgcugcaucgggaucagcaaccgggacuucguggagggcgucuccggcgggagcuggguggacaucgugcuggagcacggcuccugcgucaccaccauggccaagaacaagcccacgcucgacuucgagcugaucaagaccgaggccaagcaccuggccacccuccgcaaguacugcguggaggccaagcugaccaacacgaccaccgcgagccggugccccacccagggggagcccucccugaacgaggagcaggacaagcgcuucgugugcaagcacagcauggucgaccggggcuggggcaacgggugcggccucuucgggaagggcgggaucgugacgugcgccauguucacgugcaagaagaacauggagggcaaggugguccagcccgagaaccuggaguacaccaucgugaucacgccccacuccggcgaggagaacgccguggggaacgacacgggcaagcacgggaaggagaucaaggucacgccccagagcuccaucaccgaggccgagcugaccggcuacgggaccgugacgauggagugcagcccgcgcaccggccucgacuucaacgagauggugcugcugcagauggagaacaaggccuggcucguccaccggcagugguuccuggaccugccccuccccuggcugcccggcgcggacacccagggguccaacuggauccagaaggagacccuggugacguucaagaacccgcacgccaagaagcaggacgucguggugcucggcagccaggagggggccaugcacaccgcccugaccggcgccaccgagauccagaugagcuccgggaaccuccuguucacgggccaccugaagugccgccugcggauggacaagcuccagcugaagggcaugagcuacuccaugugcaccgggaaguucaaggucgugaaggagaucgcggagacccagcacggcaccaucgugauccgcguccaguacgagggggacggcagccccugcaagauccccuucgagaucauggaccuggagaagcggcacgugcucggccgccugaucacggugaaccccaucgucaccgagaaggacuccccggugaacaucgaggccgagccgcccuucggggacagcuacaucaucaucggcguggagcccgggcagcugaagcucuccugguucaagaagggcagcuccaucgggcagauguucgagaccaccaugcgcggcgccaagcggauggccauccugggcgacacggccugggacuucgggagccugggcggggucuucaccuccaucggcaaggcgcuccaccagguguucggggccaucuacggcgccgccuucagcggcguguccuggaccaugaagauccugaucggggucgugaucaccuggaucggcaugaacagccgcuccacgagccuguccgugagccugguccucguggggguggucacccuguaccugggcgugauggugcaggcggacuccgggugcgucgugagcuggaagaacaaggagcucaagugcggcagcggcaucuucaucaccgacaacgugcacaccuggacggagcaguacaaguuccagccggagucccccagcaagcuggccuccgccauccagaaggcccacgaggaggggaucugcggcauccggagcgucacccgccuggagaaccucauguggaagcagaucacccccgagcugaaccacauccugaccgagaacgaggugaagcucacgaucaugaccggggacaucaagggcaucaugcaggccgggaagcggacccugcgcccccagccgaccgagcugaaguacuccuggaaggcguggggcaaggccaagaugcucagcacggagcugcacaaccacaccuuccugaucgacggccccgagaccgccgagugccccaacaccaaccgggccuggaacucccucgagguggaggacuacggguucggcgucuucacgaccaacaucuggcugaagcugaaggagcgccaggacguguucugcgacagcaagcucauguccgccgcgaucaaggacaaccgggccgugcacgccgacaugggguacuggaucgagagcgcccugaacgacaccuggaagaucgagaaggccuccuucaucgaggucaagagcugccacuggccgaagucccacacccuguggagcaacggcgugcucgaguccgagaugaucauccccaagaacuucgcgggccccgugagccagcacaacuaccgccccggguaccacacccagacggccggcccguggcaccuggggcggcuggagauggacuucgacuucugcgagggcaccaccgucguggugaccgaggacugcgggaaccgcggccccucccuccggacgaccaccgccagcggcaagcugaucaccgaguggugcugccgcagcugcacgcugccgccccuccgguaccgcggggaggacggcugcugguacgggauggagauccggccgcugaaggagaaggaggagaaccuggucaacucccucgugaccgccggccacgggcagaucgacaacuucagccugggcgugcugggcauggcccucuuccuggaggagaugcugcgcacccgggucgggaccaagcacgccauccuccugguggccguguccuucgucacgcugaucaccggcaacaugagcuuccgcgaccucgggcgcgugauggugauggucggcgccaccaugaccgacgacaucgggaugggcgugacguaccuggcccugcucgcggccuucaagauccggcccaccuucgccgccggccugcugcuccgcaagcugaccuccaaggagcugaugaugaccacgaucgggaucgugcuccugagccaguccaccauccccgagagcauccuggagcucaccgacgcccuggcgcugggcaugaugguccucaagaucgugcggaacauggagaaguaccagcuggccgucaccaucauggccauccugugcgugcccaacgccgugauccuccagaacgccuggaaggucuccugcacgacccuggcgguggugagcgucuccccgcugcuccugaccagcucccagcagaaggccgacuggaucccccuggcccucaccaucaaggggcugaaccccacggccaucuuccugaccacccucagccgcaccuccaagaagcggagcuggccccugaacgaggcgaucauggccgugggcaugguguccauccuggccagcucccuccugaagaacgacaucccgaugacgggcccccuggucgccgggggccuccugaccgugugcuacgugcugaccgggcgcagcgccgaccucgagcuggagcgggcggccgacguccgcugggaggagcaggccgagaucagcggcuccagccccauccuguccaucaccaucagcgaggacggguccaugagcaucaagaacgaggaggaggagcagacgcucaccauccugauccggaccggccugcucgugaucuccggccuguuccccgugagcaucccgaucaccgccgccgcgugguaccugugggaggucaagaagcagcgcgccggggugcucugggacgugcccagcccgccgcccgucggcaaggccgagcuggaggacggggccuaccggaucaagcagaagggcauccugggguacagccagaucggcgccggcguguacaaggaggggaccuuccacacgauguggcacgugacccgcggcgcgguccucaugcacaaggggaagcggaucgagcccuccugggccgacgugaagaaggaccugaucagcuacggcgggggcuggaagcuggagggcgaguggaaggagggggaggaggugcagguccucgcccuggagcccggcaagaacccccgcgccgugcagaccaagcccgggcuguucaagaccaacacgggcaccaucggggccgugucccucgacuucagccccggcaccuccggcagccccaucgucgacaagaaggggaagguggugggccuguacgggaacggcgucgugacccgguccggcacguacgugagcgcgaucgcccagaccgagaaguccaucgaggacaacccggagaucgaggacgacaucuuccgcaagaagcggcugaccaucauggaccugcaccccggggccggcaagaccaagcgcuaccuccccgccaucguccgggaggcgaucaagcgcgggcugcggacgcugauccucgcccccacccgcgugguggccgccgagauggaggaggcccugcgcggccugccgauccgguaccagacccccgcgauccgcgccgagcacaccgggcgggagaucgucgaccucaugugccacgccacguucaccaugcgccugcugagccccauccgggugcccaacuacaaccucaucaucauggacgaggcccacuucaccgacccggccagcaucgcggcccgcggcuacaucuccacccggguggagaugggcgaggccgccgggaucuucaugacggccacgccgcccggcagccgcgaccccuucccgcaguccaacgcgcccaucauggacgaggagaaggagauccccgagcggagcuggaacuccgggcacgagugggucaccgacuucaagggcaagaccgugugguucgugcccagcaucaaggccgggaacgacaucgccgccugccugcgcaagaacggcaagaaggucauccagcugucccggaagacguucgacagcgaguacaucaagacccgcaccaacgacugggacuucguggugaccacggacaucuccgagaugggcgcgaacuucaaggccgagcgggucaucgacccgcgccggugcaugaagcccgugauccucaccgacggggaggagcgcgugauccuggccggccccaugcccgucacccacagcuccgccgcccagcggcgcgggcgggugggccgcaacccgaagaacgagaacgaccaguacaucuacaugggggagccccuggagaacgacgaggacugcgcgcacuggaaggaggccaagaugcuccuggacaacaucaacacccccgagggcaucauccccagcauguucgagccggagcgcgagaagguggacgccaucgacggcgaguaccggcugcgcggggaggcccggaagacguucgucgaccucaugcgccggggcgaccugcccguguggcuggccuaccgcgucgcggccgaggggaucaacuacgccgaccggcgcuggugcuucgacggcgugaagaacaaccagauccucgaggagaacguggaggucgagaucuggaccaaggagggggagcggaagaagcugaagccccgcuggcuggacgcccggaucuacuccgacccgcucgcccugaaggaguucaaggaguucgcggccggccgcaagagccugacccucaaccugaucaccgagaugggccggcugcccacguucaugacccagaaggccaagaacgcccucgacaaccuggcggugcugcacaccgccgaggccgggggccgcgccuacaaccacgcccucuccgagcugcccgagacccuggagacgcuccugcugcucacccugcuggcgaccgugaccgggggcaucuuccucuuccugaugagcggcaaggggaucggcaagaugacccuggggaugugcugcaucaucacggccuccauccuccugugguacgcccagauccagccccacuggaucgccgccagcaucauccuggaguucuuccucaucguccugcugaucccggagcccgagaagcagcggacgccccaggacaaccagcucaccuacguggugaucgcgauccugaccgucguggccgccacgauggccaacgagaugggcuuccuggagaagaccaagaaggacuucgggcucggcuccaucaccacccagcagcccgagagcaacauccuggacaucgaccugcgcccggccagcgcguggacgcucuacgccguggccaccaccuucaucacccccaugcugcggcacuccaucgagaacagcuccgucaacgugagccugacggccaucgccaaccaggcgaccgugcucaugggccuggggaagggcuggccccuguccaagauggacaucggggucccccuccuggccaucggcugcuacagccaggugaacccgaucacccugaccgccgcccuccugcugcucguggcgcacuacgccaucaucgggcccggccugcaggccaaggccacgcgcgaggcccagaagcgggcggccgccggcaucaugaagaaccccaccgucgacgggaugaccgugaucgaccuggaccccaucccguacgaccccaaguucgagaagcagcucggccaggugaugcugcugguccucugcgugacccaggugcugaugaugcgcacgaccugggcccugugcgaggcccucacccuggcgaccgggcccaucuccacgcugugggagggcaaccccgggcgguucuggaacaccaccaucgccgucagcauggccaacaucuuccgcggcuccuaccucgccggcgccgggcugcuguucagcaucaugaagaacaccgcgaacacgcgccggggcaccgggaacaccggcgagacccucggcgagaaguggaagaaccgccugaacgcccuggggaaguccgaguuccagaucuacaagaaguccggcauccaggagguggaccggacgcucgccaaggaggggaucaagcgcggcgagaccgaccaccacgccgugagccgggggagcgcgaagcugcgcugguucgucgagcggaaccuggugaccccggagggcaagguggucgaccucggcugcgggcgcggcgggugguccuacuacugcggcgggcugaagaacgugaaggaggugaagggccugaccaagggcgggcccggccacgaggagcccauccccaugagcacguacggguggaaccucguccggcugcaguccggcguggacguguucuucaccagcccggagaagugcgacacccugcucugcgacaucggggaguccagccccaaccccaccgucgaggccggccgcacccugcgggugcugaaccucguggagaacuggcugaacaacaacacgcaguucugcaucaagguccugaaccccuacaugccgagcgugaucgagaagauggaggcccugcagcgcaaguacggcggggcccucgugcggaacccccugucccgcaacagcacccacgagauguacugggucuccaacgccagcggcaacaucguguccagcgugaacaugaucucccggaugcugaucaaccgcuucaccaugcggcacaagaaggcgaccuacgagcccgacgucgaccucgggagcggcacgcgcaacaucgggaucgaguccgagaccccgaaccuggacaucaucggcaagcggaucgagaagaucaagcaggagcacgagaccagcuggcacuacgaccaggaccaccccuacaagaccugggccuaccacggcuccuacgagacgaagcagaccgggagcgccuccagcauggugaacggcgugguccgccugcucaccaagcccugggacgugauccccauggugacccagauggccaugacggacaccaccccguucgggcagcagcgcgucuucaaggagaagguggacacccggacgcaggagcccaaggagggcaccaagaagcugaugaagaucaccgccgaguggcuguggaaggagcucggcaagaagaagacgccccgcaugugcacgcgggaggaguucacccgcaagguccgguccaacgcggcccugggggccaucuucaccgacgagaacaaguggaaguccgcccgcgaggccguggaggacuccggcuucugggagcugguggacaaggagcggaaccuccaccuggaggggaagugcgagaccugcgucuacaacaugaugggcaagcgcgagaagaagcugggggaguucggcaaggcgaagggcagccgggccaucugguacauguggcucggggcccgcuuccuggaguucgaggcccugggcuuccucaacgaggaccacugguucucccgggagaacagccugagcgggguggagggcgaggggcugcacaagcucggcuacauccugcgcgacguguccaagaaggagggcggggcgauguacgccgacgacacggccggcugggacacccggaucacccuggaggaccucgagaacgaggagauggucaccaaccacauggagggggagcacaagaagcuggccgaggccaucuucaagcugacguaccagaacaagguggugcgcguccagcggcccaccccgcgcggcaccgugauggacaucaucagccggcgcgaccagcggggguccggccagguggucaccuacggccucaacacguucaccaacauggaggcgcagcugauccgccagauggagggggagggcguguucaagagcauccagcagcugaccgugaaggaggagaucgccgucaagaacuggcucacccggguggggcgcgagcgccugucccggauggccaucagcggcgacgacugcguggucaagccccuggacgaccgcuucgccuccgcccucacggcgcugaacgacaugggcaaggugcggaaggacauccagcagugggagcccagccgcggguggaacgacuggacccaggugcccuucugcucccaccacuuccacgagcugaucaugaaggacggccggguccucguggugccgugccgcaaccaggacgagcugaucgggcgggcccgcaucagccagggcgccggguggucccugcgggagaccgccugccucggcaagagcuacgcccagauguggucccugauguacuuccaccgccgggaccugcgccucgcggccaacgccaucugcagcgccguccccucccacuggauccccaccagccggaccacgugguccauccacgccacccacgaguggaugaccaccgaggacaugcugacgguguggaaccgcguguggauccaggagaaccccuggauggaggacaagaccccggucgagagcugggaggagauccccuaccugggcaagcgggaggaccaguggugcgggagccucaucggccugaccucccgcgcgaccugggccaagaacauccagacggccaucaaccaggugcggagccugaucgggaacgaggaguacaccgacuacaugcccuccaugaagcgcuuccggcgcgaggaggaggaggccggcgugcucugguga

SEQ ID NO: 9092 - RNA, 9876 nt, Artificial Sequence
  derived and/or modified CDS sequence (opt1) from DENV-2__KM279568__SS-prME
accgcgggcaucaucaucaugaugauccccaccgugauggccuuccaccugaccacccggaacggggagccccacaugaucgugagccggcaggagaagggcaagagccuccuguucaagaccgagaacggggugaacaugugcacccugauggcgauggaccucggcgagcugugcgaggacaccaucaccuacaacugcccccugcuccgccagaacgagcccgaggacaucgacugcuggugcaacagcaccuccaccugggugaccuacgggaccugcaccgccaccggcgagcaccggcgcgagaagcggagcgucgcccuggugccccacgugggcauggggcuggagacccgcaccgagaccuggauguccagcgagggcgccuggaagcacgcccagcggaucgagaccuggauccuccgccaccccggguucacgaucauggcggccauccuggccuacaccaucggcaccaccuacuuccagcggguccugaucuucauccuccugacggccgugacccccuccauggcgaugcgcugcaucgggaucagcaaccgggacuucguggagggcgucuccggcgggagcuggguggacaucgugcuggagcacggcuccugcgucaccaccauggccaagaacaagcccacgcucgacuucgagcugaucaagaccgaggccaagcaccuggccacccuccgcaaguacugcguggaggccaagcugaccaacacgaccaccgcgagccggugccccacccagggggagcccucccugaacgaggagcaggacaagcgcuucgugugcaagcacagcauggucgaccggggcuggggcaacgggugcggccucuucgggaagggcgggaucgugacgugcgccauguucacgugcaagaagaacauggagggcaaggugguccagcccgagaaccuggaguacaccaucgugaucacgccccacuccggcgaggagaacgccguggggaacgacacgggcaagcacgggaaggagaucaagaucacgccccagagcuccaucaccgaggccgagcugaccggcuacgggaccgucacgauggagugcagcccgcgcaccggccucgacuucaacgagauggugcugcugcagauggagaacaaggccuggcucgugcaccggcagugguuccuggaccugccccuccccuggcugcccggcgcggacacccagggguccaacuggauccagaaggagacccuggucacguucaagaacccgcacgccaagaagcaggacaucgugguccucggcagccaggagggggccaugcacaccgcccugaccggcgccaccgagauccagaugagcuccgggaaccuccuguucacgggccaccugaagugccgccugcggauggacaagcuccagcugaagggcaugagcuacuccaugugcaccgggaaguucaagguggugaaggagaucgcggagacccagcacggcaccaucgucauccgcgugcaguacgagggggacggcagccccugcaagauccccuucgagaucauggaccuggagaagcggcacgugcucggccgccugaucacggucaaccccaucgugaccgagaaggacuccccggugaacaucgaggccgagccgcccuucggggacagcuacaucaucaucggcgucgagcccgggcagcugaagcucuccugguucaagaagggcagcuccaucgggcagauguucgagaccaccaugcgcggcgccaagcggauggccauccugggcgacacggccugggacuucgggagccugggcgggguguucaccuccaucggcaaggcgcuccaccagguguucggggccaucuacggcgccgccuucagcggcgucuccuggaccaugaagauccugaucgggguggugaucaccuggaucggcaugaacagccgcuccacgagccuguccgucagccuggugcucgugggggucgugacccuguaccugggcgugaugguccaggcggacuccgggugcguggugagcuggaagaacaaggagcucaagugcggcagcggcaucuucaucaccgacaacguccacaccuggacggagcaguacaaguuccagccggagucccccagcaagcuggccuccgccauccagaaggcccacgaggaggggaucugcggcauccggagcgugacccgccuggagaaccucauguggaagcagaucacccccgagcugaaccacauccugaccgagaacgaggugaagcucacgaucaugaccggggacaucaagggcaucaugcaggccgggaagcggucccugcgcccccagccgaccgagcugaaguacagcuggaaggcguggggcaaggccaagaugcucuccaccgagcugcacaaccacacguuccugaucgacggccccgagaccgccgagugccccaacaccaaccgggccuggaacagccucgaggucgaggacuacggguucggcguguucaccacgaacaucuggcugaagcugaaggagcgccaggacguguucugcgacuccaagcucaugagcgccgcgaucaaggacaaccgggccguccacgccgacaugggguacuggaucgaguccgcccugaacgacaccuggaagaucgagaaggccagcuucaucgaggugaaguccugccacuggcccaagagccacacccugugguccaacggcgugcucgagagcgagaugaucauccccaagaacuucgcgggccccgucucccagcacaacuaccgccccggguaccacacccagaccgccggcccguggcaccuggggcggcuggagauggacuucgacuucugcgagggcacgaccgugguggucaccgaggacugcgggaaccgcggccccagccuccggaccacgaccgccagcggcaagcugaucaccgaguggugcugccgcuccugcacccugccgccccuccgguaccgcggggaggacggcugcugguacgggauggagauccggccgcugaaggagaaggaggagaaccuggugaacagccucgugacggccggccacgggcagaucgacaacuucucccugggcguccugggcauggcccucuuccuggaggagaugcugcgcacccggguggggaccaagcacgccauccuccugguggccgucagcuucgugacccugaucacgggcaacauguccuuccgcgaccucgggcgcgugauggucauggugggcgccaccaugaccgacgacaucgggaugggcgugaccuaccuggcccugcucgcggccuucaagguccggcccacguucgccgccggccugcugcuccgcaagcugaccagcaaggagcugaugaugaccaccaucgggaucgugcuccugucccagagcacgauccccgaguccauccuggagcucaccgacgcccuggcgcugggcaugauggugcucaagaucguccggaacauggagaaguaccagcuggccgugaccaucauggccaucagcugcguccccaacgccgugauccugcagaacgccuggaagguguccugcaccacgcucgcggucgugagcguguccccgcugcugcucaccagcucccagcagaaggccgacuggaucccccuggcccugaccaucaaggggcucaaccccaccgccaucuuccugacgacccugagccgcaccuccaagaagcggagcuggccccucaacgaggcgaucauggccgucggcaugguguccauccuggccagcagccugcucaagaacgacaucccgaugaccggcccccugguggccgggggccugcucacggucugcuacgugcugaccgggcgcuccgccgaccuggagcucgagcgggcggccgacgugcgcugggaggagcaggccgagaucagcggcuccagccccauccuguccaucaccaucagcgaggacggguccaugagcaucaagaacgaggaggaggagcagacccugacgauccucauccggaccggccugcuggucaucuccggccucuuccccgugagcaucccgaucaccgccgccgcgugguaccugugggaggugaagaagcagcgcgccgggguccugugggacgugcccagcccgccgcccgugggcaaggccgagcucgaggacggggccuaccggaucaagcagaagggcauccugggguacagccagaucggcgccggcgucuacaaggaggggaccuuccacaccauguggcacgugacgcgcggcgcggugcugaugcacaaggggaagcggaucgagcccuccugggccgacgucaagaaggaccucaucagcuacggcgggggcuggaagcuggagggcgaguggaaggagggggaggagguccaggugcuggcccucgagcccggcaagaacccgcgcgccguccagaccaagcccgggcuguucaagaccaacaccggcacgaucggggccgugucccuggacuucagccccggcaccuccggcagccccaucguggacaagaaggggaaggucgugggccucuacgggaacggcguggucacccgguccggcaccuacgugagcgcgaucgcccagacggagaaguccaucgaggacaacccggagaucgaggacgacaucuuccgcaagaagcggcugaccaucauggaccugcaccccggggccggcaagaccaagcgcuaccugcccgccaucgugcgggaggcgaucaagcgcgggcuccggacccugauccuggcccccacgcgcgucguggccgccgagauggaggaggcccuccgcggccugccgauccgguaccagacccccgcgauccgcgccgagcacaccgggcgggagaucguggaccugaugugccacgccaccuucacgaugcgccuccugagccccauccggguccccaacuacaaccugaucaucauggacgaggcccacuucaccgacccggccagcaucgcggcccgcggcuacaucuccacccggguggagaugggcgaggccgccgggaucuucaugaccgccacgccgcccggcagccgcgaccccuucccgcaguccaacgcgcccaucauggacgaggagcgggagauccccgagcgcagcuggaacuccgggcacgagugggugaccgacuucaagggcaagaccgucugguucgugcccagcaucaaggccgggaacgacaucgccgccugccuccggaagaacggcaagaaggugauccagcugucccgcaagaccuucgacagcgaguacaucaagacgcggaccaacgacugggacuucgucgugaccaccgacaucuccgagaugggcgcgaacuucaaggccgagcgcgugaucgacccgcggcgcugcaugaagcccgucauccugacggacggggaggagcgggugauccucgccggccccaugcccgugacccacagcuccgccgcccagcgccgggggcgcgucggccgcaacccgaagaacgagaacgaccaguacaucuacaugggggagccccuggagaacgacgaggacugcgcgcacuggaaggaggccaagaugcugcucgacaacaucaacacccccgagggcaucauccccagcauguucgagccggagcgggagaagguggacgccaucgacggcgaguaccgccugcgcggggaggcccgcaagaccuucguggaccugaugcggcgcggcgaccuccccgucuggcuggccuaccggguggcggccgaggggaucaacuacgccgaccgccgguggugcuucgacggcgucaagaacaaccagauccuggaggagaacguggagguggagaucuggacgaaggagggggagcgcaagaagcucaagccccgguggcuggacgcccgcaucuacuccgacccgcuggcccucaaggaguucaaggaguucgcggccggccggaagucccugacccugaaccucaucaccgagaugggccgccugcccaccuucaugacgcagaaggccaagaacgcccuggacaaccucgcgguccugcacaccgccgaggccgggggccgggccuacaaccacgcccuguccgagcuccccgagacccuggagacccugcuccugcugacgcuccuggcgaccgugaccgggggcaucuuccuguuccucaugagcggcaaggggaucggcaagaugacccuggggaugugcugcaucaucaccgccuccauccugcucugguacgcccagauccagccccacuggaucgccgccagcaucauccuggaguucuuccugaucgugcuccugaucccggagcccgagaagcagcgcacgccccaggacaaccagcugaccuacgucgugaucgcgauccucaccguggucgccgccaccauggccaacgagaugggcuuccuggagaagacgaagaaggacuucgggcugggcagcaucaccacccagcagcccgaguccaacauccucgacaucgaccugcggccggccagcgcguggacccuguacgccguggccacgaccuucaucacccccaugcuccgccacuccaucgagaacagcuccgugaacgucagccugaccgccaucgccaaccaggcgacggugcugaugggccucgggaagggcuggccccuguccaagauggacaucggggugccccugcucgccaucggcugcuacagccaggucaacccgaucacccugaccgccgcccugcuccugcugguggcgcacuacgccaucaucgggcccggccuccaggccaaggccacccgggaggcccagaagcgcgcggccgccggcaucaugaagaaccccacgguggacgggaugaccgucaucgaccuggaccccaucccguacgaccccaaguucgagaagcagcugggccaggugaugcuccuggugcugugcgucacccaggugcucaugaugcggaccacgugggcccugugcgaggcccugacccucgcgaccgggcccaucuccacccugugggagggcaaccccgggcgcuucuggaacacgaccaucgccgugagcauggccaacaucuuccgcggcuccuaccuggccggcgccgggcuccuguucagcaucaugaagaacaccgcgaacacccggcgcggcacggggaacaccggcgagacccugggcgagaaguggaagaaccggcucaacgcccuggggaaguccgaguuccagaucuacaagaaguccggcauccaggaggucgaccgcacccuggccaaggaggggaucaagcggggcgagacggaccaccacgccgugucccgcgggagcgcgaagcuccggugguucguggagcgcaaccuggucaccccggagggcaaggugguggaccugggcugcgggcggggcgggugguccuacuacugcggcgggcucaagaacgucaaggaggugaagggccugaccaagggcgggcccggccacgaggagcccauccccaugagcaccuacggguggaaccuggugcgccuccaguccggcgucgacguguucuucacgccgcccgagaagugcgacacccugcugugcgacaucggggagagcagccccaaccccaccguggaggccggccggacccuccgcguccugaaccugguggagaacuggcucaacaacaacacccaguucugcaucaaggugcugaacccguacaugcccuccgucaucgagaagauggaggcccugcagcggaaguacggcggggcccuggugcgcaacccccucagccggaacuccacgcacgagauguacugggugagcaacgccuccggcaacaucgucagcuccgugaacaugaucagccgcaugcugaucaaccgguucaccaugcgccacaagaaggcgaccuacgagccggacguggaccugggguccggcacccggaacaucgggaucgagagcgagacgcccaaccucgacaucaucggcaagcgcaucgagaagaucaagcaggagcacgagaccuccuggcacuacgaccaggaccaccccuacaagaccugggccuaccacggcagcuacgagaccaagcagacgggguccgccagcuccauggucaacggcguggugcgccugcugaccaagcccugggacgucaucccgauggugacccagauggccaugaccgacacgacccccuucgggcagcagcggguguucaaggagaaggucgacacccgcacccaggagcccaaggagggcacgaagaagcucaugaagaucaccgccgaguggcuguggaaggagcugggcaagaagaagacgccccggaugugcacccgcgaggaguucacgcggaaggugcgcagcaacgcggcccucggggccaucuucaccgacgagaacaaguggaaguccgcccgggaggccgucgaggacagcggcuucugggagcugguggacaaggagcgcaaccugcaccucgaggggaagugcgagaccugcguguacaacaugaugggcaagcgggagaagaagcugggggaguucggcaaggcgaagggcucccgcgccaucugguacauguggcugggggcccgguuccucgaguucgaggcccugggcuuccugaacgaggaccacugguucagccgcgagaacagccucuccggggucgagggcgaggggcugcacaagcugggcuacauccuccgggacgugagcaagaaggagggcggggcgauguacgccgacgacaccgccggcugggacacgcgcaucacccuggaggaccugaagaacgaggagauggugaccaaccacauggagggggagcacaagaagcucgccgaggccaucuucaagcugaccuaccagaacaaggucgugcgggugcagcgcccgacgccccggggcaccgucauggacaucaucucccgccgggaccagcgcgggagcggccagguggugaccuacggccugaacaccuucacgaacauggaggcgcagcucauccggcagauggagggggagggcgucuucaaguccauccagcagcugaccgugaaggaggagaucgccgugaagaacuggcugauccgcgucgggcgcgagcggcucagccgcauggccaucuccggcgacgacugcguggugaagccccuggacgaccgguucgccagcgcccugaccgcgcucaacgacaugggcaagguccgcaaggacauccagcagugggagcccucccggggguggaacgacuggacccaggugccguucugcagccaccacuuccacgagcugaucaugaaggacggccgcgugcuggucgugcccugccggaaccaggacgagcucaucgggcgcgcccggaucucccagggcgccggguggagccugcgcgagacggccugccugggcaaguccuacgcccagauguggagccucauguacuuccaccggcgcgaccugcggcuggcggccaacgccaucugcuccgccgugcccagccacuggauccccaccucccgcaccaccuggagcauccacgccacccacgaguggaugacgaccgaggacaugcucaccgucuggaaccggguguggauccaggagaacccguggauggaggacaagacccccguggagagcugggaggagauccccuaccugggcaagcgcgaggaccaguggugcgggucccugaucggccucacgagccgggcgaccugggccaagaacauccagaccgccaucaaccagguccgcucccugaucgggaacgaggaguacaccgacuacaugcccagcaugaagcgguuccgccgcgaggaggaggaggccggcgugcugugguga

SEQ ID NO: 9093 - RNA, 9876 nt, Artificial Sequence
  derived and/or modified CDS sequence (opt1) from DENV-2__KM279569__SS-prME
accgcgggcaucaucaucaugaugauccccaccgugauggccuuccaccugaccacccgcaacggggagccccacaugaucgucucccggcaggagaagggcaagucccuccuguucaagaccgagaacggggugaacaugugcacccugauggcgauggaccucggcgagcugugcgaggacaccaucaccuacaacugcccccugcuccgccagaacgagcccgaggacaucgacugcuggugcaacagcaccuccaccugggugaccuacgggaccugcaccgccaccggcgagcaccggcgcgagaagcggagcgucgcccuggugccccacgugggcauggggcuggagacccgcaccgagaccuggauguccagcgagggcgccuggaagcacgcccagcggaucgagaccuggauccuccgccaccccggguucaccaucauggcggccauccuggccuacaccaucggcaccaccuacuuccagcggguccugaucuucauccuccugaccgccgugacccccuccauggcgaugcgcugcaucgggaucagcaaccgggacuucguggagggcgucuccggcgggagcuggguggacaucgugcuggagcacggcuccugcgucaccaccauggccaagaacaagcccacgcucgacuucgagcugaucaagaccgaggccaagcaccuggccacccuccgcaaguacugcguggaggccaagcugaccaacacgaccaccgcgagccggugccccacccagggggagcccucccugaacgaggagcaggacaagcgcuucgugugcaagcacagcauggucgaccggggcuggggcaacgggugcggccucuucgggaagggcgggaucgugacgugcgccauguucacgugcaagaagaacauggagggcaaggugguccagcccgagaaccuggaguacaccaucgugaucacgccccacuccggcgaggagaacgccguggggaacgacacgggcaagcacgggaaggagaucaaggucacgccccagagcuccaucaccgaggccgagcugaccggcuacgggaccgugacgauggagugcagcccgcgcaccggccucgacuucaacgagauggugcugcugcagauggagaacaaggccuggcucguccaccggcagugguuccuggaccugccccuccccuggcugcccggcgcggacacccagggguccaacuggauccagaaggagacccuggugacguucaagaacccgcacgccaagaagcaggacgucguggugcucggcagccaggagggggccaugcacaccgcccugaccggcgccaccgagauccagaugagcuccgggaaccuccuguucacgggccaccugaagugccgccugcggauggacaagcuccagcugaagggcaugagcuacuccaugugcaccgggaaguucaaggucgugaaggagaucgcggagacccagcacggcaccaucgugauccgcguccaguacgagggggacggcagccccugcaagauccccuucgagaucauggaccuggagaagcggcacgugcucggccgccugaucacggugaaccccaucgucaccgagaaggacuccccggugaacaucgaggccgagccgcccuucggggacagcuacaucaucaucggcguggagcccgggcagcugaagcucuccugguucaagaagggcagcuccaucgggcagauguucgagaccaccaugcgcggcgccaagcggauggccauccugggcgacacggccugggacuucgggagccugggcggggucuucaccuccaucggcaaggcgcuccaccagguguucggggccaucuacggcgccgccuucagcggcguguccuggaccaugaagauccugaucggggucgugaucaccuggaucggcaugaacagccgcuccacgagccuguccgugagccugguccucguggggguggucacccuguaccugggcgugauggugcaggcggacuccgggugcgucgugagcuggaagaacaaggagcucaagugcggcagcggcaucuucaucaccgacaacgugcacaccuggacggagcaguacaaguuccagccggagucccccagcaagcuggccuccgccauccagaaggcccacgaggaggggaucugcggcauccggagcgucacccgccuggagaaccucauguggaagcagaucacccccgagcugaaccacauccugaccgagaacgaggugaagcucacgaucaugaccggggacaucaagggcaucaugcaggccgggaagcggacccugcgcccccagccgaccgagcugaaguacuccuggaaggcguggggcaaggccaagaugcucagcacggagcugcacaaccacaccuuccugaucgacggccccgagaccgccgagugccccaacaccaaccgggccuggaacucccucgagguggaggacuacggguucggcgucuucacgaccaacaucuggcugaagcugaaggagcgccaggacguguucugcgacagcaagcucauguccgccgcgaucaaggacaaccgggccgugcacgccgacaugggguacuggaucgagagcgcccugaacgacaccuggaagaucgagaaggccuccuucaucgaggucaagagcugccacuggccgaagucccacacccuguggagcaacggcgugcucgaguccgagaugaucauccccaagaacuucgcgggccccgugagccagcacaacuaccgccccggguaccacacccagacggccggcccguggcaccuggggcggcuggagauggacuucgacuucugcgagggcaccaccgucguggugaccgaggacugcgggaaccgcggccccucccuccggacgaccaccgccagcggcaagcugaucaccgaguggugcugccgcagcugcacgcugccgccccuccgguaccgcggggaggacggcugcugguacgggauggagauccggccgcugaaggagaaggaggagaaccuggucaacucccucgugaccgccggccacgggcagaucgacaacuucagccugggcgugcugggcauggcccucuuccuggaggagaugcugcgcacccgggucgggaccaagcacgccauccuccugguggccguguccuucgucacgcugaucaccggcaacaugagcuuccgcgaccucgggcgcgugauggugauggucggcgccaccaugaccgacgacaucgggaugggcgugacguaccuggcccugcucgcggccuucaaggugcggcccaccuucgccgccggccugcugcuccgcaagcugaccuccaaggagcugaugaugaccacgaucgggaucguccuccugagccaguccaccauccccgagagcauccuggagcucaccgacgcccuggcgcugggcaugauggugcucaagaucguccggaacauggagaaguaccagcuggccgugaccaucauggccauccugugcgugcccaacgccgucauccuccagaacgccuggaagguguccugcacgacccuggcgguggucagcguguccccgcugcuccugaccagcucccagcagaaggccgacuggaucccccuggcccucaccaucaaggggcugaaccccacggccaucuuccugaccacccucagccgcaccuccaagaagcggagcuggccccugaacgaggcgaucauggccgugggcauggucuccauccuggccagcucccuccugaagaacgacaucccgaugacgggcccccugguggccgggggccuccugaccgugugcuacguccugaccgggcgcagcgccgaccucgagcuggagcgggcggccgacgugcgcugggaggagcaggccgagaucagcggcuccagccccauccuguccaucaccaucagcgaggacggguccaugagcaucaagaacgaggaggaggagcagacgcucaccauccugauccggaccggccugcucgugaucuccggccuguuccccgucagcaucccgaucaccgccgccgcgugguaccugugggaggugaagaagcagcgcgccggggugcucugggacguccccagcccgccgcccgugggcaaggccgagcuggaggacggggccuaccggaucaagcagaagggcauccugggguacagccagaucggcgccggcguguacaaggaggggaccuuccacacgauguggcacgucacccgcggcgcggugcucaugcacaaggggaagcggaucgagcccuccugggccgacgugaagaaggaccugaucagcuacggcgggggcuggaagcuggagggcgaguggaaggagggggaggagguccaggugcucgcccuggagcccggcaagaacccccgcgccgugcagaccaagcccgggcuguucaagaccaacacgggcaccaucggggccgucucccucgacuucagccccggcaccuccggcagccccaucguggacaagaaggggaagguggucggccuguacgggaacggcguggugacccgguccggcacguacgucagcgcgaucgcccagaccgagaaguccaucgaggacaacccggagaucgaggacgacaucuuccgcaagaagcggcugaccaucauggaccugcaccccggggccggcaagaccaagcgcuaccuccccgccaucgugcgggaggcgaucaagcgcgggcugcggacgcugauccucgcccccacccgcguggucgccgccgagauggaggaggcccugcgcggccugccgauccgguaccagacccccgcgauccgcgccgagcacaccgggcgggagaucguggaccucaugugccacgccacguucaccaugcgccugcugagccccauccgggugcccaacuacaaccucaucaucauggacgaggcccacuucaccgacccggccagcaucgcggcccgcggcuacaucuccacccgggucgagaugggcgaggccgccgggaucuucaugacggccacgccgcccggcagccgcgaccccuucccgcaguccaacgcgcccaucauggacgaggagaaggagauccccgagcggagcuggaacuccgggcacgagugggugaccgacuucaagggcaagaccgugugguucguccccagcaucaaggccgggaacgacaucgccgccugccugcgcaagaacggcaagaaggugauccagcugucccggaagacguucgacagcgaguacaucaagacccgcaccaacgacugggacuucguggucaccacggacaucuccgagaugggcgcgaacuucaaggccgagcgggugaucgacccgcgccggugcaugaagcccgugauccucaccgacggggaggagcgcgucauccuggccggccccaugcccgugacccacagcuccgccgcccagcggcgcgggcgggugggccgcaacccgaagaacgagaacgaccaguacaucuacaugggggagccccuggagaacgacgaggacugcgcgcacuggaaggaggccaagaugcuccuggacaacaucaacacccccgagggcaucauccccagcauguucgagccggagcgcgagaaggucgacgccaucgacggcgaguaccggcugcgcggggaggcccggaagacguucguggaccucaugcgccggggcgaccugcccgucuggcuggccuaccgcguggcggccgaggggaucaacuacgccgaccggcgcuggugcuucgacggcgugaagaacaaccagauccucgaggagaacgucgagguggagaucuggaccaaggagggggagcggaagaagcugaagccccgcuggcuggacgcccggaucuacuccgacccgcucgcccugaaggaguucaaggaguucgcggccggccgcaagagccugacccucaaccugaucaccgagaugggccggcugcccacguucaugacccagaaggccaagaacgcccucgacaaccuggcggugcugcacaccgccgaggccgggggccgcgccuacaaccacgcccucuccgagcugcccgagacccuggagacgcuccugcugcucacccugcuggcgaccgucaccgggggcaucuuccucuuccugaugagcggcaaggggaucggcaagaugacccuggggaugugcugcaucaucacggccuccauccuccugugguacgcccagauccagccccacuggaucgccgccagcaucauccuggaguucuuccucaucgugcugcugaucccggagcccgagaagcagcggacgccccaggacaaccagcucaccuacguggucaucgcgauccugaccgugguggccgccacgauggccaacgagaugggcuuccuggagaagaccaagaaggacuucgggcucggcuccaucaccacccagcagcccgagagcaacauccuggacaucgaccugcgcccggccagcgcguggacgcucuacgccgucgccaccaccuucaucacccccaugcugcggcacuccaucgagaacagcuccgugaacgugagccugacggccaucgccaaccaggcgaccguccucaugggccuggggaagggcuggccccuguccaagauggacaucggggugccccuccuggccaucggcugcuacagccaggugaacccgaucacccugaccgccgcccuccugcugcucgucgcgcacuacgccaucaucgggcccggccugcaggccaaggccacgcgcgaggcccagaagcgggcggccgccggcaucaugaagaaccccaccguggacgggaugaccgugaucgaccuggaccccaucccguacgaccccaaguucgagaagcagcucggccaggucaugcugcuggugcucugcgugacccagguccugaugaugcgcacgaccugggcccugugcgaggcccucacccuggcgaccgggcccaucuccacgcugugggagggcaaccccgggcgguucuggaacaccaccaucgccgugagcauggccaacaucuuccgcggcuccuaccucgccggcgccgggcugcuguucagcaucaugaagaacaccgcgaacacgcgccggggcaccgggaacaccggcgagacccucggcgagaaguggaagaaccgccugaacgcccuggggaaguccgaguuccagaucuacaagaaguccggcauccaggagguggaccggacgcucgccaaggaggggaucaagcgcggcgagaccgaccaccacgccgucagccgggggagcgcgaagcugcgcugguucguggagcggaaccuggugaccccggagggcaaggucguggaccucggcugcgggcgcggcgggugguccuacuacugcggcgggcugaagaacgugaaggaggucaagggccugaccaagggcgggcccggccacgaggagcccauccccaugagcacguacggguggaaccucgugcggcugcaguccggcguggacgucuucuucaccccgcccgagaagugcgacacccugcucugcgacaucggggagagcucccccaaccccaccguggaggccggccgcacccugcgggugcugaaccucgucgagaacuggcugaacaacaacacgcaguucugcaucaaggugcugaacccguacaugcccagcgugaucgagaagauggaggcccugcagcgcaaguacggcggggcccucguccggaacccccugagccgcaacuccacccacgagauguacugggugagcaacgccuccggcaacaucgugagcuccgucaacaugaucagccggaugcugaucaaccgcuucaccaugcggcacaagaaggcgaccuacgagccggacguggaccucggguccggcacgcgcaacaucgggaucgagagcgagacccccaaccuggacaucaucggcaagcggaucgagaagaucaagcaggagcacgagaccuccuggcacuacgaccaggaccaccccuacaagaccugggccuaccacggcagcuacgagacgaagcagaccggguccgccagcuccauggugaacggcgucgugcgccugcucaccaagcccugggacgugaucccgauggucacccagauggccaugacggacaccacccccuucgggcagcagcgcguguucaaggagaaggucgacacccggacgcaggagcccaaggagggcaccaagaagcugaugaagaucaccgccgaguggcuguggaaggagcucggcaagaagaagacgccccgcaugugcacgcgggaggaguucacccgcaaggugcggagcaacgcggcccugggggccaucuucaccgacgagaacaaguggaaguccgcccgcgaggccguggaggacagcggcuucugggagcuggucgacaaggagcggaaccuccaccuggaggggaagugcgagaccugcguguacaacaugaugggcaagcgcgagaagaagcugggggaguucggcaaggcgaagggcucccgggccaucugguacauguggcucggggcccgcuuccuggaguucgaggcccugggcuuccucaacgaggaccacugguucagccgggagaacucccugagcgggguggagggcgaggggcugcacaagcucggcuacauccugcgcgacgucagcaagaaggagggcggggcgauguacgccgacgacacggccggcugggacacccggaucacccuggaggaccucaagaacgaggagauggugaccaaccacauggagggggagcacaagaagcuggccgaggccaucuucaagcugacguaccagaacaaggugguccgcgugcagcggccgacgccccgcggcaccgugauggacaucaucucccggcgcgaccagcgggggagcggccaggucgugaccuacggccucaacaccuucaccaacauggaggcgcagcugauccgccagauggagggggagggcguguucaaguccauccagcagcugaccgucaaggaggagaucgccgugaaggacuggcucauccggguggggcgcgagcgccugagccggauggccaucuccggcgacgacugcgucgugaagccccuggacgaccgcuucgccagcgcccucaccgcgcugaacgacaugggcaaggugcggaaggacauccagcagugggagcccucccgcggguggaacgacuggacgcaggucccguucugcagccaccacuuccacgagcugaucaugaaggacggccgggugcucgugguccccugccgcaaccaggacgagcugaucgggcgggcccgcaucucccagggcgccggguggagccugcgggagaccgccugccucggcaaguccuacgcccagauguggagccugauguacuuccaccgccgggaccugcgccucgcggccaacgccaucugcuccgccgugcccagccacuggauccccaccucccggaccaccuggagcauccacgccacgcacgaguggaugaccaccgaggacaugcugaccguguggaaccgcgucuggauccaggagaacccguggauggaggacaagacgcccguggaguccugggaggagauccccuaccugggcaagcgggaggaccaguggugcgggagccucaucggccugaccagccgcgcgaccugggccaagaacauccagaccgccaucaaccaggugcggucccugaucgggaacgaggaguacacggacuacaugcccagcaugaagcgcuuccggcgcgaggaggaggaggccggcguccucugguga

SEQ ID NO: 9094 - RNA, 9876 nt, Artificial Sequence
  derived and/or modified CDS sequence (opt1) from DENV-2__KM279570__SS-prME
accgccgggaucaucaucaugaugauccccaccgugauggccuuccaccugaccacccggaacggggagccccacaugaucgucagccggcaggagaagggcaagagccuccuguucaagaccgagaacggggugaacaugugcacccugauggcgauggaccucggcgagcugugcgaggacaccaucaccuacaacugcccccugcuccgccagaacgagcccgaggacaucgacugcuggugcaacagcaccagcaccugggugaccuacgggaccugcaccgccaccggcgagcaccggcgcgagaagcggagcgucgcccuggugccccacgugggcauggggcuggagacccgcaccgagaccuggaugagcagcgagggcgccuggaagcacgcccagcggaucgagaccuggauccuccgccaccccggguucacgaucauggcggccauccuggccuacaccaucggcaccaccuacuuccagcggguccugaucuucauccuccugacggccgugacccccuccauggcgaugcgcugcaucgggaucagcaaccgggacuucguggagggcgucuccggcgggagcuggguggacaucgugcuggagcacggcuccugcgucaccaccauggccaagaacaagcccacgcucgacuucgagcugaucaagaccgaggccaagcaccuggccacccuccgcaaguacugcguggaggccaagcugaccaacacgaccaccgcgagccggugccccacccagggggagcccucccugaacgaggagcaggacaagcgcuucgugugcaagcacagcauggucgaccggggcuggggcaacgggugcggccucuucgggaagggcgggaucgugacgugcgccauguucacgugcaagaagaacauggagggcaaggugguccagcccgagaaccuggaguacaccaucgugaucacgccccacuccggcgaggagaacgccguggggaacgacacgggcaagcacgggaaggagaucaaggucacgccccagagcuccaucaccgaggccgagcugaccggcuacgggaccgugacgauggagugcagcccgcgcaccggccucgacuucaacgagauggugcugcugcagauggagaacaaggccuggcucguccaccggcagugguuccuggaccugccccuccccuggcugcccggcgcggacacccagggguccaacuggauccagaaggagacccuggugacguucaagaacccgcacgccaagaagcaggacgucguggugcucggcagccaggagggggccaugcacaccgcccugaccggcgccaccgagauccagaugagcuccgggaaccuccuguucacgggccaccugaagugccgccugcggauggacaagcuccagcugaagggcaugagcuacuccaugugcaccgggaaguucaaggucgugaaggagaucgcggagacccagcacggcaccaucgugauccgcguccaguacgagggggacggcagccccugcaagauccccuucgagaucauggaccuggagaagcggcacgugcucggccgccugaucacggugaaccccaucgucaccgagaaggacuccccggugaacaucgaggccgagccgcccuucggggacagcuacaucaucaucggcguggagcccgggcagcugaagcucuccugguucaagaagggcagcuccaucgggcagauguucgagaccaccaugcgcggcgccaagcggauggccauccugggcgacacggccugggacuucgggagccugggcggggucuucaccuccaucggcaaggcgcuccaccagguguucggggccaucuacggcgccgccuucagcggcguguccuggaccaugaagauccugaucggggucgugaucaccuggaucggcaugaacagccgcuccacgagccuguccgugagccugguccucguggggguggucacccuguaccugggcgugauggugcaggcggacuccgggugcgucgugagcuggaagaacaaggagcucaagugcggcagcggcaucuucaucaccgacaacgugcacaccuggacggagcaguacaaguuccagccggagucccccagcaagcuggccuccgccauccagaaggcccacgaggaggggaucugcggcauccggagcgucacccgccuggagaaccucauguggaagcagaucacccccgagcugaaccacauccugaccgagaacgaggugaagcucacgaucaugaccggggacaucaagggcaucaugcaggccgggaagcggucccugcgcccccagccgaccgagcugaaguacagcuggaaggcguggggcaaggccaagaugcucuccaccgagcugcacaaccacacguuccugaucgacggccccgagaccgccgagugccccaacaccaaccgggccuggaacagccucgagguggaggacuacggguucggcgucuucaccacgaacaucuggcugaagcugaaggagcgccaggacguguucugcgacuccaagcucaugagcgccgcgaucaaggacaaccgggccgugcacgccgacaugggguacuggaucgaguccgcccugaacgacaccuggaagaucgagaaggccagcuucaucgaggucaaguccugccacuggcccaagagccacacccugugguccaacggcgugcucgagagcgagaugaucauccccaagaacuucgcgggccccgugucccagcacaacuaccgccccggguaccacacccagaccgccggcccguggcaccuggggcggcuggagauggacuucgacuucugcgagggcacgaccgucgccgugaccgaggacugcgggaaccgcggccccagccuccggaccacgaccgccagcggcaagcugaucaccgaguggugcugccgcuccugcacccugccgccccuccgguaccgcggggaggacggcugcugguacgggauggagauccggccgcugaaggagaaggaggagaaccuggugaacagccucgucacggcgggccacgggcagaucgacaacuucucccugggcgugcugggcauggcccucuuccuggaggagaugcugcgcacccggguggggaccaagcacgccauccuccuggucgccgugagcuucgugacccugaucacgggcaacauguccuuccgcgaccucgggcgcgucauggugauggugggcgccaccaugaccgacgacaucgggaugggcgucaccuaccuggcgcugcucgccgccuucaaggugcggcccacguucgccgccggccugcugcuccgcaagcugaccagcaaggagcugaugaugaccaccaucgggaucgugcuccugucccagagcacgauccccgaguccauccuggagcucaccgacgcgcuggcccugggcaugaugguccucaagaucgugcggaacauggagaaguaccagcuggccgucaccaucauggccauccugugcgugcccaacgccgugauccuccagaacgcguggaaggucagcugcaccacgcuggccgugguguccgucagcccgcugcuccugaccuccagccagcagaaggccgacuggaucccccuggcccucaccaucaaggggcugaaccccaccgcgaucuuccugacgacccucucccgcaccagcaagaagcgguccuggccccugaacgaggccaucauggccgugggcauggugagcauccuggccuccagccuccugaagaacgacaucccgaugaccggcccccuggucgccgggggccuccugacggugugcuacgugcugaccgggcgcagcgcggaccucgagcuggagcgggccgccgacguccgcugggaggagcaggccgagaucuccggcagcucccccauccugagcaucaccaucuccgaggacgggagcauguccaucaagaacgaggaggaggagcagacccucacgauccugauccggaccggccugcucgugaucagcggccuguuccccguguccaucccgaucaccgccgcggccugguaccugugggaggucaagaagcagcgcgccggggugcucugggacgugcccuccccgccgcccgucggcaaggccgagcuggaggacggggccuaccggaucaagcagaagggcauccugggguacucccagaucggcgcgggcguguacaaggaggggaccuuccacaccauguggcacgugacgcgcggcgccguccucaugcacaaggggaagcggaucgagcccagcugggccgacgugaagaaggaccugaucuccuacggcgggggcuggaagcuggagggcgaguggaaggagggggaggaggugcagguccucgcccuggagcccggcaagaacccgcgcgccgugcagaccaagcccgggcuguucaagaccaacaccggcacgaucggggcggugagccucgacuucucccccggcaccagcggcucccccaucgucgacaagaaggggaagguggugggccuguacgggaacggcgucgugacccggagcggcaccuacguguccgccaucgcccagacggagaaguccaucgaggacaacccggagaucgaggacgacaucuuccgcaagaagcggcugaccaucauggaccugcaccccggggccggcaagaccaagcgcuaccuccccgcgaucguccgggaggccaucaagcgcgggcugcggacccugauccucgcccccacgcgcgugguggccgccgagauggaggaggcgcugcgcggccugccgauccgguaccagacccccgccauccgcgccgagcacaccgggcgggagaucgucgaccucaugugccacgccaccuucacgaugcgccugcugagccccauccgggugcccaacuacaaccucaucaucauggacgaggcccacuucaccgacccggcguccaucgccgcccgcggcuacaucagcacccggguggagaugggcgaggccgccgggaucuucaugaccgcgacgccgcccggcucccgcgaccccuucccgcagagcaacgcccccaucauggacgaggagcgggagauccccgagcgcuccuggaacagcgggcacgagugggucaccgacuucaagggcaagaccgugugguucgugcccuccaucaaggccgggaacgacaucgccgcgugccugcggaagaacggcaagaaggucauccagcugagccgcaagaccuucgacuccgaguacaucaagacgcggaccaacgacugggacuucguggugaccaccgacaucagcgagaugggcgccaacuucaaggccgagcgcgucaucgacccgcggcgcugcaugaagcccgugauccucacggacggggaggagcgggugauccuggccggccccaugcccgucacccacuccagcgccgcgcagcgccgggggcgcgugggccgcaacccgaagaacgagaacgaccaguacaucuacaugggggagccccuggagaacgacgaggacugcgcccacuggaaggaggccaagaugcuccuggacaacaucaacacccccgagggcaucauccccuccauguucgagccggagcgggagaagguggacgccaucgacggcgaguaccgccugcgcggggaggcccgcaagaccuucgucgaccucaugcggcgcggcgaccugcccguguggcuggcguaccgggucgccgccgaggggaucaacuacgccgaccgccgguggugcuucgacggcgugaagaacaaccagauccucgaggagaacguggaggucgagaucuggacgaaggagggggagcgcaagaagcugaagccccgguggcuggacgcccgcaucuacagcgacccgcucgcgcugaaggaguucaaggaguucgccgccggccggaagucccugacccucaaccugaucaccgagaugggccgccugcccaccuucaugacgcagaaggccaagaacgcgcucgacaaccuggccgugcugcacaccgccgaggccgggggccgggccuacaaccacgcgcucagcgagcugcccgagacccuggagacccuccugcugcucacgcugcuggccaccgugaccgggggcaucuuccucuuccugauguccggcaaggggaucggcaagaugacccuggggaugugcugcaucaucaccgccagcauccuccugugguacgcccagauccagccccacuggaucgccgcguccaucauccuggaguucuuccucaucguccugcugaucccggagcccgagaagcagcgcacgccccaggacaaccagcucaccuacguggugaucgccauccugaccgucguggccgccaccauggccaacgagaugggcuuccuggagaagacgaagaaggacuucgggcucggcagcaucaccacccagcagcccgagagcaacauccuggacaucgaccugcggccggcguccgccuggacccucuacgccguggccacgaccuucaucacccccaugcugcgccacagcaucgagaacuccagcgucaacgugucccugaccgccaucgcgaaccaggccacggugcucaugggccuggggaagggcuggccccugagcaagauggacaucggggucccccuccuggccaucggcugcuacucccaggugaacccgaucacccugaccgccgcgcuccugcugcucguggcccacuacgccaucaucgggcccggccugcaggccaaggccacccgggaggcgcagaagcgcgccgccgccggcaucaugaagaaccccacggucgacgggaugaccgugaucgaccuggaccccaucccguacgaccccaaguucgagaagcagcucggccaggugaugcugcugguccucugcgugacccaggugcugaugaugcggaccacgugggcccugugcgaggcgcucacccuggccaccgggcccaucagcacccugugggagggcaaccccgggcgcuucuggaacacgaccaucgccgucuccauggccaacaucuuccgcggcagcuaccucgccggcgcggggcugcuguucuccaucaugaagaacaccgccaacacccggcgcggcacggggaacaccggcgagacccucggcgagaaguggaagaaccggcugaacgcccugggcaagagcgaguuccagaucuacaagaaguccggcauccaggagguggaccgcacccucgccaaggaggggaucaagcggggcgagacggaccaccacgcggugagccgcggguccgccaagcugcggugguucgucgagcgcaaccuggugaccccggagggcaagguggucgaccucggcugcgggcggggcggguggagcuacuacugcggcgggcugaagaacgugaaggaggugaagggccugaccaagggcgggcccggccacgaggagcccauccccauguccaccuacggguggaaccucguccgccugcagagcggcguggacguguucuucacgccgcccgagaagugcgacacccugcucugcgacaucggggaguccagccccaaccccaccgucgaggccggccggacccugcgcgugcugaaccucguggagaacuggcugaacaacaacacccaguucugcaucaagguccugaacccguacaugcccagcgugaucgagaagauggaggcccugcagcggaaguacggcggggcccucgugcgcaacccccugucccggaacagcacgcacgagauguacugggucuccaacgcgagcggcaacaucguguccagcgugaacaugaucucccgcaugcugaucaaccgguucaccaugcgccacaagaaggccaccuacgagccggacgucgaccucgggagcggcacccggaacaucgggaucgaguccgagacgcccaaccuggacaucaucggcaagcgcaucgagaagaucaagcaggagcacgagaccagcuggcacuacgaccaggaccaccccuacaagaccugggccuaccacggcuccuacgagaccaagcagacggggagcgccuccagcauggugaacggcgugguccgccugcucaccaagcccugggacgugaucccgauggugacccagauggccaugaccgacacgacccccuucgggcagcagcgggucuucaaggagaagguggacacccgcacccaggagcccaaggagggcacgaagaagcugaugaagaucaccgcggaguggcuguggaaggagcucggcaagaagaagacgccccggaugugcacccgcgaggaguucacgcggaagguccgcuccaacgccgcccugggggccaucuucaccgacgagaacaaguggaaguccgcccgggaggcgguggaggacuccggcuucugggagcugguggacaaggagcgcaaccuccaccuggaggggaagugcgagaccugcgucuacaacaugaugggcaagcgggagaagaagcugggggaguucggcaaggccaagggcagccgcgccaucugguacauguggcucggggcccgguuccuggaguucgaggcgcugggcuuccucaacgaggaccacugguucucccgcgagaacagccugagcgggguggagggcgaggggcugcacaagcucggcuacauccugcgggacguguccaagaaggagggcggggccauguacgccgacgacaccgccggcugggacacgcgcaucacccuggaggaccucaagaacgaggagauggucaccaaccacauggagggggagcacaagaagcuggccgaggcgaucuucaagcugaccuaccagaacaagguggugcggguccagcgcccgacgccccggggcaccgugauggacaucaucagccgccgggaccagcgcggguccggccagguggucaccuacggccucaacaccuucacgaacauggaggcccagcugauccggcagauggagggggagggcguguucaagagcauccagcagcugaccgugaaggaggagaucgccgucaagaacuggcucauccgcguggggcgcgagcggcugucccgcauggccaucagcggcgacgacugcguggucaagccccuggacgaccgguucgccuccgcgcucaccgcccugaacgacaugggcaaggugcgcaaggacauccagcagugggagcccagccggggguggaacgacuggacccaggugccguucugcucccaccacuuccacgagcugaucaugaaggacggccgcguccucguggugcccugccggaaccaggacgagcugaucgggcgcgcccggaucagccagggcgccggguggucccugcgcgagacggccugccucggcaagagcuacgcgcagauguggucccugauguacuuccaccggcgcgaccugcggcucgccgccaacgccaucugcagcgccguccccucccacuggauccccaccagccgcaccaccugguccauccacgcgacccacgaguggaugacgaccgaggacaugcugaccguguggaaccggguguggauccaggagaacccguggauggaggacaagacccccgucgagagcugggaggagauccccuaccugggcaagcgcgaggaccaguggugcgggagccucaucggccugacgucccgggccaccugggccaagaacauccagaccgccaucaaccaggugcgcagccugaucgggaacgaggaguacaccgacuacaugcccuccaugaagcgguuccgccgcgaggaggaggaggcgggcgugcucugguga

SEQ ID NO: 9095 - RNA, 9876 nt, Artificial Sequence
  derived and/or modified CDS sequence (opt1) from DENV-2__KM279596__SS-prME
accgccgggaucaucaucaugaugauccccaccgugauggccuuccaccugaccacccggaacggggagccccacaugaucgucagccggcaggagaagggcaagagccuccuguucaagaccgagaacggggugaacaugugcacccugauggcgauggaccucggcgagcugugcgaggacaccaucaccuacaacugcccccugcuccgccagaacgagcccgaggacaucgacugcuggugcaacagcaccagcaccugggugaccuacgggaccugcaccgccaccggcgagcaccggcgcgagaagcggagcgucgcccuggugccccacgugggcauggggcuggagacccgcaccgagaccuggaugagcagcgagggcgccuggaagcacgcccagcggaucgagaccuggauccuccgccaccccggguucacgaucauggcggccauccuggccuacaccaucggcaccaccuacuuccagcggguccugaucuucauccuccugacggccgugacccccuccauggcgaugcgcugcaucgggaucagcaaccgggacuucguggagggcgucuccggcgggagcuggguggacaucgugcuggagcacggcuccugcgucaccaccauggccaagaacaagcccacgcucgacuucgagcugaucaagaccgaggccaagcaccuggccacccuccgcaaguacugcguggaggccaagcugaccaacacgaccaccgcgagccggugccccacccagggggagcccucccugaacgaggagcaggacaagcgcuucgugugcaagcacagcauggucgaccggggcuggggcaacgggugcggccucuucgggaagggcgggaucgugacgugcgccauguucacgugcaagaagaacauggagggcaaggugguccagcccgagaaccuggaguacaccaucgugaucacgccccacuccggcgaggagaacgccguggggaacgacacgggcaagcacgggaaggagaucaaggucacgccccagagcuccaucaccgaggccgagcugaccggcuacgggaccgugacgauggagugcagcccgcgcaccggccucgacuucaacgagauggugcugcugcagauggagaacaaggccuggcucguccaccggcagugguuccuggaccugccccuccccuggcugcccggcgcggacacccagggguccaacuggauccagaaggagacccuggugacguucaagaacccgcacgccaagaagcaggacgucguggugcucggcagccaggagggggccaugcacaccgcccugaccggcgccaccgagauccagaugagcuccgggaaccuccuguucacgggccaccugaagugccgccugcggauggacaagcuccagcugaagggcaugagcuacuccaugugcaccgggaaguucaaggucgugaaggagaucgcggagacccagcacggcaccaucgugauccgcguccaguacgagggggacggcagccccugcaagauccccuucgagaucauggaccuggagaagcggcacgugcucggccgccugaucacggugaaccccaucgucaccgagaaggacuccccggugaacaucgaggccgagccgcccuucggggacagcuacaucaucaucggcguggagcccgggcagcugaagcucuccugguucaagaagggcagcuccaucgggcagauguucgagaccaccaugcgcggcgccaagcggauggccauccugggcgacacggccugggacuucgggagccugggcggggucuucaccuccaucggcaaggcgcuccaccagguguucggggccaucuacggcgccgccuucagcggcguguccuggaccaugaagauccugaucggggucgugaucaccuggaucggcaugaacagccgcuccacgagccuguccgugagccugguccucguggggguggucacccuguaccugggcgugauggugcaggcggacuccgggugcgucgugagcuggaagaacaaggagcucaagugcggcagcggcaucuucaucaccgacaacgugcacaccuggacggagcaguacaaguuccagccggagucccccagcaagcuggccuccgccauccagaaggcccacgaggaggggaucugcggcauccggagcgucacccgccuggagaaccucauguggaagcagaucacccccgagcugaaccacauccugaccgagaacgaggugaagcucacgaucaugaccggggacaucaagggcaucaugcaggccgggaagcggucccugcgcccccagccgaccgagcugaaguacagcuggaaggcguggggcaaggccaagaugcucuccaccgagcugcacaaccacacguuccugaucgacggccccgagaccgccgagugccccaacaccaaccgggccuggaacagccucgagguggaggacuacggguucggcgucuucaccacgaacaucuggcugaagcugaaggagcgccaggacguguucugcgacuccaagcucaugagcgccgcgaucaaggacaaccgggccgugcacgccgacaugggguacuggaucgaguccgcccugaacgacaccuggaagaucgagaaggccagcuucaucgaggucaaguccugccacuggcccaagagccacacccugugguccaacggcgugcucgagagcgagaugaucauccccaagaacuucgcgggccccgugucccagcacaacuaccgccccggguaccacacccagaccgccggcccguggcaccuggggcggcuggagauggacuucgacuucugcgagggcacgaccgucgccgugaccgaggacugcgggaaccgcggccccagccuccggaccacgaccgccagcggcaagcugaucaccgaguggugcugccgcuccugcacccugccgccccuccgguaccgcggggaggacggcugcugguacgggauggagauccggccgcugaaggagaaggaggagaaccuggugaacagccucgucacggcgggccacgggcagaucgacaacuucucccugggcgugcugggcauggcccucuuccuggaggagaugcugcgcacccggguggggaccaagcacgccauccuccuggucgccgugagcuucgugacccugaucacgggcaacauguccuuccgcgaccucgggcgcgucauggugauggugggcgccaccaugaccgacgacaucgggaugggcgucaccuaccuggcgcugcucgccgccuucaaggugcggcccacguucgccgccggccugcugcuccgcaagcugaccagcaaggagcugaugaugaccaccaucgggaucgugcuccugucccagagcacgauccccgaguccauccuggagcucaccgacgcgcuggcccugggcaugaugguccucaagaucgugcggaacauggagaaguaccagcuggccgucaccaucauggccauccugugcgugcccaacgccgugauccuccagaacgcguggaaggucagcugcaccacgcuggccgugguguccgucagcccgcugcuccugaccuccagccagcagaaggccgacuggaucccccuggcccucaccaucaaggggcugaaccccaccgcgaucuuccugacgacccucucccgcaccagcaagaagcgguccuggccccugaacgaggccaucauggccgugggcauggugagcauccuggccuccagccuccugaagaacgacaucccgaugaccggcccccuggucgccgggggccuccugacggugugcuacgugcugaccgggcgcagcgcggaccucgagcuggagcgggccgccgacguccgcugggaggagcaggccgagaucuccggcagcucccccauccugagcaucaccaucuccgaggacgggagcauguccaucaagaacgaggaggaggagcagacccucacgauccugauccggaccggccugcucgugaucagcggccuguuccccguguccaucccgaucaccgccgcggccugguaccugugggaggucaagaagcagcgcgccggggugcucugggacgugcccuccccgccgcccgucggcaaggccgagcuggaggacggggccuaccggaucaagcagaagggcauccugggguacucccagaucggcgcgggcguguacaaggaggggaccuuccacaccauguggcacgugacgcgcggcgccguccucaugcacaaggggaagcggaucgagcccagcugggccgacgugaagaaggaccugaucuccuacggcgggggcuggaagcuggagggcgaguggaaggagggggaggaggugcagguccucgcccuggagcccggcaagaacccgcgcgccgugcagaccaagcccgggcuguucaagaccaacaccggcacgaucggggcggugagccucgacuucucccccggcaccagcggcucccccaucgucgacaagaaggggaagguggugggccuguacgggaacggcgucgugacccggagcggcaccuacguguccgccaucgcccagacggagaaguccaucgaggacaacccggagaucgaggacgacaucuuccgcaagaagcggcugaccaucauggaccugcaccccggggccggcaagaccaagcgcuaccuccccgcgaucguccgggaggccaucaagcgcgggcugcggacccugauccucgcccccacgcgcgugguggccgccgagauggaggaggcgcugcgcggccugccgauccgguaccagacccccgccauccgcgccgagcacaccgggcgggagaucgucgaccucaugugccacgccaccuucacgaugcgccugcugagccccauccgggugcccaacuacaaccucaucaucauggacgaggcccacuucaccgacccggcguccaucgccgcccgcggcuacaucagcacccggguggagaugggcgaggccgccgggaucuucaugaccgcgacgccgcccggcucccgcgaccccuucccgcagagcaacgcccccaucauggacgaggagcgggagauccccgagcgcuccuggaacagcgggcacgagugggucaccgacuucaagggcaagaccgugugguucgugcccuccaucaaggccgggaacgacaucgccgcgugccugcggaagaacggcaagaaggucauccagcugagccgcaagaccuucgacuccgaguacaucaagacgcggaccaacgacugggacuucguggugaccaccgacaucagcgagaugggcgccaacuucaaggccgagcgcgucaucgacccgcggcgcugcaugaagcccgugauccucacggacggggaggagcgggugauccuggccggccccaugcccgucacccacuccagcgccgcgcagcgccgggggcgcgugggccgcaacccgaagaacgagaacgaccaguacaucuacaugggggagccccuggagaacgacgaggacugcgcccacuggaaggaggccaagaugcuccuggacaacaucaacacccccgagggcaucauccccuccauguucgagccggagcgggagaagguggacgccaucgacggcgaguaccgccugcgcggggaggcccgcaagaccuucgucgaccucaugcggcgcggcgaccugcccguguggcuggcguaccgggucgccgccgaggggaucaacuacgccgaccgccgguggugcuucgacggcgugaagaacaaccagauccucgaggagaacguggaggucgagaucuggacgaaggagggggagcgcaagaagcugaagccccgguggcuggacgcccgcaucuacagcgacccgcucgcgcugaaggaguucaaggaguucgccgccggccggaagucccugacccucaaccugaucaccgagaugggccgccugcccaccuucaugacgcagaaggccaagaacgcgcucgacaaccuggccgugcugcacaccgccgaggccgggggccgggccuacaaccacgcgcucagcgagcugcccgagacccuggagacccuccugcugcucacgcugcuggccaccgugaccgggggcaucuuccucuuccugauguccggcaaggggaucggcaagaugacccuggggaugugcugcaucaucaccgccagcauccuccugugguacgcccagauccagccccacuggaucgccgcguccaucauccuggaguucuuccucaucguccugcugaucccggagcccgagaagcagcgcacgccccaggacaaccagcucaccuacguggugaucgccauccugaccgucguggccgccaccauggccaacgagaugggcuuccuggagaagacgaagaaggacuucgggcucggcagcaucgcgacccagcagcccgagagcaacauccuggacaucgaccugcggccggccuccgccuggacccucuacgccguggccaccacguucaucacccccaugcugcgccacagcaucgagaacuccagcgucaacgugucccugaccgcgaucgccaaccaggccaccgugcucaugggccuggggaagggcuggccccugagcaagauggacaucggggucccccuccuggccaucggcugcuacucccaggugaacccgaucacgcugaccgcggcccuccugcugcucguggcccacuacgccaucaucgggcccggccugcaggccaaggcgacccgggaggcccagaagcgcgccgccgccggcaucaugaagaaccccaccgucgacgggaugacggugaucgaccuggaccccaucccguacgaccccaaguucgagaagcagcucggccaggugaugcugcugguccucugcgugacccaggugcugaugaugcggaccaccugggcgcugugcgaggcccucacgcuggccaccgggcccaucagcacccugugggagggcaaccccgggcgcuucuggaacaccacgaucgccgucuccauggccaacaucuuccgcggcagcuaccucgcgggcgccgggcugcuguucuccaucaugaagaacaccgccaacacccggcgcggcaccgggaacacgggcgagacccucggcgagaaguggaagaaccggcugaacgcccugggcaagagcgaguuccagaucuacaagaaguccggcauccaggagguggaccgcacccucgcgaaggaggggaucaagcggggcgagaccgaccaccacgccgugagccgcggguccgccaagcugcggugguucgucgagcgcaaccuggugacgccggagggcaagguggucgaccucggcugcgggcggggcggguggagcuacuacugcggcgggcugaagaacgugaaggaggugaagggccugaccaagggcgggcccggccacgaggagcccauccccauguccaccuacggguggaaccucguccgccugcagagcggcguggacguguucuucaccccgcccgagaagugcgacacgcugcucugcgacaucggggaguccagccccaaccccaccgucgaggccggccggacccugcgcgugcugaaccucguggagaacuggcugaacaacaacacccaguucugcaucaagguccugaacccguacaugcccagcgugaucgagaagauggaggcccugcagcggaaguacggcggggcgcucgugcgcaacccccugucccggaacagcacccacgagauguacugggucuccaacgccagcggcaacaucguguccagcgugaacaugaucucccgcaugcugaucaaccgguucacgaugcgccacaagaaggccaccuacgagccggacgucgaccucgggagcggcacccggaacaucgggaucgaguccgagacccccaaccuggacaucaucggcaagcgcaucgagaagaucaagcaggagcacgagacgagcuggcacuacgaccaggaccaccccuacaagaccugggccuaccacggcuccuacgagaccaagcagaccgggagcgccuccagcauggugaacggcgugguccgccugcucacgaagcccugggacgugaucccgauggugacccagauggcgaugaccgacaccacgcccuucgggcagcagcgggucuucaaggagaagguggacacccgcacccaggagcccaaggagggcaccaagaagcugaugaagaucacggccgaguggcuguggaaggagcucggcaagaagaagacgccccggaugugcacccgcgaggaguucacccggaagguccgcuccaacgccgcccugggggccaucuucacggacgagaacaaguggaaguccgcgcgggaggccguggaggacuccggcuucugggagcugguggacaaggagcgcaaccuccaccuggaggggaagugcgagaccugcgucuacaacaugaugggcaagcgggagaagaagcugggggaguucggcaaggccaagggcagccgcgccaucugguacauguggcucggggcgcgguuccuggaguucgaggcccugggcuuccucaacgaggaccacugguucucccgcgagaacagccugagcgggguggagggcgaggggcugcacaagcucggcuacauccugcgggacguguccaagaaggagggcggggccauguacgccgacgacaccgccggcugggacacccgcaucacgcuggaggaccucaagaacgaggagauggucaccaaccacauggagggggagcacaagaagcuggcggaggccaucuucaagcugaccuaccagaacaagguggugcggguccagcgcccgacgccccggggcaccgugauggacaucaucagccgccgggaccagcgcggguccggccagguggucaccuacggccucaacaccuucaccaacauggaggcccagcugauccggcagauggagggggagggcguguucaagagcauccagcagcugacggugaaggaggagaucgccgucaagaacuggcucauccgcguggggcgcgagcggcugucccgcauggccaucagcggcgacgacugcguggucaagccccuggacgaccgguucgcguccgcccucaccgcccugaacgacaugggcaaggugcgcaaggacauccagcagugggagcccagccggggguggaacgacuggacccaggugccguucugcucccaccacuuccacgagcugaucaugaaggacggccgcguccucguggugcccugccggaaccaggacgagcugaucgggcgcgcccggaucagccagggcgccggguggucccugcgcgagaccgcgugccucggcaagagcuacgcccagauguggucccugauguacuuccaccggcgcgaccugcggcucgccgccaacgccaucugcagcgcgguccccucccacuggauccccacgagccgcaccaccugguccauccacgccacccacgaguggaugaccacggaggacaugcugaccguguggaaccggguguggauccaggagaacccguggauggaggacaagacccccgucgagagcugggaggagauccccuaccugggcaagcgcgaggaccaguggugcgggagccucaucggccugaccucccgggccacgugggccaagaacauccagaccgcgaucaaccaggugcgcagccugaucgggaacgaggaguacaccgacuacaugcccuccaugaagcgguuccgccgcgaggaggaggaggccggcgugcucugguga

SEQ ID NO: 9096 - RNA, 9876 nt, Artificial Sequence
  derived and/or modified CDS sequence (opt1) from DENV-2__FJ850072__SS-prME
accgccggcgugaucaucaugcugauccccaccgccauggcguuccaccucaccacccgcaacggggagccccacaugaucgucggccggcaggagaaggggaagucccugcuguucaagaccgaggacggcgugaacaugugcacccucauggccauggaccugggggagcugugcgaggacaccaucaccuacaagugcccccuccugcgccagaacgagcccgaggacaucgacugcuggugcaacagcaccagcaccugggugaccuacgggaccugcaccaccacgggcgagcaccggcgcgagaagcgguccgucgcccuggugccccacguggggaugggccucgagacccgcaccgagaccuggaugagcagcgagggggccuggaagcacguccagcggaucgagaccuggauccugcgccacccgggcuucgccaucauggcggccauccuggccuacaccaucgggaccacccacuuccagcgggcccucaucuucauccugcugaccgcgguggcccccagcaugaccaugcgcugcaucggcaucagcaaccgggacuucguggagggcgucagcgggggcuccuggguggacaucgugcucgagcacgggagcugcgucaccaccauggccaagaacaagcccacgcuggacuucgagcugaucaagaccgaggccaagcagcccgccacccuccgcaaguacugcaucgaggcgaagcugaccaacacgaccaccgagucccggugcccgacccagggcgagcccagccugaacgaggagcaggacaagcgcuucaucugcaagcacuccaugguggaccggggcugggggaacggcugcggccucuucggcaagggcgggaucgugacgugcgccauguucacgugcaagaagaacauggagggcaaggucgugcugcccgagaaccuggaguacaccaucgugaucacgccccacagcggggaggagcacgccgucggcaacgacacggggaagcacggcgaggagaucaagaucaccccgcaguccagcaucaccgaggccgagcucaccggguacggcaccgugacgauggagugcagcccccggaccggccuggacuucaacgagauggugcugcuccagauggaggagaaggccuggcugguccaccggcagugguuccuggaccucccccugcccuggcugccgggggcggacacccagggcagcaacuggauccagaaggagacccucgugacguucaagaacccccacgccaagaagcaggacguggucgugcuggggucccaggagggcgccaugcacaccgcccugaccggggccaccgagauccagaugagcagcggcaaccuccuguucacgggccaccugaagugccgccuccggauggacaagcugcagcugaaggggauguccuacagcaugugcaccggcaaguucaagaucgucaaggagaucgcggagacccagcacgggaccaucgugauccgcgugcaguacgagggcgacggcucccccugcaagauccccuucgagaucauggaccucgagaagcggcacgcccuggggcgccugaucacggucaacccgaucgugaccgagaaggacagccccgugaacaucgaggccgagccgcccuucggcgacuccuacaucaucaucggggucgagccgggccagcucaagcugaacugguucaagaaggggagcuccaucggccagauguucgagaccaccaugcgcggcgccaagcggauggccauccugggggacacggcgugggacuucggcagccucgggggcguguucaccuccaucgggaaggcccugcaccagguguucggcgccaucuacggcgccgcguucagcggggucuccuggaccaugaagauccugaucggcgugaucaucaccuggaucgggaugaacagccgcuccacgagccuguccgugagccucguccuggugggcguggucacccuguaccucggggccauggugcaggccgacuccggcugcguggucagcuggaagaacaaggagcugaagugcggcuccgggaucuucaucaccgacaacgugcacaccuggacggagcaguacaaguuccagcccgagagccccagcaagcuggccuccgccauccagaaggcgcacgaggagggcaucugcgggauccggagcgugacccgccucgagaaccugauguggaagcagaucacccccgagcugaaccacauccucuccgagaacgaggucaagcugaccaucaugacgggcgacaucaaggggaucaugcaggccggcaagcggagccugcgcccgcagcccaccgagcucaaguacuccuggaagaccuggggcaaggccaagaugcugagcaccgagucccacaaccagacguuccugaucgacgggcccgagaccgccgagugcccgaacaccaaccgggccuggaacagccucgagguggaggacuacggcuucgggguguucaccacgaacaucuggcugaagcugcgcgagaagcaggacgucuucugcgacuccaagcucaugagcgcggccaucaaggacaaccgggccgugcacgccgacaugggcuacuggaucgaguccgcccugaacgacaccuggaagauggagaaggcgagcuucaucgaggugaaguccugccacuggcccaagagccacacccugugguccaacggcguccucgagagcgagaugaucauccccaagaacuucgccgggcccgugucccagcacaacuaccgcccgggcuaccacacccagaccgccgggcccuggcaccugggcaagcuggagauggacuucgacuucugcgaggggacgaccguggucgugaccgaggacugcggcaaccggggccccagccuccgcaccacgaccgccagcgggaagcugaucaccgaguggugcugccgguccugcacccugcccccgcuccgcuaccggggcgaggacgggugcugguacggcauggagauccgcccccugaaggagaaggaggagaaccuggugaacagccucgucacggcggggcacggccagaucgacaacuucucccugggcgugcuggggauggcccucuuccuggaggagaugcugcggacccgcgugggcaccaagcacgccauccuccuggucgccgugagcuucgugacccugaucacggggaacauguccuuccgggaccucggccgcgucauggugauggugggggucgccaugaccgacgacaucggcaugggcgugaccuaccuggcgcugcucgccgccuucaaggugcgccccaccuucgccgccgggcugcugcuccggaagcugacgagcaaggagcugaugauggcgaccaucggcaucacccuccugucccagagcaccauccccgagacgauccuggagcucaccgacgcccuggcccuggggaugaugguccucaagaucgugcgcaacauggagaaguaccagcuggccgugaccaucaugaccaucuccugcgucccgaacgccaugauccugcucaacgcguggaaggugagcugcacgauccuggccguggucuccgugagcccccugcuccugaccuccagccagcagaagaccgacuggaucccccuggcccucaccaucaagggccugaaccccacggccaucuuccugaccacccucucccggaccagcaagaagcgcuccuggccgcugaacgaggcggucauggccgugggcauggugagcauccuggccuccagccuccugaagaacgacauccccaugacggggccccuggucgccggcgggcuccugaccgugugcuacgugcugaccggccggagcgccgaccucgagcuggagcgcgcgaccgacgucaagugggaggaccaggccgagaucuccgggagcucccccauccugagcaucacgaucuccgaggacggcagcauguccaucaagaacgaggaggaggagcagacccucaccauccugauccggaccggccugcucgugaucagcgggguguucccggucuccauccccaucaccgccgccgccugguaccugugggaggugaagaagcagcgcgcgggcgugcugugggacguccccagcccgccgcccguggagaaggccgagcucgaggacggggccuaccggaucaagcagcgcggcauccugggguacucccagaucggcgccggcguguacaaggaggggacguuccacaccauguggcacgucacccggggcgccgugcugaugcaccgcgggaagcggaucgagcccagcugggcggacgugaagaaggaccucaucuccuacggcgggggcuggaagcuggagggcgaguggaaggagggggaggagguccaggugcuggcccucgagcccggcaagaacccccgcgccgugcagaccaagcccgggcuguucaagacgaacaccggcaccaucggggccgucagccuggacuucucccccggcaccagcggcucccccaucguggaccggaaggggaagguggucggccucuacgggaacggcguggugacgcgcagcggcgccuacgucuccgcgaucgcccagaccgagaaguccaucgaggacaaccccgagaucgaggacgacaucuuccggaagaagcgccugaccaucauggaccugcaccccggggccggcaagaccaagcgguaccugcccgccaucgugcgcgaggcgaucaagcgggggcuccgcacgcugauccuggccccgacccgcguggucgccgccgagauggaggaggcccuccggggccugcccauccgcuaccagacccccgcgauccgggccgagcacaccgggcgcgagaucguggaccugaugugccacgccacguucaccaugcggcuccugagccccgugcgcgucccgaacuacaaccugaucaucauggacgaggcccacuucaccgaccccgccuccaucgcggcccggggcuacaucagcacccgcguggagaugggcgaggccgccgggaucuucaugacggccacgccgcccggcucccgggacccguucccccagagcaacgcgcccaucauggacgaggagcgcgagauccccgagcgguccuggaacagcgggcacgagugggugaccgacuucaagggcaagaccgucugguucgugccguccaucaaggccgggaacgacaucgccgccugccuccgcaagaacggcaagaaggugauccagcugagccggaagacguucgacuccgaguacgucaagacccgcgcgaacgacugggacuucguggugaccaccgacaucagcgagaugggcgccaacuuccgggccgagcgcgucaucgacccccggcgcugcaugaagcccgugauccugacggacggggaggagcgggugauccucgccggccccaugccggucacccacuccagcgccgcgcagcgccgcgggcgggugggccgcaaccccaagaacgagaacgaccaguacaucuacaugggggagccccuggagaacgacgaggacugcgcccacuggaaggaggccaagaugcugcucgacaacaucaacacccccgagggcaucaucccguccauguucgagcccgagcgggagaagguggacgccaucgacggcgaguaccgccugcgcggggaggcccgcaagaccuucgucgaccugaugcggcgcggcgaccuccccguguggcuggcguaccggguggccgccgaggggaucaacuacgccgaccgccgguggugcuucgacggcaucaagaacaaccagauccuggaggagaacgucgagguggagaucuggacgaaggagggggagcgcaagaagcucaagccgcgguggcuggacgcccgcaucuacagcgacccccuggcgcucaaggaguucaaggaguucgccgccggccggaagucccugacccugaaccucaucaccgagaugggccgccugcccaccuucaugacgcagaaggcccggaacgcgcuggacaaccucgccguccugcacaccgccgaggccgggggccgcgccuacaaccacgcgcugagcgagcuccccgagacccuggagacccugcuccugcugacgcuccuggccaccgugaccgggggcaucuuccuguuccucauguccggcaaggggaucggcaagaugacccuggggaugugcugcaucaucaccgccagcauccugcucugguacgcccagauccagccgcacuggaucgccgcguccaucauccuggaguucuuccugaucgugcuccugauccccgagcccgagaagcagcggacgccccaggacaaccagcugaccuacgucgugaucgccauccucaccguggucgccgccaccauggccaacgagaugggcuuccuggagaagacgaagaaggaccuggggcucggcagcaucaccacccaggagagcgaguccaacauccuggacaucgaccugcgcccggcgagcgccuggacccucuacgccguggccacgaccuucaucacccccaugcugcggcacuccaucgagaacagcuccgugaacgucagccugaccgccaucgcgaaccaggccacggugcucaugggccuggggaagggcuggccccuguccaagauggacaucggggugccccuccuggccaucggcugcuacagccaggucaacccgaucacccugaccgccgcgcuccugucccugguggcccacuacgccaucaucgggcccggccuccaggccaaggccacccgcgaggcgcagaagcgcgccgccgccggcaucaugaagaaccccacgguggacgggaucaccgucaucgaccuggagcccaucccguacgaccccaaguucgagaagcagcugggccaggugaugcuccugauccugugcgugacccagguccucaugaugcggaccacgugggcccugugcgaggcgcugacccucgccaccgggcccaucagcacccugugggagggcaaccccgggcgcuucuggaacacgaccaucgccguguccauggccaacaucuuccggggcagcuaccuggccggcgcggggcuccuguucuccaucaugaagaacaccaccaacacgcgccggggcaccgggaacaucggcgagacccugggcgagaaguggaagucccgccucaacgcccuggggaaguccgaguuccagaucuacaagcggagcggcauccaggagguggaccgcacccuggccaaggaggggaucaagcggggcgagacggaccaccacgccgucucccgcgggagcgcgaagcuccggugguucguggagcgcaacauggugaccccggagggcaaggucguggaccugggcugcgggcggggcgggugguccuacuacugcggcgggcugaagaacgugcgcgaggucaagggccucaccaagggcgggcccggccacgaggagcccauccccaugagcaccuacggguggaaccuggugcggcugcagagcggcguggacgucuucuucacgccgcccgagaagugcgacacccuccugugcgacaucggggaguccagccccaaccccaccaucgaggccggccgcacccugcgggugcucaaccugguggagaacuggcugaacaacaacacccaguucugcaucaagguccucaacccguacaugcccuccgugaucgagaagauggagacgcugcagcgcaaguacggcggggcccuggugcggaacccccugagccgcaacuccacccacgagauguacugggucagcaacgccaccggcaacaucguguccagcgugaacaugaucucccgcaugcucaucaaccgguucaccaugaagcacaagaaggccacguacgagccggacgucgaccuggggagcggcacccgcaacaucgggaucgaguccgagauccccaaccuggacaucaucggcaagcggaucgagaagaucaagcaggagcacgagaccagcuggcacuacgaccaggaccaccccuacaagaccugggcguaccacggcuccuacgagacgaagcagaccgggagcgccuccagcauggugaacggcgugguccgccuccugaccaagcccugggacguggugccgauggucacccagauggccaugacggacaccacccccuucgggcagcagcggguguucaaggagaagguggacacccgcacgcaggagcccaaggagggcaccaagaagcugaugcggaucaccgccgaguggcucuggaaggagcugggcaagaagaagacgccccgcaugugcacgcgggaggaguucacccgcaagguccgguccaacgccgcgcugggggccaucuucaccgacgagaacaaguggaaguccgcccgcgaggccguggaggacucccgguucugggagcucguggaccgcgagcggaaccugcaccuggagggcaagugcgagaccugcgucuacaacaugauggggaagcgcgagaagaagcucggcgaguucgggaaggccaagggcagccgggcgaucugguacauguggcugggcgcccgcuuccuggaguucgaggcccucggguuccugaacgaggaccacugguucagccggggcaacucccugagcgggguggagggcgaggggcuccaccgccugggcuacauccugcgggacgucuccaagaaggagggcggggccauguacgcggacgacacggccggcugggacacccgcaucacccucgaggaccugaagaacgaggagauggugaccaaccacaugaagggggagcacaagaagcuggccgaggccguguucaagcucacguaccagaacaaggucgugcgcgugcagcggccgacgccccgcggcaccgucauggacaucaucagccggcgcgaccagcggggguccggccaggugggcaccuacgggcugaacacguucaccaacauggaggcccagcugauccgccagauggagggcgaggggaucuucaagagcauccagcaccucaccgugaccgaggagaucgcgguccagaacuggcuggcccgggugggccgcgagcggcugucccgcauggccaucagcggcgacgacugcguggucaagccccucgacgaccgguucgccuccgcccugacggcgcugaacgacauggggaaggugcgcaaggacauccagcagugggagcccagccggggcuggaacgacuggacccaggugccguucugcucccaccacuuccacgagcucgucaugaaggacgggcgcaugcugguggugcccugccggaaccaggacgagcugaucggccgcgcccggaucagccagggggccggcuggucccucaaggagaccgccugccugggcaagagcuacgcccagauguggacccugauguacuuccaccgccgggaccuccgccuggcggccaacgccaucugcuccgccguccccagccacugggugcccaccucccgcacgaccuggagcauccacgccaagcacgaguggaugaccaccgaggacaugcuggcgguguggaaccgggucuggauccaggagaacccguggauggaggacaagacgcccguggagagcugggaggaggugcccuaccucgggaagcgcgaggaccaguggugcggcucccugaucgggcugaccagccgggccaccugggccaagaacauccagaccgccaucaaccagguccgcucccucaucggcaacgaggaguacacggacuacaugcccagcaugaagcgguuccgccgggaggaggaggaggcgggggugcugugguga

SEQ ID NO: 9097 - RNA, 9876 nt, Artificial Sequence
  derived and/or modified CDS sequence (opt1) from DENV-2__JN819419__SS-prME
accgccggcgugaucgucaugcugauccccaccgccauggccuuccaccucaccacccgcaacggggagccccacaugaucgugggccggcaggagaaggggaagucccugcuguucaagaccgaggacggcgugaacaugugcacccucauggccaucgaccugggggagcugugcgaggacaccaucaccuacaagugcccccuccugcgccagaacgagcccgaggacaucgacugcuggugcaacagcaccagcaccugggucaccuacgggaccugcaccaccacgggcgagcaccggcgcgagaagcgguccguggcccuggugccccacgucgggaugggccucgagacccgcaccgagaccuggaugagcuccgagggggccuggaagcacgugcagcggaucgagaccuggauccugcgccacccgggcuucaccaucauggccgcgauccuggccuacaccaucgggaccacgcacuuccagcgggcccucaucuucauccugcugaccgccguggcgcccagcaugaccaugcgcugcaucggcaucuccaaccgggacuucgucgagggcgugagcgggggcuccuggguggacaucguccucgagcacgggagcugcgugaccacgauggccaagaacaagcccacccuggacuucgagcugaucaagaccgaggccaagcagcccgccacccuccgcaaguacugcguggaggccaagcugacgaacaccaccaccgagucccggugcccgacgcagggcgagcccagccugaacgaggagcaggacaagcgcuucaucugcaagcacuccauggucgaccggggcugggggaacggcugcgggcuguucggcaagggcgggaucgugaccugcgcgauguucacgugcaagaagaacauggagggcaaggugguccagcccgagaaccuggaguacaccaucgugaucacgccccacagcggggaggagcacgccgugggcaacgacaccgggaagcacggcaaggagaucaagaucaccccgcaguccagcaucaccgaggccgagcugaccggguacggcacggucaccauggagugcagcccccgcaccggccucgacuucaacgagauggugcugcugcagauggaggacaaggccuggcucgugcaccggcagugguuccuggaccugccccuccccuggcugccgggggccgacacccagggcagcaacuggauccagaaggagacgcuggucaccuucaagaacccccacgcgaagaagcaggacguggucgugcucgggucccaggagggcgccaugcacaccgcccugaccggggccacggagauccagaugagcagcggcaaccuccuguucaccggccaccugaagugccgccugcggauggacaagcuccagcugaaggggauguccuacagcaugugcaccggcaaguucaagaucgugaaggagaucgccgagacccagcacgggacgaucgucauccgcgugcaguacgagggcgacggcucccccugcaagauccccuucgagaucauggaccuggagaagcggcacgugcucgggcgccugaucaccgucaacccgaucgugaccgagaaggacagccccgugaacaucgaggcggagccgcccuucggcgacuccuacaucaucaucggggucgagccgggccagcugaagcucaacugguucaagaaggggagcuccaucggccagauguucgagaccacgaugcgcggcgccaagcggauggccauccugggggacaccgccugggacuucggcagccucggcgggguguucaccuccaucgggaaggcccuccaccagguguucggggcgaucuacggcgccgccuucagcggggucuccuggaccaugaagauccugaucggcgugaucaucacguggaucgggaugaacagccgcuccaccagccuguccgugagccugguccucgugggcguggucacccuguaccugggggccauggugcaggcggacuccggcugcguggucagcuggaagaacaaggagcucaagugcggcuccgggaucuucaucaccgacaacgugcacacguggaccgagcaguacaaguuccagcccgagagccccagcaagcuggccuccgccauccagaaggcccacgaggagggcaucugcgggauccggagcgugacccgccuggagaaccucauguggaagcagaucacccccgagcugaaccacauccuguccgagaacgaggucaagcucacgaucaugaccggcgacaucaaggggaucaugcaggccggcaagcggagccugcgcccgcagcccaccgagcugaaguacuccuggaagaccuggggcaaggcgaagaugcucagcacggagucccacaaccagaccuuccugaucgacgggcccgagaccgccgagugcccgaacaccaaccgggccuggaacagccuggagguggaggacuacggcuucgggguguucacgaccaacaucuggcucaagcugcgcgagaagcaggacgucuucugcgacuccaagcugaugagcgccgccaucaaggacaaccgggcggugcacgccgacaugggcuacuggaucgaguccgcccucaacgacaccuggaagauggagaaggccagcuucaucgaggugaaguccugccacuggcccaagagccacacccugugguccaacggcguccuggagagcgagaugaucauccccaagaacuucgccgggcccgugucccagcacaacuaccgcccgggcuaccacacccagacggcggggcccuggcaccucggcaagcuggagauggacuucgacuucugcgaggggaccaccguggucgugaccgaggacugcggcaaccggggccccagccugcgcacgaccaccgccagcgggaagcucaucaccgaguggugcugccgguccugcacgcugcccccgcugcgcuaccggggcgaggacgggugcugguacggcauggagauccgcccccucaaggagaaggaggagaaccuggugaacagccuggucaccgccgggcacggccagaucgacaacuucucccucggcgugcuggggauggcccuguuccucgaggagaugcugcggacccgcgugggcaccaagcacgcgauccugcucgucgccgugagcuucgugacgcugaucaccgggaacauguccuuccgggaccugggccgcgucauggugauggugggggccaccaugaccgacgacaucggcaugggcgucacguaccucgcccugcuggccgcguucaaggugcgccccaccuucgccgccgggcuccugcugcggaagcucaccagcaaggagcugaugauggccaccaucggcguggcccugcucucccagagcacgauccccgagaccauccuggagcugaccgacgcgcucgcccuggggaugauggcccugaagaucgucaagaacauggagaaguaccagcucgccgugaccaucauggccaucuccugcgugccgaacgcggucauccugcagaacgccuggaaggugagcugcacgauccuggccgccgucuccgugagcccccuccugcugaccuccagccagcagaaggcggacuggaucccccucgcccugaccaucaagggccugaaccccaccgccaucuuccucacgacccugucccgcaccagcaagaagcgguccuggccgcugaacgaggccaucauggccgugggcauggucagcauccucgcguccagccugcugaagaacgacauccccaugaccgggccccucguggccggcgggcugcugacggugugcuacguccucaccggccgcagcgccgaccuggagcuggagcgggccgccgacgugaagugggaggaccaggcggagaucuccgggagcucccccauccucagcaucaccaucuccgaggacggcagcauguccaucaagaacgaggaggaggagcagacccugacgauccugauccgcaccggccuccuggugaucagcggggucuucccgguguccauccccaucaccgccgccgccugguaccugugggaggugaagaagcagcgggccggcguccucugggacgugcccagcccgccgcccguggggaaggcggagcuggaggacggcgccuaccgcaucaagcagcgggggauccugggcuacucccagaucggcgccggggucuacaaggagggcaccuuccacaccauguggcacgugacgcgcggggccgugcucaugcaccggggcaagcgcaucgagcccagcugggccgacgucaagaaggaccugguguccuacgggggcggcuggaagcuggagggggaguggaaggagggcgaggaggugcagguccucgcgcuggagcccgggaagaacccccgggccgugcagaccaagcccggcaucuucaagaccaacaccgggaacaucggcgccgugagccuggacuucucccccggcacgagcgggucccccaucgucgaccgcaagggcaaggugguggggcucuacggcaacggcgucgugacccggagcggggccuacguguccgcgaucgcccagaccgagaaguccaucgaggacaaccccgagaucgaggacgacaucuuccgcaagaagcggcugaccaucauggaccugcaccccggcgccgggaagacgaagcgcuaccuccccgccaucguccgggaggccaucaagcgcggccugcggacccugauccuggcgccgacccgcgugguggccgccgagauggaggaggcccuccgcgggcugcccauccgguaccagacccccgccauccgcgcggagcacacgggccgggagaucgucgaccugaugugccacgccaccuucaccaugcgccuccugagccccgugcgggugccgaacuacaaccugaucaucauggacgaggcccacuucaccgaccccgccuccaucgccgcgcgcggcuacaucagcacgcgggucgagaugggggaggccgccggcaucuucaugaccgccacgccgcccgggucccgcgacccguucccccagagcaacgcgcccaucauggacgaggagcgggagauccccgagcgcuccuggaacagcggccacgagugggugaccgacuucaaggggaagacggugugguucgucccguccaucaaggccggcaacgacaucgccgccugccuccggaagaacggcaagaaggugauccagcugagccgcaagaccuucgacuccgaguacgugaagacccgggccaacgacugggacuucgucgugaccacggacaucagcgagaugggggcgaacuucaaggccgagcgcgugaucgacccccggcgcugcaugaagcccgucauccugaccgacggcgaggagcgggugauccucgccgggcccaugccggugacccacuccagcgccgcccagcgccggggccgcaucgggcgcaaccccaagaacgagaacgaccaguacaucuacaugggcgagccccuggagaacgacgaggacugcgcgcacuggaaggaggccaagaugcugcucgacaacaucaacacccccgagggcaucaucccguccauguucgagcccgagcgggagaaggucgacgccaucgacggggaguaccgccugcggggcgaggcccgcaagacguucguggaccugaugcggcgcggggaccuccccguguggcuggccuacaaggucgcggccgagggcaucaacuacgccgaccggcgcuggugcuucgacgggaucaagaacaaccagauccuggaggagaacguggaggucgagaucuggaccaaggagggcgagcggaagaagcucaagccgcgcuggcuggacgcccggaucuacagcgacccccuggcgcucaaggaguucaaggaguucgccgccggccgcaagucccugacccugaaccucaucaccgagauggggcggcugcccacguucaugacccagaaggcccgcaacgcccuggacaaccucgcggugcugcacaccgccgaggccggcgggaaggccuacaaccacgcccugagcgagcuccccgagacccuggagacgcugcuccugcugacccuccuggcgaccgugaccggcggcaucuuccuguuccucauguccgggaagggcaucgggaagaugacgcugggcaugugcugcaucaucaccgccagcauccugcucugguacgcccagauccagccgcacuggaucgccgccuccaucauccuggaguucuuccugaucguccuccugauccccgagcccgagaagcagcggacgccccaggacaaccagcugaccuacguggugaucgcgauccucaccgucguggccgccacgauggccaacgagaugggguuccuggagaagaccaagaaggaccugggccucggcagcaucaccacccaggagagcgaguccaacauccuggacaucgaccugcgcccggccagcgcguggacgcucuacgccguggccaccaccuucgucacccccaugcugcggcacuccaucgagaacagcuccgugaacgugagccugacggccaucgcgaaccaggccaccguccucauggggcugggcaagggguggccccuguccaagauggacaucggcgcgccccuccuggccaucgggugcuacagccaggugaacccgaucacccugaccgccgcgcuccugcugcucguggcccacuacgccaucaucggccccggccugcaggccaaggccacgcgcgaggcgcagaagcgggccgccgccgggaucaugaagaaccccaccgucgacggcaucaccgugaucgaccuggagcccaucccguacgaccccaaguucgagaagcagcucggccaggugaugcugcugauccucugcgucacccaggugcugaugaugcgcacgaccugggcccugugcgaggcgcucacccuggccaccggccccaucuccacgcugugggaggggaaccccggccgguucuggaacaccaccaucgccgugagcauggccaacaucuuccgcggcuccuaccucgcgggggccggccugcuguucagcaucaugaagaacaccacgaacacccgccgggggaccggcaacaucggcgagacccucggggagaaguggaagucccgccugaacgcccugggcaagagcgaguuccagaucuacaagaaguccgggauccaggaggucgaccggacgcucgccaaggagggcaucaagcgcggggagaccgaccaccacgccgugagccggggcuccgcgaagcugcgcugguucguggagcggaacauggucaccccggagggcaaggugguggaccuggggugcggccgcgggggcuggagcuacuacugcgggggccucaagaacguccgggaggugaagggccugaccaagggcgggcccgggcacgaggagcccauccccauguccacguacggcuggaaccuggugcgccuccagagcggggucgacguguucuucaccccgcccgagaagugcgacacccugcugugcgacaucggcgagagcucccccaaccccaccaucgaggccggccggacgcuccgcgugcugaaccuggucgagaacuggcucaacaacaacacccaguucugcaucaaggugcugaacccguacaugcccagcgugaucgagaagauggagacccugcagcggaaguacgggggcgcccucguccgcaacccccugucccggaacagcacccacgagauguacuggguguccaacgccaccgggaacaucgugagcuccgucaacaugaucagccgcaugcugaucaaccgguucacgaugaagcacaagaaggccaccuacgagccggacguggaccugggcuccgggacccgcaacaucggcaucgagagcgagauccccaaccucgacaucaucggcaagcggaucgagaagaucaagcaggagcacgagaccuccuggcacuacgaccaggaccaccccuacaagacgugggcguaccacgggagcuacgagaccaagcagaccggcuccgccagcuccauggugaacggggucgugcgccugcugaccaagcccugggacguggucccgauggugacgcagauggccaugaccgacaccacccccuucggccagcagcgcguguucaaggagaaggucgacacgcggacccaggagcccaaggagggcaccaagaagcucaugaagaucaccgccgaguggcuguggaaggagcuggggaagaagaagaucccccgcaugugcacgcgggaggaguucacccgcaaggugcggagcaacgccgcgcucggcgccaucuucaccgacgagaacaaguggaaguccgcccgcgaggccguggaggacgggcgguucugggagcuggucgaccgcgagcggaaccugcaccucgagggcaagugcgagaccugcguguacaacaugauggggaagcgcgagaagaagcugggcgaguucggcaaggcgaaggggagccgggccaucugguacauguggcugggcgcccgcuuccucgaguucgaggcccugggguuccugaacgaggaccacugguucucccggggcaacagccucagcggggucgagggcgagggccugcaccgccugggguacauccuccgggacguguccaagaaggagggcggggccauguacgcggacgacacggccggcugggacacccgcaucacccuggaggaccugaagaacgaggagauggugaccaaccacaugaagggggagcacaagaagcucgccgaggccaucuucaagcugacguaccagaacaaggucgugcgggugcagcgcccgacgccccggggcaccgucauggacaucaucagccgccgggaccagcgcggcuccggccaggugggcaccuacgggcugaacacguucaccaacauggaggcccagcucauccgccagauggagggcgagggcaucuucaagagcauccagcaccugaccgugaccgaggagaucgcgguccagaacuggcuggcccggguggggcgcgagcggcucacgcgcauggccaucuccggcgacgacugcguggucaagcccaucgacgaccgguucgccaacgcccugaccgcgcugaacgacauggggaaggugcgcaaggacauccagcagugggagcccagccggggcuggaacgacuggacccaggugccguucugcucccaccacuuccacgagcucgucaugaaggacgggcgcgugcuggugguccccugccggaaccaggacgagcugaucggccgcgcccggaucagccagggcgccggguggucccucaaggagaccgccugccugggcaagagcuacgcccagauguggacgcugauguacuuccaccgccgggaccuccgccuggcggccaacgccaucugcuccgccgugcccagccacugggugcccaccucccggaccaccuggagcauccacgcgaagcacgaguggaugaccacggaggacaugcuggccgucuggaaccgcguguggauccaggagaacccguggauggaggacaagacccccguggaguccugggaggagguccccuaccucgggaagcgggaggaccaguggugcggcagccugaucgggcugaccucccgcgccaccugggccaagaacauccagacggccaucaaccaggugcggagccucaucggcaacgaggaguacaccgacuacaugcccagcaugaagcgcuuccgccgggaggaggaggaggcgggcgugcugugguga

SEQ ID NO: 9098 - RNA, 9876 nt, Artificial Sequence
  derived and/or modified CDS sequence (opt1) from DENV-2__FJ850074__SS-prME
accgccggcgugaucgucaugcugauccccaccgugauggccuuccaccucaccacccgcaacggggagccccacaugaucgugggccggcaggagaaggggaagucccugcuguucaagaccgaggacggcgucaacaugugcacccucauggcgaucgaccugggggagcugugcgaggacaccaucaccuacaagugcccccuccugcgccagaacgagcccgaggacaucgacugcuggugcaacuccaccuccaccugggugaccuacgggaccugcaccaccacgggcgagcaccggcgcgagaagcgguccguggcccuggucccccacguggggaugggccucgagacccgcaccgagaccuggaugagcuccgagggggccuggaagcacgugcagcggaucgagacguggauccugcgccaccccggcuucaccaugauggccgccauccuggcguacaccaucgggaccacgcacuuccagcgggcccucaucuucauccugcugaccgccgucgcccccagcaugaccaugcgcugcaucggcaucuccaaccgggacuucguggagggcgugagcgggggcuccugggucgacaucgugcucgagcacgggagcugcgugaccacgauggcgaagaacaagcccacccuggacuucgagcugaucaagaccgaggccaagcagcccgccacccuccgcaaguacugcgucgaggccaagcugacgaacaccaccaccgagucccggugcccgacgcagggcgagcccagccugaacgaggagcaggacaagcgcuucaucugcaagcacuccaugguggaccggggcugggggaacggcugcgggcuguucggcaagggcgggaucgugaccugcgccauguucacgugcaagaagaacauggagggcaaggucgugcagcccgagaaccuggaguacaccaucgugaucacgccccacagcggggaggagcacgcggucggcaacgacaccgggaagcacggcaaggagaucaagaucaccccgcaguccagcaucaccgaggccgagcugaccggguacggcacggugaccauggagugcagcccccgcaccggccucgacuucaacgagauggugcugcugcagauggaggacaaggccuggcucguccaccggcagugguuccuggaccugccccuccccuggcugccgggggccgacacccagggcagcaacuggauccagaaggagacgcuggugaccuucaagaacccccacgccaagaagcaggacgucguggugcucgggucccaggagggcgcgaugcacaccgcccugaccggggccacggagauccagaugagcagcggcaaccuccuguucaccggccaccugaagugccgccugcggauggacaagcuccagcugaaggggauguccuacagcaugugcaccggcaaguucaagaucgucaaggagaucgccgagacccagcacgggacgaucgugauccgcgugcaguacgagggcgacggcucccccugcaagauccccuucgagaucauggaccuggagaagcggcacguccucgggcgccugaucaccgugaacccgaucgugaccgagaaggacagccccgucaacaucgaggccgagccgcccuucggcgacuccuacaucaucaucgggguggagccgggccagcugaagcucaacugguucaagaaggggagcuccaucggccagauguucgagaccacgaugcgcggcgcgaagcggauggccauccugggggacaccgccugggacuucggcagccucggcgggguguucaccuccaucgggaaggcccuccaccaggucuucggggccaucuacggcgcggccuucagcgggguguccuggaccaugaagauccugaucggcgugaucaucacguggaucgggaugaacagccgcuccaccagccuguccgucagccuggugcucgugggcgucgugacccuguaccugggggccauggugcaggccgacuccggcugcgucgugagcuggaagaacaaggagcucaagugcggcuccgggaucuucaucaccgacaacgugcacacguggaccgagcaguacaaguuccagcccgagagccccagcaagcuggcguccgccauccagaaggcccacgaggagggcaucugcgggauccggagcgucacccgccuggagaaccucauguggaagcagaucacccccgagcugaaccacauccuguccgagaacgaggugaagcucacgaucaugaccggcgacaucaaggggaucaugcaggccggcaagcggagccugcgcccgcagcccaccgagcugaaguacuccuggaagaccuggggcaaggccaagaugcuccccacggagagccacaaccagaccuuccugaucgacgggccggagaccgcggagugccccaacaccaaccgggccuggaacucccuggagguggaggacuacggcuucggggucuucacgaccaacaucuggcucaagcugcgcgagaagcaggacguguucugcgacagcaagcugauguccgccgccaucaaggacaaccgggccgugcacgcggacaugggcuacuggaucgagagcgcccucaacgacaccuggaagauggagaaggccuccuucaucgaggucaagagcugccacuggcccaagucccacacccuguggagcaacggcgugcuggaguccgagaugaucauccccaagaacuucgccgggccggugagccagcacaacuaccgccccggcuaccacacccagacggccgggcccuggcaccucggcaagcuggagauggacuucgacuucugcgaggggaccaccgucguggugaccgaggacugcggcaaccggggccccucccugcgcacgaccaccgcgagcgggaagcucaucaccgaguggugcugccggagcugcacgcugccgccccugcgcuaccggggcgaggacgggugcugguacggcauggagauccgcccccucaaggagaaggaggagaaccuggucaacucccuggugaccgccgggcacggccagaucgacaacuucagccucggcgugcuggggauggcccuguuccucgaggagaugcugcggacccgcgucggcaccaagcacgccauccugcucguggcgguguccuucgucacgcugaucaccgggaacaugagcuuccgggaccugggccgcgugauggugauggucggggccaccaugaccgacgacaucggcaugggcgugacguaccucgcccugcuggccgccuucaaggugcgccccaccuucgcggccgggcuccugcugcggaagcucaccuccaaggagcugaugauggccaccaucggcgucgcccugcucagccaguccacgaucccggagaccauccuggagcugaccgacgcccucgcgcuggggaugauggcccugaagaucgugaagaacauggagaaguaccagcucgccgugaccaucauggccaucagcugcguccccaacgccgugauccugcagaacgcguggaaggucuccugcacgauccuggccgccgugagcgugagcccccuccugcugaccagcucccagcagaaggccgacuggaucccccucgcgcugaccaucaagggccugaacccgaccgccaucuuccucacgacccugagccgcaccuccaagaagcggagcuggccccugaacgaggccaucauggccgucggcaugguguccauccucgccagcucccugcugaagaacgacauccccaugaccgggccccucguggcgggcgggcugcugacggucugcuacgugcucaccggccgcagcgccgaccuggagcuggagcgggccgccgacgugaagugggaggaccaggccgagaucagcggguccagcccgauccucuccaucaccaucagcgaggacggcuccaugagcaucaagaacgaggaggaggagcagacccugacgauccugauccgcaccggccuccuggucaucuccgggguguuccccgugagcauccccaucaccgcggccgccugguaccugugggaggucaagaagcagcgggccggcgugcucugggacgugcccuccccgccgcccgucgggaaggccgagcuggaggacggcgcguaccgcaucaagcagcgggggauccugggcuacagccagaucggcgccgggguguacaaggagggcaccuuccacaccauguggcacgugacgcgcggggccguccucaugcaccggggcaagcgcaucgagccguccugggccgacgugaagaaggaccuggugagcuacgggggcggcuggaagcuggagggggaguggaaggagggcgaggagguccaggugcucgcccuggagcccgggaagaacccccgggcggugcagaccaagcccggcaucuucaagaccaacaccgggacgaucggcgccgucucccuggacuucagcccgggcaccuccgggagccccaucguggaccgcaagggcaagguggucgggcucuacggcaacggcguggugacccgguccggggccuacgucagcgccaucgcgcagaccgagaaguccaucgaggacaaccccgagaucgaggacgacaucuuccgcaagaagcggcugacgaucauggaccugcaccccggcgccgggaagaccaagcgcuaccucccggccaucgugcgggaggccaucaagcgcggccugcggacccugauccuggcccccacccgcguggucgcggccgagauggaggaggcccuccgcgggcugcccauccgguaccagacgcccgccauccgcgccgagcacaccggccgggagaucguggaccugaugugccacgcgaccuucaccaugcgccuccugagcccggugcggguccccaacuacaaccugaucaucauggacgaggcccacuucacggaccccgccagcaucgccgcccgcggcuacaucuccacccggguggagaugggggaggcggccggcaucuucaugaccgccacgccgcccgggagccgcgaccccuucccccaguccaacgcccccaucauggacgaggagcgggagauccccgagcgcagcuggaacuccggccacgagugggugacggacuucaaggggaagaccgucugguucgugcccagcaucaaggcgggcaacgacaucgccgccugccuccggaagaacggcaagaaggugauccagcugucccgcaagaccuucgacagcgaguacgucaagacccgguccaacgacugggacuucguggugacgaccgacaucagcgagaugggggccaacuucaaggccgagcgcgucaucgacccccggcgcugcaugaagcccgugauccugaccgacggcgaggagcgggugauccucgcggggccgaugcccgucacccacuccagcgccgcccagcgccggggccgcaucgggcgcaaccccaagaacgagaacgaccaguacaucuacaugggcgagccccuggagaacgacgaggacugcgcccacuggaaggaggccaagaugcugcucgacaacaucaacacgccggagggcaucauccccuccauguucgagcccgagcgggagaagguggacgcgaucgacggggaguaccgccugcggggcgaggcccgcaagaccuucguggaccugaugcggcgcggggaccucccggucuggcuggccuacaagguggccgccgagggcaucaacuacgcggaccggcgcuggugcuucgacgggaucaagaacaaccagauccuggaggagaacgucgagguggagaucuggaccaaggagggcgagcggaagaagcucaagccccgcuggcuggacgcccggaucuacagcgacccccuggcccucaaggaguucaaggaguucgccgcgggccgcaagucccugacccugaaccucaucacggagauggggcggcugcccaccuucaugacccagaaggcccgcaacgcccuggacaaccucgccgugcugcacaccgccgaggcgggcgggaaggccuacaaccacgcccugagcgagcucccggagacgcuggagacccugcuccugcugacccuccuggccaccgucacgggcggcaucuuccuguuccucauguccgggaagggcaucgggaagaugacccugggcaugugcugcaucaucaccgccagcauccugcucugguacgcgcagauccagccccacuggaucgccgccuccaucauccuggaguucuuccugaucgugcuccugauccccgagcccgagaagcagcggaccccgcaggacaaccagcugaccuacguggucaucgccauccucacggugguggccgcgaccauggccaacgagaugggguuccuggagaagaccaagaaggaccugggccucggcagcaucaccacgcaggagagcgaguccaacauccuggacaucgaccugcgccccgccagcgccuggacccucuacgccgucgcgaccaccuucgugacgcccaugcugcggcacuccaucgagaacagcuccgugaacgucagccugaccgccaucgccaaccaggccaccgugcucauggggcugggcaagggguggccccuguccaagauggacaucggcgugccgcuccuggcgaucgggugcuacagccaggucaaccccaucacccugacggccgcccuccugcugcucguggcccacuacgccaucaucggccccggccugcaggcgaaggccacccgcgaggcccagaagcgggccgccgcggggaucaugaagaaccccaccguggacggcaucaccgucaucgaccuggagccgauccccuacgaccccaaguucgagaagcagcucggccaggugaugcugcugauccucugcgugacgcagguccugaugaugcgcaccaccugggcccugugcgaggcccucacccuggccacgggccccaucuccacccugugggaggggaacccgggccgguucuggaacaccaccaucgccgugagcauggcgaacaucuuccgcggcuccuaccucgccggggccggccugcuguucagcaucaugaagaacacgaccaacacccgccgggggaccggcaacaucggcgagacgcucggggagaaguggaagucccgccugaacgcccugggcaagagcgaguuccagaucuacaagaaguccgggauccaggagguggaccggacccucgcgaaggagggcaucaagcgcggggagaccgaccaccacgccgucagccggggcuccgccaagcugcgcugguucguggagcggaacauggugacccccgagggcaaggucguggaccuggggugcggccgcgggggcuggagcuacuacugcgggggccucaagaacgugcgggaggucaagggccugacgaagggcggccccgggcacgaggagcccaucccgauguccaccuacggcuggaaccuggugcgccuccagagcgggguggacgucuucuucacgccgcccgagaagugcgacacccugcugugcgacaucggcgagagcucccccaacccgacgaucgaggccggccggacccuccgcgugcugaaccugguggagaacuggcucaacaacaacacccaguucugcaucaagguccugaaccccuacaugcccagcgugaucgagaagauggagacccugcagcggaaguacgggggcgcccucgugcgcaacccgcugucccggaacagcacccacgagauguacugggucuccaacgcgacggggaacaucgugagcuccgugaacaugaucagccgcaugcugaucaaccgguucaccaugaagcacaagaaggccaccuacgagcccgacgucgaccugggcuccgggacccgcaacaucggcaucgagagcgagauccccaaccucgacaucaucggcaagcggaucgagaagaucaagcaggagcacgagacguccuggcacuacgaccaggaccaccccuacaagaccugggccuaccacgggagcuacgagaccaagcagaccggcuccgccagcuccauggugaacggggugguccgccugcugacgaagccgugggacguggugcccauggucacccagauggccaugaccgacaccacgcccuucggccagcagcgcguguucaaggagaagguggacacccggacccaggagcccaaggagggcaccaagaagcucaugaagaucacggcggaguggcuguggaaggagcuggggaagaagaagaccccgcgcaugugcacccgggaggaguucacccgcaagguccggagcaacgccgcccucggcgccaucuucacggacgagaacaaguggaaguccgcccgcgaggcgguggaggacgggcgguucugggagcuggucgaccgcgagcggaaccugcaccucgagggcaagugcgagaccugcguguacaacaugauggggaagcgcgagaagaagcugggcgaguucggcaaggccaaggggagccgggccaucugguacauguggcugggcgcccgcuuccucgaguucgaggcgcugggguuccugaacgaggaccacugguucucccggggcaacagccucagcgggguggagggcgagggccugcaccgccugggguacauccuccgggacgucuccaagaaggagggcggggccauguacgccgacgacaccgccggcugggacacccgcaucacgcuggaggaccugaagaacgaggagauggugaccaaccacaugaagggggagcacaagaagcucgccgaggcgaucuucaagcugaccuaccagaacaaggugguccgggugcagcgccccacgccccggggcacggugauggacaucaucagccgccgggaccagcgcggcuccgggcaggucggcaccuacgggcugaacaccuucaccaacauggaggcccagcucauccgccagauggagggcgagggcaucuucaagagcauccagcaccugacggugaccgaggagaucgccgugcagaacuggcuggcccgggucgggcgcgagcggcucacccgcauggccaucuccggcgacgacugcguggugaagcccaucgacgaccgguucgcgaacgcccugaccgcccugaacgacauggggaagguccgcaaggacauccagcagugggagccgagccggggcuggaacgacuggacccaggugcccuucugcucccaccacuuccacgagcucgugaugaaggacgggcgcguccugguggugcccugccggaaccaggacgagcugaucggccgcgcccggaucagccagggcgccggguggucccucaaggagaccgcgugccugggcaagagcuacgcccagauguggacccugauguacuuccaccgccgggaccuccgccuggccgccaacgccaucugcuccgcgguccccagccacugggugccgaccucccggaccacguggagcauccacgccaagcacgaguggaugaccaccgaggacaugcuggccguguggaaccgcgucuggauccaggagaaccccuggauggaggacaagacccccguggaguccugggaggaggugcccuaccucgggaagcgggaggaccaguggugcggcagccugaucgggcugacgucccgcgccaccugggcgaagaacauccagaccgccaucaaccagguccggagccucaucggcaacgaggaguacaccgacuacaugccgagcaugaagcgcuuccgccgggaggaggaggaggccggcgugcugugguga

SEQ ID NO: 9099 - RNA, 9876 nt, Artificial Sequence
  derived and/or modified CDS sequence (opt1) from DENV-2__FJ850076__SS-prME
accgccggcgccaucgugaugcugauccccaccgucauggcguuccaccucaccacccgcaacggggagccccacaugaucgugggccggcaggagaaggggaagucccugcuguucaagaccgaggacggcgugaacaugugcacccucauggccaucgaccugggggagcugugcgaggacaccaucaccuacaagugcccccuccugcgccagaacgagcccgaggacaucgacugcuggugcaacuccaccuccaccugggucaccuacgggaccugcaccaccacgggcgagcaccggcgcgagaagcgguccguggcccuggugccccacgucgggaugggccucgagacccgcaccgagaccuggaugagcuccgagggggccuggaagcacgugcagcggaucgagacguggauccugcgccaccccggcuucaccaugauggccgcgauccuggccuacaccaucgggaccacgcacuuccagcgggcccucaucuucauccugcugaccgccguggcgcccagcaugaccaugcgcugcaucggcaucuccaaccgggacuucgucgagggcgugagcgggggcuccuggguggacaucguccucgagcacgggagcugcgugaccacgauggccaagaacaagcccacccuggacuucgagcugaucaagaccgaggccaagcagcccgccacccuccgcaaguacugcguggaggccaagcugacgaacaccaccaccgagucccggugcccgacgcagggcgagcccagccugaacgaggagcaggacaagcgcuucaucugcaagcacuccauggucgaccggggcugggggaacggcugcgggcuguucggcaagggcgggaucgugaccugcgcgauguucacgugcaagaagaacauggagggcaaggugguccagcccgagaaccuggaguacaccaucgugaucacgccccacagcggggaggagcacgccgugggcaacgacaccgggaagcacggcaaggagaucaagaucaccccgcaguccagcaucaccgaggccgagcugaccggguacggcacggucaccauggagugcagcccccgcaccggccucgacuucaacgagauggugcugcugcagauggaggacaaggccuggcucgugcaccggcagugguuccuggaccugccccuccccuggcugccgggggccgacacccagggcagcaacuggauccagaaggagacgcuggucaccuucaagaacccccacgcgaagaagcaggacguggucgugcucgggucccaggagggcgccaugcacaccgcccugaccggggccacggagauccagaugagcagcggcaaccuccuguucaccggccaccugaagugccgccugcggauggacaagcuccagcugaaggggauguccuacagcaugugcaccggcaaguucaagaucgugaaggagaucgccgagacccagcacgggacgaucgucauccgcgugcaguacgagggcgacggcucccccugcaagauccccuucgagaucauggaccuggagaagcggcacgugcucgggcgccugaucaccgucaacccgaucgugaccgagaaggacagccccgugaacaucgaggcggagccgcccuucggcgacuccuacaucaucaucggggucgagccgggccagcugaagcucaacugguucaagaaggggagcuccaucggccagauguucgagaccacgaugcgcggcgccaagcggauggccauccugggggacaccgccugggacuucggcagccucggcgggguguucaccuccaucgggaaggcccuccaccagguguucggggcgaucuacggcgccgccuucagcggggucuccuggaccaugaagauccugaucggcgugaucaucacguggaucgggaugaacagccgcuccaccagccuguccgugagccugguccucgugggcguggucacccuguaccugggggccauggugcaggcggacuccggcugcguggucagcuggaagaacaaggagcucaagugcggcuccgggaucuucaucaccgacaacgugcacacguggaccgagcaguacaaguuccagcccgagagccccagcaagcuggccuccgccauccagaaggcccacgaggagggcaucugcgggauccggagcgugacccgccuggagaaccucauguggaagcagaucacccccgagcugaaccacauccuguccgagaacgaggucaagcucacgaucaugaccggcgacaucaaggggaucaugcaggccggcaagcggagccugcgcccgcagcccaccgagcugaaguacuccuggaagaccuggggcaaggcgaagaugcuccccacggagagccacaaccagaccuuccugaucgacgggccggagaccgccgagugccccaacaccaaccgggccuggaacucccuggagguggaggacuacggcuucgggguguucacgaccaacaucuggcucaagcugcgcgagaagcaggacgucuucugcgacagcaagcugauguccgccgccaucaaggacaaccgggcggugcacgccgacaugggcuacuggaucgagagcgcccucaacgacaccuggaagauggagaaggccuccuucaucgaggucaagagcugccacuggcccaagucccacacccuguggagcaacggcgugcuggaguccgagaugaucauccccaagaacuucgccgggccggugagccagcacaacuaccgccccggcuaccacacccagacggcggggcccuggcaccucggcaagcuggagauggacuucgacuucugcgaggggaccaccguggucgugaccgaggacugcggcaaccggggccccucccugcgcacgaccaccgccagcgggaagcucaucaccgaguggugcugccggagcugcacgcugccgccccugcgcuaccggggcgaggacgggugcugguacggcauggagauccgcccccucaaggagaaggaggagaaccuggugaacucccuggucaccgccgggcacggccagaucgacaacuucagccucggcgugcuggggauggcccuguuccucgaggagaugcugcggacccgcgugggcaccaagcacgcgauccugcucgucgccguguccuucgugacgcugaucaccgggaacaugagcuuccgggaccugggccgcgucauggugauggugggggccaccaugaccgacgacaucggcaugggcgucacguaccucgcccugcuggccgcguucaaggugcgccccaccuucgccgccgggcuccugcugcggaagcucaccuccaaggagcugaugauggccaccaucggcguggcccugcucagccaguccacgaucccggagaccauccuggagcugaccgacgcgcucgcccuggggaugauggcccugaagaucgucaagaacauggagaaguaccagcucgccgugaccaucauggccaucagcugcgugcccaacgcggucauccugcagaacgccuggaagguguccugcacgauccuggccgccgucagcgugagcccccuccugcugaccagcucccagcagaaggcggacuggaucccccucgcccugaccaucaagggccugaacccgaccgccaucuuccucacgacccugagccgcaccuccaagaagcggagcuggccccugaacgaggccaucauggccgugggcauggucuccauccucgcgagcucccugcugaagaacgacgugcccaugaccgggccccucguggccggcgggcugcugacggucugcuacgugcucaccggccgcagcgccgaccuggagcuggagcgggccgccgacgugaagugggaggaccaggcggagaucagcggguccagcccgauccucuccaucaccaucagcgaggacggcuccaugagcaucaagaacgaggaggaggagcagacccugacgauccugauccgcaccggccuccuggucaucuccgggguguuccccgugagcauccccaucaccgccgccgccugguaccugugggaggucaagaagcagcgggccggcgugcucugggacgugcccuccccgccgcccgucgggaaggcggagcuggaggacggcgccuaccgcaucaagcagcgggggauccugggcuacagccagaucggcgccgggguguacaaggagggcaccuuccacaccauguggcacgugacgcgcggggccguccucaugcaccggggcaagcgcaucgagccguccugggccgacgugaagaaggaccuggugagcuacgggggcggcuggaagcuggagggggaguggaaggagggcgaggagguccaggugcucgcgcuggagcccgggaagaacccccgggccgugcagaccaagcccggcaucuucaagaccaacaccgggacgaucggcgccgucucccuggacuucagcccgggcaccuccgggagccccaucguggaccgcaagggcaagguggucgggcucuacggcaacggcguggugacccgguccggggccuacgucagcgcgaucgcccagaccgagaaguccaucgaggacaaccccgagaucgaggacgacaucuuccgcaagaagcggcugacgaucauggaccugcaccccggcgccgggaagaccaagcgcuaccucccggccaucgugcgggaggccaucaagcgcggccugcggacccugauccuggcgcccacccgcguggucgccgccgagauggaggaggcccuccgcgggcugcccauccgguaccagacgcccgccauccgcgcggagcacaccggccgggagaucguggaccugaugugccacgccaccuucaccaugcgccuccugagcccggugcggguccccaacuacaaccugaucaucauggacgaggcccacuucacggaccccgccagcaucgccgcgcgcggcuacaucuccacccggguggagaugggggaggccgccggcaucuucaugaccgccacgccgcccgggagccgcgaccccuucccccaguccaacgcgcccaucauggacgaggagcgggagauccccgagcgcagcuggaacuccggccacgagugggugacggacuucaaggggaagaccgucugguucgugcccagcaucaaggccggcaacgacaucgccgccugccuccggaagaacggcaagaaggugauccagcugucccgcaagaccuucgacagcgaguacgucaagacccgguccaacgacugggacuucguggugacgaccgacaucagcgagaugggggccaacuucaaggcggagcgcgucaucgacccccggcgcugcaugaagcccgugauccugaccgacggcgaggagcgggugauccucgccgggccgaugcccgucacccacuccagcgccgcccagcgccggggccgcaucgggcgcaaccccaagaacgagaacgaccaguacaucuacaugggcgagccccuggagaacgacgaggacugcgcccacuggaaggaggcgaagaugcugcucgacaacaucaacacgccggagggcaucauccccuccauguucgagcccgagcgggagaagguggacgccaucgacggggaguaccgccugcggggcgaggcccgcaagaccuucguggaccugaugcggcgcggggaccucccggucuggcuggccuacaagguggccgcggagggcaucaacuacgccgaccggcgcuggugcuucgacgggaucaagaacaaccagauccuggaggagaacgucgagguggagaucuggaccaaggagggcgagcggaagaagcucaagccccgcuggcuggacgcccggaucuacagcgacccccuggcccucaaggaguucaaggaguucgcggccggccgcaagucccugacccugaaccucaucacggagauggggcggcugcccaccuucaugacccagaaggcccgcaacgcccuggacaaccucgccgugcugcacaccgcggaggccggcgggaaggccuacaaccacgcccugagcgagcucccggagacgcuggagacccugcuccugcugacccuccuggccaccgucacgggcggcaucuuccuguuccucauguccgggaagggcaucgggaagaugacccugggcaugugcugcaucaucaccgcgagcauccugcucugguacgcccagauccagccccacuggaucgccgccuccaucauccuggaguucuuccugaucgugcuccugauccccgagcccgagaagcagcggaccccgcaggacaaccagcugaccuacguggucaucgccauccucacggugguggcggccaccauggccaacgagaugggguuccuggagaagaccaagaaggaccugggccucggcagcaucaccacgcaggagagcgaguccaacauccuggacaucgaccugcgccccgccagcgccuggacccucuacgcggucgccaccaccuucgugacgcccaugcugcggcacuccaucgagaacagcuccgugaacgucagccugaccgccaucgccaaccaggcgaccgugcucauggggcugggcaagggguggccccuguccaagauggacaucggcgugccgcuccuggccaucgggugcuacagccaggucaaccccaucacccugacggccgcccuccugcugcucguggcccacuacgcgaucaucggccccggccugcaggccaaggccacccgcgaggcccagaagcgggccgcggccgggaucaugaagaaccccaccguggacggcaucaccgucaucgaccuggagccgauccccuacgaccccaaguucgagaagcagcucggccaggugaugcugcugauccucugcgugacgcagguccugaugaugcgcaccaccugggcccugugcgaggcccucacccuggccacgggccccaucuccacccugugggaggggaacccgggccgguucuggaacaccaccaucgcggugagcauggccaacaucuuccgcggcuccuaccucgccggggccggccugcuguucagcaucaugaagaacacgaccaacacccgccgggggaccggcaacaucggcgagacgcucggggagaaguggaagucccgccugaacgcgcugggcaagagcgaguuccagaucuacaagaaguccgggauccaggagguggaccggacccucgccaaggagggcaucaagcgcggggagaccgaccaccacgccgucagccggggcuccgccaagcugcgcugguucguggagcggaacauggugacccccgagggcaaggucguggaccuggggugcggccgcgggggcuggagcuacuacugcgggggccucaagaacgugcgggaggucaagggccugacgaagggcggccccgggcacgaggagcccaucccgauguccaccuacggcuggaaccuggugcgccuccagagcgggguggacgucuucuucacgccgcccgagaagugcgacacccugcugugcgacaucggcgagagcucccccaacccgacgaucgaggccggccggacccuccgcgugcugaaccugguggagaacuggcucaacaacaacacccaguucugcaucaagguccugaaccccuacaugcccagcgugaucgagaagauggagacccugcagcggaaguacgggggcgcgcucgugcgcaacccgcugucccggaacagcacccacgagauguacugggucuccaacgccacggggaacaucgugagcuccgugaacaugaucagccgcaugcugaucaaccgguucaccaugaagcacaagaaggccaccuacgagcccgacgucgaccugggcuccgggacccgcaacaucggcaucgagagcgagauccccaaccucgacaucaucggcaagcggaucgagaagaucaagcaggagcacgagacguccuggcacuacgaccaggaccaccccuacaagaccugggccuaccacgggagcuacgagaccaagcagaccggcuccgccagcuccauggugaacggggugguccgccugcugacgaagccgugggacguggugcccauggucacccagauggcgaugaccgacaccacgcccuucggccagcagcgcguguucaaggagaagguggacacccggacccaggagcccaaggagggcaccaagaagcucaugaagaucacggccgaguggcuguggaaggagcuggggaagaagaagaccccgcgcaugugcacccgggaggaguucacccgcaagguccggagcaacgccgcccucggcgccaucuucacggacgagaacaaguggaaguccgcgcgcgaggccguggaggacgggcgguucugggagcuggucgaccgcgagcggaaccugcaccucgagggcaagugcgagaccugcguguacaacaugauggggaagcgcgagaagaagcugggcgaguucggcaaggccaaggggagccgggccaucugguacauguggcugggcgcgcgcuuccucgaguucgaggcccugggguuccugaacgaggaccacugguucucccggggcaacagccucagcgggguggagggcgagggccugcaccgccugggguacauccuccgggacgucuccaagaaggagggcggggccauguacgccgacgacaccgccggcugggacacccgcaucacgcuggaggaccugaagaacgaggagauggugaccaaccacaugaagggggagcacaagaagcucgcggaggccaucuucaagcugaccuaccagaacaaggugguccgggugcagcgccccacgccccggggcacggugauggacaucaucagccgccgggaccagcgcggcuccgggcaggucggcaccuacgggcugaacaccuucaccaacauggaggcccagcucauccgccagauggagggcgagggcaucuucaagagcauccagcaccugacggugaccgaggagaucgccgugcagaacuggcuggcccgggucgggcgcgagcggcucacccgcauggcgaucuccggcgacgacugcguggugaagcccaucgacgaccgguucgccaacgcccugaccgcccugaacgacauggggaagguccgcaaggacauccagcagugggagccgagccggggcuggaacgacuggacccaggugcccuucugcucccaccacuuccacgagcucgugaugaaggacgggcgcguccugguggugcccugccggaaccaggacgagcugaucggccgcgcccggaucagccagggcgcgggguggucccucaaggagaccgccugccugggcaagagcuacgcccagauguggacccugauguacuuccaccgccgggaccuccgccuggccgccaacgcgaucugcuccgccguccccagccacugggugccgaccucccggaccacguggagcauccacgccaagcacgaguggaugaccaccgaggacaugcuggccguguggaaccgcgucuggauccaggagaaccccuggauggaggacaagacccccguggaguccugggaggaggugcccuaccucgggaagcgggaggaccaguggugcggcagccugaucgggcugacgucccgcgcgaccugggccaagaacauccagaccgccaucaaccagguccggagccucaucggcaacgaggaguacaccgacuacaugccgagcaugaagcgcuuccgccgggaggaggaggaggccggcgugcugugguga

SEQ ID NO: 9100 - RNA, 9876 nt, Artificial Sequence
  derived and/or modified CDS sequence (opt1) from DENV-2__GQ868640__SS-prME
accgccggcgccaucgugaugcugauccccaccgucauggcguuccaccucaccacccgcaacggggagccccacaugaucgugggccggcaggagaaggggaagucccugcuguucaagaccgaggacggcgugaacaugugcacccucauggccaucgaccugggggagcugugcgaggacaccaucaccuacaagugcccccuccugcgccagaacgagcccgaggacaucgacugcuggugcaacuccaccuccaccugggucaccuacgggaccugcaccaccacgggcgagcaccggcgcgagaagcgguccguggcccuggugccccacgucgggaugggccucgagacccgcaccgagaccuggaugagcuccgagggggccuggaagcacgugcagcggaucgagacguggauccugcgccaccccggcuucaccaugauggccgcgauccuggccuacaccaucgggaccacgcacuuccagcgggcccucaucuucauccugcugaccgccguggcgcccagcaugaccaugcgcugcaucggcaucuccaaccgggacuucgucgagggcgugagcgggggcuccuggguggacaucguccucgagcacgggagcugcgugaccacgauggccaagaacaagcccacccuggacuucgagcugaucaagaccgaggccaagcagcccgccacccuccgcaaguacugcguggaggccaagcugacgaacaccaccaccgagucccggugcccgacgcagggcgagcccagccugaacgaggagcaggacaagcgcuucaucugcaagcacuccauggucgaccggggcugggggaacggcugcgggcuguucggcaagggcgggaucgugaccugcgcgauguucacgugcaagaagaacauggagggcaaggugguccagcccgagaaccuggaguacaccaucgugaucacgccccacagcggggaggagcacgccgugggcaacgacaccgggaagcacggcaaggagaucaagaucaccccgcaguccagcaucaccgaggccgagcugaccggguacggcacggucaccauggagugcagcccccgcaccggccucgacuucaacgagauggugcugcugcagauggaggacaaggccuggcucgugcaccggcagugguuccuggaccugccccuccccuggcugccgggggccgacacccagggcagcaacuggauccagaaggagacgcuggucaccuucaagaacccccacgcgaagaagcaggacguggucgugcucgggucccaggagggcgccaugcacaccgcccugaccggggccacggagauccagaugagcagcggcaaccuccuguucaccggccaccugaagugccgccugcggauggacaagcuccagcugaaggggauguccuacagcaugugcaccggcaaguucaagaucgugaaggagaucgccgagacccagcacgggacgaucgucauccgcgugcaguacgagggcgacggcucccccugcaagauccccuucgagaucauggaccuggagaagcggcacgugcucgggcgccugaucaccgucaacccgaucgugaccgagaaggacagccccgugaacaucgaggcggagccgcccuucggcgacuccuacaucaucaucggggucgagccgggccagcugaagcucaacugguucaagaaggggagcuccaucggccagauguucgagaccacgaugcgcggcgccaagcggauggccauccugggggacaccgccugggacuucggcagccucggcgggguguucaccuccaucgggaaggcccuccaccagguguucggggcgaucuacggcgccgccuucagcggggucuccuggaccaugaagauccugaucggcgugaucaucacguggaucgggaugaacagccgcuccaccagccuguccgugagccugguccucgugggcguggucacccuguaccugggggccauggugcaggcggacuccggcugcguggucagcuggaagaacaaggagcucaagugcggcuccgggaucuucaucaccgacaacgugcacacguggaccgagcaguacaaguuccagcccgagagccccagcaagcuggccuccgccauccagaaggcccacgaggagggcaucugcgggauccggagcgugacccgccuggagaaccucauguggaagcagaucacccccgagcugaaccacauccuguccgagaacgaggucaagcucacgaucaugaccggcgacaucaaggggaucaugcaggccggcaagcggagccugcgcccgcagcccaccgagcugaaguacuccuggaagaccuggggcaaggcgaagaugcuccccacggagagccacaaccagaccuuccugaucgacgggccggagaccgccgagugccccaacaccaaccgggccuggaacucccuggagguggaggacuacggcuucgggguguucacgaccaacaucuggcucaagcugcgcgagaagcaggacgucuucugcgacagcaagcugauguccgccgccaucaaggacaaccgggcggugcacgccgacaugggcuacuggaucgagagcgcccucaacgacaccuggaagauggagaaggccuccuucaucgaggucaagagcugccacuggcccaagucccacacccuguggagcaacggcgugcuggaguccgagaugaucauccccaagaacuucgccgggccggugagccagcacaacuaccgccccggcuaccacacccagacggcggggcccuggcaccucggcaagcuggagauggacuucgacuucugcgaggggaccaccguggucgugaccgaggacugcggcaaccggggccccucccugcgcacgaccaccgccagcgggaagcucaucaccgaguggugcugccggagcugcacgcugccgccccugcgcuaccggggcgaggacgggugcugguacggcauggagauccgcccccucaaggagaaggaggagaaccuggugaacucccuggucaccgccgggcacggccagaucgacaacuucagccucggcgugcuggggauggcccuguuccucgaggagaugcugcggacccgcgugggcaccaagcacgcgauccugcucgucgccguguccuucgugacgcugaucaccgggaacaugagcuuccgggaccugggccgcgucauggugauggugggggccaccaucaccgacgacaucggcaugggcgucacguaccucgcccugcuggccgcguucaaggugcgccccaccuucgccgccgggcuccugcugcggaagcucaccuccaaggagcugaugauggccaccaucggcguggcccugcucagccaguccacgaucccggagaccauccuggagcugaccgacgcgcucgcccuggggaugauggcccugaagaucgucaagaacauggagaaguaccagcucgccgugaccaucauggccaucagcugcgugcccaacgcggucauccugcagaacgccuggaagguguccugcacgauccuggccgccgucagcgugagcccccuccugcugaccagcucccagcagaaggcggacuggaucccccucgcccugaccaucaagggccugaacccgaccgccaucuuccucacgacccugagccgcaccuccaagaagcggagcuggccccugaacgaggccaucauggccgugggcauggucuccauccucgcgagcucccugcugaagaacgacgugcccaugaccgggccccucguggccggcgggcugcugacggucugcuacgugcucaccggccgcagcgccgaccuggagcuggagcgggccgccgacgugaagugggaggaccaggcggagaucagcggguccagcccgauccucuccaucaccaucagcgaggacggcuccaugagcaucaagaacgaggaggaggagcagacccugacgauccugauccgcaccggccuccuggucaucuccgggguguuccccgugagcauccccaucaccgccgccgccugguaccugugggaggucaagaagcagcgggccggcgugcucugggacgugcccuccccgccgcccgucgggaaggcggagcuggaggacggcgccuaccgcaucaagcagcgggggauccugggcuacagccagaucggcgccgggguguacaaggagggcaccuuccacaccauguggcacgugacgcgcggggccguccucaugcaccggggcaagcgcaucgagccguccugggccgacgugaagaaggaccuggugagcuacgggggcggcuggaagcuggagggggaguggaaggagggcgaggagguccaggugcucgcgcuggagcccgggaagaacccccgggccgugcagaccaagcccggcaucuucaagaccaacaccgggacgaucggcgccgucucccuggacuucagcccgggcaccuccgggagccccaucguggaccgcaagggcaagguggucgggcucuacggcaacggcguggugacccgguccggggccuacgucagcgcgaucgcccagaccgagaaguccaucgaggacaaccccgagaucgaggacgacaucuuccgcaagaagcggcugacgaucauggaccugcaccccggcgccgggaagaccaagcgcuaccucccggccaucgugcgggaggccaucaagcgcggccugcggacccugauccuggcgcccacccgcguggucgccgccgagauggaggaggcccuccgcgggcugcccauccgguaccagacgcccgccauccgcgcggagcacaccggccgggagaucguggaccugaugugccacgccaccuucaccaugcgccuccugagcccggugcggguccccaacuacaaccugaucaucauggacgaggcccacuucacggaccccgccagcaucgccgcgcgcggcuacaucuccacccggguggagaugggggaggccgccggcaucuucaugaccgccacgccgcccgggagccgcgaccccuucccccaguccaacgcgcccaucauggacgaggagcgggagauccccgagcgcagcuggaacuccggccacgagugggugacggacuucaaggggaagaccgucugguucgugcccagcaucaaggccggcaacgacaucgccgccugccuccggaagaacggcaagaaggugauccagcugucccgcaagaccuucgacagcgaguacgucaagacccgguccaacgacugggacuucguggugacgaccgacaucagcgagaugggggccaacuucaaggcggagcgcgucaucgacccccggcgcugcaugaagcccgugauccugaccgacggcgaggagcgggugauccucgccgggccgaugcccgucacccacuccagcgccgcccagcgccggggccgcaucgggcgcaaccccaagaacgagaacgaccaguacaucuacaugggcgagccccuggagaacgacgaggacugcgcccacuggaaggaggcgaagaugcugcucgacaacaucaacacgccggagggcaucauccccuccauguucgagcccgagcgggagaagguggacgccaucgacggggaguaccgccugcggggcgaggcccgcaagaccuucguggaccugaugcggcgcggggaccucccggucuggcuggccuacaagguggccgcggagggcaucaacuacgccgaccggcgcuggugcuucgacgggaucaagaacaaccagauccuggaggagaacgucgagguggagaucuggaccaaggagggcgagcggaagaagcucaagccccgcuggcuggacgcccggaucuacagcgacccccuggcccucaaggaguucaaggaguucgcggccggccgcaagucccugacccugaaccucaucacggagauggggcggcugcccaccuucaugacccagaaggcccgcaacgcccuggacaaccucgccgugcugcacaccgcggaggccggcgggaaggccuacaaccacgcccugagcgagcucccggagacgcuggagacccugcuccugcugacccuccuggccaccgucacgggcggcaucuuccuguuccucauguccgggaagggcaucgggaagaugacccugggcaugugcugcaucaucaccgcgagcauccugcucugguacgcccagauccagccccacuggaucgccgccuccaucauccuggaguucuuccugaucgugcuccugauccccgagcccgagaagcagcggaccccgcaggacaaccagcugaccuacguggucaucgccauccucacggugguggcggccaccauggccaacgagaugggguuccuggagaagaccaagaaggaccugggccucggcagcaucaccacgcaggagagcgaguccaacauccuggacaucgaccugcgccccgccagcgccuggacccucuacgcggucgccaccaccuucgugacgcccaugcugcggcacuccaucgagaacagcuccgugaacgucagccugaccgccaucgccaaccaggcgaccgugcucauggggcugggcaagggguggccccuguccaagauggacaucggcgugccgcuccuggccaucgggugcuacagccaggucaaccccaucacccugacggccgcccuccugcugcucguggcccacuacgcgaucaucggccccggccugcaggccaaggccacccgcgaggcccagaagcgggccgcggccgggaucaugaagaaccccaccguggacggcaucaccgucaucgaccuggagccgauccccuacgaccccaaguucgagaagcagcucggccaggugaugcugcugauccucugcgugacgcagguccugaugaugcgcaccaccugggcccugugcgaggcccucacccuggccacgggccccaucuccacccugugggaggggaacccgggccgguucuggaacaccaccaucgcggugagcauggccaacaucuuccgcggcuccuaccucgccggggccggccugcuguucagcaucaugaagaacacgaccaacacccgccgggggaccggcaacaucggcgagacgcucggggagaaguggaagucccgccugaacgcgcugggcaagagcgaguuccagaucuacaagaaguccgggauccaggagguggaccggacccucgccaaggagggcaucaagcgcggggagaccgaccaccacgccgucagccggggcuccgccaagcugcgcugguucguggagcggaacauggugacccccgagggcaaggucguggaccuggggugcggccgcgggggcuggagcuacuacugcgggggccucaagaacgugcgggaggucaagggccugacgaagggcggccccgggcacgaggagcccaucccgauguccaccuacggcuggaaccuggugcgccuccagagcgggguggacgucuucuucacgccgcccgagaagugcgacacccugcugugcgacaucggcgagagcucccccaacccgacgaucgaggccggccggacccuccgcgugcugaaccugguggagaacuggcucaacaacaacacccaguucugcaucaagguccugaaccccuacaugcccagcgugaucgagaagauggagacccugcagcggaaguacgggggcgcgcucgugcgcaacccgcugucccggaacagcacccacgagauguacugggucuccaacgccacggggaacaucgugagcuccgugaacaugaucagccgcaugcugaucaaccgguucaccaugaagcacaagaaggccaccuacgagcccgacgucgaccugggcuccgggacccgcaacaucggcaucgagagcgagauccccaaccucgacaucaucggcaagcggaucgagaagaucaagcaggagcacgagacguccuggcacuacgaccaggaccaccccuacaagaccugggccuaccacgggagcuacgagaccaagcagaccggcuccgccagcuccauggugaacggggugguccgccugcugacgaagccgugggacguggugcccauggucacccagauggcgaugaccgacaccacgcccuucggccagcagcgcguguucaaggagaagguggacacccggacccaggagcccaaggagggcaccaagaagcucaugaagaucacggccgaguggcuguggaaggagcuggggaagaagaagaccccgcgcaugugcacccgggaggaguucacccgcaagguccggagcaacgccgcccucggcgccaucuucacggacgagaacaaguggaaguccgcgcgcgaggccguggaggacgggcgguucugggagcuggucgaccgcgagcggaaccugcaccucgagggcaagugcgagaccugcguguacaacaugauggggaagcgcgagaagaagcugggcgaguucggcaaggccaaggggagccgggccaucugguacauguggcugggcgcgcgcuuccucgaguucgaggcccugggguuccugaacgaggaccacugguucucccggggcaacagccucagcgggguggagggcgagggccugcaccgccugggguacauccuccgggacgucuccaagaaggagggcggggccauguacgccgacgacaccgccggcugggacacccgcaucacgcuggaggaccugaagaacgaggagauggugaccaaccacaugaagggggagcacaagaagcucgcggaggccaucuucaagcugaccuaccagaacaaggugguccgggugcagcgccccacgccccggggcacggugauggacaucaucagccgccgggaccagcgcggcuccgggcaggucggcaccuacgggcugaacaccuucaccaacauggaggcccagcucauccgccagauggagggcgagggcaucuucaagagcauccagcaccugacggugaccgaggagaucgccgugcagaacuggcuggcccgggucgggcgcgagcggcucacccgcauggcgaucuccggcgacgacugcguggugaagcccaucgacgaccgguucgccaacgcccugaccgcccugaacgacauggggaagguccgcaaggacauccagcagugggagccgagccggggcuggaacgacuggacccaggugcccuucugcucccaccacuuccacgagcucgugaugaaggacgggcgcguccugguggugcccugccggaaccaggacgagcugaucggccgcgcccggaucagccagggcgcgggguggucccucaaggagaccgccugccugggcaagagcuacgcccagauguggacccugauguacuuccaccgccgggaccuccgccuggccgccaacgcgaucugcuccgccguccccagccacugggugccgaccucccggaccacguggagcauccacgccaagcacgaguggaugaccaccgaggacaugcuggccguguggaaccgcgucuggauccaggagaaccccuggauggaggacaagacccccguggaguccugggaggaggugcccuaccucgggaagcgggaggaccaguggugcggcagccugaucgggcugacgucccgcgcgaccugggccaagaacauccagaccgccaucaaccagguccggagccucaucggcaacgaggaguacaccgacuacaugccgagcaugaagcgcuuccgccgggaggaggaggaggccggcgugcugugguga

SEQ ID NO: 9101 - RNA, 9876 nt, Artificial Sequence
  derived and/or modified CDS sequence (opt1) from DENV-2__FJ850078__SS-prME
accgccggcgugaucgucaugcugauccccaccgugauggccuuccaccucaccacccgcaacggggagccccacaugaucgugggccggcaggagaaggggaagucccugcuguucaagaccgaggacggcgucaacaugugcacccucauggcgaucgaccugggggagcugugcgaggacaccaucaccuacaagugcccccuccugcgccagaacgagcccgaggacaucgacugcuggugcaacagcaccagcaccugggugaccuacgggaccugcaccaccacgggcgagcaccggcgcgagaagcgguccguggcccuggucccccacguggggaugggccucgagacccgcaccgagaccuggaugagcagcgagggggccuggaagcacgugcagcggaucgagaccuggauccugcgccaccccggcuucaccaugauggccgccauccuggcguacaccaucgggaccacgcacuuccagcgggcccucaucuucauccugcugaccgccgucgcccccagcaugaccaugcgcugcaucggcaucagcaaccgggacuucguggagggcgugagcgggggcagcugggucgacaucgugcucgagcacgggagcugcgugaccacgauggcgaagaacaagcccacccuggacuucgagcugaucaagaccgaggccaagcagcccgccacccuccgcaaguacugcgucgaggccaagcugacgaacaccaccaccgagucccggugcccgacgcagggcgagcccagccugaacgaggagcaggacaagcgcuucaucugcaagcacuccaugguggaccggggcugggggaacggcugcgggcuguucggcaagggcgggaucgugaccugcgccauguucacgugcaagaagaacauggagggcaaggucgugcagcccgagaaccuggaguacaccaucgugaucacgccccacagcggggaggagcacgcggucggcaacgacaccgggaagcacggcaaggagaucaagaucaccccgcaguccagcaucaccgaggccgagcugaccggguacggcacggugaccauggagugcagcccccggaccggccucgacuucaacgagauggugcugcugcagauggaggacaaggccuggcucguccaccggcagugguuccuggaccugccccuccccuggcugccgggggccgacacccagggcagcaacuggauccagaaggagacgcuggugaccuucaagaacccccacgccaagaagcaggacgucguggugcucgggucccaggagggcgcgaugcacaccgcccugaccggggccacggagauccagaugagcagcggcaaccuccuguucaccggccaccugaagugccgccugcggauggacaagcuccagcugaaggggauguccuacagcaugugcaccggcaaguucaagaucgucaaggagaucgccgagacccagcacgggacgaucgugauccgcgugcaguacgagggcgacggcucccccugcaagauccccuucgagaucauggaccuggagaagcggcacguccucgggcgccugaucaccgugaacccgaucgugaccgagaaggacagccccgucaacaucgaggccgagccgcccuucggcgacuccuacaucaucguggggguggagccgggccagcugaagcucaacugguucaagaaggggagcuccaucggccagauguucgagaccacgaugcgcggcgcgaagcggauggccauccugggggacaccgccugggacuucggcagccucgggggcgucuucaccuccaucgggaaggcccuccaccagguguucggcgccaucuacggcgcggccuucaacggggugagcuggaccaugaagauccugaucggcgucaucaucacguggaucgggaugaacucccgcagcaccucccugagcgugucccuggugcucgucggcguggugacccuguaccugggggccaugguccaggccgacagcggcugcgugguguccuggaagaacaaggagcucaagugcggcagcgggaucuucaucaccgacaacguccacacguggaccgagcaguacaaguuccagcccgagucccccagcaagcuggcgagcgccauccagaaggcccacgaggagggcaucugcgggauccgguccgugacccgccuggagaaccucauguggaagcagaucacccccgagcugaaccacauccugagcgagaacgaggugaagcucacgaucaugaccggcgacaucaaggggaucaugcaggccggcaagcggucccugcgcccgcagcccaccgagcugaaguacagcuggaagaccuggggcaaggccaagaugcuccccacggagucccacaaccagaccuuccugaucgacgggccggagaccgcggagugccccaacgccaaccgggccuggaacagccuggaggucgaggacuacggcuucgggguguucaccacgaacaucuggcucaagcugcgcgagaagcaggacguguucugcgacuccaagcugaugagcgccgccaucaaggacaaccgggcgguccacgccgacaugggcuacuggaucgaguccgcccucaacgacaccuggaagauggagaaggccagcuucaucgaggugaaguccugccacuggcccaagagccacacccugugguccaacggcgugcuggagagcgagaugaucauccccaagaacuucgccgggccggucucccagcacaacuaccgccccggcuaccacacccagaccgcggggcccuggcaccucggcaagcuggagauggacuucgacuucugcgaggggacgaccgugguggucaccgaggacugcggcaaccggggccccagccugcgcaccacgaccgccuccgggaagcucaucaccgaguggugcugccggagcugcacccugccgccccugcgcuaccggggcgaggacgggugcugguacggcauggagauccgcccccucaaggagaaggaggagaaccuggugaacagccuggugacggccgggcacggccagaucgacaacuucucccucggcguccuggggauggcccuguuccucgaggagaugcugcggacccgcgugggcaccaagcacgcgauccugcucguggccgucagcuucgugacccugaucacggggaacauguccuuccgggaccugggccgcgugauggucauggugggggccaccaugaccgacgacaucggcaugggcgugaccuaccucgcccugcuggccgcguucaagguccgccccacguucgccgccgggcuccugcugcggaagcucaccagcaaggagcugaugauggccaccaucggcguggcccugcucucccagagcaccaucccggagacgauccuggagcugaccgacgcgcucgcccuggggaugauggcccugaagaucgugaagaacauggagaaguaccagcucgccgucaccaucauggccaucuccugcgugcccaacgcggucauccugcagaacgccuggaaggugagcugcaccauccuggccgccguguccgucagcccccuccugcugacguccagccagcagaaggcggacuggaucccccucgcccugaccaucaagggccugaacccgaccgccaucuuccucaccacgcugucccgcaccagcaagaagcgguccuggccccugaacgaggccgugauggccgugggcauggucagcauccucgcguccagccugcugaagaacgacauccccaugaccgggccccucguggccggcgggcugcugaccgugugcuacguccucacgggccgcuccgccgaccuggagcuggagcgggccgccgacgugaagugggaggaccaggcggagaucagcgggagcuccccgauccucagcaucaccaucuccgaggacggcagcauguccaucaagaacgaggaggaggagcagacccugaccauccugauccgcacgggccuccuggugaucagcggggucuuccccguguccauccccaucaccgccgccgccugguaccugugggaggugaagaagcagcgggccggcguccucugggacgugcccagcccgccgcccguggagaaggcggagcuggaggacggggccuaccgcaucaagcagcggggcauccugggguacucccagaucggcgccggcgucuacaaggaggggaccuuccacaccauguggcacgugacccgcggcgccgugcucaugcaccgggggaagcgcaucgagccgagcugggccgacgucaagaaggaccugguguccuacggcgggggcuggaagcuggagggcgaguggaaggagggggaggaggugcagguccucgcgcuggagcccggcaagaacccccgggccgugcagacgaagcccgggaucuucaagaccaacaccggcaccaucggggccgugagccuggacuucuccccgggcacgagcggcucccccaucgucgaccgcaaggggaagguggugggccucuacgggaacggcgucgugacccggagcggcgccuacguguccgcgaucgcccagaccgagaaguccaucgaggacaaccccgagaucgaggacgacaucuuccgcaagaagcggcugaccaucauggaccugcaccccggggccggcaagacgaagcgcuaccucccggccaucguccgggaggccaucaagcgcgggcugcggacccugauccuggcgcccacccgcgugguggccgccgagauggaggaggcccuccgcggccugcccauccgguaccagacccccgccauccgcgcggagcacacggggcgggagaucgucgaccugaugugccacgccaccuucaccaugcgccuccuguccccggugcgggugcccaacuacaaccugaucaucauggacgaggcccacuucaccgaccccgccagcaucgccgcgcgcggcuacaucagcacgcgggucgagaugggcgaggccgccgggaucuucaugaccgccacgccgcccggcucccgcgaccccuucccccagagcaacgcgcccaucauggacgaggagcgggagauccccgagcgcuccuggaacagcgggcacgagugggugaccgacuucaagggcaagacggugugguucguccccuccaucaaggccgggaacgacaucgccgccugccuccggaagaacggcaagaaggugauccagcugagccgcaagaccuucgacuccgaguacgugaagacccggagcaacgacugggacuucgucgugaccacggacaucuccgagaugggcgccaacuucaaggcggagcgcgugaucgacccccggcgcugcaugaagcccgucauccugaccgacggggaggagcgggugauccucgccggcccgaugcccgugacccacagcuccgccgcccagcgccgggggcgcaucggccgcaaccccaagaacgagaacgaccaguacaucuacaugggggagccccuggagaacgacgaggacugcgcccacuggaaggaggcgaagaugcugcucgacaacaucaacaccccggagggcaucauccccagcauguucgagcccgagcgggagaaggucgacgccaucgacggcgaguaccgccugcgcggggaggcccgcaagacguucguggaccugaugcggcgcggcgaccucccggucuggcuggccuacaagguggccgcggaggggaucaacuacgccgaccggcgcuggugcuucgacggcaucaagaacaaccagauccuggaggagaacguggaggucgagaucuggaccaaggagggggagcggaagaagcucaagccccgcuggcuggacgcccggaucuacuccgacccccuggcccucaaggaguucaaggaguucgcggccggccgcaagagccugacccugaaccucaucaccgagaugggccggcugcccacguucaugacccagaaggcccgcaacgcccuggacaaccucgccgugcugcacaccgcggaggccgggggcaaggccuacaaccacgcccuguccgagcucccggagacccuggagacgcugcuccugcugacccuccuggccaccgugaccgggggcaucuuccuguuccucaugagcggcaaggggaucggcaagaugacgcuggggaugugcugcaucaucaccgcguccauccugcucugguacgcccagauccagccccacuggaucgccgccagcaucauccuggaguucuuccugaucguccuccugauccccgagcccgagaagcagcggaccccgcaggacaaccagcugaccuacguggugaucgccauccucaccgucguggcggccacgauggccaacgagaugggcuuccuggagaagaccaagaaggaccuggggcucggcuccaucaccacccaggagagcgagagcaacauccuggacaucgaccugcgccccgccuccgccuggacgcucuacgcgguggccaccaccuucgucacccccaugcugcggcacagcaucgagaacuccagcgugaacgugucccugacggccaucgccaaccaggcgaccguccucaugggccuggggaagggcuggccccugagcaagauggacaucggggugccgcuccuggccaucggcugcuacucccaggugaaccccaucacccugaccgccgcccuccugcugcucgucgcccacuacgcgaucaucgggcccggccugcaggccaaggccacgcgcgaggcccagaagcgggccgcggccggcaucaugaagaaccccaccguggacgggaucaccgugaucgaccuggagccgauccccuacgaccccaaguucgagaagcagcucggccaggucaugcugcugauccucugcgugacccaggugcugaugaugcgcacgaccugggcccugugcgaggcccucacccuggccaccgggcccaucagcacgcugugggagggcaacccggggcgguucuggaacaccaccaucgcggucuccauggccaacaucuuccgcggcagcuaccucgccggcgccgggcugcuguucuccaucaugaagaacaccacgaacacccgccggggcaccgggaacaucggcgagacccucggcgagaaguggaagucccgccugaacgcgcuggggaaguccgaguuccagaucuacaagaaguccggcauccaggagguggaccggacgcucgccaaggaggggaucaagcgcggcgagaccgaccaccacgccgugucccgggggagcgccaagcugcgcugguucgucgagcggaacauggugacccccgagggcaagguggucgaccugggcugcgggcgcggcgggugguccuacuacugcggcgggcucaagaacgugcgggaggugaagggccugacccgcggcgggcccggccacgaggagcccaucccgaugagcacguacggguggaaccugguccggcuccaguccggcguggacguguucuucacgccgcccgagaagugcgacacccugcugugcgacaucggggagagcagccccaacccgaccaucgaggccggccgcacgcuccggguccugaaccugguggagaacuggcucaacaacaacacccaguucugcaucaaggugcugaaccccuacaugcccuccgucaucgagaagauggagacccugcagcgcaaguacggcggggcgcucgugcggaacccgcugagccgcaacuccacccacgagauguacugggugagcaacgccaccggcaacaucgucuccagcgugaacaugaucucccggaugcugaucaaccgcuucacgaugaagcacaagaaggccaccuacgagcccgacguggaccuggggagcggcacccggaacaucgggaucgaguccgagauccccaaccucgacaucaucggcaagcgcaucgagaagaucaagcaggagcacgagaccagcuggcacuacgaccaggaccaccccuacaagacgugggccuaccacggcuccuacgagaccaagcagaccgggagcgccuccagcauggucaacggcguggugcgccugcugaccaagccgugggacgucgugcccauggugacgcagauggcgaugaccgacaccacccccuucgggcagcagcgggucuucaaggagaagguggacacgcgcacccaggagcccaaggagggcaccaagaagcucaugaagaucaccgccgaguggcuguggaaggagcugggcaagaagaagacgccgcggaugugcacccgcgaggaguucacccggaagguccgcuccaacgccgcccucggggccaucuucaccgacgagaacaaguggaaguccgcgcgggaggccguggaggacggccgcuucugggagcugguggaccgggagcgcaaccugcaccucgaggggaagugcgagacgugcgucuacaacaugaugggcaagcgggagaagaagcugggggaguucggcaaggccaagggcucccgcgccaucugguacauguggcugggggcgcgguuccucgaguucgaggcccugggcuuccugaacgaggaccacugguucagccgcgggaacucccucagcggcguggagggggagggccugcaccggcugggcuacauccuccgcgacgugagcaagaaggagggcggcgccauguacgccgacgacaccgccgggugggacacccggaucacccuggaggaccugaagaacgaggagauggucacgaaccacaugaagggcgagcacaagaagcucgcggaggccaucuucaagcugaccuaccagaacaagguggugcgcguccagcggcccacgccccgcgggaccgugauggacaucaucucccggcgcgaccagcgcggcagcggccagguggggacguacggccugaacaccuucaccaacauggaggcccagcucauccggcagauggagggggagggcaucuucaaguccauccagcaccugaccgucacggaggagaucgccgugcagaacuggcuggcccgcgugggccgggagcgccucacccggauggcgaucagcggggacgacugcgucgugaagcccaucgacgaccgcuucgccaacgcccugaccgcccugaacgacaugggcaaggugcggaaggacauccagcagugggagccgucccgcggguggaacgacuggacccagguccccuucugcagccaccacuuccacgagcucgugaugaaggacggccgggugcuggucgugcccugccgcaaccaggacgagcugaucgggcgggcccgcaucucccagggcgcgggcuggagccucaaggagacggccugccuggggaaguccuacgcccagauguggacccugauguacuuccaccggcgcgaccuccggcuggccgccaacgcgaucugcagcgccgugcccucccacugggucccgaccagccgcaccaccugguccauccacgccaagcacgaguggaugacgaccgaggacaugcuggccguguggaaccggguguggauccaggagaaccccuggauggaggacaagacccccgucgagagcugggaggaggugcccuaccucggcaagcgcgaggaccaguggugcgggucccugaucggccugaccagccgggcgacgugggccaagaacauccagaccgccaucaaccaggugcgcucccucaucgggaacgaggaguacaccgacuacaugccgagcaugaagcgcuuccggcgcgaggaggaggaggccggcguccugugguga

SEQ ID NO: 9102 - RNA, 9876 nt, Artificial Sequence
  derived and/or modified CDS sequence (opt1) from DENV-2__FJ850082__SS-prME
accgugggcgugaucgugaugcugauccccaccgccauggccuuccaccucaccacccgcaacggggagccccacaugaucgugggccggcaggagaaggggaagucccugcuguucaagaccgagaacggcgucaacaugugcacccucauggcgaucgaccugggggagcugugcgaggacaccaucaccuacaagugcccccuccugcgccagaacgagcccgaggacaucgacugcuggugcaacuccaccagcaccugggugaccuacgggaccugcaccaccacgggcgagcaccggcgcgagaagcgguccguggcccuggucccccacguggggaugggccucgagacccgcaccgagaccuggaugagcuccgagggggccuggaagcacgugcagcggaucgagacguggauccugcgccacccgggcuucaccaucauggccgccauccuggcguacaccaucgggaccacgcacuuccagcgggcccucaucuucauccugcugaccgccgucgcccccagcaugaccaugcgcugcaucggcaucuccaaccgggacuucguggagggcgugagcgggggcuccugggucgacaucgugcucgagcacgggagcugcgugaccacgauggcgaagaacaagcccacccuggacuucgagcugaucaagaccgaggccaagcagcccgccacccuccgcaaguacugcgucgaggccaagcugacgaacaccaccaccgagucccggugcccgacgcagggcgagcccagccugaacgaggagcaggacaagcgcuucaucugcaagcacuccaugguggaccggggcugggggaacggcugcgggcuguucggcaagggcgggaucgugaccugcgccauguucacgugcaagaagaacauggagggcaaggucgugcagcccgagaaccuggaguacaccaucgugaucacgccccacagcggggaggagcacgcggucggcaacgacaccgggaagcacggcaaggagaucaagaucaccccgcaguccagcaucaccgaggccgagcugaccggguacggcacggugaccauggagugcagcccccgcaccggccucgacuucaacgagauggugcugcugcagauggaggacaaggccuggcucguccaccggcagugguuccuggaccugccccuccccuggcugccgggggccgacacccagggcagcaacuggauccagaaggagacgcuggugaccuucaagaacccccacgccaagaagcaggacgucguggugcucgggucccaggagggcgcgaugcacaccgcccugaccggggccacggagauccagaugagcagcggcaaccuccuguucaccggccaccugaagugccgccugcggauggacaagcuccagcugaaggggauguccuacagcaugugcaccggcaaguucaagaucgucaaggagaucgccgagacccagcacgggacgaucgugauccgcgugcaguacgagggcgacggcucccccugcaagauccccuucgagaucauggaccuggagaagcggcacguccucgggcgccugaucaccgugaacccgaucgugaccgagaaggacagccccgucaacaucgaggccgagccgcccuucggcgacuccuacaucaucaucgggguggagccgggccagcugaagcucaacugguucaagaaggggagcuccaucggccagauguucgagaccacgaugcgcggcgcgaagcggauggccauccugggggacaccgccugggacuucggcagccucggcgggguguucaccuccaucgggaaggcccuccaccaggucuucggggccaucuacggcgcggccuucagcgggguguccuggaccaugaagauccugaucggcgugaucaucacguggaucgggaugaacagccgcuccaccagccuguccgucagccuggugcucgugggcgucgugacccuguaccugggggccauggugcaggccgacuccggcugcgucgugagcuggaagaacaaggagcucaagugcggcuccgggaucuucaucaccgacaacgugcacacguggaccgagcaguacaaguuccagcccgagagccccagcaagcuggcguccgccauccagaaggcccacgaggagggcaucugcgggauccggagcgucacccgccuggagaaccucauguggaagcagaucacccccgagcugaaccacauccuguccgagaacgaggugaagcucacgaucaugaccggcgacaucaaggggaucaugcaggccggcaagcggagccugcgcccgcagcccaccgagcugaaguacuccuggaagaccuggggcaaggccaagaugcucagcacggagucccacaaccagaccuuccugaucgacgggcccgagaccgcggagugcccgaacaccaaccgggccuggaacagccuggagguggaggacuacggcuucggggucuucacgaccaacaucuggcucaagcugcgcgagaagcaggacguguucugcgacuccaagcugaugagcgccgccgugaaggacaaccgggccguccacgcggacaugggcuacuggaucgaguccgcccucaacgacaccuggaagauggagaaggccagcuucaucgaggugaaguccugccacuggcccaagagccacacccugugguccaacggcgugcuggagagcgagaugaucauccccaagaacuucgccgggcccgucucccagcacaacuaccgcccgggcuaccacacccagacggccgggcccuggcaccucggcaagcuggagauggacuucgacuucugcgaggggaccaccgugguggucaccgaggacugcggcaaccggggccccagccugcgcacgaccaccgcgagcgggaagcucaucaccgaguggugcugccgguccugcacgcugcccccgcugcgcuaccggggcgaggacgggugcugguacggcauggagauccgcccccucaaggagaaggaggagaaccuggugaacagccuggugaccgccgggcacggccagaucgacaacuucucccucggcguccuggggauggcccuguuccucgaggagaugcugcggacccgcgugggcaccaagcacgccauccugcucguggcggucagcuucgugacgcugaucaccgggaacauguccuuccgggaccugggccgcgugauggucauggugggggccaccaugaccgacgacaucggcaugggcgugacguaccucgcccugcuggccgccuucaagguccgccccaccuucgcggccgggcuccugcugcggaagcucaccagcaaggagcugaugauggccaccaucggcguggcccugcucucccagagcacgauccccgagaccauccuggagcugaccgacgcccucgcgcuggggaugauggcccugaagaucgugaagaacauggagaaguaccagcucgccgucaccaucauggccaucuccugcgugccgaacgccgucauccugcagaacgcguggaaggugagcugcacgauccuggccgccguguccgucagcccccuccugcugaccuccagccagcagaaggccgacuggaucccccucgcgcugaccaucaagggccugaaccccaccgccaucuuccucacgacccugucccgcaccagcaagaagcgguccuggccgcugaacgaggccaucauggccgugggcauggugagcauccucgccuccagccugcugaagaacgacauccccaugaccgggccccucgucgcgggcgggcugcugacggugugcuacgugcucaccggccgcagcgccgaccuggagcuggagcgggccgccgacgucaagugggaggaccaggccgagaucuccgggagcucccccauccucagcaucaccaucuccgaggacggcagcauguccaucaagaacgaggaggaggagcagacccugacgauccugauccgcaccggccuccuggugaucagcgggguguucccggucuccauccccaucaccgcggccgccugguaccugugggaggugaagaagcagcgggccggcgugcucugggacguccccagcccgccgcccguggggaaggccgagcuggaggagggcgcguaccgcaucaagcagcgggggauccugggcuacucccagaucggcgccgggguguacaaggagggcaccuuccacaccauguggcacgucacgcgcggggccgugcucaugcaccggggcaagcgcaucgagcccagcugggccgacgugaagaaggaccuggucuccuacgggggcggcuggaagcuggagggggaguggaaggagggcgaggagguccaggugcucgcccuggagcccgggaagaacccccgggcgguccagaccaagcccggcaucuucaagaccaacaccgggacgaucggcgccgugagccuggacuucucccccggcaccagcgggucccccaucguggaccgcaagggcaaggucguggggcucuacggcaacggcguggucacccggagcggggccuacguguccgccaucgcgcagaccgacaagagcaucgaggacaaccccgagaucgaggacgacaucuuccgcaagaagcggcugacgaucauggaccugcaccccggcgccgggaagaccaagcgcuaccuccccgccaucgugcgggaggccaucaagcgcggccugcggacccugauccuggccccgacccgcgucguggcggccgagauggaggaggcccuccgcgggcugcccauccgguaccagacgcccgccauccgcgccgagcacaccggccgggagaucguggaccugaugugccacgcgaccuucaccaugcgccuccugagccccguccgggugccgaacuacaaccugaucaucauggacgaggcccacuucacggaccccgccuccaucgccgcccgcggcuacaucagcacccggguggagaugggggaggcggccggcaucuucaugaccgccacgccgcccgggucccgcgacccguucccccagagcaacgcccccaucauggacgaggagcgggagauccccgagcgcuccuggaacagcggccacgagugggucacggacuucaaggggaagaccgugugguucgugccguccaucaaggcgggcaacgacaucgccgccugccuccggaagaacggcaagaaggucauccagcugagccgcaagaccuucgacuccgaguacgugaagacccgggccaacgacugggacuucguggucacgaccgacaucagcgagaugggggccaacuucaaggcggagcgcgugaucgacccccggcgcugcaugaagcccgugauccugaccgacggcgaggagcgggucauccucgccgggcccaugccggugacccacuccagcgccgcccagcgccggggccgcaucgggcgcaaccccaagaacgagaacgaccaguacaucuacaugggcgagccccuggagaacgacgaggacugcgcccacuggaaggaggcgaagaugcugcucgacaacaucaacacgcccgagggcaucaucccguccauguucgagcccgagcgggagaagguggacgccaucgacggggaguaccgccugcggggcgaggcccgcaagaccuucgucgaccugaugcggcgcggggaccuccccguguggcuggccuacaaggucgccgcggagggcaucaacuacgccgaccggcgcuggugcuucgacgggaucaagaacaaccagauccuggaggagaacguggagguggagaucuggaccaaggagggcgagcggaagaagcucaagccgcgcuggcuggacgcccggaucuacagcgacccccuggcccucaaggaguucaaggaguucgcggccggccgcaagucccugacccugaaccucaucacggagauggggcggcugcccaccuucaugacccagaaggcccgcaacgcccuggacaaccucgccguccugcacaccgcggaggccggcgggaaggccuacaaccacgcccugagcgagcuccccgagacgcuggagacccugcuccugcugacccuccuggccaccgugacgggcggcaucuuccuguuccucauguccgggaagggcaucgggaagaugacccugggcaugugcugcaucaucaccgcgagcauccugcucugguacgcccagauccagccgcacuggaucgccgccuccaucauccuggaguucuuccugaucgugcuccugauccccgagcccgagaagcagcggacgccccaggacaaccagcugaccuacgucgugaucgccauccucacgguggucgcggccaccauggccaacgagaugggguuccuggagaagaccaagaaggaccugggccucggcagcaucaccacgcaggagagcgaguccaacauccuggacaucgaccugcgcccggccagcgccuggacccucuacgcgguggccaccaccuucgugacgcccaugcugcggcacuccaucgagaacagcuccgucaacgugagccugaccgccaucgccaaccaggcgaccgugcucauggggcugggcaagggguggccccuguccaagauggacaucggcgucccccuccuggccaucgggugcuacagccaggugaacccgaucacccugacggccgcccuccugcugcucguggcccacuacgcgaucaucggccccggccugcaggccaaggccacccgcgaggcccagaagcgggccgcggccgggaucaugaagaaccccaccgucgacggcaucaccgugaucgaccuggagcccaucccguacgaccccaaguucgagaagcagcucggccaggugaugcugcugauccucugcgucacccaggugcugaugaugcgcaccaccugggcccugugcgaggcccucacccuggccacgggccccaucuccacccugugggaggggaaccccggccgguucuggaacaccaccaucgcggugagcauggccaacaucuuccgcggcuccuaccucgccggggccggccugcuguucagcaucaugaagaacacgaccaacacccgccgggggaccggcaacaucggcgagacgcucggggagaaguggaagucccgccugaacgcgcugggcaagagcgaguuccagaucuacaagaaguccgggauccaggaggucgaccggacccucgccaaggagggcaucaagcgcggggagaccgaccaccacgccgugagccggggcuccgccaagcugcgcugguucguggagcggaacauggucaccccggagggcaaggugguggaccuggggugcggccgcgggggcuggagcuacuacugcgggggccucaagaacguccgggaggugaagggccugacgaagggcgggcccgggcacgaggagcccauccccauguccaccuacggcuggaaccuggugcgccuccagagcggggucgacguguucuucaccccgcccgagaagugcgacacccugcugugcgacaucggcgagagcucccccaaccccacgaucgaggccggccggacccuccgcgugcugaaccuggucgagaacuggcucaacaacaacacccaguucugcaucaaggugcugaacccguacaugcccagcgugaucgagaagauggagacccugcagcggaaguacgggggcgcgcucguccgcaacccccugucccggaacagcacccacgagauguacuggguguccaacgccacggggaacaucgugagcuccgucaacaugaucagccgcaugcugaucaaccgguucaccaugaagcacaagaaggccaccuacgagccggacguggaccugggcuccgggacccgcaacaucggcaucgagagcgaggugcccaaccucgacaucaucggcaagcggaucgagaagaucaagcaggagcacgagacguccuggcacuacgaccaggaccaccccuacaagaccugggccuaccacgggagcuacgagaccaagcagaccggcuccgccagcuccauggucaacgggguggugcgccugcugacgaagcccugggacgucgugccgauggugacccagauggcgaugaccgacaccacgcccuucggccagcagcgcgucuucaaggagaagguggacacccggacccaggagcccaaggagggcaccaagaagcucaugaagaucacggccgaguggcuguggaaggagcuggggaagaagaagaucccccgcaugugcacccgggaggaguucacccgcaagguccggagcaacgccgcccucggcgccaucuucaccgacgagaacaaguggaaguccgcgcgcgaggccguggaggacgggcgguucugggagcugguggaccgcgagcggaaccugcaccucgagggcaagugcgagacgugcgucuacaacaugauggggaagcgcgagaagaagcugggcgaguucggcaaggccaaggggagccgggccaucugguacauguggcugggcgcgcgcuuccucgaguucgaggcccugggguuccugaacgaggaccacugguucucccggggcaacagccucagcgggguggagggcgagggccugcaccgccugggguacauccuccgggacguguccaagaaggagggcggggccauguacgccgacgacaccgccggcugggacacccgcaucacccuggaggaccugaagaacgaggagaugaucacgaaccacaugaagggggagcacaagaagcucgcggaggccaucuucaagcugaccuaccagaacaaggucgugcgggugcagcgcccgacgccccggggcaccgucauggacaucaucagccgccgggaccagcgcggcuccggccaggugggcacguacgggcugaacaccuucaccaacauggaggcccagcucauccgccagauggagggcgagggcaucuucaagagcauccagcaccugaccgugacggaggagaucgccguccagaacuggcuggcccggguggggcgcgagcggcucacccgcauggcgaucuccggcgacgacugcguggucaagcccaucgacgaccgguucgccaacgcccugaccgcccugaacgacauggggaaggugcgcaaggacauccagcagugggagcccagccggggcuggaacgacuggacccaggugccguucugcucccaccacuuccacgagcucgucaugaaggacgggcgcgugcuggugguccccugccggaaccaggacgagcugaucggccgcgcccggaucagccagggcgcgggguggucccucaaggagacggccugccugggcaagagcuacgcccagauguggacccugauguacuuccaccgccgggaccuccgccuggccgccaacgcgaucugcuccgccgugcccagccacugggugcccaccucccggaccaccuggagcauccacgccaagcacgaguggaugacgaccgaggacaugcuggccgucuggaaccgcguguggauccaggagaacccguggauggaggacaagacccccguggaguccugggaggagguccccuaccucgggaagcgggaggaccaguggugcggcagccugaucgggcugaccucccgcgcgacgugggccaagaacauccagaccgccaucaaccaggugcggagccucaucggcaacgagggcuacaccgacuacaugcccagcaugaagcgcuuccgccgggaggaggaggaggccggggugcugugguga

SEQ ID NO: 9103 - RNA, 9876 nt, Artificial Sequence
  derived and/or modified CDS sequence (opt1) from DENV-2__FJ850085__SS-prME
accgugggcgugaucgugaugcugauccccaccgccauggccuuccaccucaccacccgcaacggggagccccacaugaucgugggccggcaggagaaggggaagucccugcuguucaagaccgagaacggcgucaacaugugcacccucauggcgaucgaccugggggagcugugcgaggacaccaucaccuacaagugcccccuccugcgccagaacgagcccgaggacaucgacugcuggugcaacuccaccagcaccugggugaccuacgggaccugcaccaccacgggcgagcaccggcgcgagaagcgguccguggcccuggucccccacguggggaugggccucgagacccgcaccgagaccuggaugagcuccgagggggccuggaagcacgugcagcggaucgagaccuggauccugcgccacccgggcuucaccaucauggccgccauccuggcguacaccaucgggaccacgcacuuccagcgggcccucaucuucauccugcugaccgccgucgcccccagcaugaccaugcgcugcaucggcaucuccaaccgggacuucguggagggcgugagcgggggcuccugggucgacaucgugcucgagcacgggagcugcgugaccacgauggcgaagaacaagcccacccuggacuucgagcugaucaagaccgaggccaagcagcccgccacccuccgcaaguacugcgucgaggccaagcugacgaacaccaccaccgagucccggugcccgacgcagggcgagcccagccugaacgaggagcaggacaagcgcuucaucugcaagcacuccaugguggaccggggcugggggaacggcugcgggcuguucggcaagggcgggaucgugaccugcgccauguucacgugcaagaagaacauggagggcaaggucgugcagcccgagaaccuggaguacaccaucgugaucacgccccacagcggggaggagcacgcggucggcaacgacaccgggaagcacggcaaggagaucaagaucaccccgcaguccagcaucaccgaggccgagcugaccggguacggcacggugaccauggagugcagcccccgcaccggccucgacuucaacgagauggugcugcugcagauggaggacaaggccuggcucguccaccggcagugguuccuggaccugccccuccccuggcugccgggggccgacacccagggcagcaacuggauccagaaggagacgcuggugaccuucaagaacccccacgccaagaagcaggacgucguggugcucgggucccaggagggcgcgaugcacaccgcccugaccggggccacggagauccagaugagcagcggcaaccuccuguucaccggccaccugaagugccgccugcggauggacaagcuccagcugaaggggauguccuacagcaugugcaccggcaaguucaagaucgucaaggagaucgccgagacccagcacgggacgaucgugauccgcgugcaguacgagggcgacggcucccccugcaagauccccuucgagaucauggaccuggagaagcggcacguccucgggcgccugaucaccgugaacccgaucguggccgagaaggacagccccgucaacaucgaggcggagccgcccuucggcgacuccuacaucaucaucgggguggagccgggccagcugaagcucaacugguucaagaaggggagcuccaucggccagauguucgagaccaccaugcgcggcgccaagcggauggccauccugggggacacggccugggacuucggcagccucggcgggguguucaccuccaucgggaaggcccuccaccaggucuucggggcgaucuacggcgccgccuucagcgggguguccuggaccaugaagauccugaucggcgugaucaucaccuggaucgggaugaacagccgcuccacgagccuguccgucagccuggugcucgugggcgucgugacccuguaccugggggccauggugcaggcggacuccggcugcgucgugagcuggaagaacaaggagcucaagugcggcuccgggaucuucaucaccgacaacgugcacaccuggacggagcaguacaaguuccagcccgagagccccagcaagcuggccuccgccauccagaaggcccacgaggagggcaucugcgggauccggagcgucacccgccuggagaaccucauguggaagcagaucacccccgagcugaaccacauccuguccgagaacgaggugaagcucaccaucaugacgggcgacaucaaggggaucaugcaggccggcaagcggagccugcgcccgcagcccaccgagcugaaguacuccuggaagaccuggggcaaggcgaagaugcucagcaccgagucccacaaccagacguuccugaucgacgggcccgagaccgccgagugcccgaacaccaaccgggccuggaacagccuggagguggaggacuacggcuucggggucuucaccacgaacaucuggcucaagcugcgcgagaagcaggacguguucugcgacuccaagcugaugagcgccgccgugaaggacaaccgggcgguccacgccgacaugggcuacuggaucgaguccgcccucaacgacaccuggaagauggagaaggccagcuucaucgaggugaaguccugccacuggcccaagagccacacccugugguccaacggcgugcuggagagcgagaugaucauccccaagaacuucgccgggcccgucucccagcacaacuaccgcccgggcuaccacacccagaccgcggggcccuggcaccucggcaagcuggagauggacuucgacuucugcgaggggacgaccgugguggucaccgaggacugcggcaaccggggccccagccugcgcaccacgaccgccagcgggaagcucaucaccgaguggugcugccgguccugcacccugcccccgcugcgcuaccggggcgaggacgggugcugguacggcauggagauccgcccccucaaggagaaggaggagaaccuggugaacagccuggugacggccgggcacggccagaucgacaacuucucccucggcguccuggggauggcccuguuccucgaggagaugcugcggacccgcgugggcaccaagcacgcgauccugcucguggccgucagcuucgugacccugaucacggggaacauguccuuccgggaccugggccgcgugauggucauggugggggccaccaugaccgacgacaucggcaugggcgugaccuaccucgcccugcuggccgcguucaagguccgccccacguucgccgccgggcuccugcugcggaagcucaccagcaaggagcugaugauggccaccaucggcguggcccugcucucccagagcaccauccccgagacgauccuggagcugaccgacgcgcucgcccuggggaugauggcccugaagaucgugaagaacauggagaaguaccagcucgccgucaccaucauggccaucuccugcgugccgaacgcggucauccugcagaacgccuggaaggugagcugcaccauccuggccgccguguccgucagcccccuccugcugacguccagccagcagaaggcggacuggaucccccucgcccugaccaucaagggccugaaccccaccgccaucuuccucaccacgcugucccgcaccagcaagaagcgguccuggccgcugaacgaggccaucauggccgugggcauggugagcauccucgcguccagccugcugaagaacgacauccccaugaccgggccccucgucgccggcgggcugcugaccgugugcuacgugcucacgggccgcagcgccgaccuggagcuggagcgggccgccgacgucaagugggaggaccaggcggagaucuccgggagcucccccauccucagcaucaccaucuccgaggacggcagcauguccaucaagaacgaggaggaggagcagacccugaccauccugauccgcacgggccuccuggugaucagcgggguguucccggucuccauccccaucaccgccgccgccugguaccugugggaggugaagaagcagcgggccggcgugcucugggacguccccagcccgccgcccguggggaaggcggagcuggaggagggcgccuaccgcaucaagcagcgggggauccugggcuacucccagaucggcgccgggguguacaaggagggcaccuuccacaccauguggcacgucacccgcggggccgugcucaugcaccggggcaagcgcaucgagcccagcugggccgacgugaagaaggaccuggucuccuacgggggcggcuggaagcuggagggggaguggaaggagggcgaggagguccaggugcucgcgcuggagcccgggaagaacccccgggccguccagacgaagcccggcaucuucaagaccaacaccgggaccaucggcgccgugagccuggacuucucccccggcacgagcgggucccccaucguggaccgcaagggcaaggucguggggcucuacggcaacggcguggucacccggagcggggccuacguguccgcgaucgcccagaccgacaagagcaucgaggacaaccccgagaucgaggacgacaucuuccgcaagaagcggcugaccaucauggaccugcaccccggcgccgggaagacgaagcgcuaccuccccgccaucgugcgggaggccaucaagcgcggccugcggacccugauccuggcgccgacccgcgucguggccgccgagauggaggaggcccuccgcgggcugcccauccgguaccagacccccgccauccgcgcggagcacacgggccgggagaucguggaccugaugugccacgccaccuucaccaugcgccuccugagccccguccgggugccgaacuacaaccugaucaucauggacgaggcccacuucaccgaccccgccuccaucgccgcgcgcggcuacaucagcacgcggguggagaugggggaggccgccggcaucuucaugaccgccacgccgcccgggucccgcgacccguucccccagagcaacgcgcccaucauggacgaggagcgggagauccccgagcgcuccuggaacagcggccacgagugggucaccgacuucaaggggaagacggugugguucgugccguccaucaaggccggcaacgacaucgccgccugccuccggaagaacggcaagaaggucauccagcugagccgcaagaccuucgacuccgaguacgugaagacccgggccaacgacugggacuucguggucaccacggacaucagcgagaugggggcgaacuucaaggccgagcgcgugaucgacccccggcgcugcaugaagcccgugauccugaccgacggcgaggagcgggucauccucgccgggcccaugccggugacccacuccagcgccgcccagcgccggggccgcaucgggcgcaaccccaagaacgagaacgaccaguacaucuacaugggcgagccccuggagaacgacgaggacugcgcgcacuggaaggaggccaagaugcugcucgacaacaucaacacccccgagggcaucaucccguccauguucgagcccgagcgggagaagguggacgccaucgacggggaguaccgccugcggggcgaggcccgcaagacguucgucgaccugaugcggcgcggggaccuccccguguggcuggccuacaaggucgcggccgagggcaucaacuacgccgaccggcgcuggugcuucgacgggaucaagaacaaccagauccuggaggagaacguggagguggagaucuggaccaaggagggcgagcggaagaagcucaagccgcgcuggcuggacgcccggaucuacagcgacccccuggcgcucaaggaguucaaggaguucgccgccggccgcaagucccugacccugaaccucaucaccgagauggggcggcugcccacguucaugacccagaaggcccgcaacgcccuggacaaccucgcgguccugcacaccgccgaggccggcgggaaggccuacaaccacgcccugagcgagcuccccgagacccuggagacgcugcuccugcugacccuccuggcgaccgugaccggcggcaucuuccuguuccucauguccgggaagggcaucgggaagaugacgcugggcaugugcugcaucaucaccgccagcauccugcucugguacgcccagauccagccgcacuggaucgccgccuccaucauccuggaguucuuccugaucgugcuccugauccccgagcccgagaagcagcggacgccccaggacaaccagcugaccuacgucgugaucgcgauccucaccguggucgccgccacgauggccaacgagaugggguuccuggagaagaccaagaaggaccugggccucggcagcaucaccacccaggagagcgaguccaacauccuggacaucgaccugcgcccggccagcgcguggacgcucuacgccguggccaccaccuucgugacccccaugcugcggcacuccaucgagaacagcuccgucaacgugagccugacggccaucgcgaaccaggccaccgugcucauggggcugggcaagggguggccccuguccaagauggacaucggcgucccccuccuggccaucgggugcuacagccaggugaacccgaucacccugaccgccgcccuccugcugcucguggcgcacuacgccaucaucggccccggccugcaggccaaggccacgcgcgaggcccagaagcgggcggccgccgggaucaugaagaaccccaccgucgacggcaucaccgugaucgaccuggagcccaucccguacgaccccaaguucgagaagcagcucggccaggugaugcugcugauccucugcgucacccaggugcugaugaugcgcacgaccugggcccugugcgaggcccucacccuggcgaccggccccaucuccacgcugugggaggggaaccccggccgguucuggaacaccaccaucgccgugagcauggccaacaucuuccgcggcuccuaccucgccggggcgggccugcuguucagcaucaugaagaacaccacgaacacccgccgggggaccggcaacaucggcgagacccucggggagaaguggaagucccgccugaacgcccugggcaagagcgaguuccagaucuacaagaaguccgggauccaggaggucgaccggacgcucgccaaggagggcaucaagcgcggggagaccgaccaccacgccgugagccggggcuccgccaagcugcgcugguucguggagcggaacauggucaccccggagggcaaggugguggaccuggggugcggccgcgggggcuggagcuacuacugcgggggccucaagaacguccgggaggugaagggccugaccaagggcgggcccgggcacgaggagcccauccccauguccacguacggcuggaaccuggugcgccuccagagcggggucgacguguucuucaccccgcccgagaagugcgacacccugcugugcgacaucggcgagagcucccccaaccccaccaucgaggcgggccggacgcuccgcgugcugaaccuggucgagaacuggcucaacaacaacacccaguucugcaucaaggugcugaacccguacaugcccagcgugaucgagaagauggagacccugcagcggaaguacgggggcgcccucguccgcaacccccugucccggaacagcacccacgagauguacuggguguccaacgccaccgggaacaucgugagcuccgucaacaugaucagccgcaugcugaucaaccgguucacgaugaagcacaagaaggccaccuacgagccggacguggaccugggcuccgggacccgcaacaucggcaucgagagcgaggugcccaaccucgacaucaucggcaagcggaucgagaagaucaagcaggagcacgagaccuccuggcacuacgaccaggaccaccccuacaagacgugggccuaccacgggagcuacgagaccaagcagaccggcuccgcgagcuccauggucaacgggguggugcgccugcugaccaagcccugggacgucgugccgauggugacgcagauggccaugaccgacaccacccccuucggccagcagcgcgucuucaaggagaagguggacacgcggacccaggagcccaaggagggcaccaagaagcucaugaagaucaccgccgaguggcuguggaaggagcuggggaagaagaagaucccccgcaugugcacgcgggaggaguucacccgcaagguccggagcaacgccgcccucggcgcgaucuucaccgacgagaacaaguggaaguccgcccgcgaggccguggaggacgggcgguucugggagcugguggaccgcgagcggaaccugcaccucgagggcaagugcgagaccugcgucuacaacaugauggggaagcgcgagaagaagcugggcgaguucggcaaggccaaggggagccgggcgaucugguacauguggcugggcgcccgcuuccucgaguucgaggcccugggguuccugaacgaggaccacugguucucccggggcaacagccucagcgggguggagggcgagggccugcaccgccugggguacauccuccgggacguguccaagaaggagggcggggccauguacgccgacgacacggcgggcugggacacccgcaucacccuggaggaccugaagaacgaggagaugaucaccaaccacaugaagggggagcacaagaagcucgccgaggccaucuucaagcugacguaccagaacaaggucgugcgggugcagcgcccgacgccccggggcaccgucauggacaucaucagccgccgggaccagcgcggcuccggccaggugggcaccuacgggcugaacacguucaccaacauggaggcccagcucauccgccagauggagggcgagggcaucuucaagagcauccagcaccugaccgugaccgaggagaucgccguccagaacuggcuggcgcggguggggcgcgagcggcucacgcgcauggccaucuccggcgacgacugcguggucaagcccaucgacgaccgguucgccaacgcccugaccgcccugaacgacauggggaaggugcgcaaggacauccagcagugggagcccagccggggcuggaacgacuggacccaggugccguucugcucccaccacuuccacgagcucgucaugaaggacgggcgcgugcuggugguccccugccggaaccaggacgagcugaucggccgcgcgcggaucagccagggcgccggguggucccucaaggagaccgccugccugggcaagagcuacgcccagauguggacgcugauguacuuccaccgccgggaccuccgccuggccgcgaacgccaucugcuccgccgugcccagccacugggugcccaccucccggaccaccuggagcauccacgccaagcacgaguggaugaccacggaggacaugcuggcggucuggaaccgcguguggauccaggagaacccguggauggaggacaagacccccguggaguccugggaggagguccccuaccucgggaagcgggaggaccaguggugcggcagccugaucgggcugaccucccgcgccaccugggccaagaacauccagacggccaucaaccaggugcggagccucaucggcaacgagggcuacaccgacuacaugcccagcaugaagcgcuuccgccgggaggaggaggaggccggggugcugugguga

SEQ ID NO: 9104 - RNA, 9876 nt, Artificial Sequence
  derived and/or modified CDS sequence (opt1) from DENV-2__FJ850088__SS-prME
accgccggcgugaucgugaugcugauccccaccgugauggccuuccaccucaccacccgcaacggggagccccacaugaucgugggccggcaggagaaggggaagucccugcuguucaagaccgaggacggcgucaacaugugcacccucauggcgaucgaccugggggagcugugcgaggacaccaucaccuacaagugcccccuccugcgccagaacgagcccgaggacaucgacugcuggugcaacagcaccagcaccugggugaccuacgggaccugcaccaccacgggcgagcaccggcgcgagaagcgguccguggcccuggucccccacguggggaugggccucgagacccgcaccgagaccuggaugagcagcgagggggccuggaagcacgugcagcggaucgagacguggauccugcgccaccccggcuucaccaugauggccgccauccuggcguacaccaucgggaccacgcacuuccagcgggcccucaucuucauccugcugaccgccgucgcccccagcaugaccaugcgcugcaucggcaucagcaaccgggacuucguggagggcgugagcgggggcagcugggucgacaucgugcucgagcacgggagcugcgugaccacgauggcgaagaacaagcccacccuggacuucgagcugaucaagaccgaggccaagcagcccgccacccuccgcaaguacugcgucgaggccaagcugacgaacaccaccaccgagucccggugcccgacgcagggcgagcccagccugaacgaggagcaggacaagcgcuucaucugcaagcacuccaugguggaccggggcugggggaacggcugcgggcuguucggcaagggcgggaucgugaccugcgccauguucacgugcaagaagaacauggagggcaaggucgugcagcccgagaaccuggaguacaccaucgugaucacgccccacagcggggaggagcacgcggucggcaacgacaccgggaagcacggcaaggaggugaagaucaccccgcaguccagcaucaccgaggccgagcugaccggguacggcacggugaccauggagugcagcccccggaccggccucgacuucaacgagaugguccugcugcagauggaggacaaggccuggcucgugcaccggcagugguuccuggaccugccccuccccuggcugccgggggccgacacccagggcagcaacuggauccagaaggagacgcuggucaccuucaagaacccccacgccaagaagcaggacguggugguccucgggucccaggagggcgcgaugcacaccgcccugaccggggccacggagauccagaugagcagcggcaaccuccuguucaccggccaccugaagugccgccugcggauggacaagcuccagcugaaggggauguccuacagcaugugcaccggcaaguucaagaucgugaaggagaucgccgagacccagcacgggacgaucgugauccgcguccaguacgagggcgacggcucccccugcaagauccccuucgagaucauggaccuggagaagcggcacgugcucgggcgccugaucaccgugaacccgaucgucaccgagaaggacagccccgugaacaucgaggccgagccgcccuucggcgacuccuacaucaucgugggggucgagccgggccagcugaagcucaacugguucaagaaggggagcuccaucggccagauguucgagaccacgaugcgcggcgcgaagcggauggccauccugggggacaccgccugggacuucggcagccucgggggcguguucaccuccaucgggaaggcccuccaccagguguucggcgccaucuacggcgcggccuucaacggggucagcuggaccaugaagauccugaucggcgugaucaucacguggaucgggaugaacucccgcagcaccucccugagcgugucccugguccucgugggcguggucacccuguaccugggggccauggugcaggccgacagcggcugcguggucuccuggaagaacaaggagcucaagugcggcagcgggaucuucaucaccgacaacgugcacacguggaccgagcaguacaaguuccagcccgagucccccagcaagcuggcgagcgccauccagaaggcccacgaggagggcaucugcgggauccgguccgugacccgccuggagaaccucauguggaagcagaucacccccgagcugaaccacauccugagcgagaacgaggucaagcucacgaucaugaccggcgacaucaaggggaucaugcaggccggcaagcggucccugcgcccgcagcccaccgagcugaaguacagcuggaagaccuggggcaaggccaagaugcuccccacggagucccacaaccagaccuuccugaucgacgggccggagaccgcggagugccccaacgccaaccgggccuggaacagccuggagguggaggacuacggcuucgggguguucaccacgaacaucuggcucaagcugcgcgagaagcaggacgucuucugcgacuccaagcugaugagcgccgccaucaaggacaaccgggcggugcacgccgacaugggcuacuggaucgaguccgcccucaacgacaccuggaagauggagaaggccagcuucaucgaggugaaguccugccacuggcccaagagccacacccugugguccaacggcguccuggagagcgagaugaucauccccaagaacuucgccgggccggugucccagcacaacuaccgccccggcuaccacacccagaccgcggggcccuggcaccucggcaagcuggagauggacuucgacuucugcgaggggacgaccguggucgugaccgaggacugcggcaaccggggccccagccugcgcaccacgaccgccuccgggaagcucaucaccgaguggugcugccggagcugcacccugccgccccugcgcuaccggggcgaggacgggugcugguacggcauggagauccgcccccucaaggagaaggaggagaaccuggugaacagccuggucacggccgggcacggccagaucgacaacuucucccucggcgugcuggggauggcccuguuccucgaggagaugcugcggacccgcgugggcaccaagcacgcgauccugcucgucgccgugagccuggugacccugaucacggggaacauguccuuccgggaccucggccgcgucauggugauggugggggccaccaugaccgacgacaucggcaugggcgucaccuaccuggcccugcucgccgcguucaaggugcgccccacguucgccgccgggcugcugcuccggaagcugaccagcaaggagcugaugauggccaccaucggcguggcccuccugucccagagcaccaucccggagacgauccuggagcucaccgacgcgcuggcccuggggaugauggcccucaaggucgugaagaacauggagaaguaccagcuggccgucaccaucauggccaucuccugcgugcccaacgcggugauccugcagaacgccuggaaggucagcugcaccauccucgccgccguguccgugagcccccugcugcucacguccagccagcagaaggcggacuggaucccccuggcccugaccaucaagggccucaacccgaccgccaucuuccugaccacgcugucccgcaccagcaagaagcgguccuggccccucaacgaggccgucauggccgugggcauggugagcauccuggcguccagccugcucaagaacgacauccccaugaccgggccccuggucgccggcgggcugcucaccgugugcuacgugcugacgggccgcuccgccgaccuggagcucgagcgggccgccgacgucaagugggaggaccaggcggagaucagcgggagcuccccgauccugagcaucaccaucuccgaggacggcagcauguccaucaagaacgaggaggaggagcagacccugaccauccucauccgcacgggccugcuggugaucagcgggguguuccccgucuccauccccaucaccgccgccgccugguaccucugggaggugaagaagcagcgggccggcgugcugugggacguccccagcccgccgcccguggagaaggcggagcuggaggacggggccuaccgcaucaagcagcggggcauccucggguacucccagaucggcgccggcguguacaaggaggggaccuuccacaccauguggcacgucacccgcggcgccgugcugaugcaccgggggaagcgcaucgagccgagcugggccgacgugaagaaggaccuggucuccuacggcgggggcuggaagcucgagggcgaguggaaggagggggaggagguccaggugcuggcgcuggagcccggcaagaacccccgggccguccagacgaagcccgggaucuucaagaccaacaccggcaccaucggggccgugagccucgacuucuccccgggcacgagcggcucccccaucguggaccgcaaggggaaggucgugggccuguacgggaacggcguggucacccggagcggcgccuacguguccgcgaucgcccagaccgagaaguccaucgaggacaaccccgagaucgaggacgacaucuuccgcaagaagcggcugaccaucauggaccuccaccccggggccggcaagacgaagcgcuaccugccggccaucgugcgggaggccaucaagcgcgggcugcggacccugauccucgcgcccacccgcgucguggccgccgagauggaggaggcccugcgcggccugcccauccgguaccagacccccgccauccgcgcggagcacacggggcgggagaucguggaccucaugugccacgccaccuucaccaugcgccugcuguccccgguccgggugcccaacuacaaccucaucaucauggacgaggcccacuucaccgaccccgccagcaucgccgcgcgcggcuacaucagcacgcggguggagaugggcgaggccgccgggaucuucaugaccgccacgccgcccggcucccgcgaccccuucccccagagcaacgcgcccaucauggacgaggagcgggagauccccgagcgcuccuggaacagcgggcacgagugggucaccgacuucaagggcaagacggugugguucgugcccuccaucaaggccgggaacgacaucgccgccugccugcggaagaacggcaagaaggucauccagcugagccgcaagaccuucgacuccgaguacgugaagacccggagcaacgacugggacuucguggucaccacggacaucuccgagaugggcgccaacuucaaggcggagcgcgugaucgacccccggcgcugcaugaagcccgugauccucaccgacggggaggagcgggucauccuggccggcccgaugcccgugacccacagcuccgccgcccagcgccgggggcgcaucggccgcaaccccaagaacgagaacgaccaguacaucuacaugggggagccccuggagaacgacgaggacugcgcccacuggaaggaggcgaagaugcuccuggacaacaucaacaccccggagggcaucauccccagcauguucgagcccgagcgggagaaggucgacgccaucgacggcgaguaccgccugcgcggggaggcccgcaagacguucguggaccucaugcggcgcggcgaccugccgguguggcuggccuacaaggucgccgcggaggggaucaacuacgccgaccggcgcuggugcuucgacggcaucaagaacaaccagauccucgaggagaacguggagguggagaucuggaccaaggagggggagcggaagaagcugaagccccgcuggcuggacgcccggaucuacuccgacccccucgcccugaaggaguucaaggaguucgcggccggccgcaagagccugacccucaaccugaucaccgagaugggccggcugcccacguucaugacccagaaggcccgcaacgcccucgacaaccuggccguccugcacaccgcggaggccgggggcaaggccuacaaccacgcccucuccgagcugccggagacccuggagacgcuccugcugcucgcccugcuggcgaccgugaccgggggcaucuuccucuuccugaugagcggcaaggggaucggcaagaugacccuggggaugugcugcaucaucacggccuccauccuccugugguacgcccagauccagccccacuggaucgccgccagcaucauccuggaguucuuccucaucgugcugcugauccccgagcccgagaagcagcggaccccgcaggacaaccagcucaccuacgucgugaucgcgauccugaccguggucgccgccaccauggccaacgagaugggcuuccuggagaagacgaagaaggaccucgggcugggcuccaucaccacccaggagagcgagagcaacauccuggacaucgaccuccgccccgccuccgcguggacccuguacgccguggccacgaccuucgugacccccaugcugcggcacagcaucgagaacuccagcgucaacgugucccucaccgccaucgcgaaccaggccacggugcugaugggccuggggaagggcuggccccucagcaagauggacaucggggucccgcugcuggccaucggcugcuacucccaggugaaccccaucacccucaccgccgcccugcugcuccugguggcgcacuacgccaucaucgggcccggccugcaggccaaggccacccgcgaggcccagaagcgggcggccgccggcaucaugaagaaccccacggucgacgggaucaccgugaucgaccucgagccgauccccuacgaccccaaguucgagaagcagcugggccaggugaugcugcucauccugugcgucacccaggugcugaugaugcgcaccacgugggcccucugcgaggcccugacccuggcgaccgggcccaucagcacccucugggagggcaacccggggcgguucuggaacacgaccaucgccguguccauggccaacaucuuccgcggcagcuaccuggccggcgcggggcuccuguucuccgucaugaagaacaccaccaacacgcgccggggcaccgggaacaucggcgagacccugggcgagaaguggaagucccgccugaacgcccucgggaaguccgaguuccagaucuacaagaaguccggcauccaggagguggaccggacccuggccaaggaggggaucaagcgcggcgagacggaccaccacgccgugucccgggggagcgccaagcugcgcugguucgucgagcggaacauggugacccccgagggcaagguggucgaccucggcugcgggcgcggcgggugguccuacuacugcggcgggcugaagaacgugcgggaggugaagggccugacccgcggcgggcccggccacgaggagcccaucccgaugagcaccuacggguggaaccucguccggcugcaguccggcguggacguguucuucacgccgcccgagaagugcgacacccugcucugcgacaucggggagagcagccccaacccgaccaucgaggcgggccgcacccugcggguccugaaccucguggagaacuggcugaacaacaacacgcaguucugcaucaaggugcugaaccccuacaugcccuccgucaucgagaagauggagacccuccagcgcaccuacggcggggcccuggugcggaacccgcugagccgcaacuccacccacgagauguacugggugagcaacgccaccggcaacaucgucuccagcgugaacaugaucucccggaugcugaucaaccgcuucacgaugaagcacaagaaggccaccuacgagcccgacguggaccucgggagcggcacccggaacaucgggaucgaguccgagauccccaaccuggacaucaucggcaagcgcaucgagaagaucaagcaggagcacgagaccagcuggcacuacgaccaggaccaccccuacaagacgugggccuaccacggcuccuacgagaccaagcagaccgggagcgcguccagcauggucaacggcguggugcgccugcucaccaagccgugggacgucgugcccauggucacgcagauggccaugaccgacaccacccccuucgggcagcagcggguguucaaggagaagguggacacgcgcacccaggagcccaaggagggcaccaagaagcugaugaagaucaccgccgaguggcuguggaaggagcucggcaagaagaagacgccgcggaugugcacccgcgaggaguucacccggaagguccgcuccaacgccgcccugggggcgaucuucaccgacgagaacaaguggaaguccgcccgggaggccguggaggacggccgcuucugggagcugguggaccgggagcgcaaccuccaccuggaggggaagugcgagacgugcgucuacaacaugaugggcaagcgggagaagaagcugggggaguucggcaaggccaagggcucccgcgcgaucugguacauguggcucggggcccgguuccuggaguucgaggcccugggcuuccucaacgaggaccacugguucagccgcgggaacucccugagcggcguggagggggagggccugcaccggcucggcuacauccugcgcgacgugagccggaaggagggcggcgccauguacgccgacgacaccgcggggugggacacccgcaucacccuggaggaccucaagaacgaggagauggucacgaaccacaugaagggcgagcacaagaagcuggccgaggccaucuucaagcugaccuaccagaacaagguggugcggguccagcgccccacgccccgggggaccgugauggacaucaucucccgccgcgaccagcggggcagcggccagguggggacguacggccucaacaccuucaccaacauggaggcccagcugauccgccagauggagggggagggcaucuucaaguccauccagcaccugaccgucacggaggagaucgccgugcagaacuggcucgcgcgggugggccgcgagcggcugacccgcauggccaucagcggggacgacugcgucgugaagcccaucgacgaccgguucgccaacgcccugaccgcccucaacgacaugggcaaggugcgcaaggacauccagcagugggagccgucccggggguggaacgacuggacccagguccccuucugcagccaccacuuccacgagcuggugaugaaggacggccgcgugcuggucgugcccugccggaaccaggacgagcucaucgggcgcgcgcggaucucccagggcgccggcuggagccugaaggagacggccugccuggggaaguccuacgcccagauguggacccucauguacuuccaccgccgggaccugcgccuggccgcgaacgccaucugcagcgccgugcccucccacugggucccgaccagccggaccaccugguccauccacgccaagcacgaguggaugacgaccgaggacaugcucgcgguguggaaccgcguguggauccaggagaaccccuggauggaggacaagacccccgucgagagcugggaggaggugcccuaccugggcaagcgggaggaccaguggugcgggucccugaucggccucaccagccgcgccacgugggccaagaacauccagaccgccaucaaccaggugcgcucccugaucgggaacgaggaguacaccgacuacaugccgagcaugaagcgguuccgccgggaggaggaggaggccggcguccugugguga

SEQ ID NO: 9105 - RNA, 9876 nt, Artificial Sequence
  derived and/or modified CDS sequence (opt1) from DENV-2__FJ850091__SS-prME
accgccggcgugaucgucaugcugauccccaccgccauggcguuccaccucaccacccgcaacggggagccccacaugaucgugggccggcaggagaaggggaagucccugcuguucaagaccgaggacggcgugaacaugugcacccucauggccauggaccugggggagcugugcgaggacaccaucaccuacaagugcccccuccugcgccagaacgagcccgaggacaucgacugcuggugcaacagcaccagcaccugggucaccuacgggaccugcaccaccacgggcgagcaccggcgcgagaagcgguccguggcccuggugccccacgucgggaugggccucgagacccgcaccgagaccuggaugagcagcgagggggccuggaagcacgugcagcggaucgagaccuggauccugcgccacccgggcuucaccaucauggccgcgauccuggccuacaccaucgggaccacgcacuuccagcgggcccucaucuucauccugcugaccgccguggcgcccagcaugaccaugcgcugcaucggcaucuccaaccgggacuucgucgagggcgugagcgggggcuccuggguggacaucguccucgagcacgggagcugcgugaccacgauggccaagaacaagcccacccuggacuucgagcugaucaagaccgaggccaagcagcccgccacccuccgcaaguacugcaucgaggccaagcugacgaacaccaccaccgagucccggugcccgacgcagggcgagcccagccugaacgaggagcaggacaagcgcuucaucugcaagcacuccaugguggaccggggcugggggaacggcugcgggcuguucggcaagggcgggaucgugaccugcgcgauguucacgugcaagaagaacauggagggcaagaucgugcagcccgagaaccuggaguacaccaucgugaucacgccccacagcggggaggagcacgccgucggcaacgacaccgggaagcacggcaaggagaucaagaucaccccgcaguccagcaccaccgaggccgagcugacgggguacggcaccgugaccauggagugcagcccccggaccggccucgacuucaacgagauggugcugcugcagauggaggacaaggccuggcucguccaccggcagugguuccuggaccugccccuccccuggcugccgggggccgacacgcagggcagcaacuggauccagaaggagacccuggugaccuucaagaacccccacgcgaagaagcaggacguggucgugcucgggucccaggagggcgccaugcacaccgcccugacgggggccaccgagauccagaugagcagcggcaaccuccuguucaccggccaccugaagugccgccugcggauggacaagcuccagcugaaggggauguccuacagcaugugcaccggcaaguucaagaucgucaaggagaucgccgagacgcagcacgggaccaucgugauccgcgugcaguacgagggcgacggcucccccugcaagauccccuucgagaucaccgaccuggagaagcggcacguccucgggcgccugaucaccgugaacccgaucgugacggagaaggacagccccgucaacaucgaggcggagccgcccuucggcgacuccuacaucaucguggggguggagccgggccagcugaagcucaacugguucaagaaggggagcuccaucggccagauguucgagaccaccaugcgcggcgccaagcggauggccauccugggggacaccgccugggacuucggcagccucggcggggucuucacguccaucgggaaggcccuccaccagguguucggggcgaucuacggcgccgccuucagcgggguguccuggaccaugaagauccugaucggcgucaucaucaccuggaucgggaugaacagccgcuccaccagccuguccgugagccuggugcucgucggcguggugacgcuguaccugggggccaugguccaggcggacuccggcugcaucgugagcuggaagaacaaggagcucaagugcggcuccgggaucuucaucaccgacaacgugcacaccuggaccgagcaguacaaguuccagcccgagagccccagcaagcuggccuccgccauccagaaggcccacgaggagggcaucugcgggauccggagcgucacgcgccuggagaaccucauguggaagcagaucacccccgagcugaaccacauccuguccgagaacgaggugaagcucaccaucaugaccggcgacaucaaggggaucaugcaggccggcaagcggagccugcgcccgcagcccacggagcugaaguacuccuggaagaccuggggcaaggcgaagaugcucagcaccgagucccacaaccagaccuuccugaucgacgggcccgagacggccgagugcccgaacaccaaccgggccuggaacagccuggagguggaggacuacggcuucggggucuucaccaccaacaucuggcucaagcugcgcgagaagcaggacguguucugcgacuccaagcugaugagcgccgccaucaaggacaaccgggcggugcacgccgacaugggcuacuggaucgaguccgcccucaacgacaccuggaagauggagaaggccagcuucaucgaggucaaguccugccacuggcccaagagccacacgcugugguccaacggcgugcuggagagcgagaugaucauccccaagaacuucgccgggcccgugucccagcacaacuaccgcccgggcuaccacacccagaccgcggggcccuggcaccucggcaagcuggagauggacuucgacuucugcgaggggaccacggucguggugaccgaggacugcggcaaccggggccccagccugcgcaccaccacggccagcgggaagcucaucaccgaguggugcugccgguccugcacccugcccccgcugcgcuaccggggcgaggacgggugcugguacggcauggagauccgcccccucaaggagaaggaggagaaccuggucaacagccuggugaccgccgggcacggccagaucgacaacuucucccucggcgugcuggggauggcccuguuccucgaggagaugcugcggacgcgcgucggcaccaagcacgcgauccugcucguggcccugagcuucgugacccugaucaccgggaacauguccuuccgggaccucggccgcgucauggugauggugggggccacgaugaccgacgacaucggcaugggcgucaccuaccuggcccugcucgccgcguucaaggugcgccccaccuucgccgccgggcugcugcuccggaagcugacgagcaaggagcugaugauggccaccaucggcaucgcccuccugucccagagcacccugcccgagaccauccucgagcugacggacgcgcuggcccucgggaugauggcccugaagaucgugcgcaacauggagaaguaccagcuggccgucaccaucauggccaucuccugcgugccgaacgcggugauccuccagaacgccuggaaggucagcugcaccauccuggccgccguguccgugagcccccugcuccugaccuccagccagcagaaggcggacuggaucccccuggcccucacgaucaagggccugaaccccaccgccaucuuccugaccacccucucccggacgagcaagaagcgcuccuggccgcugaacgaggccaucauggccgucggcauggugagcauccuggcguccagccuccugaagaacgacauccccaugaccgggccccuggucgccggcgggcuccugaccgugugcuacgugcugaccggccgggccgccgaccucgagcuggagcgcgccgcggacgucaagugggaggaccaggccgagaucagcggguccagccccauccuguccaucacgaucagcgaggacggcuccaugagcaucaagaacgaggaggaggagcagacccucaccauccugauccggaccggccugcucgugaucuccgggguguucccggucagcauccccaucaccgccgccgccugguaccugugggaggugaagaagcagcgcgcgggcgugcugugggacguccccagcccgccgcccguggggaaggccgagcucgaggacggcgccuaccggaucaagcagcgcgggauccugggcuacagccagaucggcgccgggguguacaaggagggcacguuccacaccauguggcacgucacccgcggggccgugcugaugcaccgcggcaagcggaucgagcccuccugggcggacgugaagaaggaccucaucagcuacgggggcggcuggaagcuggagggggaguggaaggagggcgaggagguccaggugcuggcccucgagcccgggaagaacccccgcgccgugcagaccaagcccggcaucuucaagacgaacaccgggaccaucggcgccgucucccuggacuucagccccggcaccuccgggagccccaucguggaccggaagggcaagguggucgggcuguacggcaacggcguggugacgcgcuccggggcguacgucagcgccaucgcccagaccgagaaguccaucgaggacaaccccgagaucgaggacgacaucuuccggaagaagcgccucaccaucauggaccugcaccccggcgccgggaagaccaagcgguaccugcccgccaucgugcgcgaggcgaucaagcggggccugcgcacgcucauccuggccccgacccgcguggucgccgccgagauggaggaggcccugcgggggcuccccauccgcuaccagacccccgcgauccgggccgagcacaccggccgcgagaucguggaccugaugugccacgccacguucaccaugcggcugcucagccccgugcgcgucccgaacuacaaccugaucaucauggacgaggcccacuucaccgaccccgccagcaucgcggcccggggcuacaucuccacccgcguggagaugggggaggccgccggcaucuucaugacggcgacgccgcccgggagccgggacccguucccccaguccaacgcccccaucauggacgaggagcgcgagauccccgagcggagcuggaacuccggccacgagugggugaccgacuucaaggggaagaccgucugguucgugccgagcaucaaggccggcaacgacaucgccgccugccugcgcaagaacggcaagaaggugauccagcucucccggaagacguucgacagcgaguacgcgaagacccgcgccaacgacugggacuucgucgugaccaccgacaucuccgagaugggggccaacuucaaggccgagcgggugaucgacccccgccggugcaugaagcccgucauccugacggacggcgaggagcgcgugauccuggccgggcccaugccggugacccacagcuccgcggcccagcggcgcggccgcaucgggcggaaccccaagaacgagaacgaccaguacaucuacaugggcgagccccucgagaacgacgaggacugcgcccacuggaaggaggccaagaugcugcuggacaacaucaacacccccgagggcaucaucccgagcauguucgagcccgagcgcgagaaggucgacgccaucgacggggaguaccggcuccgcggcgaggcgcggaagaccuucguggaccugaugcgccgcggggaccugcccguguggcucgccuacaaggucgccgccgagggcaucaacuacgcggaccgcaaguggugcuucgacgggaucaagaacaaccagauccuggaggagaacguggagguggagaucuggacgaaggagggcgagcggaagaagcugaagccgcgcuggcucgacgcccggaucuacuccgacccccuggcccugaaggaguucaaggaguucgccgccggccgcaagagccucacccugaaccugaucaccgagauggggcggcuccccaccuucaugacgcagaaggcgcgcaacgcccuggacaaccuggccguccuccacaccgccgaggugggcgggaaggccuacacccacgcgcuguccgagcugcccgagacccucgagacgcugcugcuccugacccugcucgccgccgugaccggcggcaucuuccuguuccugaugagcgggaagggcaucgggaagaugacccucggcaugugcugcaucaucaccgccuccauccugcugugguacgcccagauccagccgcacuggaucgcggccagcaucauccucgaguucuuccugaucguccugcucauccccgagcccgagaagcagcggacgccccaggacaaccagcugaccuacguggucaucgccauccugaccgugguggccgccaccauggcgaacgagaugggguuccucgagaagacgaagaaggaccugggcuucggcuccaucaccacccaggagagcgagagcaacauccuggacaucgaccuccgcccggccuccgccuggacccuguacgccgucgcgacgaccuucgugacccccaugcugcggcacagcaucgagaacuccagcgugaacgucucccucaccgccaucgccaaccaggccacggugcugauggggcugggcaagggguggccccucagcaagauggacaucggcgugccccugcuggccaucgggugcuacucccaggucaacccgaucacccucaccgcggcccugcugcuccugguggcccacuacgccaucaucggccccggccugcaggccaaggcgacccgcgaggcccagaagcgggccgccgccgggaucaugaagaaccccacgguggacggcaucaccgucaucgaccucgagcccaucccguacgaccccaaguucgagaagcagcuggggcaggucaugcugcucauccugugcgugacccagguccugaugaugcgcaccacgugggcgcucugcgaggcccugacccuggccaccggccccaucagcacccucugggaggggaaccccggccgguucuggaacacgaccaucgccguguccauggcgaacaucuuccgcggcagcuaccuggccggggccggccuccuguucuccaucaugaagaacaccaccaacacgcgccgggggaccggcaacgugggcgagacccugggggagaaguggaagucccgccugaacgcccucggcaaguccgaguuccagaucuacaagaaguccgggauccaggaggucgaccggacccuggccaaggagggcaucaagcgcggggagacggaccaccacgcggugucccggggcagcgccaagcugcgcugguucguggagcggaacauggucaccccggagggcaaggugguggaccucgggugcggccgcgggggcugguccuacuacugcgggggccugaagaacguccgggaggugaagggccugaccaagggcgggcccgggcacgaggagcccauccccaugagcaccuacggcuggaaccucgugcgccugcaguccggggucgacguguucuucacgccgcccgagaagugcgacacccugcucugcgacaucggcgagagcagccccaaccccaccaucgaggccggccggacccugcgcgugcugaaccucgucgagaacuggcugaacaacaacacccaguucugcaucaaggugcugaacccguacaugcccuccgugaucgagaagauggagacgcuccagcggaaguacgggggcgcccugguccgcaacccccugagccggaacuccacccacgagauguacugggugagcaacgccaccgggaacaucguguccagcgucaacaugaucucccgcaugcugaucaaccgguucaccaugaagcacaagaaggcgacguacgagccggacguggaccucggcagcgggacccgcaacaucggcaucgaguccgagauccccaaccuggacaucaucggcaagcggaucgagaagaucaagcaggagcacgagaccagcuggcacuacgaccaggaccaccccuacaagaccugggccuaccacggguccuacgagacgaagcagaccggcagcgccuccagcauggugaacggggucgugcgccugcucaccaagcccugggacguggucccgauggugacccagauggccaugacggacaccacccccuucggccagcagcgcguguucaaggagaaggucgacacccggacgcaggagcccaaggagggcaccaagaagcugaugaagaucaccgccgaguggcuguggaaggagcucgggaaggagaagacgccccggaugugcacgcgggaggaguucacccgcaaggugcgguccaacgcggcccugggcgccguguucaccgacgagaacaaguggaaguccgcccgcgaggcggucgaggacgggcgguucugggagcugguggaccgcgagcggaaccuccaccuggagggcaagugcgagaccugcguguacaacaugauggggaagcgcgagaagaagcugggcgaguucggcaaggccaaggggucccgggccaucugguacauguggcucggcgcccgcuuccuggaguucgaggcccugggguuccucaacgaggaccacugguucagccggggcaacucccugagcggggucgagggcgagggccugcaccgccucggguacauccugcgggaggugggcaagaaggagggcggcgcgauguacgccgacgacacggccgggugggacacccgcaucacccuggaggaccucaagaacgaggagauggucaccaaccacaugaagggcgagcacaagaagcuggccgaggccaucuucaagcugacguaccagaacaagguggugcggguccagcgcccgacgccccggggcaccgugauggacaucaucagccgcaaggaccagcggggguccggccagguggggaccuacggccucaacacguucaccaacauggaggcgcagcugauccgccagauggagggcgaggggaucuucaagagcauccagcaccugaccgccaccgaggagaucgccguccagaacuggcucgcccgcgugggccgggagcgccugucccggauggccaucagcggggacgacugcguggucaagcccaucgacgaccgcuucgcguccgcccugacggcccucaacgacaugggcaaggugcggaaggacauccagcagugggagcccagccgcggguggaacgacuggacccaggugccguucugcucccaccacuuccacgagcuggucaugaaggacggccgggugcuggugguccccugccgcaaccaggacgagcucaucggccgggcccgcaucagccagggggccggcuggucccugaaggagaccgcgugccugggcaagagcuacgcccagauguggacccucauguacuuccaccggcgcgaccugcggcuggccgccaacgcgaucugcuccgccgugcccagccacugggugcccaccucccgcacgaccuggagcauccacgccaagcacgaguggaugaccaccgaggacaugcucgccgucuggaaccggguguggauccaggagaacccguggauggaggacaagacgcccguggaguccugggaggagguccccuaccugggcaagcgcgaggaccaguggugcgggagccugaucggccucaccucccgggccaccugggcgaagaacauccagaccgccaucaaccaggugcgcagccugaucggcaacgagggguacacggacuacaugcccagcaugaagcgguuccgccgcgaggaggaggaggccggcgugcugugguga

SEQ ID NO: 9106 - RNA, 9876 nt, Artificial Sequence
  derived and/or modified CDS sequence (opt1) from DENV-2__GQ199890__SS-prME
accgccggcgugaucgucaugcugauccccaccgccauggcguuccaccucaccacccgcaacggggagccccacaugaucgugggccggcaggagaaggggaagucccugcuguucaagaccgaggacggcgugaacaugugcacccucauggccaucgaccugggggagcugugcgaggacaccaucaccuacaagugcccccuccugcggcagaacgagcccgaggacaucgacugcuggugcaacagcaccagcaccugggucaccuacgggaccugcaccaccaucggcgagcaccggcgcgagaagcgguccguggcccuggugccccacgucgggaugggccucgagacgcgcaccgagaccuggaugagcagcgagggggccuggaagcacgugcagcggaucgagaccuggauccugcgccacccgggcuucacgaucauggccgcgauccuggccuacaccaucgggaccacccacuuccagcgggcccucaucuucauccugcugacggccguggcgcccagcaugaccaugcgcugcaucggcaucagcaaccgggacuucgucgagggcgugagcgggggcagcuggguggacaucguccucgagcacgggagcugcgugaccaccauggccaagaacaagcccacgcuggacuucgagcugaucaagaccgaggccaagcagcccgccacccuccgcaaguacugcaucgaggccaagcugaccaacacgaccaccgagucccggugcccgacccagggcgagcccagccugaacgaggagcaggacaagcgcuucaucugcaagcacuccaugguggaccggggcugggggaacggcugcgggcuguucggcaagggcgggaucgucacgugcgcgauguucacgugcaagaagaacauggagggcaagaucgugcagcccgagaaccuggaguacaccaucgugaucacgccccacagcggggaggagcgcgccgucggcaacgacacggggaagcacggcaaggagaucaagaucaccccgcaguccagcaccaccgaggccgagcugaccggguacggcacggugaccauggagugcagcccccggaccggccucgacuucaacgagauggugcugcugcagauggaggacaaggccuggcucguccaccgccagugguuccuggaccugccccuccccuggcugccgggggccgacacccagggcagcaacuggauccagaaggagacgcuggugaccuucaagaacccccacgcgaagaagcaggacguggucgugcucgggucccaggagggcgccaugcacaccgcccugaccggggccacggagauccagaugagcagcggcaaccuccuguucaccggccaccugaagugccggcugcgcauggacaagcuccagcugaaggggauguccuacagcaugugcaccggcaaguucaagaucgucaaggagaucgccgagacccagcacgggacgaucgugauccgggugcaguacgagggcgacggcucccccugcaagauccccuucgagaucaccgaccuggagaagcgccacguccucgggcgccugaucaccgugaacccgaucgugaccgagaaggacagccccgucaacaucgaggcggagccgcccuucggcgacuccuacaucaucguggggguggagccgggccagcugaagcucaacugguucaagaaggggagcuccaucggccagauguucgagacgaccaugcggggcgccaagcgcauggccauccugggggacaccgccugggacuucggcagccucggcggggucuucaccuccaucgggaaggcccuccaccagguguucggggcgaucuacggcgccgccuucagcgggguguccuggacgaugaagauccugaucggcgucaucaucaccuggaucgggaugaacagccgguccaccagccuguccgugagccuggugcucgucggcguggugacccuguaccugggggccaugguccaggcggacuccggcugcaucgugagcuggaagaacaaggagcucaagugcggcuccgggaucuucaucacggacaacgugcacaccuggaccgagcaguacaaguuccagcccgagagccccagcaagcuggccuccgccauccagaaggcccacgaggagggcaucugcgggauccgcagcgucacccggcuggagaaccucauguggaagcagaucacgcccgagcugaaccacauccuguccgagaacgaggugaagcucaccaucaugaccggcgacaucaaggggaucaugcaggccggcaagcgcagccugcggccgcagcccaccgagcugaaguacuccuggaagacguggggcaaggcgaagaugcucagcaccgagucccacaaccagaccuuccugaucgacgggcccgagaccgccgagugcccgaacacgaaccgcgccuggaacagccuggagguggaggacuacggcuucggggucuucaccaccaacaucuggcucaagcugcgggagaagcaggacguguucugcgacuccaagcugaugagcgccgccaucaaggacaaccgcgcggugcacgccgacaugggcuacuggaucgaguccgcccucaacgacaccuggaagauggagaaggccagcuucaucgaggucaaguccugccacuggcccaagagccacacccugugguccaacggcgugcuggagagcgagaugaucauccccaagaacuucgccgggcccgugucccagcacaacuaccggccgggcuaccacacgcagaccgcggggcccuggcaccucggcaagcuggagauggacuucgacuucugcgaggggaccaccgucguggugacggaggacugcggcaaccgcggccccagccugcggaccaccaccgccagcgggaagcucaucacggaguggugcugccgcuccugcacccugcccccgcugcgguaccgcggcgaggacgggugcugguacggcauggagauccggccccucaaggagaaggaggagaaccuggucaacagccuggugaccgccgggcacggccagaucgacaacuucucccucggcgugcuggggauggcccuguuccucgaggagaugcugcgcacccgggucggcacgaagcacgcgauccugcucguggcccugagcuucgugacccugaucaccgggaacauguccuuccgcgaccucggccgcgucauggugauggugggggccaccaugacggacgacaucggcaugggcgucaccuaccuggcccugcucgccgcguucaaggugcggcccaccuucgccgccgggcugcugcuccgcaagcugaccagcaaggagcugaugauggccacgaucggcaucgcccuccugucccagagcacccugcccgagaccauccucgagcugaccgacgcgcuggcccucgggaugauggcccugaagaucgugcggaacauggagaaguaccagcuggccgucacgaucauggccaucuccugcgugccgaacgcggugauccuccagaacgccuggaaggucagcugcaccauccuggccgccguguccgugagcccccugcuccugaccuccagccagcagaaggcggacuggaucccccuggcccucaccaucaagggccugaaccccacggccaucuuccugaccacccucucccgcaccagcaagaagcgguccuggccgcugaacgaggccaucauggccgucggcauggugagcauccuggcguccagccuccugaagaacgacauccccaugacggggccccuggucgccggcgggcuccugaccgugugcuacgugcugaccggccgcagcgccgaccucgagcuggagcgggccgccgacgucaagugggaggaccaggcggagaucuccgggagcucccccauccugagcaucaccaucuccgaggacggcagcauguccaucaagaacgaggaggaggagcagacgcucaccauccugauccgcaccggccugcucgugaucagcgggguguucccggucuccauccccaucaccgccgccgccugguaccugugggaggugaagaagcagcgggccggcgugcugugggacguccccagcccgccgcccguggggaaggcggagcucgaggacggcgccuaccgcaucaagcagcgggggauccugggcuacucccagaucggcgccgggguguacaaggagggcaccuuccacacgauguggcacgucacccgcggggccgugcugaugcaccggggcaagcgcaucgagcccagcugggccgacgugaagaaggaccucaucuccuacgggggcggcuggaagcuggagggggaguggaaggagggcgaggagguccaggugcuggcgcucgagcccgggaagaacccccgggccgugcagaccaagcccggcaucuucaagaccaacacggggaccaucggcgccgucagccuggacuucucccccggcaccagcgggucccccaucguggaccgcaagggcaagguggucgggcuguacggcaacggcguggugacccggagcggggccuacgucuccgcgaucgcccagacggagaaguccaucgaggacaaccccgagaucgaggacgacaucuuccgcaagaagcggcucaccaucauggaccugcaccccggcgccgggaagaccaagcgcuaccugcccgccaucgugcgggaggccaucaagcgcggccugcgcacccucauccuggcgccgacgcggguggucgccgccgagauggaggaggcccugcgcgggcuccccauccgguaccagacccccgccauccgcgcggagcacaccggccgggagaucguggaccugaugugccacgccaccuucacgaugcgccugcucagccccgugcgggucccgaacuacaaccugaucaucauggacgaggcccacuucaccgaccccgccuccaucgccgcgcgcggcuacaucagcacccggguggagaugggggaggccgccggcaucuucaugaccgccacgccgcccgggucccgcgacccguucccccagagcaacgcgcccaucauggacgaggagcgggagauccccgagcgcuccuggaacagcggccacgagugggugaccgacuucaaggggaagaccgucugguucgugccguccaucaaggccggcaacgacaucgccgccugccugcggaagaacggcaagaaggugauccagcucagccgcaagaccuucgacuccgaguacgucaagacgcgggccaacgacugggacuucguggugaccaccgacaucagcgagaugggggcgaacuucaaggccgagcgcgucaucgacccccggcgcugcaugaagcccgugauccugaccgacggcgaggagcgggugauccuggccgggcccaugccggucacgcacuccagcgccgcccagcgccgcggccggaucgggcgcaaccccaagaacgagaacgaccaguacaucuacaugggcgagccccucgagaacgacgaggacugcgcgcacuggaaggaggccaagaugcugcuggacaacaucaacacccccgagggcaucaucccguccauguucgagcccgagcgggagaagguggacgccaucgacggggaguaccgccuccggggcgaggcccgcaagaccuucguggaccugaugcggcgcggggaccugcccgucuggcucgccuacaagguggcggccgagggcaucaacuacgccgaccggaaguggugcuucgacgggaucaagaacaaccagauccuggaggagaacguggaggucgagaucuggaccaaggagggcgagcgcaagaagcugaagccgcgguggcucgacgcccgcaucuacagcgacccccuggcgcugaaggaguucaaggaguucgccgccggccggaagucccucacgcugaaccugaucaccgagauggggcgccuccccaccuucaugacccagaaggcccggaacgcccuggacaaccuggcggugcuccacacggccgaggugggcgggaaggccuacacccacgcccugagcgagcugcccgagacccucgagacccugcugcuccugacgcugcucgccaccaucaccggcggcaucuuccuguuccugauguccgggaagggcaucgggaagaugacccucggcaugugcugcaucaucaccgcgagcauccugcugugguacgcccagauccagccgcacuggaucgccgccuccaucauccucgaguucuuccugaucguccugcucauccccgagcccgagaagcagcgcacgccccaggacaaccagcugaccuacguggucaucgccauccugaccgugguggcggccaccauggccaacgagaugggguuccucgagaagacgaagaaggaccugggcuucggcaccaucaccacccaggagagcgagagcaacauccuggacaucgaccuccggccggccuccgccuggacgcuguacgcggucgccaccaccuucgugacccccaugcugcgccacagcaucgagaacuccagcgugaacgucucccucacggccaucgccaaccaggcgaccgugcugauggggcugggcaagggguggccccucagcaagauggacaucggcgugccccugcuggccaucgggugcuacucccaggucaacccgaucacccucaccgccgcccugcugcuccugguggcccacuacgcgaucaucggccccggccugcaggccaaggccacgcgggaggcccagaagcgcgccgcggccgggaucaugaagaaccccaccguggacggcaucaccgucaucgaccucgagcccaucccguacgaccccaaguucgagaagcagcugggccaggugaugcugcucauccugugcgugacccagguccugaugaugcggacgaccugggcccucugcgaggcccugacccuggccaccggccccaucagcacgcucugggaggggaaccccggccgcuucuggaacaccaccaucgcgguguccauggccaacaucuuccgcggcagcuaccuggccggggccggccuccuguucuccaucaugaagaacaccacgaacacccggcgcgggaccggcaacgugggcgagacccugggggagaaguggaagucccggcugaacgcgcucggcaaguccgaguuccagaucuacaagaaguccgggauccaggaggucgaccgcacgcuggccaaggagggcaucaagcgcggggagaccgaccaccacgccgugucccgcggcagcgccaagcugcggugguucguggagcgcaacauggucaccccggagggcaaggugguggaccucgggugcggccgcggcgggugguccuacuacugcggcgggcugaagaacguccgcgaggugaaggggcugaccaagggcgggcccgggcacgaggagcccauccccaugagcacguacggcuggaaccucgugcggcugcaguccggggucgacguguucuucaccccgcccgagaagugcgacacccugcucugcgacaucggcgagagcagccccaaccccaccaucgaggccggccgcacccugcgggugcugaaccucgucgagaacuggcugaacaacaacacgcaguucugcaucaaggugcugaacccguacaugcccuccgugaucgagaagauggagacccuccagcgcaaguacgggggcgcgcugguccggaacccccugagccgcaacuccacccacgagauguacugggugagcaacgccaccgggaacaucguguccagcgucaacaugaucucccggaugcugaucaaccgcuucacgaugaagcacaagaaggccaccuacgagccggacguggaccucggcagcgggacccggaacaucggcaucgaguccgagauccccaaccuggacaucaucggcaagcgcaucgagaagaucaagcaggagcacgagaccagcuggcacuacgaccaggaccaccccuacaagacgugggccuaccacggguccuacgagaccaagcagaccggcagcgccuccagcauggugaacggggucgugcgccugcucaccaagcccugggacguggucccgauggugacgcagauggcgaugaccgacaccacccccuucggccagcagcggguguucaaggagaaggucgacacgcgcacccaggagcccaaggagggcaccaagaagcugaugaagaucaccgccgaguggcuguggaaggagcucgggaaggagaagacgccccggaugugcacccgcgaggaguucacccggaaggugcgcuccaacgccgcccugggcgccaucuucaccgacgagaacaaguggaaguccgcgcgggaggccguggaggacgggcgcuucugggagcuggucgaccgggagcgcaaccuccaccuggagggcaagugcgagacgugcguguacaacaugauggggaagcgggagaagaagcugggcgaguucggcaaggccaaggggucccgcgccaucugguacauguggcucggcgcgcgguuccuggaguucgaggcccugggguuccucaacgaggaccacugguucagccgcggcaacucccugagcgggguggagggcgagggccugcaccggcucggguacauccugcgcgaggucggcaagaaggagggcggcgccauguacgccgacgacaccgccgggugggacacccggaucacccuggaggaccucaagaacgaggagauggugacgaaccacaugaagggcgagcacaagaagcuggcggaggccaucuucaagcugaccuaccagaacaaggucgugcgcgugcagcggccgacgccccggggcaccgucauggacaucaucagccggaaggaccagcgcggguccggccagguggggacguacggccucaacaccuucaccaacauggaggcccagcugauccgccagauggagggcgaggggaucuucaagagcauccagcaccugaccgccacggaggagaucgccgugcagaacuggcucgcgcgggucggccgcgagcggcugucccgcauggccaucagcggggacgacugcguggugaagcccaucgacgaccgguucgccuccgcccugaccgcccucaacgacaugggcaagguccgcaaggacauccagcagugggagcccagccggggguggaacgacuggacccaggugccguucugcucccaccacuuccacgagcuggugaugaaggacggccgcguccugguggugcccugccggaaccaggacgagcucaucggccgcgcgcggaucagccagggggccggcuggucccugaaggagaccgccugccugggcaagagcuacgcccagauguggacccucauguacuuccaccgccgggaccugcgccuggccgcgaacgccaucugcuccgccguccccagccacugggugcccacgucccggaccaccuggagcauccacgccaagcacgaguggaugaccacggaggacaugcucgcgguguggaaccgcgucuggauccaggagaacccguggauggaggacaagacccccguggaguccugggaggaggugcccuaccugggcaagcgggaggaccaguggugcgggagccugaucggccucaccucccgcgccaccugggccaagaacauccagacggccaucaaccagguccggagccugaucggcaacgagggguacaccgacuacaugcccagcaugaagcgcuuccgcaaggaggaggaggaggccggcgugcugugguga

SEQ ID NO: 9107 - RNA, 9876 nt, Artificial Sequence
  derived and/or modified CDS sequence (opt1) from DENV-2__GQ868549__SS-prME
accgccggcgugaucgucaugcugauccccaccgccauggcguuccaccucaccacccgcaacggggagccccacaugaucgugggccggcaggagaaggggaagucccugcuguucaagaccgaggacggcgugaacaugugcacccucauggccaucgaccugggggagcugugcgaggacaccaucaccuacaagugcccccuccugcgccagaacgagcccgaggacaucgacugcuggugcaacagcaccagcaccugggucaccuacgggaccugcaccaccacgggcgagcaccggcgcgagaagcgguccguggcccuggugccccacgucgggaugggccucgagacccgcaccgagaccuggaugagcuccgagggggccuggaagcacgugcagcggaucgagaccuggauccugcgccacccgggcuucaccaucauggccgcgauccuggccuacaccaucgggaccacgcacuuccagcgggcccucaucuucauccugcugaccgccguggcgcccagcaugaccaugcgcugcaucggcaucuccaaccgggacuucgucgagggcgugagcgggggcuccuggguggacaucguccucgagcacgggagcugcgugaccacgauggccaagaacaagcccacccuggacuucgagcugaucaagaccgaggccaagcagcccgccacccuccgcaaguacugcaucgaggccaagcugacgaacaccaccaccgagucccggugcccgacgcagggcgagcccagccugaacgaggagcaggacaagcgcuucaucugcaagcacuccaugguggaccggggcugggggaacggcugcgggcuguucggcaagggcgggaucgugaccugcgcgauguucacgugcaagaagaacauggagggcaagaucgugcagcccgagaaccuggaguacaccaucgugaucacgccccacagcggggaggagcacgccgucggcaacgacaccgggaagcacggcaaggagaucaagaucaccccgcaguccagcaccaccgaggccgagcugacgggguacggcaccgugaccauggagugcagcccccggaccggccucgacuucaacgagauggugcugcugcagauggaggacaaggccuggcucguccaccggcagugguuccuggaccugccccuccccuggcugccgggggccgacacgcagggcagcaacuggauccagaaggagacccuggugaccuucaagaacccccacgcgaagaagcaggacguggucgugcucgggucccaggagggcgccaugcacaccgcccugacgggggccaccgagauccagaugagcagcggcaaccuccuguucaccggccaccugaagugccgccugcggauggacaagcuccagcugaaggggauguccuacagcaugugcaccggcaaguucaagaucgucaaggagaucgccgagacgcagcacgggaccaucgugauccgcgugcaguacgagggcgacggcucccccugcaagauccccuucgagaucaccgaccuggagaagcggcacguccucgggcgccugaucaccgugaacccgaucgugacggagaaggacagccccgucaacaucgaggcggagccgcccuucggcgacuccuacaucaucguggggguggagccgggccagcugaagcucaacugguucaagaaggggagcuccaucggccagauguucgagaccaccaugcgcggcgccaagcggauggccauccugggggacaccgccugggacuucggcagccucggcggggucuucacguccaucgggaaggcccuccaccagguguucggggcgaucuacggcgccgccuucagcgggguguccuggaccaugaagauccugaucggcgucaucaucaccuggaucgggaugaacagccgcuccaccagccuguccgugagccuggugcucgucggcguggugacgcuguaccugggggccaugguccaggcggacuccggcugcaucgugagcuggaagaacaaggagcucaagugcggcuccgggaucuucaucaccgacaacgugcacaccuggaccgagcaguacaaguuccagcccgagagccccagcaagcuggccuccgccauccagaaggcccacgaggagggcaucugcgggauccggagcgucacgcgccuggagaaccucauguggaagcagaucacccccgagcugaaccacauccuguccgagaacgaggugaagcucaccaucaugaccggcgacaucaaggggaucaugcaggccggcaagcggagccugcgcccgcagcccacggagcugaaguacuccuggaagaccuggggcaaggcgaagaugcucagcaccgagucccacaaccagaccuuccugaucgacgggcccgagacggccgagugcccgaacaccaaccgggccuggaacagccuggagguggaggacuacggcuucggggucuucaccaccaacaucuggcucaagcugcgcgagaagcaggacguguucugcgacuccaagcugaugagcgccgccaucaaggacaaccgggcggugcacgccgacaugggcuacuggaucgaguccgcccucaacgacaccuggaagauggagaaggccagcuucaucgaggucaaguccugccacuggcccaagagccacacgcugugguccaacggcgugcuggagagcgagaugaucauccccaagaacuucgccgggcccgugucccagcacaacuaccgcccgggcuaccacacccagaccgcggggcccuggcaccucggcaagcuggagauggacuucgacuucugcgaggggaccacggucguggugaccgaggacugcggcaaccggggccccagccugcgcaccaccacggccagcgggaagcucaucaccgaguggugcugccgguccugcacccugcccccgcugcgcuaccggggcgaggacgggugcugguacggcauggagauccgcccccucaaggagaaggaggagaaccuggucaacagccuggugaccgccgggcacggccagaucgacaacuucucccucggcgugcuggggauggcccuguuccucgaggagaugcugcggacgcgcgucggcaccaagcacgcgauccugcucguggcccugagcuucgugacccugaucaccgggaacauguccuuccgggaccucggccgcgucauggugauggugggggccacgaugaccgacgacaucggcaugggcgucaccuaccuggcccugcucgccgcguucaaggugcgccccaccuucgccgccgggcugcugcuccggaagcugacgagcaaggagcugaugauggccaccaucggcaucgcccuccugucccagagcacccugcccgagaccauccucgagcugacggacgcgcuggcccucgggaugauggcccugaagaucgugcgcaacauggagaaguaccagcuggccgucaccaucauggccaucuccugcgugccgaacgcggugauccuccagaacgccuggaaggucagcugcaccauccuggccgccguguccgugagcccccugcuccugaccuccagccagcagaaggcggacuggaucccccuggcccucacgaucaagggccugaaccccaccgccaucuuccugaccacccucucccggacgagcaagaagcgcuccuggccgcugaacgaggccaucauggccgucggcauggugagcauccuggcguccagccuccugaagaacgacauccccaugaccgggccccuggucgccggcgggcuccugaccgugugcuacgugcugaccggccggagcgccgaccucgagcuggagcgcgccgccgacgucaagugggaggaccaggcggagaucuccgggagcucccccauccugagcaucacgaucuccgaggacggcagcauguccaucaagaacgaggaggaggagcagacccucaccauccugauccggaccggccugcucgugaucagcgggguguucccggucuccauccccaucaccgccgccgccugguaccugugggaggugaagaagcagcgcgccggcgugcugugggacguccccagcccgccgcccguggggaaggcggagcucgaggacggcgccuaccggaucaagcagcgcgggauccugggcuacucccagaucggcgccgggguguacaaggagggcacguuccacaccauguggcacgucacccgcggggccgugcugaugcaccgcggcaagcggaucgagcccagcugggccgacgugaagaaggaccucaucuccuacgggggcggcuggaagcuggagggggaguggaaggagggcgaggagguccaggugcuggcgcucgagcccgggaagaacccccgcgccgugcagaccaagcccggcaucuucaagacgaacaccgggaccaucggcgccgucagccuggacuucucccccggcaccagcgggucccccaucguggaccggaagggcaagguggucgggcuguacggcaacggcguggugacgcgcagcggggccuacgucuccgcgaucgcccagaccgagaaguccaucgaggacaaccccgagaucgaggacgacaucuuccggaagaagcgccucaccaucauggaccugcaccccggcgccgggaagaccaagcgguaccugcccgccaucgugcgcgaggccaucaagcggggccugcgcacgcucauccuggcgccgacccgcguggucgccgccgagauggaggaggcccugcgggggcuccccauccgcuaccagacccccgccauccgggcggagcacaccggccgcgagaucguggaccugaugugccacgccacguucaccaugcggcugcucagccccgugcgcgucccgaacuacaaccugaucaucauggacgaggcccacuucaccgaccccgccuccaucgccgcgcggggcuacaucagcacccgcguggagaugggggaggccgccggcaucuucaugacggccacgccgcccgggucccgggacccguucccccagagcaacgcgcccaucauggacgaggagcgcgagauccccgagcgguccuggaacagcggccacgagugggugaccgacuucaaggggaagaccgucugguucgugccguccaucaaggccggcaacgacaucgccgccugccugcgcaagaacggcaagaaggugauccagcucagccggaagacguucgacuccgaguacgucaagacccgcgccaacgacugggacuucguggugaccaccgacaucagcgagaugggggcgaacuucaaggccgagcgggucaucgacccccgccggugcaugaagcccgugauccugacggacggcgaggagcgcgugauccuggccgggcccaugccggucacccacuccagcgccgcccagcggcgcggccgcaucgggcggaaccccaagaacgagaacgaccaguacaucuacaugggcgagccccucgagaacgacgaggacugcgcgcacuggaaggaggccaagaugcugcuggacaacaucaacacccccgagggcaucaucccguccauguucgagcccgagcgcgagaagguggacgccaucgacggggaguaccggcuccgcggcgaggcccggaagaccuucguggaccugaugcgccgcggggaccugcccgucuggcucgccuacaagguggcggccgagggcaucaacuacgccgaccgcaaguggugcuucgacgggaucaagaacaaccagauccuggaggagaacguggaggucgagaucuggacgaaggagggcgagcggaagaagcugaagccgcgcuggcucgacgcccggaucuacagcgacccccuggcgcugaaggaguucaaggaguucgccgccggccgcaagucccucacccugaaccugaucaccgagauggggcggcuccccaccuucaugacgcagaaggcccgcaacgcccuggacaaccuggcggugcuccacaccgccgaggugggcgggaaggccuacacccacgcccugagcgagcugcccgagacccucgagacgcugcugcuccugacccugcucgccgcggucaccggcggcaucuuccuguuccugauguccgggaagggcaucgggaagaugacccucggcaugugcugcaucaucaccgccagcauccugcugugguacgcccagauccagccgcacuggaucgccgccuccaucauccucgaguucuuccugaucgugcugcucauccccgagcccgagaagcagcggacgccccaggacaaccagcugaccuacgucgugaucgcgauccugaccguggucgccgccaccauggccaacgagaugggguuccucgagaagacgaagaaggaccugggcuucggcagcaucaccacccaggagagcgaguccaacauccuggacaucgaccuccgcccggccagcgcguggacccuguacgccguggccacgaccuucgugacccccaugcugcggcacuccaucgagaacagcuccgucaacgugagccucaccgccaucgcgaaccaggccacggugcugauggggcugggcaagggguggccccucuccaagauggacaucggcgucccccugcuggccaucgggugcuacagccaggugaacccgaucacccucaccgccgcccugcugcuccugguggcgcacuacgccaucaucggccccggccugcaggccaaggccacccgcgaggcccagaagcgggcggccgccgggaucaugaagaaccccacggucgacggcaucaccgugaucgaccucgagcccaucccguacgaccccaaguucgagaagcagcuggggcaggucaugcugcucauccugugcgucacccaggugcugaugaugcgcaccacgugggcccucugcgaggcccugacccuggcgaccggccccaucuccacccucugggaggggaaccccggccgguucuggaacacgaccaucgccgugagcauggccaacaucuuccgcggcuccuaccuggccggggcgggccuccuguucagcaucaugaagaacaccaccaacacgcgccgggggaccggcaacgucggcgagacccugggggagaaguggaagucccgccugaacgcccucggcaagagcgaguuccagaucuacaagaaguccgggauccaggagguggaccggacccuggccaaggagggcaucaagcgcggggagacggaccaccacgccgugagccggggcuccgccaagcugcgcugguucgucgagcggaacauggugaccccggagggcaagguggucgaccucgggugcggccgcgggggcuggagcuacuacugcgggggccugaagaacgugcgggaggugaagggccugaccaagggcggccccgggcacgaggagcccauccccauguccaccuacggcuggaaccucguccgccugcagagcgggguggacguguucuucacgccgcccgagaagugcgacacccugcucugcgacaucggcgagagcucccccaaccccaccaucgaggcgggccggacccugcgcguccugaaccucguggagaacuggcugaacaacaacacccaguucugcaucaaggugcugaacccguacaugcccagcgucaucgagaagauggagacgcuccagcggaaguacgggggcgcccuggugcgcaacccccugucccggaacagcacccacgagauguacuggguguccaacgccaccgggaacaucgucagcuccgugaacaugaucagccgcaugcugaucaaccgguucaccaugaagcacaagaaggccacguacgagccggacguggaccucggcuccgggacccgcaacaucggcaucgagagcgagauccccaaccuggacaucaucggcaagcggaucgagaagaucaagcaggagcacgagaccuccuggcacuacgaccaggaccaccccuacaagaccugggccuaccacgggagcuacgagacgaagcagaccggcuccgcgagcuccauggucaacgggguggugcgccugcucaccaagcccugggacgucgugccgauggugacccagauggccaugacggacaccacccccuucggccagcagcgcgucuucaaggagaagguggacacccggacgcaggagcccaaggagggcaccaagaagcugaugaagaucaccgccgaguggcuguggaaggagcucgggaaggagaagacgccccggaugugcacgcgggaggaguucacccgcaaggugcggagcaacgccgcccugggcgcggucuucaccgacgagaacaaguggaaguccgcccgcgaggccguggaggacgggcgguucugggagcugguggaccgcgagcggaaccuccaccuggagggcaagugcgagaccugcgucuacaacaugauggggaagcgcgagaagaagcugggcgaguucggcaaggccaaggggagccgggcgaucugguacauguggcucggcgcccgcuuccuggaguucgaggcccugggguuccucaacgaggaccacugguucucccggggcaacagccugagcgggguggagggcgagggccugcaccgccucggguacauccugcgggaggucggcaagaaggagggcggcgccauguacgccgacgacacggcggggugggacacccgcaucacccuggaggaccucaagaacgaggagauggugaccaaccacaugaagggcgagcacaagaagcuggccgaggccaucuucaagcugacguaccagaacaaggugguccgggugcagcgcccgacgccccggggcaccgugauggacaucaucucccgcaaggaccagcgggggagcggccaggucgggaccuacggccucaacacguucaccaacauggaggcccagcugauccgccagauggagggcgaggggaucuucaaguccauccagcaccugaccgccaccgaggagaucgcggugcagaacuggcucgcccgcgugggccgggagcgccugagccggauggccaucuccggggacgacugcgucgugaagcccaucgacgaccgcuucgccagcgcccugacggcgcucaacgacaugggcaaggugcggaaggacauccagcagugggagcccucccgcggguggaacgacuggacccaggucccguucugcagccaccacuuccacgagcuggugaugaaggacggccgggugcuggucgugcccugccgcaaccaggacgagcucaucggccgggcccgcaucucccagggggccggcuggagccugaaggagaccgccugccuggggaaguccuacgcccagauguggacccucauguacuuccaccggcgcgaccugcggcuggcggccaacgccaucugcagcgccgugcccucccacuggguccccaccagccgcacgaccugguccauccacgcgaagcacgaguggaugaccaccgaggacaugcucgccguguggaaccggguguggauccaggagaacccguggauggaggacaagacgcccgucgagagcugggaggaggugcccuaccugggcaagcgcgaggaccaguggugcgggucccugaucggccucaccagccgggccaccugggccaagaacauccagaccgccaucaaccaggugcgcagccugaugggcaacgagggguacacggacuacaugcccuccaugaagcgguuccgccgcgaggaggaggaggcgggcguccugugguga

SEQ ID NO: 9108 - RNA, 9876 nt, Artificial Sequence
  derived and/or modified CDS sequence (opt1) from DENV-2__GQ868551__SS-prME
accgccggcgugaucgucaugcugauccccaccgccauggcguuccaccucaccacccgcaacggggagccccacaugaucgugggccggcaggagaaggggaagucccugcuguucaagaccgaggacggcgugaacaugugcacccucauggccaucgaccugggggagcugugcgaggacaccaucaccuacaagugcccccuccugcgccagaacgagcccgaggacaucgacugcuggugcaacagcaccagcaccugggucaccuacgggaccugcaccaccacgggcgagcaccggcgcgagaagcgguccguggcccuggugccccacgucgggaugggccucgagacccgcaccgagaccuggaugagcuccgagggggccuggaagcacgugcagcggaucgagaccuggauccugcgccacccgggcuucaccaucauggccgcgauccuggccuacaccaucgggaccacgcacuuccagcgggcccucaucuucauccugcugaccgccguggcgcccagcaugaccaugcgcugcaucggcaucuccaaccgggacuucgucgagggcgugagcgggggcuccuggguggacaucguccucgagcacgggagcugcgugaccacgauggccaagaacaagcccacccuggacuucgagcugaucaagaccgaggccaagcagcccgccacccuccgcaaguacugcaucgaggccaagcugacgaacaccaccaccgagucccggugcccgacgcagggcgagcccagccugaacgaggagcaggacaagcgcuucaucugcaagcacuccaugguggaccggggcugggggaacggcugcgggcuguucggcaagggcgggaucgugaccugcgcgauguucacgugcaagaagaacauggagggcaagaucgugcagcccgagaaccuggaguacaccaucgugaucacgccccacagcggggaggagcacgccgucggcaacgacaccgggaagcacggcaaggagaucaagaucaccccgcaguccagcaccaccgaggccgagcugacgggguacggcaccgugaccauggagugcagcccccggaccggccucgacuucaacgagauggugcugcugcagauggaggacaaggccuggcucguccaccggcagugguuccuggaccugccccuccccuggcugccgggggccgacacgcagggcagcaacuggauccagaaggagacccuggugaccuucaagaacccccacgcgaagaagcaggacguggucgugcucgggucccaggagggcgccaugcacaccgcccugacgggggccaccgagauccagaugagcagcggcaaccuccuguucaccggccaccugaagugccgccugcggauggacaagcuccagcugaaggggauguccuacagcaugugcaccggcaaguucaagaucgucaaggagaucgccgagacgcagcacgggaccaucgugauccgcgugcaguacgagggcgacggcucccccugcaagauccccuucgagaucaccgaccuggagaagcggcacguccucgggcgccugaucaccgugaacccgaucgugacggagaaggacagccccgucaacaucgaggcggagccgcccuucggcgacuccuacaucaucguggggguggagccgggccagcugaagcucaacugguucaagaaggggagcuccaucggccagauguucgagaccaccaugcgcggcgccaagcggauggccauccugggggacaccgccugggacuucggcagccucggcggggucuucacguccaucgggaaggcccuccaccagguguucggggcgaucuacggcgccgccuucagcgggguguccuggaccaugaagauccugaucggcgucaucaucaccuggaucgggaugaacagccgcuccaccagccuguccgugagccuggugcucgucggcguggugacgcuguaccugggggccaugguccaggcggacuccggcugcaucgugagcuggaagaacaaggagcucaagugcggcuccgggaucuucaucaccgacaacgugcacaccuggaccgagcaguacaaguuccagcccgagagccccagcaagcuggccuccgccauccagaaggcccacgaggagggcaucugcgggauccggagcgucacgcgccuggagaaccucauguggaagcagaucacccccgagcugaaccacauccuguccgagaacgaggugaagcucaccaucaugaccggcgacaucaaggggaucaugcaggccggcaagcggagccugcgcccgcagcccacggagcugaaguacuccuggaagaccuggggcaaggugaagaugcucagcaccgagucccacaaccagaccuuccugaucgacgggcccgagacggcggagugcccgaacaccaaccgggccuggaacagccuggaggucgaggacuacggcuucgggguguucaccaccaacaucuggcucaagcugcgcgagaagcaggacguguucugcgacuccaagcugaugagcgccgccaucaaggacaaccgggccguccacgcggacaugggcuacuggaucgaguccgcccucaacgacaccuggaagauggagaaggccagcuucaucgaggugaaguccugccacuggcccaagagccacacgcugugguccaacggcgugcuggagagcgagaugaucauccccaagaacuucgccgggcccgucucccagcacaacuaccgcccgggcuaccacacccagaccgccgggcccuggcaccucggcaagcuggagauggacuucgacuucugcgaggggaccacggugguggucaccgaggacugcggcaaccggggccccagccugcgcaccaccacggcgagcgggaagcucaucaccgaguggugcugccgguccugcacccugcccccgcugcgcuaccggggcgaggacgggugcugguacggcauggagauccgcccccucaaggagaaggaggagaaccuggugaacagccuggugaccgccgggcacggccagaucgacaacuucucccucggcguccuggggauggcccuguuccucgaggagaugcugcggacgcgcgugggcaccaagcacgccauccugcucguggcgcugagcuucgucacccugaucaccgggaacauguccuuccgggaccucggccgcgugauggugauggucggggccacgaugaccgacgacaucggcaugggcgugaccuaccuggcccugcucgccgccuucaaggugcgccccaccuucgcggccgggcugcugcuccggaagcugacgagcaaggagcugaugauggccaccaucggcaucgcccuccugucccagagcacccugcccgagaccauccucgagcugacggacgcccuggcgcucgggaugauggcccugaagaucguccgcaacauggagaaguaccagcuggccgugaccaucauggccaucuccugcgugccgaacgccgucauccuccagaacgcguggaaggugagcugcaccauccuggccgccguguccgucagcccccugcuccugaccuccagccagcagaaggccgacuggaucccccuggcgcucacgaucaagggccugaaccccaccgccaucuuccugaccacccucucccggacgagcaagaagcgcuccuggccgcugaacgaggccaucauggccgugggcauggucagcauccuggccuccagccuccugaagaacgacauccccaugaccgggccccugguggcgggcgggcuccugaccgugugcuacguccugaccggccggagcgccgaccucgagcuggagcgcgccgccgacgugaagugggaggaccaggccgagaucuccgggagcucccccauccugagcaucacgaucuccgaggacggcagcauguccaucaagaacgaggaggaggagcagacccucaccauccugauccggaccggccugcucgugaucagcggggucuucccgguguccauccccaucaccgcggccgccugguaccugugggaggugaagaagcagcgcgccggcguccugugggacgugcccagcccgccgcccguggggaaggccgagcucgaggacggcgcguaccggaucaagcagcgcgggauccugggcuacucccagaucggcgccggggucuacaaggagggcacguuccacaccauguggcacgugacccgcggggccgugcugaugcaccgcggcaagcggaucgagcccagcugggccgacgucaagaaggaccucaucuccuacgggggcggcuggaagcuggagggggaguggaaggagggcgaggagguccaggugcuggcccucgagcccgggaagaacccccgcgcgguccagaccaagcccggcaucuucaagacgaacaccgggaccaucggcgccgugagccuggacuucucccccggcaccagcgggucccccaucguggaccggaagggcaaggucguggggcuguacggcaacggcguggucacgcgcagcggggccuacguguccgccaucgcgcagaccgagaaguccaucgaggacaaccccgagaucgaggacgacaucuuccggaagaagcgccucaccaucauggaccugcaccccggcgccgggaagaccaagcgguaccugcccgccaucgugcgcgaggccaucaagcggggccugcgcacgcucauccuggccccgacccgcgucguggcggccgagauggaggaggcccugcgggggcuccccauccgcuaccagacccccgccauccgggccgagcacaccggccgcgagaucguggaccugaugugccacgcgacguucaccaugcggcugcucagccccguccgcgugccgaacuacaaccugaucaucauggacgaggcccacuucaccgaccccgccuccaucgccgcccggggcuacaucagcacccgcguggagaugggggaggcggccggcaucuucaugacggccacgccgcccgggucccgggacccguucccccagagcaacgcccccaucauggacgaggagcgcgagauccccgagcgguccuggaacagcggccacgagugggucaccgacuucaaggggaagaccgugugguucgugccguccaucaaggcgggcaacgacaucgccgccugccugcgcaagaacggcaagaaggucauccagcucagccggaagacguucgacuccgaguacgugaagacccgcgccaacgacugggacuucguggucaccaccgacaucagcgagaugggggccaacuucaaggcggagcgggugaucgacccccgccggugcaugaagcccgugauccugacggacggcgaggagcgcgucauccuggccgggcccaugccggugacccacuccagcgccgcccagcggcgcggccgcaucgggcggaaccccaagaacgagaacgaccaguacaucuacaugggcgagccccucgagaacgacgaggacugcgcccacuggaaggaggcgaagaugcugcuggacaacaucaacacccccgagggcaucaucccguccauguucgagcccgagcgcgagaagguggacgccaucgacggggaguaccggcuccgcggcgaggcccggaagaccuucgucgaccugaugcgccgcggggaccugcccguguggcucgccuacaagguggccgcggagggcaucaacuacgccgaccgcaaguggugcuucgacgggaucaagaacaaccagauccuggaggagaacgucgagguggagaucuggacgaaggagggcgagcggaagaagcugaagccgcgcuggcucgacgcccggaucuacagcgacccccuggcccugaaggaguucaaggaguucgcggccggccgcaagucccucacccugaaccugaucaccgagauggggcggcuccccaccuucaugacgcagaaggcccgcaacgcccuggacaaccuggccgugcuccacaccgcggaggucggcgggaaggccuacacccacgcccugagcgagcugcccgagacccucgagacgcugcugcuccugacccugcucgccgccgugaccggcggcaucuuccuguuccugauguccgggaagggcaucgggaagaugacccucggcaugugcugcaucaucaccgcgagcauccugcugugguacgcccagauccagccgcacuggaucgccgccuccaucauccucgaguucuuccugaucguccugcucauccccgagcccgagaagcagcggacgccccaggacaaccagcugaccuacguggugaucgccauccugaccgucguggcggccaccauggccaacgagaugggguuccucgagaagacgaagaaggaccugggcuucggcagcaucaccacccaggagagcgaguccaacauccuggacaucgaccuccgcccggccagcgccuggacccuguacgcgguggccacgaccuucgucacccccaugcugcggcacuccaucgagaacagcuccgugaacgugagccucaccgccaucgccaaccaggcgacgguccugauggggcugggcaagggguggccccucuccaagauggacaucggcgugccccugcuggccaucgggugcuacagccaggugaacccgaucacccucaccgccgcccugcugcuccuggucgcccacuacgcgaucaucggccccggccugcaggccaaggccacccgcgaggcccagaagcgggccgcggccgggaucaugaagaaccccacgguggacggcaucaccgugaucgaccucgagcccaucccguacgaccccaaguucgagaagcagcuggggcaggucaugcugcucauccugugcgugacccaggugcugaugaugcgcaccacgugggcccucugcgaggcccugacccuggccaccggccccaucuccacccucugggaggggaaccccggccgguucuggaacacgaccaucgcggucagcauggccaacaucuuccgcggcuccuaccuggccggggccggccuccuguucagcaucaugaagaacaccaccaacacgcgccgggggaccggcaacgugggcgagacccugggggagaaguggaagucccgccugaacgcgcucggcaagagcgaguuccagaucuacaagaaguccgggauccaggagguggaccggacccuggccaaggagggcaucaagcgcggggagacggaccaccacgccgucagccggggcuccgccaagcugcgcugguucguggagcggaacauggugaccccggagggcaaggucguggaccucgggugcggccgcgggggcuggagcuacuacugcgggggccugaagaacgugcgggaggucaagggccugaccaagggcggccccgggcacgaggagcccauccccauguccaccuacggcuggaaccucgugcgccugcagagcgggguggacgucuucuucacgccgcccgagaagugcgacacccugcucugcgacaucggcgagagcucccccaaccccaccaucgaggccggccggacccugcgcgugcugaaccucguggagaacuggcugaacaacaacacccaguucugcaucaagguccugaacccguacaugcccagcgugaucgagaagauggagacgcuccagcggaaguacgggggcgcgcuggugcgcaacccccugucccggaacagcacccacgagauguacugggucuccaacgccaccgggaacaucgugagcuccgugaacaugaucagccgcaugcugaucaaccgguucaccaugaagcacaagaaggccacguacgagccggacgucgaccucggcuccgggacccgcaacaucggcaucgagagcgagauccccaaccuggacaucaucggcaagcggaucgagaagaucaagcaggagcacgagaccuccuggcacuacgaccaggaccaccccuacaagaccugggccuaccacgggagcuacgagacgaagcagaccggcuccgccagcuccauggugaacggggugguccgccugcucaccaagcccugggacguggugccgauggucacccagauggcgaugacggacaccacccccuucggccagcagcgcguguucaaggagaagguggacacccggacgcaggagcccaaggagggcaccaagaagcugaugaagaucaccgccgaguggcuguggaaggagcucgggaaggagaagacgccccggaugugcacgcgggaggaguucacccgcaagguccggagcaacgccgcccugggcgccguguucaccgacgagaacaaguggaaguccgcgcgcgaggccguggaggacgggcgguucugggagcuggucgaccgcgagcggaaccuccaccuggagggcaagugcgagaccugcguguacaacaugauggggaagcgcgagaagaagcugggcgaguucggcaaggccaaggggagccgggccaucugguacauguggcucggcgcgcgcuuccuggaguucgaggcccugggguuccucaacgaggaccacugguucucccggggcaacagccugagcggggucgagggcgagggccugcaccgccucggguacauccugcgggaggugggcaagaaggagggcggcgccauguacgccgacgacacggccgggugggacacccgcaucacccuggaggaccucaagaacgaggagauggugaccaaccacaugaagggcgagcacaagaagcuggcggaggccaucuucaagcugacguaccagaacaaggucgugcgggugcagcgcccgacgccccggggcaccgucauggacaucaucucccgcaaggaccagcgggggagcggccagguggggaccuacggccucaacacguucaccaacauggaggcccagcugauccgccagauggagggcgaggggaucuucaaguccauccagcaccugaccgccaccgaggagaucgccgugcagaacuggcucgcgcgcgucggccgggagcgccugagccggauggccaucuccggggacgacugcguggugaagcccaucgacgaccgcuucgccagcgcccugacggcccucaacgacaugggcaagguccggaaggacauccagcagugggagcccucccgcggguggaacgacuggacccaggugccguucugcagccaccacuuccacgagcuggugaugaaggacggccggguccugguggugcccugccgcaaccaggacgagcucaucggccgggcgcgcaucucccagggggccggcuggagccugaaggagaccgccugccuggggaaguccuacgcccagauguggacccucauguacuuccaccggcgcgaccugcggcuggccgcgaacgccaucugcagcgccguccccucccacugggugcccaccagccgcacgaccugguccauccacgccaagcacgaguggaugaccaccgaggacaugcucgcgguguggaaccgggucuggauccaggagaacccguggauggaggacaagacgcccguggagagcugggaggaggugcccuaccugggcaagcgcgaggaccaguggugcgggucccugaucggccucaccagccgggccaccugggccaagaacauccagaccgccaucaaccagguccgcagccugaugggcaacgagggguacacggacuacaugcccuccaugaagcgguuccgccgcgaggaggaggaggccggcgugcugugguga

SEQ ID NO: 9109 - RNA, 9876 nt, Artificial Sequence
  derived and/or modified CDS sequence (opt1) from DENV-2__HM181971__SS-prME
accgccggcgugaucgucaugcugauccccaccgccauggcguuccaccucaccacccgcaacggggagccccacaugaucgugggccggcaggagaaggggaagucccugcuguucaagaccgaggacggcgugaacaugugcacccucauggccaucgaccugggggagcugugcgaggacaccaucaccuacaagugcccccuccugcgccagaacgagcccgaggacaucgacugcuggugcaacagcaccagcaccugggucaccuacgggaccugcaccaccacgggcgagcaccggcgcgagaagcgguccguggcccuggugccccacgucgggaugggccucgagacccgcaccgagaccuggaugagcuccgagggggccuggaagcacgugcagcggaucgagaccuggauccugcgccacccgggcuucaccaucauggccgcgauccuggccuacaccaucgggaccacgcacuuccagcgggcccucaucuucauccugcugaccgccguggcgcccagcaugaccaugcgcugcaucggcaucuccaaccgggacuucgucgagggcgugagcgggggcuccuggguggacaucguccucgagcacgggagcugcgugaccacgauggccaagaacaagcccacccuggacuucgagcugaucaagaccgaggccaagcagcccgccacccuccgcaaguacugcaucgaggccaagcugacgaacaccaccaccgagucccggugcccgacgcagggcgagcccagccugaacgaggagcaggacaagcgcuucaucugcaagcacuccaugguggaccggggcugggggaacggcugcgggcuguucggcaagggcgggaucgugaccugcgcgauguucacgugcaagaagaacauggagggcaagaucgugcagcccgagaaccuggaguacaccaucgugaucacgccccacagcggggaggagcacgccgucggcaacgacaccgggaagcacggcaaggagaucaagaucaccccgcaguccagcaccaccgaggccgagcugacgggguacggcaccgugaccauggagugcagcccccggaccggccucgacuucaacgagauggugcugcugcagauggaggacaaggccuggcucguccaccggcagugguuccuggaccugccccuccccuggcugccgggggccgacacgcagggcagcaacuggauccagaaggagacccuggugaccuucaagaacccccacgcgaagaagcaggacguggucgugcucgggucccaggagggcgccaugcacaccgcccugacgggggccaccgagauccagaugagcagcggcaaccuccuguucaccggccaccugaagugccgccugcggauggacaagcuccagcugaaggggauguccuacagcaugugcaccggcaaguucaagaucgucaaggagaucgccgagacgcagcacgggaccaucgugauccgcgugcaguacgagggcgacggcucccccugcaagauccccuucgagaucaccgaccuggagaagcggcacguccucgggcgccugaucaccgugaacccgaucgugacggagaaggacagccccgucaacaucgaggcggagccgcccuucggcgacuccuacaucaucguggggguggagccgggccagcugaagcucaacugguucaagaaggggagcuccaucggccagauguucgagaccaccaugcgcggcgccaagcggauggccauccugggggacaccgccugggacuucggcagccucggcggggucuucacguccaucgggaaggcccuccaccagguguucggggcgaucuacggcgccgccuucagcgggguguccuggaccaugaagauccugaucggcgucaucaucaccuggaucgggaugaacagccgcuccaccagccuguccgugagccuggugcucgucggcguggugacgcuguaccugggggccaugguccaggcggacuccggcugcaucgugagcuggaagaacaaggagcucaagugcggcuccgggaucuucaucaccgacaacgugcacaccuggaccgagcaguacaaguuccagcccgagagccccagcaagcuggccuccgccauccagaaggcccacgaggagggcaucugcgggauccggagcgucacgcgccuggagaaccucauguggaagcagaucacccccgagcugaaccacauccuguccgagaacgaggugaagcucaccaucaugaccggcgacaucaaggggaucaugcaggccggcaagcggagccugcgcccgcagcccacggagcugaaguacuccuggaagaccuggggcaaggcgaagaugcucagcaccgagucccacaaccagaccuuccugaucgacgggcccgagacggccgagugcccgaacaccaaccgggccuggaacagccuggagguggaggacuacggcuucggggucuucaccaccaacaucuggcucaagcugcgcgagaagcaggacguguucugcgacuccaagcugaugagcgccgccaucaaggacaaccgggcggugcacgccgacaugggcuacuggaucgaguccgcccucaacgacaccuggaagauggagaaggccagcuucaucgaggucaaguccugccacuggcccaagagccacacgcugugguccaacggcgugcuggagagcgagaugaucauccccaagaacuucgccgggcccgugucccagcacaacuaccgcccgggcuaccacacccagaccgcggggcccuggcaccucggcaagcuggagaucgacuucgacuucugcgaggggaccacggucguggugaccgaggacugcggcaaccggggccccagccugcgcaccaccacggccagcgggaagcucaucaccgaguggugcugccgguccugcacccugcccccgcugcgcuaccggggcgaggacgggugcugguacggcauggagauccgcccccucaaggagaaggaggagaaccuggucaacagccuggugaccgccgggcacggccagaucgacaacuucucccucggcgugcuggggauggcccuguuccucgaggagaugcugcggacgcgcgucggcaccaagcacgcgauccugcucguggcccugagcuucgugacccugaucaccgggaacauguccuuccgggaccucggccgcgucauggugauggugggggccacgaugaccgacgacaucggcaugggcgucaccuaccuggcccugcucgccgcguucaaggugcgccccaccuucgccgccgggcugcugcuccggaagcugacgagcaaggagcugaugauggccaccaucggcaucgcccuccugucccagagcacccugcccgagaccauccucgagcugacggacgcgcuggcccucgggaugauggcccugaagaucgugcgcaacauggagaaguaccagcuggccgucaccaucauggccaucuccugcgugccgaacgcggugauccuccagaacgccuggaaggucagcugcaccauccuggccgccguguccgugagcccccugcuccugaccuccagccagcagaaggcggacuggaucccccuggcccucacgaucaagggccugaaccccaccgccaucuuccugaccacccucucccggacgagcaagaagcgcuccuggccgcugaacgaggccaucauggccgucggcauggugagcauccuggcguccagccuccugaagaacgacauccccaugaccgggccccuggucgccggcgggcuccugaccgugugcuacgugcugaccggccggagcgccgaccucgagcuggagcgcgccgccgacgucaagugggaggaccaggcggagaucuccgggagcucccccauccugagcaucacgaucuccgaggacggcagcauguccaucaagaacgaggaggaggagcagacccucaccauccugauccggaccggccugcucgugaucagcgggguguucccggucuccauccccaucaccgccgccgccugguaccugugggaggugaagaagcagcgcgccggcgugcugugggacguccccagcccgccgcccguggggaaggcggagcucgaggacggcgccuaccggaucaagcagcgcgggauccugggcuacucccagaucggcgccgggguguacaaggagggcacguuccacaccauguggcacgucacccgcggggccgugcugaugcaccgcggcaagcggaucgagcccagcugggccgacgugaagaaggaccucaucuccuacgggggcggcuggaagcuggagggggaguggaaggagggcgaggagguccaggugcuggcgcucgagcccgggaagaacccccgcgccgugcagaccaagcccggcaucuucaagacgaacaccgggaccaucggcgccgucagccuggacuucucccccggcaccagcgggucccccaucguggaccggaagggcaagguggucgggcuguacggcaacggcguggugacgcgcagcggggccuacgucuccgcgaucgcccagaccgagaaguccaucgaggacaaccccgagaucgaggacgacaucuuccggaagaagcgccucaccaucauggaccugcaccccggcgccgggaagaccaagcgguaccugcccgccaucgugcgcgaggccaucaagcggggccugcgcacgcucauccuggcgccgacccgcguggucgccgccgagauggaggaggcccugcgggggcuccccauccgcuaccagacccccgccauccgggcggagcacaccggccgcgagaucguggaccugaugugccacgccacguucaccaugcggcugcucagccccgugcgcgucccgaacuacaaccugaucaucauggacgaggcccacuucaccgaccccgccuccaucgccgcgcggggcuacaucagcacccgcguggagaugggggaggccgccggcaucuucaugacggccacgccgcccgggucccgggacccguucccccagagcaacgcgcccaucauggacgaggagcgcgagauccccgagcgguccuggaacagcggccacgagugggugaccgacuucaaggggaagaccgucugguucgugccguccaucaaggccggcaacgacaucgccgccugccugcgcaagaacggcaagaaggugauccagcucagccggaagacguucgacuccgaguacgucaagacccgcgccaacgacugggacuucguggugaccaccgacaucagcgagaugggggcgaacuucaaggccgagcgggucaucgacccccgccggugcaugaagcccgugauccugacggacggcgaggagcgcgugauccuggccgggcccaugccggucacccacuccagcgccgcccagcggcgcggccgcaucgggcggaaccccaagaacgagaacgaccaguacaucuacaugggcgagccccucgagaacgacgaggacugcgcgcacuggaaggaggccaagaugcugcuggacaacaucaacacccccgagggcaucaucccguccauguucgagcccgagcgcgagaagguggacgccaucgacggggaguaccggcuccgcggcgaggcccggaagaccuucguggaccugaugcgccgcggggaccugcccgucuggcucgccuacaagguggcggccgagggcaucaacuacgccgaccgcaaguggugcuucgacgggaucaagaacaaccagauccuggaggagaacguggaggucgagaucuggacgaaggagggcgagcggaagaagcugaagccgcgcuggcucgacgcccggaucuacagcgacccccuggcgcugaaggaguucaaggaguucgccgccggccgcaagucccucacccugaaccugaucaccgagauggggcggcuccccaccuucaugacgcagaaggcccgcaacgcccuggacaaccuggcggugcuccacaccgccgaggugggcgggaaggccuacacccacgcccugagcgagcugcccgagacccucgagacgcugcugcuccugacccugcucgccgcggucaccggcggcaucuuccuguuccugauguccgggaagggcaucgggaagaugacccucggcaugugcugcaucaucaccgccagcauccugcugugguacgcccagauccagccgcacuggaucgccgccuccaucauccucgaguucuuccugaucgugcugcucauccccgagcccgagaagcagcggacgccccaggacaaccagcugaccuacgucgugaucgcgauccugaccguggucgccgccaccauggccaacgagaugggguuccucgagaagacgaagaaggaccugggcuucggcagcaucaccacccaggagagcgaguccaacauccuggacaucgaccuccgcccggccagcgcguggacccuguacgccguggccacgaccuucgugacccccaugcugcggcacuccaucgagaacagcuccgucaacgugagccucaccgccaucgcgaaccaggccacggugcugauggggcugggcaagggguggccccucuccaagauggacaucggcgucccccugcuggccaucgggugcuacagccaggugaacccgaucacccucaccgccgcccugcugcuccugguggcgcacuacgccaucaucggccccggccugcaggccaaggccacccgcgaggcccagaagcgggcggccgccgggaucaugaagaaccccacggucgacggcaucaccgugaucgaccucgagcccaucccguacgaccccaaguucgagaagcagcuggggcaggucaugcugcucauccugugcgucacccaggugcugaugaugcgcaccacgugggcccucugcgaggcccugacccuggcgaccggccccaucuccacccucugggaggggaaccccggccgguucuggaacacgaccaucgccgugagcauggccaacaucuuccgcggcuccuaccuggccggggcgggccuccuguucagcaucaugaagaacaccaccaacacgcgccgggggaccggcaacgucggcgagacccugggggagaaguggaagucccgccugaacgcccucggcaagagcgaguuccagaucuacaagaaguccgggauccaggagguggaccggacccuggccaaggagggcaucaagcgcggggagacggaccaccacgccgugagccggggcuccgccaagcugcgcugguucgucgagcggaacauggugaccccggagggcaagguggucgaccucgggugcggccgcgggggcuggagcuacuacugcgggggccugaagaacgugcgggaggugaagggccugaccaagggcggccccgggcacgaggagcccauccccauguccaccuacggcuggaaccucguccgccugcagagcgggguggacguguucuucacgccgcccgagaagugcgacacccugcucugcgacaucggcgagagcucccccaaccccaccaucgaggcgggccggacccugcgcguccugaaccucguggagaacuggcugaacaacaacacccaguucugcaucaaggugcugaacccguacaugcccagcgucaucgagaagauggagacgcuccagcggaaguacgggggcgcccuggugcgcaacccccugucccggaacagcacccacgagauguacuggguguccaacgccaccgggaacaucgucagcuccgugaacaugaucagccgcaugcugaucaaccgguucaccaugaagcacaagaaggccacguacgagccggacguggaccucggcuccgggacccgcaacaucggcaucgagagcgagauccccaaccuggacaucaucggcaagcggaucgagaagaucaagcaggagcacgagaccuccuggcacuacgaccaggaccaccccuacaagaccugggccuaccacgggagcuacgagacgaagcagaccggcuccgcgagcuccauggucaacgggguggugcgccugcucaccaagcccugggacgucgugccgauggugacccagauggccaugacggacaccacccccuucggccagcagcgcgucuucaaggagaagguggacacccggacgcaggagcccaaggagggcaccaagaagcugaugaagaucaccgccgaguggcuguggaaggagcucgggaaggagaagacgccccggaugugcacgcgggaggaguucacccgcaaggugcggagcaacgccgcccugggcgcggucuucaccgacgagaacaaguggaaguccgcccgcgaggccguggaggacgggcgguucugggagcugguggaccgcgagcggaaccuccaccuggagggcaagugcgagaccugcgucuacaacaugauggggaagcgcgagaagaagcugggcgaguucggcaaggccaaggggagccgggcgaucugguacauguggcucggcgcccgcuuccuggaguucgaggcccugggguuccucaacgaggaccacugguucucccggggcaacagccugagcgggguggagggcgagggccugcaccgccucggguacauccugcgggaggucggcaagaaggagggcggcgccauguacgccgacgacacggcggggugggacacccgcaucacccuggaggaccucaagaacgaggagauggugaccaaccacaugaagggcgagcacaagaagcuggccgaggccaucuucaagcugacguaccagaacaaggugguccgggugcagcgcccgacgccccggggcaccgugauggacaucaucucccgcaaggaccagcgggggagcggccaggucgggaccuacggccucaacacguucaccaacauggaggcccagcugauccgccagauggagggcgaggggaucuucaaguccauccagcaccugaccgccaccgaggagaucgcggugcagaacuggcucgcccgcgugggccgggagcgccugagccggauggccaucuccggggacgacugcgucgugaagcccaucgacgaccgcuucgccagcgcccugacggcgcucaacgacaugggcaaggugcggaaggacauccagcagugggagcccucccgcggguggaacgacuggacccaggucccguucugcagccaccacuuccacgagcuggugaugaaggacggccgggugcuggucgugcccugccgcaaccaggacgagcucaucggccgggcccgcaucucccagggggccggcuggagccugaaggagaccgccugccuggggaaguccuacgcccagauguggacccucauguacuuccaccggcgcgaccugcggcuggcggccaacgccaucugcagcgccgugcccucccacuggguccccaccagccgcacgaccugguccauccacgcgaagcacgaguggaugaccaccgaggacaugcucgccguguggaaccggguguggauccaggagaacccguggauggaggacaagacgcccgucgagagcugggaggaggugcccuaccugggcaagcgcgaggaccaguggugcgggucccugaucggccucaccagccgggccaccugggccaagaacauccagaccgccaucaaccaggugcgcagccugaugggcaacgagggguacacggacuacaugcccuccaugaagcgguuccgccgcgaggaggaggaggcgggcguccugugguga

SEQ ID NO: 9110 - RNA, 9876 nt, Artificial Sequence
  derived and/or modified CDS sequence (opt1) from DENV-2__GU131881__SS-prME
accgccggcgugaucgucaugcugauccccaccgccauggcguuccaccucaccacccgcaacggggagccccacaugaucgugggccggcaggagaaggggaagucccugcuguucaagaccgaggacggcgugaacaugugcacccucauggccaucgaccugggggagcugugcgaggacaccaucaccuacaagugcccccuccugcgccagaacgagcccgaggacaucgacugcuggugcaacagcaccagcaccugggucaccuacgggaccugcaccaccacgggcgagcaccggcgcgagaagcgguccguggcccuggugccccacgucgggaugggccucgagacccgcaccgagaccuggaugagcuccgagggggccuggaagcacgugcagcggaucgagaccuggauccugcgccacccgggcuucaccaucauggccgcgauccuggccuacaccaucgggaccacgcacuuccagcgggcccucaucuucauccugcugaccgccguggcgcccagcaugaccaugcgcugcaucggcaucuccaaccgggacuucgucgagggcgugagcgggggcuccuggguggacaucguccucgagcacgggagcugcgugaccacgauggccaagaacaagcccacccuggacuucgagcugaucaagaccgaggccaagcagcccgccacccuccgcaaguacugcaucgaggccaagcugacgaacaccaccaccgagucccggugcccgacgcagggcgagcccagccugaacgaggagcaggacaagcgcuucaucugcaagcacuccaugguggaccggggcugggggaacggcugcgggcuguucggcaagggcgggaucgugaccugcgcgauguucacgugcaagaagaacauggagggcaagaucgugcagcccgagaaccuggaguacaccaucgugaucacgccccacagcggggaggagcacgccgucggcaacgacaccgggaagcacggcaaggagaucaagaucaccccgcaguccagcaccaccgaggccgagcugacgggguacggcaccgugaccauggagugcagcccccggaccggccucgacuucaacgagauggugcugcugcagauggaggacaaggccuggcucguccaccggcagugguuccuggaccugccccuccccuggcugccgggggccgacacgcagggcagcaacuggauccagaaggagacccuggugaccuucaagaacccccacgcgaagaagcaggacguggucgugcucgggucccaggagggcgccaugcacaccgcccugacgggggccaccgagauccagaugagcagcggcaaccuccuguucaccggccaccugaagugccgccugcggauggacaagcuccagcugaaggggauguccuacagcaugugcaccggcaaguucaagaucgucaaggagaucgccgagacgcagcacgggaccaucgugauccgcgugcaguacgagggcgacggcucccccugcaagauccccuucgagaucaccgaccuggagaagcggcacguccucgggcgccugaucaccgugaacccgaucgugacggagaaggacagccccgucaacaucgaggcggagccgcccuucggcgacuccuacaucaucguggggguggagccgggccagcugaagcucaacugguucaagaaggggagcuccaucggccagauguucgagaccaccaugcgcggcgccaagcggauggccauccugggggacaccgccugggacuucggcagccucggcggggucuucacguccaucgggaaggcccuccaccagguguucggggcgaucuacggcgccgccuucagcgggguguccuggaccaugaagauccugaucggcgucaucaucaccuggaucgggaugaacagccgcuccaccagccuguccgugagccuggugcucgucggcguggugacgcuguaccugggggccaugguccaggcggacuccggcugcaucgugagcuggaagaacaaggagcucaagugcggcuccgggaucuucaucaccgacaacgugcacaccuggaccgagcaguacaaguuccagcccgagagccccagcaagcuggccuccgccauccagaaggcccacgaggagggcaucugcgggauccggagcgucacgcgccuggagaaccucauguggaagcagaucacccccgagcugaaccacauccuguccgagaacgaggugaagcucaccaucaugaccggcgacaucaaggggaucaugcaggccggcaagcggagccugcgcccgcagcccacggagcugaaguacuccuggaagaccuggggcaaggcgaagaugcucagcaccgagucccacaaccagaccuuccugaucgacgggcccgagacggccgagugcccgaacaccaaccgggccuggaacagccuggagguggaggacuacggcuucggggucuucaccaccaacaucuggcucaagcugcgcgagaagcaggacguguucugcgacuccaagcugaugagcgccgccaucaagaacaaccgggcggugcacgccgacaugggcuacuggaucgaguccgcccucaacgacaccuggaagauggagaaggccagcuucaucgaggucaaguccugccacuggcccaagagccacacgcugugguccaacggcgugcuggagagcgagaugaucauccccaagaacuucgccgggcccgugucccagcacaacuaccgcccgggcuaccacacccagaccgcggggcccuggcaccucggcaagcuggagauggacuucgacuucugcgaggggaccacggucguggugaccgaggacugcggcaaccggggccccagccugcgcaccaccacggccagcgggaagcucaucaccgaguggugcugccgguccugcacccugcccccgcugcgcuaccggggcgaggacgggugcugguacggcauggagauccgcccccucaaggagaaggaggagaaccuggucaacagccuggugaccgccgggcacggccagaucgacaacuucucccucggcgugcuggggauggcccuguuccucgaggagaugcugcggacgcgcgucggcaccaagcacgcgauccugcucguggcccugagcuucgugacccugaucaccgggaacauguccuuccgggaccucggccgcgucauggugauggugggggccacgaugaccgacgacaucggcaugggcgucaccuaccuggcccugcucgccgcguucaaggugcgccccaccuucgccgccgggcugcugcuccggaagcugacgagcaaggagcugaugauggccaccaucggcaucgcccuccugucccagagcacccugcccgagaccauccucgagcugacggacgcgcuggcccucgggaugauggcccugaagaucgugcgcaacauggagaaguaccagcuggccgucaccaucauggccaucuccugcgugccgaacgcggugauccuccagaacgccuggaaggucagcugcaccauccuggccgccguguccgugagcccccugcuccugaccuccagccagcagaaggcggacuggaucccccuggcccucacgaucaagggccugaaccccaccgccaucuuccugaccacccucucccggacgagcaagaagcgcuccuggccgcugaacgaggccaucauggccgucggcauggugagcauccuggcguccagccuccugaagaacgacauccccaugaccgggccccuggucgccggcgggcuccugaccgugugcuacgugcugaccggccggagcgccgaccucgagcuggagcgcgccgccgacgucaagugggaggaccaggcggagaucuccgggagcucccccauccugagcaucacgaucuccgaggacggcagcauguccaucaagaacgaggaggaggagcagacccucaccauccugauccggaccggccugcucgugaucagcgggguguucccggucuccauccccaucaccgccgccgccugguaccugugggaggugaagaagcagcgcgccggcgugcugugggacguccccagcccgccgcccguggggaaggcggagcucgaggacggcgccuaccggaucaagcagcgcgggauccugggcuacucccagaucggcgccgggguguacaaggagggcacguuccacaccauguggcacgucacccgcggggccgugcugaugcaccgcggcaagcggaucgagcccagcugggccgacgugaagaaggaccucaucuccuacgggggcggcuggaagcuggagggggaguggaaggagggcgaggagguccaggugcuggcgcucgagcccgggaagaacccccgcgccgugcagaccaagcccggcaucuucaagacgaacaccgggaccaucggcgccgucagccuggacuucucccccggcaccagcgggucccccaucguggaccggaagggcaagguggucgggcuguacggcaacggcguggugacgcgcagcggggccuacgucuccgcgaucgcccagaccgagaaguccaucgaggacaaccccgagaucgaggacgacaucuuccggaagaagcgccucaccaucauggaccugcaccccggcgccgggaagaccaagcgguaccugcccgccaucgugcgcgaggccaucaagcggggccugcgcacgcucauccuggcgccgacccgcguggucgccgccgagauggaggaggcccugcgggggcuccccauccgcuaccagacccccgccauccgggcggagcacaccggccgcgagaucguggaccugaugugccacgccacguucaccaugcggcugcucagccccgugcgcgucccgaacuacaaccugaucaucauggacgaggcccacuucaccgaccccgccuccaucgccgcgcggggcuacaucagcacccgcguggagaugggggaggccgccggcaucuucaugacggccacgccgcccgggucccgggacccguucccccagagcaacgcgcccaucauggacgaggagcgcgagauccccgagcgguccuggaacagcggccacgagugggugaccgacuucaaggggaagaccgucugguucgugccguccaucaaggccggcaacgacaucgccgccugccugcgcaagaacggcaagaaggugauccagcucagccggaagacguucgacuccgaguacgucaagacccgcgccaacgacugggacuucguggugaccaccgacaucagcgagaugggggcgaacuucaaggccgagcgggucaucgacccccgccggugcaugaagcccgugauccugacggacggcgaggagcgcgugauccuggccgggcccaugccggucacccacuccagcgccgcccagcggcgcggccgcaucgggcggaaccccaagaacgagaacgaccaguacaucuacaugggcgagccccucgagaacgacgaggacugcgcgcacuggaaggaggccaagaugcugcuggacaacaucaacacccccgagggcaucaucccguccauguucgagcccgagcgcgagaagguggacgccaucgacggggaguaccggcuccgcggcgaggcccggaagaccuucguggaccugaugcgccgcggggaccugcccgucuggcucgccuacaagguggcggccgagggcaucaacuacgccgaccgcaaguggugcuucgacgggaucaagaacaaccagauccuggaggagaacguggaggucgagaucuggacgaaggagggcgagcggaagaagcugaagccgcgcuggcucgacgcccggaucuacagcgacccccuggcgcugaaggaguucaaggaguucgccgccggccgcaagucccucacccugaaccugaucaccgagauggggcggcuccccaccuucaugacgcagaaggcccgcaacgcccuggacaaccuggcggugcuccacaccgccgaggugggcgggaaggccuacacccacgcccugagcgagcugcccgagacccucgagacgcugcugcuccugacccugcucgccgcggucaccggcggcaucuuccuguuccugauguccgggaagggcaucgggaagaugacccucggcaugugcugcaucaucaccgccagcauccugcugugguacgcccagauccagccgcacuggaucgccgccuccaucauccucgaguucuuccugaucgugcugcucauccccgagcccgagaagcagcggacgccccaggacaaccagcugaccuacgucgugaucgcgauccugaccguggucgccgccaccauggccaacgagaugggguuccucgagaagacgaagaaggaccugggcuucggcagcaucaccacccaggagagcgaguccaacauccuggacaucgaccuccgcccggccagcgcguggacccuguacgccguggccacgaccuucgugacccccaugcugcggcacuccaucgagaacagcuccgucaacgugagccucaccgccaucgcgaaccaggccacggugcugauggggcugggcaagggguggccccucuccaagauggacaucggcgucccccugcuggccaucgggugcuacagccaggugaacccgaucacccucaccgccgcccugcugcuccugguggcgcacuacgccaucaucggccccggccugcaggccaaggccacccgcgaggcccagaagcgggcggccgccgggaucaugaagaaccccacggucgacggcaucaccgugaucgaccucgagcccaucccguacgaccccaaguucgagaagcagcuggggcaggucaugcugcucauccugugcgucacccaggugcugaugaugcgcaccacgugggcccucugcgaggcccugacccuggcgaccggccccaucuccacccucugggaggggaaccccggccgguucuggaacacgaccaucgccgugagcauggccaacaucuuccgcggcuccuaccuggccggggcgggccuccuguucagcaucaugaagaacaccaccaacacgcgccgggggaccggcaacgucggcgagacccugggggagaaguggaagucccgccugaacgcccucggcaagagcgaguuccagaucuacaagaaguccgggauccaggagguggaccggacccuggccaaggagggcaucaagcgcggggagacggaccaccacgccgugagccggggcuccgccaagcugcgcugguucgucgagcggaacauggugaccccggagggcaagguggucgaccucgggugcggccgcgggggcuggagcuacuacugcgggggccugaagaacgugcgggaggugaagggccugaccaagggcggccccgggcacgaggagcccauccccauguccaccuacggcuggaaccucguccgccugcagagcgggguggacguguucuucacgccgcccgagaagugcgacacccugcucugcgacaucggcgagagcucccccaaccccaccaucgaggcgggccggacccugcgcguccugaaccucguggagaacuggcugaacaacaacacccaguucugcaucaaggugcugaacccguacaugcccagcgucaucgagaagauggagacgcuccagcggaaguacgggggcgcccuggugcgcaacccccugucccggaacagcacccacgagauguacuggguguccaacgccaccgggaacaucgucagcuccgugaacaugaucagccgcaugcugaucaaccgguucaccaugaagcacaagaaggccacguacgagccggacguggaccucggcuccgggacccgcaacaucggcaucgagagcgagauccccaaccuggacaucaucggcaagcggaucgagaagaucaagcaggagcacgagaccuccuggcacuacgaccaggaccaccccuacaagaccugggccuaccacgggagcuacgagacgaagcagaccggcuccgcgagcuccauggucaacgggguggugcgccugcucaccaagcccugggacgucgugccgauggugacccagauggccaugacggacaccacccccuucggccagcagcgcgucuucaaggagaagguggacacccggacgcaggagcccaaggagggcaccaagaagcugaugaagaucaccgccgaguggcuguggaaggagcucgggaaggagaagacgccccggaugugcacgcgggaggaguucacccgcaaggugcggagcaacgccgcccugggcgcggucuucaccgacgagaacaaguggaaguccgcccgcgaggccguggaggacgggcgguucugggagcugguggaccgcgagcggaaccuccaccuggagggcaagugcgagaccugcgucuacaacaugauggggaagcgcgagaagaagcugggcgaguucggcaaggccaaggggagccgggcgaucugguacauguggcucggcgcccgcuuccuggaguucgaggcccugggguuccucaacgaggaccacugguucucccggggcaacagccugagcgggguggagggcgagggccugcaccgccucggguacauccugcgggaggucggcaagaaggagggcggcgccauguacgccgacgacacggcggggugggacacccgcaucacccuggaggaccucaagaacgaggagauggugaccaaccacaugaagggcgagcacaagaagcuggccgaggccaucuucaagcugacguaccagaacaaggugguccgggugcagcgcccgacgccccggggcaccgugauggacaucaucucccgcaaggaccagcgggggagcggccaggucgggaccuacggccucaacacguucaccaacauggaggcccagcugauccgccagauggagggcgaggggaucuucaaguccauccagcaccugaccgccaccgaggagaucgcggugcagaacuggcucgcccgcgugggccgggagcgccugagccggauggccaucuccggggacgacugcgucgugaagcccaucgacgaccgcuucgccagcgcccugacggcgcucaacgacaugggcaaggugcggaaggacauccagcagugggagcccucccgcggguggaacgacuggacccaggucccguucugcagccaccacuuccacgagcuggugaugaaggacggccgggugcuggucgugcccugccgcaaccaggacgagcucaucggccgggcccgcaucucccagggggccggcuggagccugaaggagaccgccugccuggggaaguccuacgcccagauguggacccucauguacuuccaccggcgcgaccugcggcuggcggccaacgccaucugcagcgccgugcccucccacuggguccccaccagccgcacgaccugguccauccacgcgaagcacgaguggaugaccaccgaggacaugcucgccguguggaaccggguguggauccaggagaacccguggauggaggacaagacgcccgucgagagcugggaggaggugcccuaccugggcaagcgcgaggaccaguggugcgggucccugaucggccucaccagccgggccaccugggccaagaacauccagaccgccaucaaccaggugcgcagccugaucggcaacgagggguacacggacuacaugcccuccaugaagcgguuccgccgcgaggaggaggaggcgggcguccugugguga

SEQ ID NO: 9111 - RNA, 9876 nt, Artificial Sequence
  derived and/or modified CDS sequence (opt1) from DENV-2__FJ898461__SS-prME
accgccggcgugaucgucaugcugauccccaccgccauggcguuccaccucaccacccgcaacggggagccccacaugaucgugggccggcaggagaaggggaagucccugcuguucaagaccgaggacggcgugaacaugugcacccucauggccaucgaccugggggagcugugcgaggacaccaucaccuacaagugcccccuccugcgccagaacgagcccgaggacaucgacugcuggugcaacagcaccagcaccugggucaccuacgggaccugcaccaccacgggcgagcaccggcgcgagaagcgguccguggcccuggugccccacgucgggaugggccucgagacccgcaccgagaccuggaugagcagcgagggggccuggaagcacgugcagcggaucgagacguggauccugcgccaccccggcuucaccaucauggccgcgauccuggccuacaccaucgggaccacgcacuuccagcgggcccucaucuucauccugcugaccgccguggcgcccagcaugaccaugcgcugcaucggcaucagcaaccgggacuucgucgagggcgugagcgggggcagcuggguggacaucguccucgagcacgggagcugcgugaccacgauggccaagaacaagcccacccuggacuucgagcugaucaagaccgaggccaagcagcccgccacccuccgcaaguacugcaucgaggccaagcugacgaacaccaccaccgagucccggugcccgacgcagggcgagcccagccugaacgaggagcaggacaagcgcuucaucugcaagcacuccaugguggaccggggcugggggaacggcugcgggcuguucggcaagggcggcaucgugaccugcgcgauguucacgugcaagaagaacauggagggcaagguggugcagcccgagaaccuggaguacaccaucgucaucacgccccacagcggggaggagcacgccgugggcaacgacaccgggaagcacggcaaggagaucaagaucaccccgcaguccagcaucaccgaggccgagcugaccggguacggcacggugaccauggagugcagcccccggaccggccucgacuucaacgagaugguccugcugcagauggaggacaaggccuggcucgugcaccggcagugguuccuggaccugccccuccccuggcugccgggggccgacacccagggcagcaacuggauccagaaggagacgcuggugaccuucaagaacccccacgcgaagaagcaggacgucgugguccucgggucccaggagggcgccaugcacaccgcccugaccggggccacggagauccagaugagcagcggcaaccuccuguucaccggccaccugaagugccgccugcggauggacaagcuccagcugaaggggauguccuacagcaugugcaccggcaaguucaagaucgugaaggagaucgccgagacccagcacgggacgaucgugauccgcguccaguacgagggcgacggcucccccugcaagauccccuucgagaucaccgaccuggagaagcggcacgugcucgggcgccugaucaccgugaacccgaucgucaccgagaaggacagccccgugaacaucgaggcggagccgcccuucggcgacuccuacaucaucaucgggguggagccgggccagcugaagcucaacugguucaagaaggggagcuccaucggccagauguuccagacgaccguccgcggcgccaagcggauggccauccugggggacaccgccugggacuucggcagccucgggggcguguucaccuccaucgggaaggcccuccaccagguguucggcgcgaucuacggcgccgccuucagcggggucuccuggacgaugaagauccugaucggcgugaucaucaccuggaucgggaugaacagccgcuccaccagccuguccgugagccugguccucgugggcguggucacccuguaccugggggccauggugcaggcggacuccggcugcguggucagcuggaagaacaaggagcucaagugcggcuccgggaucuucaucacggacaacgugcacaccuggaccgagcaguacaaguuccagcccgagagccccagcaagcuggccuccgccauccagaaggcccacgaggagggcaucugcgggauccggagcgugacccgccuggagaaccucauguggaagcagaucacgcccgagcugaaccacauccuguccgagaacgaggucaagcucaccaucaugaccggcgacaucaaggggaucaugcaggccggcaagcggagccugcgcccgcagcccaccgagcugaaguacuccuggaagacguggggcaaggcgaagaugcucagcaccgagucccacaaccagaccuuccugaucgacgggcccgagaccgccgagugcccgaacacgaaccgggccuggaacagccuggagguggaggacuacggcuucgggguguucaccaccaacaucuggcucaagcugcgcgagaagcaggacgucuucugcgacuccaagcugaugagcgccgccaucaaggacaaccgggcggugcacgccgacaugggcuacuggaucgaguccgcccucaacgacaccuggaagauggagaaggccagcuucaucgaggugaaguccugccacuggcccaagagccacacccugugguccaacggcguccuggagagcgagaugaucauccccaagaacuucgccgggcccgugucccagcacaacuaccgcccgggcuaccacacgcagaccgcggggcccuggcaccucggcaagcuggagauggacuucgaccugugcgaggggaccaccguggucgugacggaggacugcggcaaccggggccccagccuccgcaccaccaccgccagcgggaagcugaucacggaguggugcugccgguccugcacccugcccccgcuccgcuaccggggcgaggacgggugcugguacggcauggagauccgcccccugaaggagaaggaggagaaccuggugaacagccucgucaccgccgggcacggccagaucgacaacuucucccugggcgugcuggggauggcccucuuccuggaggagaugcugcggacccgcaucggcacgaagcacgcgauccuccugguggucgugagcuucgugacccugaucaccgggaacauguccuuccgggaccucggccgcgucauggugauggugggggccaccaugacggacgacaucggcaugggcgucaccuaccuggcccugcucgccgccuucaaggugcgccccaccuucgcggccgggcugcugcuccggaagcugaccagcaaggagcugaugauggccacgaucggcaucgcccuccugucccagagcaccauccccgagaccauccuggagcucaccgacgcccuggcgcuggggaugauggugcucaagaucguccgcaacauggagaaguaccagcuggccgugacgaucauggccaucuccugcgugccgaacgccgucauccugcagaacgccuggaaggugagcugcaccauccucgcggccgucuccgugagcccccugcugcucaccuccagccagcagaaggccgacuggaucccccuggcccugaccaucaagggccucaaccccacggcgaucuuccugaccacccugucccggaccagcaagaagcgcuccuggccgcucaacgaggccaucauggccgugggcauggucagcauccuggccuccagccugcucaagaacgacauccccaugacggggccccugguggccggcgggcugcucaccgugugcuacguccugaccggccggagcgcggaccuggagcucgagcgcgccgccgacgugaagugggaggaccaggccgagaucuccgggagcucccccauccugagcaucaccaucuccgaggacggcagcauguccaucaagaacgaggaggaggagcagacgcugaccauccucauccggaccggccugcuggugaucagcggggucuucccgguguccauccccaucaccgccgcggccugguaccucugggaggugaagaagcagcgcgccggcguccugugggacgugcccagcccgccgcccguggagaaggccgagcuggaggacggggccuaccggaucaagcagcgcggcauccucggguacucccagaucggcgcgggcgucuacaaggaggggaccuuccacacgauguggcacgugacccggggcgccgugcugaugcaccgcgggaagcggaucgagcccagcugggccgacgucaagaaggaccugaucuccuacggcgggggcuggaagcucgagggcgaguggaaggagggggaggagguccaggugcuggcccuggagcccggcaagaacccccgcgccguccagaccaagcccgggaucuucaagaccaacacgggcaccaucggggcggugagccucgacuucucccccggcaccagcggcucccccaucguggaccggaaggggaaggucgugggccuguacgggaacggcguggucacccgcagcggcgccuacguguccgccaucgcccagacggagaaguccaucgaggacaaccccgagaucgaggacgacaucuuccggaagaagcgccugaccaucauggaccuccaccccggggcgggcaagaccaagcgguaccugcccgccaucgugcgcgaggccaucaagcgggggcugcgcacccugauccucgccccgacgcgcgucguggccgcggagauggaggaggcccugcggggccugcccauccgcuaccagacccccgccaucaagaccgagcacaccgggcgggagaucguggaccucaugugccacgccacguucaccaugcgccugcugagccccguccgggugccgaacuacaaccucaucaucauggacgaggcccacuucaccgaccccgcguccaucgccgcccgcggcuacaucagcacccggguggagaugggcgaggccgccgggaucuucaugacggcgacgccgcccggcucccgcgacccguucccccagagcaacgcccccaucauggacgaggagcgggagauccccgagcgcuccuggaacagcgggcacgagugggucaccgacuucaagggcaagaccgugugguucgugccguccaucaaggccgggaacgacaucgccgcgugccugcggaagaacggcaagaaggucauccagcugagccgcaagacguucgacuccgaguacgugaagacccgggccaacgacugggacuucguggucaccaccgacaucagcgagaugggcgccaacuucaaggccgagcgcgugaucgacccccggcgcugcaugaagcccgugauccucacggacggggaggagcgggucauccuggccggccccaugccggugacccacuccagcgcggcccagcgccgggggcgcaucggccgcaaccccaagaacgagaacgaccaguacaucuacaugggggagccccuggagaacgacgaggacugcgcccacuggaaggaggccaagaugcuccuggacaacaucaacacccccgagggcaucaucccguccauguucgagcccgagcgggagaagguggacgccaucgacggcgaguaccgccugcgcggggaggcgcgcaagaccuucgucgaccucaugcggcgcggcgaccugcccguguggcuggccuacaagguggccgccgaggggaucaacuacgccgaccggaaguggugcuucgacggcaucaagaacaaccagauccucgaggagaacauggaggucgagaucuggacgaaggagggggagcgcaagaagcugaagccgcgguggcuggacgcgcgcaucuacagcgacccccucgcccugaaggaguucaaggaguucgccgccggccggaagucccugacccucaaccugaucaccgagaugggccgccugcccaccuucaugacgcagaaggcgcggaacgcccucgacaaccuggccgugcugcacaccgccgaggccgggggccgcgcguacaaccacgcccucagcgagcugcccgagacccuggagacccuccugcugcucacgcugcuggccaccgucaccgggggcaucuuccucuuccugauguccggcaaggggaucggcaagaugacccuggggaugugcugcaucaucaccgccagcauccuccugugguacgcccagauccagccgcacuggaucgcggccuccaucauccuggaguucuuccucaucgugcugcugauccccgagcccgagaagcagcggacgccccaggacaaccagcucaccuacguggucaucgccauccugaccgugguggccgccaccauggcgaacgagaugggcuuccuggagaagacgaagaaggaccucgggcugggcagcaucaccacccaggagccggagagcaacauccuggacaucgaccuccgccccgccuccgccuggacccuguacgccgucgccacgaccuucgugacccccaugcugcggcacagcaucgagaacuccagcgugaacgucucccucaccgcgaucgccaaccaggccacggugcugaugggccuggggaagggcuggccccucagcaagauggacaucggggugccgcugcuggccaucggcugcuacucccaggucaaccccaucacccucaccgcggcccugcugcuccugguggcccacuacgccaucaucgggcccggccugcaggccaaggcgacccgcgaggcccagaagcgggccgccgccggcaucaugaagaaccccacgguggacgggaucaccgucaucgaccucgagccgauccccuacgaccccaaguucgagaagcagcugggccaggugaugcugcucauccugugcgugacccagguccugaugaugcgcaccacgugggcgcucugcgaggcccugacccuggccaccgggcccaucagcacccucugggagggcaacccggggcgguucuggaacacgaccaucgccguguccauggccaacaucuuccgcggcagcuaccuggcgggcgccgggcuccuguucuccaucaugaagaacaccaccaacacgcgccggggcaccgggaacaucggcgagacccugggcgagaaguggaagucccgccugaacgcccucgggaaguccgaguuccagaucuacaagaaguccggcauccaggagguggaccggacccuggccaaggaggggaucaagcgcggcgagacggaccaccacgcggucucccgggggagcgccaagcugcgcugguucguggagcggaacauggugacccccgagggcaaggucguggaccucggcugcgggcgcggcgggugguccuacuacugcggcgggcugaagaacgugcgggaggucaagggccugaccaagggcgggcccggccacgaggagcccaucccgaugagcaccuacggguggaaccucgugcgccugcaguccggcguggacgucuucuucacgccgcccgagaagugcgacacccugcucugcgacaucggggagagcagccccaacccgaccaucgaggccggccggacccugcgcgugcugaaccucguggagaacuggcugaacaacaacacccaguucugcaucaagguccugaaccccuacaugcccuccgugaucgagaagauggagacgcuccagcggaaguacggcggggcccuggugcgcaacccgcugagccggaacuccacccacgagauguacugggucagcaacgccaccggcaacaucguguccagcgugaacaugaucucccgcaugcugaucaaccgguucaccaugaagcacaagaaggcgacguacgagcccgacgucgaccucgggagcggcacccgcaacaucgggaucgaguccgagauccccaaccuggacaucaucggcaagcggaucgagaagaucaagcaggagcacgagaccagcuggcacuacgaccaggaccaccccuacaagaccugggccuaccacggcuccuacgagacgaagcagaccgggagcgccuccagcauggugaacggcgugguccgccugcucaccaagccgugggacguggugcccauggucacccagauggccaugacggacaccacccccuucgggcagcagcgcguguucaaggagaagguggacacccggacgcaggagcccaaggagggcaccaagaagcugaugaagaucaccgccgaguggcuguggaaggagcucggcaagaagaagaccccgcgcaugugcacgcgggaggaguucacccgcaagguccgguccaacgcggcccugggggccaucuucaccgacgagaacaaguggaaguccgcccgcgaggccguggaggacggccgguucugggagcugguggaccgcgagcggaaccuccaccuggaggggaagugcgagaccugcgucuacaacaugaugggcaagcgcgagaagaagcugggggaguucggcaaggcgaagggcucccgggccaucugguacauguggcucggggcccgcuuccuggaguucgaggcccugggcuuccucaacgaggaccacugguucagccgggggaacucccugagcggcguggagggggagggccugcaccgccucggcuacauccugcgggacgucgggaagaaggagggcggggcgauguacgccgacgacacggccggcugggacacccgcaucacccuggaggaccucaagaacgaggagauggugaccaaccacaugaagggggagcacaagaagcuggccgaggccaucuucaagcugacguaccagaacaaggugguccgggugcagcgccccacgccccggggcaccgugauggacaucaucagccgccgggaccagcgcggcuccgggcaggucggcaccuacgggcucaacacguucaccaacauggaggcgcagcugauccgccagauggagggcgagggcaucuucaagagcauccagcaccugaccgccaccgaggagaucgccgugcagaacuggcucgcccggcuggggcgcgagcggcugucccgcauggccaucagcggcgacgacugcguggucaagcccaucgacgaccgguucgcguccgcccucacggcccugaacgacauggggaaggugcgcaaggacauccagcagugggagccgagccggggcuggaacgacuggacccaggugcccuucugcucccaccacuuccacgagcuggucaugaaggacgggcgcgugcucgugguccccugccggaaccaggacgagcugaucggccgcgcccggaucagccagggcgccggguggucccugaaggagaccgcgugccucggcaagagcuacgcccagauguggacccugauguacuuccaccgccgggaccugcgccucgccgccaacgccaucugcuccgcggugcccagccacugggugccgaccucccggacgaccuggagcauccacgccaagcacgaguggaugaccaccgaggacaugcuggccgucuggaaccgcguguggauccaggagaaccccuggauggaggacaagacgcccguggaguccugggaggagguccccuaccuggggaagcgggaggaccaguggugcggcagccucaucgggcugaccucccgcgccaccugggcgaagaacauccagaccgccaucaaccaggugcggagccugaucggcaacgaggaguacacggacuacaugccgagcaugaagcgcuuccgccgggaggaggaggaggccggcgugcucugguga

SEQ ID NO: 9112 - RNA, 9876 nt, Artificial Sequence
  derived and/or modified CDS sequence (opt1) from DENV-2__FJ024473__SS-prME
accgccggcgugaucgucaugcugauccccaccgccauggcguuccaccucaccacccgcaacggggagccgcacaugaucgugggccggcaggagaaggggaagucccugcuguucaagaccgaggacggcgugaacaugugcacccucauggccaucgaccugggggagcugugcgaggacaccaucaccuacaagugcccccuccugcggcagaacgagcccgaggacaucgacugcuggugcaacagcaccagcaccugggucaccuacgggaccugcaccaccacgggcgagcaccggcgcgagaagcgguccguggcccuggugccccacgucgggaugggccucgagacccgcaccgagaccuggaugagcuccgagggggccuggaagcacgugcagcggaucgagaccuggauccugcgccacccgggcuucaccaucauggccgcgauccuggccuacaccaucgggaccacccacuuccagcgggcccucaucuucauccugcugaccgccguggcgcccagcaugaccaugcgcugcaucggcaccuccaaccgggacuucgucgagggcgugagcgggggcuccuggguggacaucguccucgagcacgggagcugcgugaccaccauggccaagaacaagcccacccuggacuucgagcugaucaagaccgaggccaagcagcccgccacccuccgcaaguacugcaucgaggccaagcugaccaacaccaccacggagucccggugcccgacccagggcgagcccagccugaacgaggagcaggacaagcgcuucaucugcaagcacuccaugguggaccggggcugggggaacggcugcgggcuguucggcaagggcgggaucgugaccugcgcgauguucacgugcaagaagaacauggagggcaagguggugcagcccgagaaccuggaguacacgaucgucaucacgccccacagcggggaggagcacgccgugggcgacgacaccgggaagcacggcaaggagaucaagaucaccccgcaguccagcaucaccgaggccgagcugacgggguacggcaccgugaccauggagugcagcccccggaccggccucgacuucaacgagaugguccugcugcagauggaggacaaggccuggcucgugcaccggcagugguuccuggaccugccccuccccuggcugccgggggccgacacgcagggcagcaacuggauccagaaggagacccuggugaccuucaagaacccccacgcgaagaagcaggacgucgugguccucgggucccaggagggcgccaugcacaccgcccugacgggggccaccgagauccagaugagcagcggcaaccuccuguucaccggccaccugaagugccgccugcggauggacaagcuccagcugaaggggauguccuacagcaugugcaccggcaaguucaagaucgugaaggagaucgccgagacgcagcacgggaccaucgugauccgcguccaguacgagggcgacggcucccccugcaagauccccuucgagaucaccgaccuggagaagcggcacgugcucgggcgccugaucaccgugaacccgaucgucaucgagaaggacagccccgugaacaucgaggcggagccgcccuucggcgacuccuacaucaucaucgggguggagccgggccagcugaagcucaacugguucaagaaggggagcuccaucggccagauguucgagacgaccaugcgcggcgccaagcggauggccauccugggggacaccgccugggacuucggcagccucggcggggucuucaccuccaucgggaaggcccuccaccagguguucggggcgaucuacggcgccgccuucagcgggguguccuggacgaugaagauccugaucggcgucgugaucaccuggaucgggaugaacagccgcuccaccagccuguccgugagccugguccucgugggcguggucacccuguaccugggggccauggugcaggcggacuccggcugcguggucagcuggaagaacaaggagcucaagugcggcuccgggaucuucaucacggacaacgugcacaccuggaccgagcaguacaaguuccagcccgagagccccagcaagcuggccuccgccauccagaaggcccacgaggagggcaucugcgggauccggagcgugacccgccuggagaaccucauguggaagcagaucacgcccgagcugaaccacauccuguccgagaacgaggucaagcucaccaucaugaccggcgacaccaaggggaucaugcaggccggcaagcgguaccugcgcccgcagcccacggagcugaaguacagcuggaagaccuggggcaaggcgaagaugcucuccaccgagagccacaaccagaccuuccugaucgacgggcccgagacggccgagugcccgaacaccaaccgggccuggaacucccuggagguggaggacuacggcuucgggguguucaccaccaacaucuggcucaagcugcgcgagaagcaggacgucuucugcgacagcaagcugauguccgccgccaucaaggacaaccgggcggugcacgccgacaugggcuacuggaucgagagcgcccucaacgacaccuggaagauggagaaggccuccuucaucgaggucaagagcugccacuggcccaagucccacacgcuguggagcaacggcgugcuggaguccgagaugaucauccccaagaacuucgccgggcccgugagccagcacaacuaccgcccgggcuaccacacccagaccgcggggcccuggcaccucggcaagcuggagauggacuucgacuucugcgaggggaccacgguggucgugaccgaggacugcggcaaccggggccccucccugcgcaccaccacggccagcgggaagcucaucaccgaguggugcugccggagcugcacccugcccccgcugcgcuaccggggcgaggacgggugcugguacggcauggagauccgcccccucaaggagaaggaggagaaccuggugaacucccuggucaccgccgggcacggccagaucgacaacuucagccucggcgugcuggggauggcccuguuccucgaggagaugcugcggacgcgcgugggcaccaagcacgcgauccugcucgucgccguguccuucgugacccugaucaccgggaacaugagcuuccgggaccugggccgcgucauggugauggugggggccacgaugaccgacgacaucggcaugggcgucaccuaccucgcccugcuggccgcguucaaggugcgccccaccuucgccgccgggcuccugcugcggaagcucacguccaaggagcugaugauggccaccaucggcaucacccugcucagccaguccaccauccccgagacgauccuggagcugaccgacgcccucgcgcuggggaugauggugcugaagaucguccgcaacauggagaaguaccagcucgccgugaccaucauggccaucagcugcgugccgaacgccgucauccugcggaacgccuggaagguguccugcaccauccuggcggccgucagcgugagcccccugcugcugacgagcucccagcagaaggccgacuggaucccccucgcccugaccaucaagggccugaaccccaccgcgaucuuccucaccacgcugagccgcaccuccaagaagcggagcuggccgcugaacgaggccaucauggccgugggcauggucuccauccucgccagcucccugcugaagaacgacauccccaugaccgggccccucguggccggcgggcugcugaccgugugcuacguccucacgggccgcagcgcggaccuggagcuggagcgggccgccgacgugaagugggaggaccaggccgagaucagcggguccagccccauccucuccaucaccaucagcgaggacggcuccaugagcaucaagaacgaggaggaggagaccacccugaccauccugauccgcacgggccuccuggugaucuccggggucuucccggugagcauccccaucaccgccgcggccugguaccugugggaggugaagaagcagcgggccggcguccucugggacgugcccagcccgccccugguggggaaggccgagcuggaggacggcgccuaccgcaucaagcagcgggggauccucggcuacagccagaucggcgcgggggucuacaaggagggcaccuuccacaccauguggcacgugacgcgcggggccgugcugaugcaccggggcaagcgcaucgagcccuccugggccgacgucaagaaggaccugaucagcuacgggggcggcuggaagcucgagggggaguggaaggagggcgaggagguccaggugcuggcccuggagcccgggaagaacccccgggccguccagaccaagcccggcaucuucaagaccaacaccgggacgaucggcgcggugucccucgacuucagccccggcaccuccgggagccccaucguggaccgcaagggcaaggucguggggcuguacggcaacggcguggucacccgguccggggccuacgugagcgccaucgcccagaccgagaaguccaucgaggacaacccggagaucgaggacgacaucuuccgcaagaagcggcugacgaucauggaccuccaccccggcgcggggaagaccaagcgcuaccugcccgccaucgugcgggaggccaucaagcgcggccugcgcacccugauccucgcccccacccgggucguggccgcggagauggaggaggcccugcgcgggcugccgauccgguaccagacgcccgccaucaaggccgagcacaccggccgcgagaucguggaccucaugugccacgccaccuucaccaugcggcugcugagccccguccgcgugcccaacuacaaccucaucaucauggacgaggcgcacuucacggacccggccagcaucgccgcccggggcuacaucuccacccgcguggagaugggggaggccgcgggcaucuucaugaccgccacgccgcccgggagccgggaccccuucccgcaguccaacgcccccaucauggacgaggagcgcgagauccccgagcggagcuggaacuccggccacgagugggucacggacuucaaggggaagaccgugugguucgugcccagcaucaaggccggcaacgacaucgcggccugccugcgcaagaacggcaagaaggucauccagcugucccggaagaccuucgacagcgaguacgugaagacccgcgccaacgacugggacuucguggucacgaccgacaucuccgagaugggggccaacuucaaggccgagcgggugaucgacccgcgccggugcaugaagcccgugauccucaccgacggcgaggagcgcgucauccuggcggggcccaugcccgugacccacagcuccgccgcccagcggcgcggccgcaucgggcggaacccgaagaacgagaacgaccaguacaucuacaugggcgagccccuggagaacgacgaggacugcgcccacuggaaggaggccaagaugcuccuggacaacaucaacacgcccgagggcaucauccccagcauguucgagccggagcgcgagaagguggacgcggucgacggggaguaccggcugcgcggcgaggcccggaagaccuucguggaccucaugcgccgcggggaccugcccguguggcuggccuacaaggucgccgccgagggcaucaacuacgcggaccgcaaguggugcuucgacgggaucaagaacaaccagauccucgaggagaacguggaggucgagaucuggaccaaggagggcgagcggaagaagcugaagccccgcuggcuggacgcccggaucuacuccgacccgcucgcccugaaggaguucaaggaguucgccgcgggccgcaagagccugacccucaaccugaucacggagauggggcggcugcccaccuucaugacccagaaggcccgcaacgcccucgacaaccuggccgugcugcacaccgccgaggcgggcgggcgggccuacaaccacgcccucuccgagcugcccgagacgcuggagacccuccugcugcucacccugcuggccaccgugaccggcggcaucuuccucuuccugaugagcgggaagggcaucgggaagaugacgcugggcaugugcugcaucaucaccgccuccguccuccugugguacgcgcagauccagccccacuggaucgccgccagcaucauccuggaguucuuccucaucgugcugcugaucccggagcccgagaagcagcgcacgccccaggacaaccagcucaccuacguggucaucgccauccugacggugguggccgcgaccauggccaacgagaugggguuccuggagaagaccaagaaggaccucggccugggcuccaucaccacgcaggagagcgagagcaacauccuggacaucgaccuccggcccgccuccgccuggacccuguacgccgucgcgaccaccuucgugacgccgaugcugcgccacagcaucgagaacuccagcgugaacgucucccucaccgccaucgccaaccaggccaccgugcugauggggcugggcaagggguggccccucagcaagauggacaucggcgugccccugcuggcgaucgggugcuacucccaggucaaccccaucacccucacggccgcccugcugcuccugguggcccacuacgccaucaucggcccgggccugcaggcgaaggccacccgggaggcccagaagcgcgccgccgcggggaucaugaagaaccccaccguggacggcaucaccgucaucgaccucgagcccauccccuacgacccgaaguucgagaagcagcugggccaggugaugcugcucauccugugcgugacgcagguccugaugaugcggaccaccugggcccucugcgaggcccugacccuggccacgggccccaucagcacccucugggaggggaaccccggccgcuucuggaacaccaccaucgccguguccauggcgaacaucuuccgcggcagcuaccuggccggggccggccuccucuucuccaucaugaagaacacgaccaacacccggcgcgggaccggcaacaucggcgagacgcugggggagaaguggaagucccggcugaacgcccucggcaaguccgaguuccagaucuacaagaaguccgggauccaggagguggaccgcacccuggcgaaggagggcaucaagcgcggggagaccgaccaccacgccgucucccgcggcagcgccaagcugcggugguucguggagcgcaacauggugacccccgagggcaaggucguggaccucgggugcggccgcggcgggugguccuacuacugcggcgggcugaagaacgugcgcgaggucaaggggcugacgaagggcgggccggggcacgaggagcccauccccaugagcaccuacggcuggaaccucgugcggcugcaguccgggguggacgucuucuucacgccgcccgagaagugcgacacccugcucugcgacaucggcgagagcagccccaaccccaccaucgaggccggccgcacgcugcgggugcugaaccucguggagaacuggcugaacaacaacacccaguucugcaucaagguccugaaccccuacaugcccuccgugaucgagaagauggagacccuccagcgcaaguacgggggcgcccuggugcggaacccccugagccgcaacuccacccacgagauguacugggucagcaacgcgacggggaacaucguguccagcgugaacaugaucucccggaugcugaucaaccgcuucaccaugaagcacaagaaggccaccuacgaggccgacgucgaccucggcagcgggacccggaacaucggcaucgaguccgagauccccaaccuggacaucaucggcaagcgcaucgagaagaucaagcaggagcacgagacgagcuggcacuacgaccaggaccacccguacaagaccugggccuaccacggguccuacgagaccaagcagaccggcagcgccuccagcauggugaacggggugguccgccugcucacgaagcccugggacguggugcccauggucacccagauggcgaugaccgacaccacgcccuucggccagcagcggguguucaaggagaagguggacacccgcacccaggagccgaaggagggcaccaagaagcugaugcggaucacggccgaguggcuguggaaggagcucgggaagaagaagacgccccggaugugcacccgggaggaguucacccgcaagguccgguccaacgccgcccugggcgccaucuucacggacgagaacaaguggaaguccgcgcgcgaggccguggaggacgggcgguucugggagcuggucgaccgcgagcggaaccuccaccuggagggcaagugcgagaccugcguguacaacaugauggggaagcgcgagaagaagcugggcgaguucggcaaggccaaggggucccgggccaucugguacauguggcucggcgcgcgcuuccuggaguucgaggcccugggguuccucaacgaggaccacugguucagccggggcaacucccugagcgggguggagggcgagggccugcaccgccucggguacauccugcgggacgucggcaagaaggagggcggcgccauguacgccgacgacaccgccgggugggacacccgcaucacgcuggaggaccucaagaacgaggagauggugaccaaccacaugaagggcgagcacaagaagcuggcggaggccaucuucaagcugaccuaccagaacaaggugguccgggugcagcgccccacgccccggggcacggugauggacaucaucagccgccgcgaccagcggggguccggccaggucgggaccuacggccucaacaccuucaccaacauggaggcccagcugauccgccagauggagggcgaggggaucuucaagagcauccagcaccugacggccaccgaggagaucgccgcgcagaacuggcucgcccgggugggccgcgagcggcugucccgcauggccaucagcggggacgacugcguggucaagccgaucgacgaccgguucgccuccgcccugaccgcgcucaacgacaugggcaaggugcgcaaggacauccagcagugggagcccagccggggguggaacgacuggacccaggugcccuucugcucccaccacuuccacgagcuggucaugaaggacggccgcgugcuggugguccccugccggaaccaggacgagcucaucggccgcgcccggaucagccagggggccggcuggucccugaaggagaccgccugccugggcaagagcuacgcccagauguggacgcucauguacuuccaccgccgggaccugcgccuggcggccaacgccaucugcuccgccgugccgagccacugggugcccaccucccggaccaccuggagcauccacgcgaagcacgaguggaugacgaccgaggacaugcucgccgucuggaaccgcguguggauccaggagaaccccuggauggaggacaagacccccguggaguccugggaggaggucccguaccugggcaagcgggaggaccaguggugcgggagccugaucggccucaccucccgcgccacgugggccaagaacauccagaccgccaucaaccaggugcgcagccugaucggcaacgaggaguacaccgacuacaugcccagcaugaagcgguuccgccgggaggaggaggaggcgggggugcugugguga

SEQ ID NO: 9113 - RNA, 9876 nt, Artificial Sequence
  derived and/or modified CDS sequence (opt1) from DENV-2__FJ024474__SS-prME
accgccggcgugaucgucaugcugauccccaccgccauggcguuccaccucaccacccgcaacggggagccccacaugaucgugggccggcaggagaaggggaagucccugcuguucaagaccgaggacggcgugaacaugugcacccucauggccaucgaccugggggagcugugcgaggacaccaucaccuacaagugcccccuccugaagcagaacgagcccgaggacaucgacugcuggugcaacagcaccagcaccugggucaccuacgggaccugcaccaccacgggcgagcaccgccgggagaagcgcuccguggcccuggugccccacgucgggaugggccucgagacccggaccgagaccuggaugagcagcgagggggccuggaagcacgugcagcgcaucgagaccuggauccugcggcacccgggcuucaccaucauggccgcgauccuggccuacaccaucgggaccacgcacuuccagcgcgcccucaucuucauccugcugaccgccguggcgcccagcaugaccaugcggugcaucggcaucuccaaccgcgacuucgucgagggcgugagcgggggcuccuggguggacaucguccucgagcacgggagcugcgugaccacgauggccaagaacaagcccacccuggacuucgagcugaucaagaccgaggccaagcagcccgccacccuccggaaguacugcaucgaggccaagcugacgaacaccaccaccgagucccgcugcccgacgcagggcgagcccagccugaacgaggagcaggacaagcgguucaucugcaagcacuccaugguggaccgcggcugggggaacggcugcgggcuguucggcaagggcgggaucgugaccugcgcgauguucacgugcaagaagaacauggagggcaagguggugcagcccgagaaccuggaguacaccaucgucaucacgccccacagcggggaggagcacgccgugggcaacgacaucgggaagcacggcaaggagaucaagaucaccccgcaguccagcaucaccgaggccgagcugaccggguacggcaccgugacgauggagugcagcccccggaccggccucgacuucaacgagaugguccugcugcagauggaggacaaggccuggcucgugcaccgccagugguuccuggaccugccccuccccuggcugccgggggccgacacccagggcagcaacuggauccagaaggagacccuggugacguucaagaacccccacgcgaagaagcaggacgucgugguccucgggucccaggagggcgccaugcacaccgcccugaccggggccaccgagauccagaugagcagcggcaaccuccuguucacgggccaccugaagugccggcugcgcauggacaagcuccagcugaaggggauguccuacagcaugugcaccggcaaguucaagaucgugaaggagaucgccgagacccagcacgggaccaucgugauccggguccaguacgagggcgacggcucccccugcaagauccccuucgagaucacggaccuggagaagcgccacgugcucgggcggcugaucaccgugaacccgaucgucaucgagaaggacagccccgugaacaucgaggcggagccgcccuucggcgacuccuacaucaucaucgggguggagccgggccagcugaagcucaacugguucaagaaggggagcuccaucggccagauguucgagaccaccaugcgcggcgccaagcgcauggccauccugggggacacggccugggacuucggcagccucggcggggucuucaccuccaucgggaaggcccuccaccagguguucggggcgaucuacggcgccgccuucagcgggguguccuggaccaugaagauccugaucggcgucgugaucaccuggaucgggaugaacagccgguccacgagccuguccgugagccugguccucgugggcguggucacccuguaccugggggccauggugcaggcggacuccggcugcguggucagcuggaagaacaaggagcucaagugcggcuccgggaucuucaucaccgacaacgugcacaccuggacggagcaguacaaguuccagcccgagagccccagcaagcuggccuccgccauccagaaggcccacgaggagggcaucugcgggauccgcagcgugacccggcuggagaaccucauguggaagcagaucacccccgagcugaaccacauccuguccgagaacgaggucaagcucaccaucaugacgggcgacaccaaggggaucaugcaggccggcaagcgcuaccugcggccgcagcccaccgagcugaaguacagcuggaagaccuggggcaaggcgaagaugcucuccacggagagccacaaccagaccuuccugaucgacgggcccgagaccgccgagugcccgaacaccaaccgcgccuggaacucccuggagguggaggacuacggcuucgggguguucacgaccaacaucuggcucaagcugcgggagaagcaggacgucuucugcgacagcaagcugauguccgccgccaucaaggacaaccgcgcggugcacgccgacaugggcuacuggaucgagagcgcccucaacgacaccuggaagauggagaaggccuccuucaucgaggucaagagcugccacuggcccaagucccacacccuguggagcaacggcgugcuggaguccgagaugaucauccccaagaacuucgccgggcccgugagccagcacaacuaccggccgggcuaccacacccagacggcggggcccuggcaccucggcaagcuggagauggacuucgacuucugcgaggggaccaccguggucgugaccgaggacugcggcaaccgcggccccucccugcggacgaccaccgccagcgggaagcucaucaccgaguggugcugccgcagcugcacgcugcccccgcugcgguaccgcggcgaggacgggugcugguacggcauggagauccggccccucaaggagaaggaggagaaccuggugaacucccuggucaccgccgggcacggccagaucgacaacuucagccucggcgugcuggggauggcccuguuccucgaggagaugcugcgcacccgggugggcaccaagcacgcgauccugcucgucgccguguccuucgugacgcugaucaccgggaacaugagcuuccgcgaccugggccgggucauggugauggugggggccaccaugaccgacgacaucggcaugggcgucacguaccucgcccugcuggccgcguucaaggugcgccccaccuucgccgccgggcuccugcugcgcaagcucaccuccaaggagcugaugauggccaccaucggcaucacgcugcucagccaguccaccauccccgagaccauccuggagcugaccgacgcccucgcgcuggggaugauggugcugaagaucguccggaacauggagaaguaccagcucgccgugacgaucauggccaucagcugcgugccgaacgccgucauccugcgcaacgccuggaagguguccugcaccauccuggcggccgccagcgucagcccccuccugcugaccagcucccagcagaaggccgacuggaucccccucgcgcugaccaucaagggccugaaccccacggccaucuuccucaccacccugagccggaccuccaagaagcgcagcuggccgcugaacgaggccaucauggccgugggcaugguguccauccucgccagcucccugcugaagaacgacauccccaugacggggccccucgucgcgggcgggcugcugaccgugugcuacgugcucaccggccggagcgccgaccuggagcuggagcgcgccgccgacgucaagugggaggaccaggccgagaucagcggguccagccccauccucuccaucaccaucagcgaggacggcuccaugagcaucaagaacgaggaggaggagcagauccugacgauccugauccggaccggccuccuggugaucuccgggguguucccggucagcauccccaucaccgcggccgccugguaccugugggaggugaagaagcagcgcgccggcgugcucugggacguccccagcccgccgcccguggggaaggccgagcuggaggacggcgcguaccggaucaagcagcgcgggauccugggcuacagccagaucggcgccgggguguacaaggagggcaccuuccacaccauguggcacgucacgcgcggggccgugcucaugcaccgcggcaagcggaucgagcccuccugggccgacgugaagaaggaccugaucagcuacgggggcggcuggaagcuggagggggaguggaaggagggcgaggagguccaggugcucgcccuggagcccgggaagaacccccgcgcggugcagaccaagcccggcaucuucaagaccaacaccgggacgaucggcgccgucucccuggacuucagccccggcaccuccgggagccccaucguggaccggaagggcaagguggucgggcucuacggcaacggcguggugacccgcuccggggccuacgucagcgccaucgcgcagaccgagaaguccaucgaggacaaccccgagaucgaggacgacaucuuccggaagaagcgccugacgaucauggaccugcaccccggcgccgggaagaccaagcgguaccuccccgccaucgugcgcgaggccaucaagcggggccugcgcacccugauccuggccccgacccgcguggucgcggccgagauggaggaggcccuccgggggcugcccauccgcuaccagacgcccgccaucaaggccgagcacaccggccgggagaucguggaccugaugugccacgcgaccuucaccaugcgccuccugagccccgugcgggucccgaacuacaaccugaucaucauggacgaggcccacuucacggaccccgccagcaucgccgcccgcggcuacaucuccacccggguggagaugggggaggcggccggcaucuucaugaccgccacgccgcccgggagccgcgacccguucccccaguccaacgcccccaucauggacgaggagcgggagauccccgagcgcagcuggaacuccggccacgagugggugacggacuucaaggggaagaccgucugguucgugccgagcaucaaggcgggcaacgacaucgccgccugccuccggaagaacggcaagaaggugauccagcugucccgcaagaccuucgacagcgaguacgucaagacccgggccaacgacugggacuucguggugacgaccgacaucuccgagaugggggccaacuucaaggcggagcgcgucaucgacccccggcgcugcaugaagcccgugauccugacccacggcgaggagcgggugauccucgccgggcccaugccggucacccacagcuccgccgcccagcgccggggccgcaucgggcgcaaccccaagaacgagaacgaccaguacaucuacaugggcgagccccuggagaacgacgaggacugcgcccacuggaaggaggcgaagaugcugcucgacaacaucaacacgcccgagggcaucaucccgagcauguucgagcccgagcgggagaagguggacgccguggacggggaguaccgccugcggggcgaggcccgcaagaccuucgucgaccugaugcggcgcggggaccuccccguguggcuggccuacaagguggccgcggagggcaucaacuacgccgaccggaaguggugcuucgacgggaucaagaacaaccagauccuggaggagaacgucgagguggagaucuggaccaaggagggcgagcgcaagaagcucaagccgcgguggcuggacgcccgcaucuacuccgacccccuggcccucaaggaguucaaggaguucgcggccggccggaagucccugacccugaaccucaucacggagauggggcgccugcccaccuucaugacccagaaggcccggaacgcccuggacaaccucgccguccugcacaccgcggaggccggcgggcgcgccuacaaccacgcccuguccgagcuccccgagacgcuggagacccugcuccugcugacccuccuggccaccgugacgggcggcaucuuccuguuccucaugagcgggaagggcaucgggaagaugacccugggcaugugcugcaucaucaccgcguccgugcugcucugguacgcccagauccagccgcacuggaucgccgccagcaucauccuggaguucuuccugaucguccuccugauccccgagcccgagaagcagcggacgccccaggacaaccagcugaccuacguggugaucgccauccucacggucguggcggccaccauggccaacgagaugggguuccuggagaagaccaagaaggaccugggccucggcuccaucaccacgcaggagagcgagagcaacauccuggacaucgaccugcgcccggccuccgccuggacccucuacgcgguggccaccaccuucgucacgcccaugcugcggcacagcaucgagaacuccagcgugaacgugucccugaccgccaucgccaaccaggcgaccguccucauggggcugggcaagggguggccccugagcaagauggacaucggcgugccccuccuggccaucgggugcuacucccaggugaacccgaucacccugacggccgcccuccugcugcucgucgcccacuacgcgaucaucggccccggccugcaggccaaggccacccgcgaggcccagaagcgggccgcggccgggaucaugaagaaccccaccguggacggcaucaccgugaucgaccuggagcccaucccguacgaccccaaguucgagaagcagcucgggcaggucaugcugcugauccucugcgugacccagguccugaugaugcgcaccaccugggcccugugcgaggcccucacccuggccacgggccccaucagcacccugugggaggggaaccccggccgguucuggaacaccaccaucgcggucuccauggccaacaucuuccgcggcagcuaccucgccggggccggccugcuguucuccaucaugaagaacacgaccaacacccgccgggggaccggcaacaucggcgagacgcucggggagaaguggaagucccgccugaacgcgcugggcaaguccgaguuccagaucuacaagaaguccgggauccaggagguggaccggacccucgccaaggagggcaucaagcgcggggagaccgaccaccacgccgugucccggggcagcgccaagcugcgcugguucgucgagcggaacauggugaccccggagggcaagguggucgaccuggggugcggccgcgggggcugguccuacuacugcgggggccucaagaacgugcgggaggugaagggccugacgaagggcgggcccgggcacgaggagcccauccccaugagcaccuacggcuggaaccugguccgccuccaguccgggguggacguguucuucaccccgcccgagaagugcgacacccugcugugcgacaucggcgagagcagccccaaccccacgaucgaggccggccggacccuccgcguccugaaccugguggagaacuggcucaacaacaacacccaguucugcaucaaggugcugaacccguacaugcccuccgucaucgagaagauggagacccugcagcggaaguacgggggcgcgcucgugcgcaacccccugagccggaacuccacccacgagauguacugggugagcaacgccacggggaacaucgucuccagcgugaacaugaucucccgcaugcugaucaaccgguucaccaugaagcacaagaaggccaccuacgagccggacguggaccugggcagcgggacccgcaacaucggcaucgaguccgagauccccaaccucgacaucaucggcaagcggaucgagaagaucaagcaggagcacgagacgagcuggcacuacgaccaggaccaccccuacaagaccugggccuaccacggguccuacgagaccaagcagaccggcagcgccuccagcauggucaacgggguggugcgccugcugacgaagcccugggacgucgugccgauggugacccagauggcgaugaccgacaccacgcccuucggccagcagcgcgucuucaaggagaagguggacacccggacccaggagcccaaggagggcaccaagaagcucaugcgcaucacggccgaguggcuguggaaggagcuggggaagaagaagacgccccggaugugcacccgcgaggaguucacccggaaggugcgcuccaacgccgcccucggcgccaucuucacggacgagaacaaguggaaguccgcgcgggaggccgucgaggacgggcgcuucugggagcugguggaccgggagcgcaaccugcaccucgagggcaagugcgagaccugcgucuacaacaugauggggaagcgggagaagaagcugggcgaguucggcaaggccaaggggucccgcgccaucugguacauguggcugggcgcgcgguuccucgaguucgaggcccugggguuccugaacgaggaccacugguucagccgcggcaacucccucagcgggguggagggcgagggccugcaccggcugggguacauccuccgcgacgugggcaagaaggagggcggcgccauguacgccgacgacaccgccgggugggacacccggaucacgcuggaggaccugaagaacgaggagauggucaccaaccacaugaagggcgagcacaagaagcucgcggaggccaucuucaagcugaccuaccagaacaagguggugcgcguccagcggccgacgccccggggcacggugauggacaucaucagccggcgcgaccagcgcggguccggccagguggggaccuacggccugaacaccuucaccaacauggaggcccagcucauccggcagauggagggcgaggggaucuucaagagcauccagcaccugacggccaccgaggagaucgccgcgcagaacuggcuggcccgcgucggccgggagcgccucucccggauggccaucagcggggacgacugcguggugaagcccaucgacgaccgcuucgccuccgcccugaccgcgcugaacgacaugggcaagguccggaaggacauccagcagugggagcccagccgcggguggaacgacuggacccaggugccguucugcucccaccacuuccacgagcucgugaugaaggacggccggguccugguggugcccugccgcaaccaggacgagcugaucggccgggcccgcaucagccagggggccggcuggucccucaaggagacggccugccugggcaagagcuacgcccagauguggacccugauguacuuccaccggcgcgaccuccggcuggcggccaacgccaucugcuccgccguccccagccacugggugcccaccucccgcaccaccuggagcauccacgcgaagcacgaguggaugacgaccgaggacaugcuggccguguggaaccgggucuggauccaggagaacccguggauggaggacaagacccccguggaguccugggaggaggugcccuaccucggcaagcgcgaggaccaguggugcgggagccugaucggccugaccucccgggccacgugggccaagaacauccagaccgccaucaaccagguccgcagccucaucggcaacgaggaguacaccgacuacaugcccagcaugaagcgcuuccggcgcgaggaggaggaggcgggggugcugugguga

SEQ ID NO: 9114 - RNA, 9876 nt, Artificial Sequence
  derived and/or modified CDS sequence (opt1) from DENV-2__FJ024475__SS-prME
accgccggcgugaucgucaugcugauccccaccgccauggcguuccaccucaccacccggaacggggagccccacaugaucgugggccggcaggagaaggggaagucccugcuguucaagaccgaggacggcgugaacaugugcacccucauggccaucgaccugggggagcugugcgaggacaccaucaccuacaagugcccccuccugcgccagaacgagcccgaggacaucgacugcuggugcaacagcaccagcaccugggucaccuacgggaccugcaccaccacgggcgagcaccggcgcgagaagcgguccguggcccuggugccccacgucgggaugggccucgagacccggaccgagaccuggaugagcuccgagggggccuggaagcacgugcagcggaucgagaccuggauccugcgccacccgggcuucaccaucauggccgcgauccuggccuacaccaucgggaccacgcacuuccagcgggcccucaucuucauccugcugaccgccguggcgcccagcaugaccaugcgcugcaucggcaucuccaaccgggacuucgucgagggcgugagcgggggcuccuggguggacaucguccucgagcacgggagcugcgugaccacgauggccaagaacaagcccacccuggacuucgagcugaucaagaccgaggccaagcagcccgccacccuccgcaaguacugcaucgaggccaagcugacgaacaccaccaccgagucccggugcccgacgcagggcgagcccagccugaacgaggagcaggacaagcgcuucaucugcaagcacuccaugguggaccggggcugggggaacggcugcgggcuguucggcaagggcgggaucgugaccugcgcgauguucacgugcaagaagaacauggagggcaagguggugcagcccgagaaccuggaguacaccaucgucaucacgccccacagcggggaggagcacgccgugggcgacgacaccgggaagcacggcaaggagaucaagaucaccccgcaguccagcaucaccgaggccgagcugaccggguacggcacggugaccauggagugcagcccccggaccggccucgacuucaacgagaugguccugcugcagauggaggacaaggccuggcucgugcaccggcagugguuccuggaccugccccuccccuggcugccgggggccgacacccagggcagcaacuggauccagaaggagacgcuggugaccuucaagaacccccacgcgaagaagcaggacgucgugguccucgggucccaggagggcgccaugcacaccgcccugaccggggccacggagauccagaugagcagcggcaaccuccuguucaccggccaccugaagugccgccugcggauggacaagcuccagcugaaggggauguccuacagcaugugcaccggcaaguucaagaucgugaaggagaucgccgagacccagcacgggacgaucgugauccgcguccaguacgagggcgacggcucccccugcaagauccccuucgagaucaccgaccuggagaagcggcacgugcucgggcgccugaucaccgugaacccgaucgucaucgagaaggacagccccgugaacaucgaggcggagccgcccuucggcgacuccuacaucaucaucgggguggagccgggccagcugaagcucaacugguucaagaaggggagcuccaucggccagauguucgagaccacgaugcgcggcgccaagcggauggccauccugggggacaccgccugggacuucggcagccucggcggggucuucaccuccaucgggaaggcccuccaccagguguucggggcgaucuacggcgccgccuucagcgggguguccuggaccaugaagauccugaucggcgucgugaucacguggaucgggaugaacagccgcuccaccagccuguccgugagccugguccucgugggcguggucacccuguaccugggggccauggugcaggcggacuccggcugcguggucagcuggaagaacaaggagcucaagugcggcuccgggaucuucaucaccgacaacgugcacacguggaccgagcaguacaaguuccagcccgagagccccagcaagcuggccuccgccauccagaaggcccacgaggagggcaucugcgggauccggagcgugacccgccuggagaaccucauguggaagcagaucacccccgagcugaaccacauccuguccgagaacgaggucaagcucacgaucaugaccggcgacaccaaggggaucaugcaggccggcaagcgguaccugcgcccgcagcccaccgagcugaaguacagcuggaagacguggggcaaggcgaagaugcucuccaccgagagccacaaccagaccuuccugaucgacgggcccgagaccgccgagugcccgaacacgaaccgggccuggaacucccuggagguggaggacuacggcuucgggguguucaccaccaacaucuggcucaagcugcgcgagaagcaggacgucuucugcgacagcaagcugauguccgccgccaucaaggacaaccgggcggugcacgccgacaugggcuacuggaucgagagcgcccucaacgacaccuggaagauggagaaggccuccuucaucgaggucaagagcugccacuggcccaagucccacacccuguggagcaacggcgugcuggaguccgagaugaucauccccaagaacuucgccgggcccgugagccagcacaacuaccgcccgggcuaccacacgcagaccgcggggcccuggcaccucggcaagcuggagauggacuucgacuucugcgaggggaccaccguggucgugacggaggacugcggcaaccggggccccucccugcgcaccaccaccgccagcgggaagcucaucacggaguggugcugccggagcugcacccugcccccgcugcgcuaccggggcgaggacgggugcugguacggcauggagauccgcccccucaaggagaaggaggagaaccuggugaacucccuggucaccgccgggcacggccagaucgacaacuucagccucggcgugcuggggauggcccuguuccucgaggagaugcugcggacccgcgugggcacgaagcacgcgauccugcucgucgccguguccuucgugacccugaucaccgggaacaugagcuuccgggaccugggccgcgucauggugauggugggggccaccaugacggacgacaucggcaugggcgucaccuaccucgcccugcuggccgcguucaaggugcgccccaccuucgccgccgggcuccugcugcggaagcucaccuccaaggagcugaugauggccacgaucggcaucacccugcucagccaguccaccauccccgagaccauccuggagcugacggacgcccucgcgcuggggaugauggugcugaagaucguccgcaacauggagaaguaccagcucgccgugaccaucauggccaucagcugcgugccgaacgccgucauccugcggaacgccuggaagguguccugcaccauccuggcggccgucagcgugagcccccuccugcugaccagcucccagcagaaggccgacuggaucccccucgcccugacgaucaagggccugaaccccaccgcgaucuuccucaccacccugagccgcacguccaagaagcggagcuggccgcugaacgaggccaucauggccgugggcauggucuccauccucgccagcucccugcugaagaacgacauccccaugaccgggccccucguggccggcgggcugcugaccgugugcuacguccucaccggccgcagcgcggaccuggagcuggagcgggccgccgacgugaagugggaggaccaggccgagaucagcggguccagccccauccucuccaucacgaucagcgaggacggcuccaugagcaucaagaacgaggaggaggagaccacccugaccauccugauccgcaccggccuccuggugaucuccggggucuucccggugagcauccccaucacggccgcggccugguaccugugggaggugaagaagcagcgggccggcguccucugggacgugcccagcccgccgcccguggggaaggccgagcuggaggacggcgccuaccgcaucaagcagcgggggauccugggcuacagccagaucggcgcgggggucuacaaggagggcaccuuccacaccauguggcacgugacccgcggggccgugcucaugcaccggggcaagcgcaucgagcccuccugggccgacgucaagaaggaccugaucagcuacgggggcggcuggaagcuggagggggaguggaaggagggcgaggagguccaggugcucgcccuggagcccgggaagaacccccgggccguccagacgaagcccggcaucuucaagaccaacaccgggaccaucggcgcggugucccuggacuucagccccggcacguccgggagccccaucguggaccgcaagggcaaggucguggggcucuacggcaacggcguggucacccgguccggggccuacgugagcgccaucgcccagaccgagaaguccaucgaggacaaccccgagaucgaggacgacaucuuccgcaagaagcggcugaccaucauggaccugcaccccggcgcggggaagacgaagcgcuaccuccccgccaucgugcgggaggccaucaagcgcggccugcgcacccugauccuggccccgacccgggucguggccgcggagauggaggaggcccuccgcgggcugcccauccgguaccagacccccgccaucaaggccgagcacacgggccgcgagaucguggaccugaugugccacgccaccuucaccaugcggcuccugagccccguccgcgugccgaacuacaaccugaucaucauggacgaggcgcacuucaccgaccccgccagcaucgccgcccggggcuacaucuccacgcgcguggagaugggggaggccgcgggcaucuucaugaccgccacgccgcccgggagccgggacccguucccccaguccaacgcccccaucauggacgaggagcgcgagauccccgagcggagcuggaacuccggccacgagugggucaccgacuucaaggggaagacggugugguucgugccgagcaucaaggccggcaacgacaucgcggccugccuccgcaagaacggcaagaaggucauccagcugucccggaagaccuucgacagcgaguacgugaagacccgcgccaacgacugggacuucguggucaccacggacaucuccgagaugggggccaacuucaaggccgagcgggugaucgacccccgccggugcaugaagcccgugauccugaccgacggcgaggagcgcgucauccucgcggggcccaugccggugacccacagcuccgccgcccagcggcgcggccgcaucgggcggaaccccaagaacgagaacgaccaguacaucuacaugggcgagccccuggagaacgacgaggacugcgcccacuggaaggaggccaagaugcugcucgacaacaucaacacccccgagggcaucaucccgagcauguucgagcccgagcgcgagaagguggacgcggucgacggggaguaccggcugcgcggcgaggcccggaagacguucguggaccugaugcgccgcggggaccuccccguguggcuggccuacaaggucgccgccgagggcaucaacuacgcggaccgcaaguggugcuucgacgggaucaagaacaaccagauccuggaggagaacguggaggucgagaucuggaccaaggagggcgagcggaagaagcucaagccgcgcuggcuggacgcccggaucuacuccgacccccuggcccucaaggaguucaaggaguucgccgcgggccgcaagagccugacccugaaccucaucaccgagauggggcggcugcccacguucaugacccagaaggcccgcaacgcccuggacaaccucgccgugcugcacaccgccgaggcgggcgggcgggccuacaaccacgcccuguccgagcuccccgagacccuggagacgcugcuccugcugacccuccuggccaccgugaccggcggcaucuuccuguuccucaugagcgggaagggcaucgggaagaugacccugggcaugugcugcaucaucacggccuccguccugcucugguacgcgcagauccagccgcacuggaucgccgccagcaucauccuggaguucuuccugaucgugcuccugauccccgagcccgagaagcagcgcacgccccaggacaaccagcugaccuacguggucaucgccauccucaccgugguggccgcgacgauggccaacgagaugggguuccuggagaagaccaagaaggaccugggccucggcuccaucaccacccaggagagcgagagcaacauccuggacaucgaccugcggccggccuccgccuggacgcucuacgccgucgcgaccaccuucgugacccccaugcugcgccacagcaucgagaacuccagcgugaacgucucccugacggccaucgccaaccaggccaccgugcucauggggcugggcaagggguggccccugagcaagauggacaucggcgugccccuccuggcgaucgggugcuacucccaggucaacccgaugacccugaccgccgcccuccugcugcucguggcccacuacgccaucaucggccccggccugcaggcgaaggccacgcgggaggcccagaagcgcgccgccgcggggaucaugaagaaccccaccguggacggcaucaccgucaucgaccuggagcccaucccguacgaccccaaguucgagaagcagcucggccaggugaugcugcugauccucugcgugacccagguccugaugaugcggacgaccugggcccugugcgaggcccucacccuggccaccggccccaucagcacgcugugggaggggaaccccggccgcuucuggaacaccaccaucgccguguccauggcgaacaucuuccgcggcagcuaccucgccggggccggccugcuguucuccaucaugaagaacaccacgaacacccggcgcgggaccggcaacaucggcgagacccucggggagaaguggaagucccggcugaacgcccugggcaaguccgaguuccagaucuacaagaaguccgggauccaggagguggaccgcacgcucgcgaaggagggcaucaagcgcggggagaccgaccaccacgccgucucccgcggcagcgccaagcugcggugguucguggagcgcaacauggugaccccggagggcaaggucguggaccuggggugcggccgcggcgggugguccuacuacugcggcgggcucaagaacgugcgcgaggucaaggggcugaccaagggcgggcccgggcacgaggagcccauccccaugagcacguacggcuggaaccuggugcggcuccaguccgggguggacgucuucuucaccccgcccgagaagugcgacacccugcugugcgacaucggcgagagcagccccaaccccaccaucgaggccggccgcacccuccgggugcugaaccugguggagaacuggcucaacaacaacacgcaguucugcaucaagguccugaacccguacaugcccuccgugaucgagaagauggagacccugcagcgcaaguacgggggcgcccucgugcggaacccccugagccgcaacuccacccacgagauguacugggucagcaacgcgaccgggaacaucguguccagcgugaacaugaucucccggaugcugaucaaccgcuucacgaugaagcacaagaaggccaccuacgagccggacgucgaccugggcagcgggacccggaacaucggcaucgaguccgagauccccaaccucgacaucaucggcaagcgcaucgagaagaucaagcaggagcacgagaccagcuggcacuacgaccaggaccaccccuacaagacgugggccuaccacggguccuacgagaccaagcagaccggcagcgccuccagcauggugaacggggugguccgccugcugaccaagcccugggacguggugccgauggucacgcagauggccaugaccgacaccacccccuucggccagcagcggguguucaaggagaagguggacacgcgcacccaggagcccaaggagggcaccaagaagcucaugcggaucaccgcggaguggcuguggaaggagcuggggaagaagaagacgccccgcaugugcacccgggaggaguucacccgcaagguccgguccaacgccgcccucggcgccaucuucaccgacgagaacaaguggaaguccgcccgcgaggcgguggaggacgggcgguucugggagcuggucgaccgcgagcggaaccugcaccucgagggcaagugcgagacgugcguguacaacaugauggggaagcgcgagaagaagcugggcgaguucggcaaggccaaggggucccgggccaucugguacauguggcugggcgcccgcuuccucgaguucgaggcgcugggguuccugaacgaggaccacugguucagccggggcaacucccucagcgggguggagggcgagggccugcaccgccugggguacauccuccgggacgucggcaagaaggagggcggcgccauguacgccgacgacaccgccgggugggacacccgcaucacccuggaggaccugaagaacgaggagauggugacgaaccacaugaagggcgagcacaagaagcucgccgaggcgaucuucaagcugaccuaccagaacaaggugguccgggugcagcgcccgacgccccggggcaccgugauggacaucaucagccgccgcgaccagcggggguccggccaggucgggacguacggccugaacaccuucaccaacauggaggcccagcucauccgccagauggagggcgaggggaucuucaagagcauccagcaccugaccgccacggaggagaucgccgcccagaacuggcuggcgcgggugggccgcgagcggcucucccgcauggccaucagcggggacgacugcguggucaagcccaucgacgaccgguucgccuccgcccugaccgcccugaacgacaugggcaaggugcgcaaggacauccagcagugggagcccagccggggguggaacgacuggacccaggugccguucugcucccaccacuuccacgagcucgucaugaaggacggccgcgugcuggugguccccugccggaaccaggacgagcugaucggccgcgcgcggaucagccagggggccggcuggucccucaaggagaccgccugccugggcaagagcuacgcccagauguggacccugauguacuuccaccgccgggaccuccgccuggccgcgaacgccaucugcuccgccgugcccagccacugggugcccacgucccggaccaccuggagcauccacgccaagcacgaguggaugaccacggaggacaugcuggcggucuggaaccgcguguggauccaggagaacccguggauggaggacaagacccccguggaguccugggaggagguccccuaccucggcaagcgggaggaccaguggugcgggagccugaucggccugaccucccgcgccaccugggccaagaacauccagacggccaucaaccaggugcgcagccucaucggcaacgaggaguacaccgacuacaugcccagcaugaagcgguuccgccgggaggaggaggaggccggggugcugugguga

SEQ ID NO: 9115 - RNA, 9867 nt, Artificial Sequence
  derived and/or modified CDS sequence (opt1) from DENV-2__FJ182012__SS-prME
accgcgggcgugaucgucaugcugauccccaccgccauggcguuccaccucaccacccgcaacggggagccccacaugaucgugggccggcaggagaaggggaagucccugcuguucaagaccgaggacggcgugaacaugugcacccucauggccaucgaccugggggagcugugcgaggacaccaucaccuacaagugcccccuccugcgccagaacgagcccgaggacaucgacugcuggugcaacuccaccuccaccugggucaccuacgggaccugcaccaccacgggcgagcaccggcgcgagaagcgguccguggcccuggugccccacgucgggaugggccucgagacccgcaccgagaccuggaugagcuccgagggggccuggaagcacgugcagcggaucgagaccuggauccugcgccacccgggcuucaccaucauggccgcgauccuggccuacaccaucgggaccacgcacuuccagcgggcccucaucuucauccugcugaccgccguggcgcccagcaugaccaugcgcugcaucggcaucuccaaccgggacuucgucgagggcgugagcgggggcuccuggguggacaucguccucgagcacgggagcugcgugaccacgauggccaagaacaagcccacccuggacuucgagcugaucaagaccgaggccaagcagcccgccacccuccgcaaguacugcaucgaggccaagcugacgaacaccaccaccgagucccggugcccgacgcagggcgagcccagccugaacgaggagcaggacaagcgcuucaucugcaagcacuccaugguggaccggggcugggggaacggcugcggccuguucggcaagggcgggaucgugaccugcgcgauguucacgugcaagaagaacauggagggcaagguggugcagcccgagaaccuggaguacaccaucgucaucacgccccacagcggggaggagcacgccgugggcaacgacaacgggaaggagaucaagaucaccccgcaguccagcaucaccgaggccgagcugaccggcuacgggaccgugacgauggagugcagcccccggaccggccucgacuucaacgagaugguccugcugcagauggaggacaaggccuggcucgugcaccggcagugguuccuggaccugccccuccccuggcugccgggcgccgacacccaggggagcaacuggauccagaaggagacccuggugacguucaagaacccccacgcgaagaagcaggacgucgugguccucggcucccaggagggggccaugcacaccgcccugaccggcgccaccgagauccagaugagcagcgggaaccuccucuucacgggccaccugaagugccgccugcggauggacaagcuccagcugaagggcauguccuacagcaugugcaccgggaaguucaagaucgugaaggagaucgccgagacccagcacggcaccaucgugauccgcguccaguacgagggggacggcucccccugcaagauccccuucgagaucacggaccuggagaagcggcacgugcucggccgccugaucaccgugaacccgaucgucaucgagaaggacagccccgugaacaucgaggcggagccgcccuucggggacuccuacaucaucaucggcguggagccggggcagcugaagcucaacugguucaagaagggcagcuccaucgggcagauguucgagaccaccaugcgcggcgccaagcggauggccauccugggcgacacggccugggacuucgggagccugggcggggucuucaccuccaucggcaaggcccuccaccagguguucggggcgaucuacggcgccgccuucagcggcguguccuggaccaugaagauccugaucggggucgugaucaccuggaucggcaugaacagccgcuccacgagccuguccgugagccugguccucguggggguggucacccuguaccugggcgccauggugcaggcggacuccgggugcguggucagcuggaagaacaaggagcucaagugcggcuccggcaucuucaucaccgacaacgugcacaccuggacggagcaguacaaguuccagcccgagagccccagcaagcuggccuccgccauccagaaggcccacgaggaggggaucugcggcauccggagcgugacccgccuggagaaccucauguggaagcagaucacccccgagcugaaccacauccuguccgagaacgaggucaagcucaccaucaugacgggggacaccaagggcaucaugcaggccgggaagcgguaccugcgcccgcagcccaccgagcugaaguacagcuggaagaccuggggcaaggcgaagaugcucuccacggagagccacaaccagaccuuccugaucgacggccccgagaccgccgagugcccgaacaccaaccgggccuggaacucccuggagguggaggacuacggguucggcguguucacgaccaacaucuggcucaagcugcgcgagaagcaggacgucuucugcgacagcaagcugauguccgccgccaucaaggacaaccgggcggugcacgccgacaugggguacuggaucgagagcgcccucaacgacaccuggaagauggagaaggccuccuucaucgaggucaagagcugccacuggcccaagucccacacccuguggagcaacggcgugcuggaguccgagaugaucauccccaagaacuucgccggccccgugagccagcacaacuaccgcccgggguaccacacccagacggcgggccccuggcaccucgggaagcuggagauggacuucgacuucugcgagggcaccaccguggucgugaccgaggacugcgggaaccggggccccucccugcgcacgaccaccgccagcggcaagcucaucaccgaguggugcugccggagcugcacgcugcccccgcugcgcuaccgcggggaggacggcugcugguacgggauggagauccgcccccucaaggagaaggaggagaaccuggugaacucccuggucaccgccggccacgggcagaucgacaacuucagccucggcgugcugggcauggcccuguuccucgaggagaugcugcggacccgcguggggaccaagcacgcgauccugcucgucgccguguccuucgugacgcugaucaccggcaacaugagcuuccgggaccuggggcgcgucauggugauggugggcgccaccaugaccgacgacaucgggaugggcgucacguaccucgcccugcuggccgcguucaaggugcgccccaccuucgccgccggccuccugcugcggaagcucaccuccaaggagcugaugauggccaccaucgggaucacgcugcucagccaguccaccauccccgagaccauccuggagcugaccgacgcccucgcgcugggcaugauggugcugaagaucguccgcaacauggagaaguaccagcucgccgugacgaucauggccaucagcugcgugccgaacgccgucauccugcggaacgccuggaagguguccugcaccauccuggcggccgucagcgugagcccccuccugcugaccagcucccagcagaaggccgacuggaucccccucgcccugaccaucaaggggcugaaccccacggcgaucuuccucaccacccugagccgcaccuccaagaagcggagcuggccgcugaacgaggccaucauggccgugggcauggucuccauccucgccagcucccugcugaagaacgacauccccaugacgggcccccucguggccgggggccugcugaccgugugcuacguccucaccgggcgcagcgcggaccuggagcuggagcgggccgccgacgugaagugggaggaccaggccgagaucagcggcuccagccccauccucuccaucaccaucagcgaggacggguccaugagcaucaagaacgaggaggaggagcagauccugacgauccugauccgcaccggccuccuggugaucuccggcgucuucccggugagcauccccaucaccgccgcggccugguaccugugggaggugaagaagcagcgggccgggguccucugggacgugcccagcccgccgcccgugggcaaggccgagcuggaggacggggccuaccgcaucaagcagcggggcauccugggguacagccagaucggcgcgggcgucuacaaggaggggaccuuccacaccauguggcacgugacgcgcggcgccgugcucaugcaccgggggaagcgcaucgagcccuccugggccgacgucaagaaggaccugaucagcuacggcgggggcuggaagcuggagggcgaguggaaggagggggaggagguccaggugcucgcccuggagcccggcaagaacccccgggccguccagaccaagcccgggaucuucaagaccaacaccggcacgaucggggcggugucccuggacuucagccccggcaccuccggcagccccaucguggaccgcaaggggaaggucgugggccucuacgggaacggcguggucacccgguccggcgccuacgugagcgccaucgcccagaccgagaaguccaucgaggacaaccccgagaucgaggacgacaucuuccgcaagaagcggcugacgaucauggaccugcaccccggggcgggcaagaccaagcgcuaccuccccgccaucgugcgggaggccaucaagcgcgggcugcgcacccugauccuggccccgacccgggucguggccgcggagauggaggaggcccuccgcggccugcccauccgguaccagacgcccgccaucaaggccgagcacaccgggcgcgagaucguggaccugaugugccacgccaccuucaccaugcggcuccugagccccguccgcgugccgaacuacaaccugaucaucauggacgaggcgcacuucacggaccccgccagcaucgccgcccggggcuacaucuccacccgcguggagaugggcgaggccgcggggaucuucaugaccgccacgccgcccggcagccgggacccguucccccaguccaacgcccccaucauggacgaggagcgcgagauccccgagcggagcuggaacuccgggcacgagugggucacggacuucaagggcaagaccgugugguucgugccgagcaucaaggccgggaacgacaucgcggccugccuccgcaagaacggcaagaaggucauccagcugucccggaagaccuucgacagcgaguacgugaagacccgcgccaacgacugggacuucguggucacgaccgacaucuccgagaugggcgccaacuucaaggccgagcgggugaucgacccccgccggugcaugaagcccgugauccugacccacggggaggagcgcgucauccucgcgggccccaugccggugacccacagcuccgccgcccagcggcgcgggcgcaucggccggaaccccaagaacgagaacgaccaguacaucuacaugggggagccccuggagaacgacgaggacugcgcccacuggaaggaggccaagaugcugcucgacaacaucaacacgcccgagggcaucaucccgagcauguucgagcccgagcgcgagaagguggacgcggucgacggcgaguaccggcugcgcggggaggcccggaagaccuucguggaccugaugcgccggggcgaccuccccguguggcuggccuacaaggucgccgccgaggggaucaacuacgcggaccgcaaguggugcuucgacggcaucaagaacaaccagauccuggaggagaacguggaggucgagaucuggaccaaggagggggagcggaagaagcucaagccgcgcuggcuggacgcccggaucuacuccgacccccuggcccucaaggaguucaaggaguucgccgcgggccgcaagagccugacccugaaccucaucacggagaugggccggcugcccaccuucaugacccagaaggcccgcaacgcccuggacaaccucgccgugcugcacaccgccgaggccgggggccgggccuacaaccacgcccuguccgagcuccccgagacgcuggagacccugcuccugcugacccuccuggccaccgugaccgggggcaucuuccuguuccucaugagcggcaaggggaucggcaagaugacccuggggaugugcugcaucaucaccgccuccguccugcucugguacgcgcagauccagccgcacuggaucgccgccagcaucauccuggaguucuuccugaucgugcuccugauccccgagcccgagaagcagcgcacgccccaggacaaccagcugaccuacguggucaucgccauccucacggugguggccgcgaccauggccaacgagaugggcuuccuggagaagaccaagaaggaccuggggcucggcuccaucaccacgcaggagagcgagagcaacauccuggacaucgaccugcggccggccuccgccuggacccucuacgccgucgcgaccaccuucgugacgcccaugcugcgccacagcaucgagaacuccagcgugaacgucucccugaccgccaucgccaaccaggccaccgugcucaugggccuggggaagggcuggccccugagcaagauggacaucggggugccccuccuggcgaucggcugcuacucccaggucaacccgaucacccugacggccgcccuccugagccugguggcccacuacgccaucaucgggcccggccuccaggcgaaggccacccgggaggcccagaagcgcgccgccgcgggcaucaugaagaaccccaccguggacgggaucaccgucaucgaccuggagcccaucccguacgaccccaaguucgagaagcagcugggccaggugaugcuccugauccugugcgugacgcagguccucaugaugcggaccaccugggcccugugcgaggcccugacccucgccacggggcccaucuccacccugugggagggcaaccccgggcgcuucuggaacaccaccaucgccgugagcauggcgaacaucuuccgcggcuccuaccuggccggcgccgggcuccuguucagcaucaugaagaacacgaccaacacccggcgcggcaccgggaacaucggcgagacgcugggcgagaaguggaagucccggcucaacgcccuggggaaguccgaguuccagaucuacaagaaguccggcauccaggagguggaccgcacccuggcgaaggaggggaucaagcggggcgagaccgaccaccacgccgucagccgcggguccgccaagcuccggugguucguggagcgcaacauggugaccccggagggcaaggucguggaccugggcugcgggcggggcggguggagcuacuacugcggcgggcugaagaacgugcgcgaggucaagggccucacgaagggcgggcccggccacgaggagcccauccccauguccaccuacggguggaaccuggugcggcugcagagcggcguggacgucuucuucaccccgcccgagaagugcgacacccuccugugcgacaucggggagagcucccccaaccccacgaucgaggccggccgcacccugcgggugcucaaccugguggagaacuggcugaacaacaacacccaguucugcaucaagguccucaacccguacaugcccagcgugaucgagaagauggagacccugcagcgcaaguacggcggggcccuggugcggaacccccucucccgcaacagcacccacgagauguacugggucuccaacgcgacgggcaacaucgugagcuccgugaacaugaucagccggaugcugaucaaccgcuucaccaugaagcacaagaaggccaccuacgagccggacgucgaccugggguccggcacccggaacaucgggaucgagagcgagauccccaaccuggacaucaucggcaagcgcaucgagaagaucaagcaggagcacgagacguccuggcacuacgaccaggaccaccccuacaagaccugggccuaccacggcagcuacgagaccaagcagaccggguccgccagcuccauggugaacggcgugguccgccuccugacgaagcccugggacguggugccgauggucacccagauggccaugaccgacaccacgcccuucgggcagcagcggguguucaaggagaagguggacacccgcacccaggagcccaaggagggcaccaagaagcugaugcggaucacggcggaguggcucuggaaggagcugggcaagaagaagacgccccgcaugugcacccgggaggaguucacccgcaagguccggagcaacgccgcccugggggccaucuucacggacgagaacaaguggaaguccgcccgcgaggcgguggaggacggccgguucugggagcucgucgaccgcgagcggaaccugcaccuggaggggaagugcgagaccugcguguacaacaugaugggcaagcgcgagaagaagcucggggaguucggcaaggccaagggcagccgggccaucugguacauguggcugggggcccgcuuccuggaguucgaggcgcucggcuuccugaacgaggaccacugguucucccgggggaacagccugagcggcguggagggggagggccuccaccgccugggcuacauccugcgggacgucgggaagaaggagggcggggccauguacgccgacgacaccgccggcugggacacccgcaucacgcucgaggaccugaagaacgaggagauggugaccaaccacaugaagggggagcacaagaagcuggccgaggcgaucuucaagcucaccuaccagaacaaggugguccgggugcagcgcccgacgccccggggcacggugauggacaucaucucccgccgcgaccagcggggcagcgggcaggucggcaccuacgggcugaacaccuucaccaacauggaggcccagcugauccgccagauggagggcgagggcaucuucaaguccauccagcaccucacggccaccgaggagaucgccgcccagaacuggcuggcgcggguggggcgcgagcggcugagccgcauggccaucuccggcgacgacugcguggucaagcccaucgacgaccgguucgccagcgcccucaccgcccugaacgacauggggaaggugcgcaaggacauccagcagugggagcccucccggggcuggaacgacuggacccaggugccguucugcagccaccacuuccacgagcuggucaugaaggacgggcgcgugcucgugguccccugccggaaccaggacgagcugaucggccgcgcgcggaucucccagggcgccggguggagccugaaggagacggccugccucggcaaguccuacgcccagauguggacccugauguacuuccaccgccgggaccugcgccucgccgcgaacgccaucugcagcgccgugcccucccacugggugcccaccagccggaccaccugguccauccacgccaagcacgaguggaugacgaccgaggacaugcuggcggucuggaaccgcguguggauccaggagaacccguggauggaggacaagacccccguggagagcugggaggagguccccuaccuggggaagcgggaggaccaguggugcggcucccucaucgggcugaccagccgcgccacgugggccaagaacauccagaccgccaucaaccaggugcgcagccugaucggcaacgaggaguacaccgacuacaugcccuccaugaagcgguuccgccgggaggaggaggaggccggcgugcucugguga

SEQ ID NO: 9116 - RNA, 9876 nt, Artificial Sequence
  derived and/or modified CDS sequence (opt1) from DENV-2__EU854293__SS-prME
accgccggcaugaucaucaugcugauccccaccgugauggccuuccaccucaccacccggaacggggagccccacaugaucgucagccggcaggagaagggcaagagccugcuguucaagaccggggacggcgugaacaugugcacccucauggcgauggaccugggggagcugugcgaggacaccaucaccuacaagugcccccuccugcggcagaacgagcccgaggacaucgacugcuggugcaacagcaccagcaccugggugaccuacgggaccugcaccaccacgggcgagcaccggcgcgagaagcggagcgucgcccuggugccccacguggggaugggccucgagacccgcaccgagaccuggaugagcagcgagggggccuggaagcacgcccagcggaucgagacguggauccugcgccaccccggcuucaccaucauggccgcgauccuggccuacaccaucgggaccacgcacuuccagcgggcccucaucuucauccugcugaccgccgucgcgcccuccaugaccaugcgcugcaucggcaucagcaaccgggacuucguggagggcguguccgggggcagcugggucgacaucgugcucgagcacggguccugcgugaccacgauggccaagaacaagcccacccuggacuucgagcugaucaagaccgaggccaagcagagcgccacccuccgcaaguacugcaucgaggccaagcugacgaacaccaccaccgagucccggugccccacgcagggcgagcccagccugaacgaggagcaggacaagcgcuucgucugcaagcacuccaugguggaccggggcugggggaacggcugcgggcuguucggcaagggcgggaucgugaccugcgcgauguucacgugcaagaagaacaugaagggcaaggucgugcagcccgagaaccuggaguacaccaucgugaucacgccccacagcggggaggagcacgccgucggcaacgacaccgggaagcacggcaaggagaucaagaucacgccccaguccagcaucaccgaggccgagcugaccggguacggcacggugaccauggagugcuccccgcgcaccggccucgacuucaacgagauggugcugcugcagauggagaacaaggccuggcucguccaccggcagugguuccuggaccugccccuccccuggcugcccggggccgacacccagggcagcaacuggauccagaaggagacgcuggugaccuucaagaacccgcacgcgaagaagcaggacguggucgugcucgggagccaggagggcgccaugcacaccgcccugaccggggccacggagauccagauguccagcggcaaccuccuguucaccggccaccugaagugccgccugcggauggacaagcuccagcugaaggggauguccuacagcaugugcaccggcaaguucaaggucgugaaggagaucgccgagacccagcacgggacgaucgugauccgcguccaguacgagggcgacggcucccccugcaagauccccuucgagaucauggaccuggagaagcggcacgugcucgggcgccugaucaccgugaaccccaucgucaccgagaaggacagcccggugaacaucgaggcggagccgcccuucggcgacuccuacaucaucaucgggguggagcccggccagcugaagcucaacugguucaagaaggggagcuccaucggccagauguucgagaccacgaugcgcggcgccaagcggauggccauccugggggacaccgccugggacuucggcagccucggcggggucuucaccuccaucgggaaggcccuccaccagguguucggggcgaucuacggcgccgccuucagcgggguguccuggaccaugaagauccugaucggcgucaucaucacguggaucgggaugaacagccgcuccaccagccuguccgugagccuggugcucgucggcguggugacccuguaccugggggucauggugcaggccgacuccggcugcguggucagcuggaagaacaaggagcucaagugcggcagcgggaucuucaucaccgacaacgugcacacguggaccgagcaguacaaguuccagccggagucccccagcaagcuggcguccgccauccagaaggcccacgaggagggcaucugcgggauccggagcgugacccgccuggagaaccucauguggaagcagaucacccccgagcugaaccacauccuguccgagaacgaggucaagcucacgaucaugaccggcgacaucaaggggaucaugcaggccggcaagcggagccugcgcccccagccgaccgagcugaaguacuccuggaagaccuggggcaaggccaagaugcucagcacggagucccacaaccagaccuuccugaucgacgggcccgagaccgcggagugccccaacaccaaccgggccuggaacagccuggagguggaggacuacggcuucgggguguucacgaccaacaucuggcucaagcugcgcgagaagcaggacgucuucugcgacuccaagcugaugagcgccgccaucaaggacaaccgggccgugcacgcggacaugggcuacuggaucgaguccgcccucaacgacaccuggaagaucgagaaggccagcuucaucgaggugaaguccugccacuggcccaagagccacacccugugguccaacgagguccuggagagcgagaugaucauccccaagaacuucgccggccccgugagccagcacaacuaccgccccggguaccacacccagacggccggcccguggcaccucgggaagcuggagauggacuucgacuucugcgagggcaccaccguggucgugaccgaggacugcgggaaccggggccccucccugcgcacgaccaccgcgagcggcaagcucaucaccgaguggugcugccgguccugcacgcugccgccccugcgcuaccgcggggaggacggcugcugguacgggauggagauccgcccgcucaaggagaaggaggagaaccuggugaacagccuggucaccgccggccacgggcagaucgacaacuucucccucggcgugcugggcauggcccuguuccucgaggagaugcugcggacccgcguggggaccaagcacgccauccugcucgucgcggugagcuucgugacgcugaucaccggcaacauguccuuccgggaccuggggcgcgucauggugauggugggcgccaccaugaccgacgacaucgggaugggcgucacguaccucgcccugcuggccgccuucaaggugcgccccaccuucgcggccggccuccugcugcggaagcucaccagcaaggagcugaugaugaccacgaucgggaucgugcugcucucccagagcaccauccccgagaccauccuggagcugaccgacgcccucgcccugggcaugaugguccugaagauggugcgcaagauggagaaguaccagcucgccgugacgaucauggcgauccugugcguccccaacgccgugauccugcagaacgccuggaaggucuccugcaccauccucgccguggugagcgucuccccgcuguuccugaccagcucccagcagaaggccgacuggaucccccucgcgcugaccaucaaggggcugaaccccacggccaucuuccucaccacccugagccggaccaacaagaagcgcuccuggccccugaacgaggccaucauggccgugggcauggugagcauccucgcguccagccugcugaagaacgacaucccgaugacgggcccccucgucgccgggggccugcugaccgugugcuacgugcucaccgggcggagcgccgaccuggagcuggagcgcgccgccgacgucaagugggaggaccaggcggagaucuccggcagcucccccauccucagcaucaccaucuccgaggacgggagcauguccaucaagaacgaggaggaggagcagauccugacgauccugauccggaccggccuccuggugaucagcggccuguuccccguguccaugccgaucaccgccgccgccugguaccucugggaggucaagaagcagcgcgccggggugcugugggacgugcccuccccgccgcccgucggcaaggcggagcuggaggacggggccuaccggaucaagcagaagggcauccucggguacucccagaucggcgccggcguguacaaggaggggaccuuccacaccauguggcacgugacgcgcggcgccguccugaugcacaaggggaagcggaucgagcccagcugggccgacgugaagaaggaccugaucuccuacggcgggggcuggaagcucgagggcgaguggaaggagggggaggaggugcagguccuggcgcuggagcccggcaagaacccgcgcgccgugcagaccaagcccggccuguucaagaccaacgccggcaccaucggggccgugagccuggacuucucccccggcacgagcggcucccccaucaucgacaagaaggggaaggucgugggccuguacgggaacggcguggucacccggagcggcgccuacguguccgcgaucgcccagaccgagaaguccaucgaggacaacccggagaucgaggacgacaucuuccgcaagcggaagcucaccaucauggaccugcaccccggggccggcaagacgaagcgcuaccugcccgccaucgugcgggaggcgaucaagcgcgggcugcggacccucauccuggcccccacccgcgucguggccgccgagauggaggaggcccugcggggccucccgauccgcuaccagacccccgcgauccgcgccgagcacacggggcgggagaucguggaccugaugugccacgccaccuucaccaugcgccugcucagccccguccgggugcccaacuacaaccugaucaucauggacgaggcccacuucaccgacccggccuccaucgcggcccgcggcuacaucagcacgcggguggagaugggcgaggccgccgggaucuucaugaccgccacgccgcccggcucccgcgaccccuucccgcagagcaacgcgcccaucauggacgaggagcgggagauccccgagcgcuccuggagcuccgggcacgagugggucaccgacuucaagggcaagacggugugguucgugcccagcaucaaggccgggaacgacaucgccgccugccugcggaagaacggcaagaaggucauccagcucucccgcaagaccuucgacagcgaguacgugaagacccggaccaacgacugggacuucguggucacgaccgacaucuccgagaugggcgcgaacuucaaggccgagcgcgugaucgacccgcggcgcugcaugaagcccgugauccugaccgacggggaggagcgggucauccuggccggccccaugcccgugacccacagcuccgccgcccagcgccgggggcgcaucggccggaacccgaagaacgagaacgaccaguacaucuacaugggggagccccucgagaacgacgaggacugcgcgcacuggaaggaggccaagaugcugcuggacaacaucaacacgcccgagggcaucauccccagcauguucgagccggagcgcgagaagguggacgccaucgacggcgaguaccgccuccgcggggaggcccgcaagaccuucgucgaccugaugcggcgcggcgaccugcccguguggcucgccuaccggguggcggccgaggggaucaacuacgccgaccgccgguggugcuucgacggcaucaagaacaaccagauccuggaggagaacgucgagguggagaucuggaccaaggagggggagcgcaagaagcugaagccccgguggcucgacgcccgcaucuacuccgacccgcuggcccugaaggaguucaaggaguucgcggccggccgcaagagccucacccugaaccugaucacggagaugggccgccuccccaccuucaugacccagaaggcccgggacgcccuggacaaccuggcgguccuccacaccgccgaggccgggggccgcgccuacaaccacgcccuguccgagcugcccgagacgcucgagacccugcugcuccugacccugcucgcgaccgugaccgggggcaucuuccuguuccugaugagcggccgggggaucggcaagaugacccucgggaugugcugcaucaucaccgccuccauccugcugugguacgcccagauccagccccacuggaucgccgccagcaucauccucgaguucuuccugaucgugcugcucaucccggagcccgagaagcagcgcacgccccaggacaaccagcugaccuacgucgugaucgcgauccugacgguggucgccgccaccauggccaacgagaugggcuuccucgagaagaccaagaaggaccuggggcugggcagcaucaccacgcagcagcccgaguccaacauccucgacaucgaccugcggccggccagcgcguggacccuguacgccguggccaccaccuucgugacgcccaugcuccgccacuccaucgagaacagcuccgucaacgugagccugaccgccaucgccaaccaggcgaccgugcugaugggccucgggaagggcuggccccuguccaagauggacaucggggucccccugcucgccaucggcugcuacagccaggugaacccgaucacccugacggccgcccuguuccuccugguggcgcacuacgccaucaucgggcccggccugcaggccaaggccacccgggaggcccagaagcgcgcggccgccggcaucaugaagaaccccaccgucgacgggaucaccgugaucgaccucgaccccaucccguacgaccccaaguucgagaagcagcugggccaggugaugcugcucguccugugcgugacccaggugcugaugaugcggaccaccugggcccucugcgaggcccugacccuggcgacggggcccaucuccacccucugggagggcaaccccgggcgcuucuggaacaccaccaucgccgucagcauggccaacaucuuccgcggcuccuaccuggccggcgccgggcuccucuucagcaucaugaagaacacgaccaacacccggcgcggcaccgggaacaucggcgagacgcugggcgagaaguggaagucccggcugaacgcgcucggcaagagcgaguuccagaucuacaagaaguccggcauccaggagguggaccgcacccuggccaaggaggggaucaagcggggcgagaccgaccaccacgccgugagccgcggguccgccaagcugcggugguucgucgagcgcaacauggugaccccggagggcaagguggucgaccucggcugcgggcggggcggguggagcuacuacugcggcgggcugaagaacgugcgcgaggugaagggccugacgaagggcgggcccggccacgaggagcccauccccauguccaccuacggguggaaccucguccggcugcagagcggcguggacguguucuucaccccgcccgagaagugcgacacccugcucugcgacaucggggagagcucccccaaccccacggucgaggcgggccgcacccugcgggugcugaaccucguggagaacuggcugaacaacaacacccaguucugcaucaagguccugaacccguacaugcccagcgugaucgagaagauggaggcccuccagcgcaaguacggcggggcccuggugcggaacccccugucccgcaacagcacccacgagauguacugggucuccaacgccagcggcaacaucguguccagcgugaacaugaucucccggaugcugaucaaccgcuucaccaugcggcacaagaaggccacguacgagccggacgucgaccucgggagcggcacccgcaacaucgggaucgaguccgagauccccaaccuggacaucaucggcaagcgcaucgagaagaucaagcaggagcacgagaccagcuggcacuacgaccaggaccaccccuacaagaccugggcguaccacggcuccuacgagacgaagcagaccgggagcgccuccagcauggugaacggcgugguccggcugcucaccaagcccugggacguggugccgauggucacccagauggccaugacggacaccacccccuucgggcagcagcgcguguucaaggagaagguggacacccggacgcaggagcccaaggagggcaccaagaagcugaugaagaucaccgccgaguggcuguggaaggagcucggcaagaagaagacgccccggaugugcacgcgggaggaguucacccgcaagguccgguccaacgccgcgcugggggccaucuucaccgacgagaacaaguggaaguccgcccgcgaggccguggaggacucccgguucugggagcuggucgacaaggagcgcaaccuccaccuggagggcaagugcgagaccugcguguacaacaugauggggaagcgggagaagaagcugggcgaguucgggaaggccaagggcagccgcgcgaucugguacauguggcucggcgcccgguuccuggaguucgaggcccugggguuccucaacgaggaccacugguucagccgcgagaacucccugagcggcguggagggggagggccugcacaagcucggguacauccugcgggacgucuccaagaaggagggcggcgccauguacgcggacgacacggccgggugggacacccgcaucacccuggaggaccucaagaacgaggagauggugaccaaccacauggagggcgagcacaagaagcuggccgaggccaucuucaagcugacguaccagaacaaggugguccgggugcagcgcccgacgccccgggggaccgugauggacaucaucagccgccgggaccagcgcggcuccgggcaggucggcaccuacggccucaacaccuucaccaacauggaggcccagcugauccgccagauggagggggagggcguguucaagagcauccagcaccugaccgugaccgaggagaucgcgguccagaacuggcucgcccggguggggcgcgagcggcugucccgcauggccaucagcggcgacgacugcguggucaagccccuggacgaccgguucgccuccgcccucacggcgcugaacgacaugggcaaggugcgcaaggacauccagcagugggagcccagccggggguggaacgacuggacccaggugccguucugcucccaccacuuccacgagcugaucaugaaggacggccgcguccucguggugcccugccggaaccaggacgagcugaucgggcgcgcccggaucagccagggcgccggguggucccugcgcgagaccgccugccucggcaagagcuacgcccagauguggucccugauguacuuccaccggcgcgaccugcggcucgcggccaacgccaucugcagcgccguccccucccacugggugcccaccagccgcacgaccuggagcauccacgccaagcacgaguggaugaccaccgaggacaugcugaccguguggaaccgggucuggauccaggagaacccguggauggaggacaagacgcccguggaguccugggaggagauccccuaccugggcaagcgcgaggaccaguggugcgggagccucaucggccugaccucccgggcgaccugggccaagaacauccagaccgccaucaaccaggugcgcagccugaucgggaacgaggaguacacggacuacaugcccuccaugaagcgcuuccggcgcgaggaggaggaggccggcguccucugguga

SEQ ID NO: 9117 - RNA, 9876 nt, Artificial Sequence
  derived and/or modified CDS sequence (opt1) from DENV-2__EU854294__SS-prME
accgccggcgugaucgucaugcugauccccaccgccauggcguuccaccucaccacccgcaacggggagccccacaugaucgugggccggcaggagaaggggaagucccugcuguucaagaccgaggacggcgugaacaugugcacccucauggccaucgaccugggggagcugugcgaggacaccaucaccuacaagugcccccuccugcggcagaacgagcccgaggacaucgacugcuggugcaacagcaccagcaccugggucaccuacgggaccugcaccaccacgggcgagcaccggcgcgagaagcgguccguggcccuggugccccacgucgggaugggccucgagacccgcaccgagaccuggaugagcuccgagggggccuggaagcacgugcagcggaucgagaccuggauccugcgccacccgggcuucaccaucauggccgcgauccuggccuacaccaucgggaccacgcacuuccagcgggcccucaucuucauccugcugaccgccguggcgcccagcaugaccaugcgcugcaucggcaucuccaaccgggacuucgucgagggcgugagcgggggcuccuggguggacaucguccucgagcacgggagcugcgugaccacgauggccaagaacaagcccacccuggacuucgagcugaucaagaccgaggccaagcagcccgccacccuccgcaaguacugcaucgaggccaagcugacgaacaccaccaccgagucccggugcccgacgcagggcgagcccagccugaacgaggagcaggacaagcgcuucaucugcaagcacuccaugguggaccggggcugggggaacggcugcgggcuguucggcaagggcgggaucgugaccugcgcgauguucacgugcaagaagaacauggagggcaagguggugcagcccgagaaccuggaguacaccaucgucaucacgccccacagcggggaggagcacgccgugggcaacgacaccgggaagcacggcaaggagaucaagaucaccccgcaguccagcaucaccgaggccgagcugaccggguacggcacggugaccauggagugcagcccccggaccggccucgacuucaacgagaugguccugcugcagauggaggacaaggccuggcucgugcaccggcagugguuccuggaccugccccuccccuggcugccgggggccgacacccagggcagcaacuggauccagaaggagacgcuggugaccuucaagaacccccacgcgaagaagcaggacgucgugguccucgggucccaggagggcgccaugcacaccgcccugaccggggccacggagauccagaugagcagcggcaaccuccuguucaccggccaccugaagugccgccugcggauggacaagcuccagcugaaggggauguccuacagcaugugcaccggcaaguucaagaucgugaaggagaucgccgagacccagcacgggacgaucgugauccgcguccaguacgagggcgacggcucccccugcaagauccccuucgagaucaccgaccuggagaagcggcacgugcucgggcgccugaucaccgugaacccgaucgucaucgagaaggacagccccgugaacaucgaggcggagccgcccuucggcgacuccuacaucaucaucgggguggagccgggccagcugaagcucaacugguucaagaaggggagcuccaucggccagauguucgagaccacgaugcgcggcgccaagcggauggccauccugggggacaccgccugggacuucggcagccucggcggggucuucaccuccaucgggaaggcccuccaccagguguucggggcgaucuacggcgccgccuucagcgggguguccuggaccaugaagauccugaucggcgucgugaucacguggaucgggaugaacagccgcuccaccagccuguccgugagccugguccucgugggcguggucacccuguaccugggggccauggugcaggcggacuccggcugcguggucagcuggaagaacaaggagcucaagugcggcuccgggaucuucaucaccgacaacgugcacacguggaccgagcaguacaaguuccagcccgagagccccagcaagcuggccuccgccauccagaaggcccacgaggagggcaucugcgggauccggagcgugacccgccuggagaaccucauguggaagcagaucacccccgagcugaaccacauccuguccgagaacgaggucaagcucacgaucaugaccggcgacaccaaggggaucaugcaggccggcaagcgguaccugcgcccgcagcccaccgagcugaaguacagcuggaagacguggggcaaggcgaagaugcucuccaccgagagccacaaccagaccuuccugaucgacgggcccgagaccgccgagugcccgaacacgaaccgggccuggaacucccuggagguggaggacuacggcuucgggguguucaccaccaacaucuggcucaagcugcgcgagaagcaggacgucuucugcgacagcaagcugauguccgccgccaucaaggacaaccgggcggugcacgccgacaugggcuacuggaucgagagcgcccucaacgacaccuggaagauggagaaggccuccuucaucgaggucaagagcugccacuggcccaagucccacacccuguggagcaacggcgugcuggaguccgagaugaucauccccaagaacuucgccgggcccgugagccagcacaacuaccgcccgggcuaccacacgcagaccgcggggcccuggcaccucggcaagcuggagauggacuucgacuucugcgaggggaccaccguggucgugacggaggacugcggcaaccggggccccucccugcgcaccaccaccgccagcgggaagcucaucacggaguggugcugccggagcugcacccugcccccgcugcgcuaccggggcgaggacgggugcugguacggcauggagauccgcccccucaaggagaaggaggagaaccuggugaacucccuggucaccgccgggcacggccagaucgacaacuucagccucggcgugcuggggauggcccuguuccucgaggagaugcugcggacccgcgugggcacgaagcacgcgauccugcucgucgccguguccuucgugacccugaucaccgggaacaugagcuuccgggaccugggccgcgucauggugauggugggggccaccaugacggacgacaucggcaugggcgucaccuaccucgcccugcuggccgcguucaaggugcgccccaccuucgccgccgggcuccugcugcggaagcucaccuccaaggagcugaugauggccacgaucggcaucacccugcucagccaguccaccauccccgagaccauccuggagcugacggacgcccucgcgcuggggaugauggugcugaagaucguccgcaacauggagaaguaccagcucgccgugaccaucauggccaucagcugcgugccgaacgccgucauccugcggaacgccuggaagguguccugcaccauccuggcggccgucagcgugagcccccuccugcugaccagcucccagcagaaggccgacuggaucccccucgcccugacgaucaagggccugaaccccaccgcgaucuuccucaccacccugagccgcacguccaagaagcggagcuggccgcugaacgaggccaucauggccgugggcauggucuccauccucgccagcucccugcugaagaacgacauccccaugaccgggccccucguggccggcgggcugcugaccgugugcuacguccucaccggccgcagcgcggaccuggagcuggagcgggccgccgacgugaagugggaggaccaggccgagaucagcggguccagccccauccucuccaucacgaucagcgaggacggcuccaugagcaucaagaacgaggaggaggagcagacccugaccauccugauccgcaccggccuccuggugaucuccggggucuucccggugagcauccccaucaccgccgcggccugguaccugugggaggugaagaagcagcgggccggcguccucugggacgugcccagcccgccgcccguggggaaggccgagcuggaggacggcgccuaccgcaucaagcagcgggggauccugggcuacagccagaucggcgcgggggucuacaaggagggcacguuccacaccauguggcacgugacccgcggggccgugcucaugcaccggggcaagcgcaucgagcccuccugggccgacgucaagaaggaccugaucagcuacgggggcggcuggaagcuggagggggaguggaaggagggcgaggagguccaggugcucgcccuggagcccgggaagaacccccgggccguccagaccaagcccggcaucuucaagacgaacaccgggaccaucggcgcggugucccuggacuucagccccggcaccuccgggagccccaucguggaccgcaagggcaaggucguggggcucuacggcaacggcguggucacgcgguccggggccuacgugagcgccaucgcccagaccgagaaguccaucgaggacaaccccgagaucgaggacgacaucuuccgcaagaagcggcugaccaucauggaccugcaccccggcgcggggaagaccaagcgcuaccuccccgccaucgugcgggaggccaucaagcgcggccugcgcacgcugauccuggccccgacccgggucguggccgcggagauggaggaggcccuccgcgggcugcccauccgguaccagacccccgccaucaaggccgagcacaccggccgcgagaucguggaccugaugugccacgccacguucaccaugcggcuccugagccccguccgcgugccgaacuacaaccugaucaucauggacgaggcgcacuucaccgaccccgccagcaucgccgcccggggcuacaucuccacccgcguggagaugggggaggccgcgggcaucuucaugacggccacgccgcccgggagccgggacccguucccccaguccaacgcccccaucauggacgaggagcgcgagauccccgagcggagcuggaacuccggccacgagugggucaccgacuucaaggggaagaccgugugguucgugccgagcaucaaggccggcaacgacaucgcggccugccuccgcaagaacggcaagaaggucauccagcugucccggaagacguucgacagcgaguacgugaagacccgcgccaacgacugggacuucguggucaccaccgacaucuccgagaugggggccaacuucaaggccgagcgggugaucgacccccgccggugcaugaagcccgugauccugacggacggcgaggagcgcgucauccucgcggggcccaugccggugacccacagcuccgccgcccagcggcgcggccgcaucgggcggaaccccaagaacgagaacgaccaguacaucuacaugggcgagccccuggagaacgacgaggacugcgcccacuggaaggaggccaagaugcugcucgacaacaucaacacccccgagggcaucaucccgagcauguucgagcccgagcgcgagaagguggacgcggucgacggggaguaccggcugcgcggcgaggcccggaagaccuucguggaccugaugcgccgcggggaccuccccguguggcuggccuacaaggucgccgccgagggcaucaacuacgcggaccgcaaguggugcuucgacgggaucaagaacaaccagauccuggaggagaacguggaggucgagaucuggacgaaggagggcgagcggaagaagcucaagccgcgcuggcuggacgcccggaucuacuccgacccccuggcccucaaggaguucaaggaguucgccgcgggccgcaagagccugacccugaaccucaucaccgagauggggcggcugcccaccuucaugacgcagaaggcccgcaacgcccuggacaaccucgccgugcugcacaccgccgaggcgggcgggcgggccuacaaccacgcccuguccgagcuccccgagacccuggagacccugcuccugcugacgcuccuggccaccgugaccggcggcaucuuccuguuccucaugagcgggaagggcaucgggaagaugacccugggcaugugcugcaucaucaccgccuccguccugcucugguacgcgcagauccagccgcacuggaucgccgccagcaucauccuggaguucuuccugaucgugcuccugauccccgagcccgagaagcagcgcacgccccaggacaaccagcugaccuacguggucaucgccauccucaccgugguggccgcgaccauggccaacgagaugggguuccuggagaagacgaagaaggaccugggccucggcuccaucaccacccaggagagcgagagcaacauccuggacaucgaccugcggccggccuccgccuggacccucuacgccgucgcgacgaccuucgugacccccaugcugcgccacagcaucgagaacuccagcgugaacgucucccugaccgccaucgccaaccaggccacggugcucauggggcugggcaagggguggccccugagcaagauggacaucggcgugccccuccuggcgaucgggugcuacucccaggucaacccgaucacccugaccgccgcccuccugcugcucguggcccacuacgccaucaucggccccggccugcaggcgaaggccacccgggaggcccagaagcgcgccgccgcggggaucaugaagaaccccacgguggacggcaucaccgucaucgaccuggagcccaucccguacgaccccaaguucgagaagcagcucggccaggugaugcugcugauccucugcgugacccagguccugaugaugcggaccacgugggcccugugcgaggcccucacccuggccaccggccccaucagcacccugugggaggggaaccccggccgcuucuggaacacgaccaucgccguguccauggcgaacaucuuccgcggcagcuaccucgccggggccggccugcuguucuccaucaugaagaacaccaccaacacgcggcgcgggaccggcaacaucggcgagacccucggggagaaguggaagucccggcugaacgcccugggcaaguccgaguuccagaucuacaagaaguccgggauccaggagguggaccgcacccucgcgaaggagggcaucaagcgcggggagacggaccaccacgccgucucccgcggcagcgccaagcugcggugguucguggagcgcaacauggugaccccggagggcaaggucguggaccuggggugcggccgcggcgggugguccuacuacugcggcgggcucaagaacgugcgcgaggucaaggggcugaccaagggcgggcccgggcacgaggagcccauccccaugagcaccuacggcuggaaccuggugcggcuccaguccgggguggacgucuucuucacgccgcccgagaagugcgacacccugcugugcgacaucggcgagagcagccccaaccccaccaucgaggccggccgcacccuccgggugcugaaccugguggagaacuggcucaacaacaacacccaguucugcaucaagguccugaacccguacaugcccuccgugaucgagaagauggagacgcugcagcgcaaguacgggggcgcccucgugcggaacccccugagccgcaacuccacccacgagauguacugggucagcaacgcgaccgggaacaucguguccagcgugaacaugaucucccggaugcugaucaaccgcuucaccaugaagcacaagaaggccacguacgagccggacgucgaccugggcagcgggacccggaacaucggcaucgaguccgagauccccaaccucgacaucaucggcaagcgcaucgagaagaucaagcaggagcacgagaccagcuggcacuacgaccaggaccaccccuacaagaccugggccuaccacggguccuacgagacgaagcagaccggcagcgccuccagcauggugaacggggugguccgccugcugaccaagcccugggacguggugccgauggucacccagauggccaugacggacaccacccccuucggccagcagcggguguucaaggagaagguggacacccgcacgcaggagcccaaggagggcaccaagaagcucaugcggaucaccgcggaguggcuguggaaggagcuggggaagaagaagacgccccggaugugcacgcgggaggaguucacccgcaagguccgguccaacgccgcccucggcgccaucuucaccgacgagaacaaguggaaguccgcccgcgaggcgguggaggacgggcgguucugggagcuggucgaccgcgagcggaaccugcaccucgagggcaagugcgagaccugcguguacaacaugauggggaagcgcgagaagaagcugggcgaguucggcaaggccaaggggucccgggccaucugguacauguggcugggcgcccgcuuccucgaguucgaggcgcugggguuccugaacgaggaccacugguucagccggggcaacucccucagcgggguggagggcgagggccugcaccgccugggguacauccuccgggacgucggcaagaaggagggcggcgccauguacgccgacgacacggccgggugggacacccgcaucacccuggaggaccugaagaacgaggagauggugaccaaccacaugaagggcgagcacaagaagcucgccgaggcgaucuucaagcugacguaccagaacaaggugguccgggugcagcgcccgacgccccggggcaccgugauggacaucaucagccgccgcgaccagcggggguccggccaggucgggaccuacggccugaacacguucaccaacauggaggcccagcucauccgccagauggagggcgaggggaucuucaagagcauccagcaccugaccgccaccgaggagaucgccgcccagaacuggcuggcgcgggugggccgcgagcggcucucccgcauggccaucagcggggacgacugcguggucaagcccaucgacgaccgguucgccuccgcccugacggcccugaacgacaugggcaaggugcgcaaggacauccagcagugggagcccagccggggguggaacgacuggacccaggugccguucugcucccaccacuuccacgagcucgucaugaaggacggccgcgugcuggugguccccugccggaaccaggacgagcugaucggccgcgcgcggaucagccagggggccggcuggucccucaaggagaccgccugccugggcaagagcuacgcccagauguggacccugauguacuuccaccgccgggaccuccgccuggccgcgaacgccaucugcuccgccgugcccagccacugggugcccaccucccggacgaccuggagcauccacgccaagcacgaguggaugaccaccgaggacaugcuggcggucuggaaccgcguguggauccaggagaacccguggauggaggacaagacgcccguggaguccugggaggagguccccuaccucggcaagcgggaggaccaguggugcgggagccugaucggccugaccucccgcgccaccugggccaagaacauccagaccgccaucaaccaggugcgcagccucaucggcaacgaggaguacacggacuacaugcccagcaugaagcgguuccgccgggaggaggaggaggccggggugcugugguga

SEQ ID NO: 9118 - RNA, 9876 nt, Artificial Sequence
  derived and/or modified CDS sequence (opt1) from DENV-2__FJ024477__SS-prME
accgccggcgugaucgucaugcugauccccaccgccauggcguuccaccucaccacccgcaacggggagccccacaugaucgugggccggcaggagaaggggaagucccugcuguucaagaccgaggacggcgugaacaugugcacccucauggccaucgaccugggggagcugugcgaggacaccaucaccuacaagugcccccuccugcgccagaacgagcccgaggacaucgacugcuggugcaacagcaccagcaccugggucaccuacgggaccugcaccaccacgggcgagcaccggcgcgagaagcgguccguggcccuggugccccacgucgggaugggccucgagacccgcaccgagaccuggaugagcuccgagggggccuggaagcacgugcagcggaucgagacguggauccugcgccacccgggcuucaccaucauggccgcgauccuggccuacaccaucgggaccacgcacuuccagcgggcccucaucuucauccugcugaccgccguggcgcccagcaugaccaugcgcugcaucggcaucuccaaccgggacuucgucgagggcgugagcgggggcuccuggguggacaucguccucgagcacgggagcugcgugaccacgauggccaagaacaagcccacccuggacuucgagcugaucaagaccgaggccaagcagcccgccacccuccgcaaguacugcaucgaggccaagcugacgaacaccaccaccgagucccggugcccgacgcagggcgagcccagccugaacgaggagcaggacaagcgcuucaucugcaagcacuccaugguggaccggggcugggggaacggcugcgggcuguucggcaagggcgggaucgugaccugcgcgauguucacgugcaagaagaacauggagggcaagguggugcagcccgagaaccuggaguacaccaucgucaucacgccccacagcggggaggagcacgccgugggcaacgacaccgggaagcacggcaaggagaucaagaucaccccgcaguccagcaucaccgaggccgagcugaccggguacggcacggugaccauggagugcagcccccggaccggccucgacuucaacgagaugguccugcugcagauggaggacaaggccuggcucgugcaccggcagugguuccuggaccugccccuccccuggcugccgggggccgacacccagggcagcaacuggauccagaaggagacgcuggugaccuucaagaacccccacgcgaagaagcaggacgucgugguccucgggucccaggagggcgccaugcacaccgcccugaccggggccacggagauccagaugagcagcggcaaccuccuguucaccggccaccugaagugccgccugcggauggacaagcuccagcugaaggggauguccuacagcaugugcaccggcaaguucaagaucgugaaggagaucgccgagacccagcacgggacgaucgugauccgcguccaguacgagggcgacggcucccccugcaagauccccuucgagaucaccgaccuggagaagcggcacgugcucgggcgccugaucaccgugaacccgaucgucaccgagaaggacagccccgugaacaucgaggcggagccgcccuucggcgacuccuacaucaucaucgggguggagccgggccagcugaagcucaacugguucaagaaggggagcuccaucggccagauguucgagacgaccaugcgcggcgccaagcggauggccauccugggggacaccgccugggacuucggcagccucgggggcgucuucaccuccaucgggaaggcccuccaccagguguucggcgcgaucuacggcgccgccuucagcgggguguccuggacgaugaagauccugaucggcgucaucaucaccuggaucgggaugaacagccgcuccaccagccuguccgugagccuggugcucgucggcguggugacccuguaccugggggccaugguccaggcggacuccggcugcguggugagcuggaagaacaaggagcucaagugcggcuccgggaucuucaucacggacaacguccacaccuggaccgagcaguacaaguuccagcccgagagccccagcaagcuggccuccgccauccagaaggcccacgaggagggcaucugcgggauccggagcgccacccgccuggagaaccucauguggaagcagaucacgcccgagcugaaccacauccuguccgagaacgaggugaagcucaccaucaugaccggcgacaucaaggggaucaugcaggcgggcaagcggagccugcgcccgcagcccaccgagcugaaguacuccuggaagacguggggcaaggccaagaugcucagcaccgagucccacaaccagaccuuccugaucgacgggcccgagaccgccgagugcccgaacacgaaccgggccuggaacagccuggagguggaggacuacggcuucggggucuucaccaccaacaucuggcucaagcugcgcgagaagcaggacguguucugcgacuccaagcugaugagcgccgcgaucaaggacaaccgggccgugcacgccgacaugggcuacuggaucgaguccgcccucaacgacaccuggaagauggagaaggccagcuucaucgaggucaaguccugccacuggcccaagagccacacccugugguccaacggcgugcuggagagcgagaugaucauccccaagaacuucgcggggcccgugucccagcacaacuaccgcccgggcuaccacacgcagaccgccgggcccuggcaccucggcaagcuggagauggacuucgacuucugcgaggggaccaccgucguggugacggaggacugcggcaaccggggccccagccugcgcaccaccaccgccagcgggaagcucaucacggaguggugcugccgguccugcacccugcccccgcugcgcuaccggggcgaggacgggugcugguacggcauggagauccgcccccucaaggagaaggaggagaaccuggucaacagccuggugaccgccgggcacggccagaucgacaacuucucccucggcgugcuggggauggcgcuguuccucgaggagaugcugcggacccgcgucggcacgaagcacgccauccugcucgccgccgugagcuucgugacccugaucaccgggaacauguccuuccgggaccugggccgcgucauggugauggugggggccaccaugacggacgacaucggcaugggcgucaccuaccucgcgcugcuggccgccuucaaggugcgccccaccuucgccgccgggcuccugcugcggaagcucaccagcaaggagcugaugauggcgacgaucggcaucgcccugcucucccagagcaccauccccgagaccauccuggagcugaccgacgcccucgcccuggggaugauggugcugaagaucguccgcaacauggagaaguaccagcucgccgugacgaucauggcgaucuccugcgugccgaacgccgucauccugcagaacgccuggaaggugagcugcaccauccuggccguggucuccgugagcccccuccugcugaccuccagccagcagaaggcggacuggaucccccucgcccugaccaucaagggccugaaccccacggccaucuuccucaccacccugucccggaccagcaagaagcgcuccuggccgcugaacgaggccaucauggccgucggcauggugagcauccucgcguccagccugcugaagaacgacauccccaugacggggccccucguggccggcgggcugcugaccgucugcuacgugcucaccggccggagcgccgaccuggagcuggagcgcgccgccgacgugaagugggaggaccaggcggagaucuccgggagcucccccauccucagcaucaccaucuccgaggacggcagcauguccaucaagaacgaggaggaggagcagacgcugaccauccugauccggaccggccuccuggucaucagcgggguguucccgguguccauccccaucaccgccgccgccugguaccugugggaggucaagaagcagcgcgccggcgugcucugggacgugcccagcccgccgcccgucgggaaggcggagcuggaggacggcgccuaccggaucaagcagcgcgggauccugggcuacucccagaucggcgccgggguguacaaggagggcaccuuccacacgauguggcacgugacccgcggggccguccucaugcaccgcggcaagcggaucgagcccagcugggccgacgugaagaaggaccugaucuccuacgggggcggcuggaagcuggagggggaguggaaggagggcgaggaggugcagguccucgcgcuggagcccgggaagaacccccgcgccgugcagaccaagcccggcaucuucaagaccaacacggggaccaucggcgccgugagccuggacuucucccccggcaccagcgggucccccaucgucgaccggaagggcaaggugguggggcucuacggcaacggcgucgugacccgcagcggggccuacguguccgcgaucgcccagacggagaaguccaucgaggacaaccccgagaucgaggacgacaucuuccggaagaagcgccugaccaucauggaccugcaccccggcgccgggaagaccaagcgguaccuccccgccaucguccgcgaggccaucaagcggggccugcgcacccugauccuggcgccgacgcgcgugguggccgccgagauggaggaggcccuccgggggcugcccauccgcuaccagacccccgccaucaaggcggagcacaccggccgggagaucgucgaccugaugugccacgccaccuucacgaugcgccuccugagccccgugcgggugccgaacuacaaccugaucaucauggacgaggcccacuucaccgaccccgccuccaucgccgcgcgcggcuacaucagcacccgggucgagaugggggaggccgccggcaucuucaugaccgccacgccgcccgggucccgcgacccguucccccagagcaacgcgcccaucauggacgaggagcgggagauccccgagcgcuccuggaacagcggccacgagugggugaccgacuucaaggggaagaccgugugguucgucccguccaucaaggccggcaacgacaucgccgccugccuccggaagaacggcaagaaggugauccagcugagccgcaagaccuucgacuccgaguacgugaagacgcgggccaacgacugggacuucgucgugaccaccgacaucagcgagaugggggcgaacuucaaggccgagcgcgugaucgacccccggcgcugcaugaagcccgucauccugaccgacggcgaggagcgggugauccucgccgggcccaugccggugacgcacuccagcgccgcccagcgccggggccgcaucgggcgcaaccccaagaacgagaacgaccaguacaucuacaugggcgagccccuggagaacgacgaggacugcgcgcacuggaaggaggccaagaugcugcucgacaacaucaacacccccgagggcaucaucccguccauguucgagcccgagcgggagaaggucgacgccaucgacggggaguaccgccugcggggcgaggcccgcaagaccuucguggaccugaugcggcgcggggaccuccccguguggcuggccuacaaggucgcggccgagggcaucaacuacgccgaccggaaguggugcuucgacgggaucaagaacaaccagauccuggaggagaacguggagguggagaucuggaccaaggagggcgagcgcaagaagcucaagccgcgguggcuggacgcccgcaucuacagcgacccccuggcgcucaaggaguucaaggaguucgccgccggccggaagucccugacgcugaaccucaucaccgagauggggcgccugcccaccuucaugacccagaaggcccggaacgcccuggacaaccucgcgguccugcacacggccgaggccggcgggcgcgccuacaaccacgcccugagcgagcuccccgagacccuggagacccugcuccugcugacccuccuggcgacggugaccggcggcaucuuccuguuccucauguccgggaagggcaucgggaagaugacccugggcaugugcugcaucaucaccgccagcguccugcucugguacgcccagauccagccgcacuggaucgccgccuccaucauccuggaguucuuccugaucgugcuccugauccccgagcccgagaagcagcggacgccccaggacaaccagcugacguacguggucaucgcgauccucaccgugguggccgccaccauggccaacgagaugggguuccuggagaagaccaagaaggaccugggccucggcagcaucacgacccaggagagcgaguccaacauccuggacaucgaccugcgcccggccagcgcguggacccucuacgccgucgccaccacguucgugacccccaugcugcggcacuccaucgagaacagcuccgugaacgucagccugaccgccaucgcgaaccaggccaccgugcucauggggcugggcaagggguggccccuguccaagauggacaucggcgugccccuccuggccaucgggugcuacagccaggucaacccgaucacgcugaccgccgcccuccugcugcucguggcgcacuacgccaucaucggccccggccugcaggccaaggccacccgcgaggcccagaagcgggcggccgccgggaucaugaagaaccccaccguggacggcaucacggucaucgaccuggagcccaucccguacgaccccaaguucgagaagcagcucgggcaggucaugcugcugauccucugcgugacccagguccugaugaugcgcaccaccugggcccugugcgaggcccucacgcuggcgaccggccccaucuccacccugugggaggggaaccccggccgguucuggaacaccacgaucgccgugagcauggccaacaucuuccgcggcuccuaccucgccggggcgggccugcuguucagcaucaugaagaacaccaccaacacccgccgggggacgggcaacaucggcgagacccucggggagaaguggaagucccgccugaacgcccugggcaagagcgaguuccagaucuacaagaaguccgggauccaggagguggaccggacccucgccaaggagggcaucaagcgcggggagaccgaccaccacgccgucagccggggcuccgccaagcugcgcugguucguggagcggaacauggugacgccggagggcaaggucguggaccuggggugcggccgcgggggcuggagcuacuacugcgggggccucaagaacgugcgggaggucaagggccugaccaagggcggccccgggcacgaggagcccauccccauguccaccuacggcuggaaccuggugcgccuccagagcgggguggacgucuucuucaccccgcccgagaagugcgacacgcugcugugcgacaucggcgagagcucccccaaccccaccaucgaggcgggccggacccuccgcgugcugaaccugguggagaacuggcucaacaacaacacccaguucugcaucaagguccugaacccguacaugcccagcgugaucgagaagauggagacccugcagcggaaguacgggggcgcccucgugcgcaacccccugucccggaacagcacgcacgagauguacugggucuccaacgccaccgggaacaucgugagcuccgugaacaugaucagccgcaugcugaucaaccgguucaccaugaagcacaagaaggccaccuacgagccggacgucgaccugggcuccgggacgcgcaacaucggcaucgagagcgagauccccaaccucgacaucaucggcaagcggaucgagaagaucaagcaggagcacgagaccuccuggcacuacgaccaggaccaccccuacaagaccugggccuaccacgggagcuacgagaccaagcagacgggcuccgcgagcuccauggugaacggggugguccgccugcugaccaagcccugggacguggugccgauggucacccagauggccaugaccgacacgacccccuucggccagcagcgcguguucaaggagaagguggacacccggacccaggagcccaaggagggcacgaagaagcucaugaagaucaccgccgaguggcuguggaaggagcuggggaagaagaagacgccccgcaugugcacccgggaggaguucacgcgcaagguccggagcaacgccgcccucggcgcgaucuucaccgacgagaacaaguggaaguccgcccgcgaggccguggaggacgggcgguucugggagcugguggaccgcgagcggaaccugcaccucgagggcaagugcgagaccugcgucuacaacaugauggggaagcgcgagaagaagcugggcgaguucggcaaggccaaggggagccgggcgaucugguacauguggcugggcgcccgcuuccucgaguucgaggcccugggguuccugaacgaggaccacugguucucccggggcaacagccucagcgggguggagggcgagggccugcaccgccugggguacauccuccgggacgucuccaagaaggagggcggggccauguacgccgacgacaccgcgggcugggacacgcgcaucacccuggaggaccugaagaacgaggagauggugaccaaccacaugaagggggagcacaagaagcucgccgaggccaucuucaagcugaccuaccagaacaaggugguccgggugcagcgcccgacgccccggggcaccgugauggacaucaucagccgccgggaccagcgcggcuccgggcaggucggcaccuacgggcugaacaccuucacgaacauggaggcccagcucauccgccagauggagggcgagggcaucuucaagagcauccagcaccugaccgccaccgaggagaucgcggugcagaacuggcuggcccggguggggcgcgagcggcucucccgcauggccaucagcggcgacgacugcgucgugaagcccaucgacgaccgguucgccuccgcccugaccgcgcugaacgacauggggaaggugcgcaaggacauccagcagugggagcccagccggggcuggaacgacuggacgcaggucccguucugcucccaccacuuccacgagcucgugaugaaggacgggcgcgugcuggucgugcccugccggaaccaggacgagcugaucggccgcgcccggaucagccagggcgccggguggucccucaaggagaccgccugccugggcaagagcuacgcccagauguggacccugauguacuuccaccgccgggaccuccgccuggcggccaacgccaucugcuccgccgugcccagccacuggguccccaccucccggaccacguggagcauccacgcgaagcacgaguggaugaccaccgaggacaugcuggccguguggaaccgcguguggauccaggagaacccguggauggaggacaagacccccgucgaguccugggaggaggugcccuaccucgggaagcgggaggaccaguggugcggcagccugaucgggcugacgagccgcgccaccugggccaagaacauccagaccgccaucaaccaggugcggucccucaucggcaacgaggaguacaccgacuacaugcccagcaugaagcgcuuccgccgggaggaggaggaggcgggcguccugugguga

SEQ ID NO: 9119 - RNA, 9876 nt, Artificial Sequence
  derived and/or modified CDS sequence (opt1) from DENV-2__GQ868552__SS-prME
accgcgggggugaucaucaugcugauccccaccgccauggcguuccaccucaccacccgcaacggggagccccacaugaucgucggccggcaggagaaggggaagucccugcuguucaagaccgaggacggcgugaacaugugcacccucauggccaucgaccugggggagcugugcgaggacaccaucaccuacaagugcccccuccugcgccagaacgagcccgaggacaucgacugcuggugcaacagcaccagcaccugggugaccuacgggaccugcaccaccacgggcgagcaccggcgcgagaagcgguccgucgcccuggugccccacguggggaugggccucgagacccgcaccgagaccuggaugagcuccgagggggccuggaagcacguccagcggaucgagaccuggauccugcgccaccccggcuucgccaucauggcggccauccuggccuacaccaucgggaccacccacuuccagcgggcccucaucuucauccugcugaccgcgguggcccccagcaugaccaugcgcugcaucggcaucuccaaccgggacuucguggagggcgucagcgggggcuccuggguggacaucgugcucgagcacgggagcugcgucaccaccauggccaagaacaagcccacccuggacuucgagcugaucaagaccgaggccaagcagcccgccacccuccgcaaguacugcaucgaggcgaagcugaccaacacgaccaccgagucccggugcccgacccagggcgagcccagccugaacgaggagcaggacaagcgcuucaucugcaagcacuccaugguggaccggggcugggggaacggcugcggccucuucggcaagggcgggaucgugacgugcgccauguucacgugcaagaagaacauggagggcaaggucgugcugcccgagaaccuggaguacaccaucgugaucacgccccacagcggggaggagcacgccgucggcaacgacacggggaagcacggcaaggagaucaagaucaccccgcaguccagcaucaccgaggccgagcucaccggguacggcaccgugacgauggagugcagcccccgcaccggccuggacuucaacgagauggugcugcuccagauggaggagaaggccuggcugguccaccggcagugguuccuggaccucccccugcccuggcugccgggggcggacacccagggcagcaacuggauccagaaggagacccucgugacguucaagaacccccacgccaagaagcaggacguggucgugcuggggucccaggagggcgccaugcacaccgcccugaccggggccaccgagauccagaugagcagcggcaaccuccuguucacgggccaccugaagugccgccuccggauggacaagcugcagcugaaggggauguccuacagcaugugcaccggcaaguucaagaucgucaaggagaucgcggagacccagcacgggaccaucgugauccgcgugcaguacgagggcgacggcucccccugcaagauccccuucgagaucauggaccucgagaagcggcacguccuggggcgccugaucacggugaacccgaucgugaccgagaaggacagccccgucaacaucgaggccgagccgcccuucggcgacuccuacaucaucaucgggguggagccgggccagcucaagcugaacugguucaagaaggggagcuccaucggccagauguucgagaccaccaugcgcggcgccaagcggauggccauccugggggacacggccugggacuucggcagccucgggggcguguucaccuccaucgggaaggcgcugcaccaggucuucggcgccaucuacggcgccgccuucagcgggguguccuggaccaugaagauccugaucggcgugaucaucaccuggaucgggaugaacagccgcuccacgagccuguccgucagccucgugcuggugggcgucgugacccuguaccucggggcgauggugcaggccgacuccggcugcgucgugagcuggaagaacaaggagcugaagugcggcuccgggaucuucaucaccgacaacgugcacaccuggacggagcaguacaaguuccagcccgagagccccagcaagcuggccuccgccauccagaaggcccacgaggagggcaucugcgggauccggagcgucacccgccucgagaaccugauguggaagcagaucacccccgagcugaaccacauccucuccgagaacgaggugaagcugaccaucaugacgggcgacaucaaggggaucaugcaggcgggcaagcggagccugcgcccgcagcccaccgagcucaaguacuccuggaagaccuggggcaaggccaagaugcugagcaccgagucccacaaccagacguuccugaucgacgggcccgagaccgccgagugcccgaacaccaaccgggccuggaacagccucgagguggaggacuacggcuucggggucuucaccacgaacaucuggcugaagcugcgcgagaagcaggacguguucugcgacuccaagcucaugagcgccgcgaucaaggacaaccgggccgugcacgccgacaugggcuacuggaucgaguccgcccugaacgacaccuggaagauggagaaggccagcuucaucgaggucaaguccugccacuggcccaagagccacacccugugguccaacggcgugcucgagagcgagaugaucauccccaagaacuucgcggggcccgugucccagcacaacuaccgcccgggcuaccacacccagaccgccgggcccuggcaccugggcaagcuggagauggacuucgacuucugcgaggggacgaccgucguggugaccgaggacugcggcaaccggggccccagccuccgcaccacgaccgccagcgggaagcugaucaccgaguggugcugccgguccugcacccugcccccgcuccgcuaccggggcgaggacgggugcugguacggcauggagauccgcccccugaaggagaaggaggagaaccuggucaacagccucgugacggccgggcacggccagaucgacaacuucucccugggcgugcuggggaucgcccucuuccuggaggagaugcugcggacccgcgucggcaccaagcacgccauccuccugguggccaucagcuucgugacccugaucacggggaacauguccuuccgggaccucggccgcgucauggugauggugggggccaccaugaccgacgacaucggcaugggcgucaccuaccuggcccugcucgcggccuucaaggugcgccccacguucgccgccgggcugcugcuccggcgccugaccagcaaggagcugaugauggccaccaucggcaucgcgcuccugucccagagcaccauccccgagacgauccuggagcucaccgacgcccuggcccuggggaugauggugcucaagaucguccggaacauggagaaguaccagcuggccgugaccaucauggccaucuccugcgugccgaacgcggucauccugcucaacgccuggaaggugagcugcaccauccuggccgccguguccgucagcccccugcuccugacguccagccagcagaaggcggacuggaucccccuggcccucaccaucaagggccugaaccccaccgccaucuuccugaccacgcucucccgcaccagcaagaagcgguccuggccgcugaacgaggccgugauggccgucggcauggugagcauccuggcguccagccuccugaagaacgacauccccaugaccgggccccugguggccggcgggcuccugaccgucugcuacgugcugacgggccgcagcgccgaccucgagcuggagcgggccgccgacgugaagugggaggaccacgcggagaucuccgggagcucccccauccugagcaucaccaucuccgaggacggcagcauguccaucaagaacgaggaggaggagcagacccucaccauccugauccgcacgggccugcucgucaucagcgggguguucccgguguccauccccaucaccgccgccgccugguaccugugggaggucaagaagcagcgggccggcgugcugugggacgugcccagcccgccgcccgucgagaaggcggagcucgaggacggggccuaccgcaucaagcagcggggcauccugggguacucccagaucggcgccggcguguacaaggaggggaccuuccacaccauguggcacgugacccgcggcgccguccugaugcaccgggggaagcgcaucgagcccagcugggccgacgugaagaaggaccucaucuccuacggcgggggcuggaagcuggagggcgaguggaaggagggggaggaggugcagguccuggcgcucgagcccggcaagaacccccgggccgugcagacgaagcccgggcuguucaagaccaacaccggcaccaucggggccgugagccuggacuucucccccggcacgagcggcucccccaucgucgaccgcaaggggaagguggugggccucuacgggaacggcgucgugacccggagcggcgccuacguguccgcgaucgcccagaccgagaaguccaucgagaacaaccccgagaucgaggacgacaucuuccgcaagaagcggcugaccaucauggaccugcaccccggggccggcaagacgaagcgcuaccugcccgccaucguccgggaggccaucaagcgcgggcuccgcacccugauccuggcgccgacccgggugguggccgccgagauggaggaggcccuccgcggccugcccauccgguaccagacccccgccauccgcgcggagcacacggggcgggagaucgucgaccugaugugccacgccaccuucaccaugcgccuccugagccccgugcgggugccgaacuacaaccugaucaucauggacgaggcccacuucaccgaccccgccuccaucgccgcgcgcggcuacaucagcacgcgggucgagaugggcgaggccgccgggaucuucaugaccgccacgccgcccggcucccgcgacccguucccccagagcaacgcgcccaucauggacgaggagcgggagauccccgagcgcuccuggaacagcgggcacgagugggugaccgacuucaagggcaagacggugugguucgucccguccaucaaggccgggaacgacaucgccgccugccuccggaagaacggcaagaaggugauccagcugagccgcaagaccuucgacuccgaguacgugaagacccgggccaacgacugggacuucgucgugaccacggacaucagcgagaugggcgcgaacuuccgcgccgagcgggugaucgacccccgccggugcaugaagcccgucauccugaccgacggggaggagcgcgugauccucgccggccccaugccggugacccacuccagcgccgcccagcgccgggggcgcaucggccggaaccccaagaacgagaacgaccaguacaucuacaugggggagccccuggagaacgacgaggacugcgcgcacuggaaggaggccaagaugcugcucgacaacaucaacacccccgagggcaucaucccguccauguucgagcccgagcgcgagaaggucgacgccaucgacggcgaguaccggcugcgcggggaggcccggaagacguucguggaccugaugcgccggggcgaccuccccguguggcuggccuaccgcgucgcggccgaggggaucaacuacgccgaccggcgcuggugcuucgacggcaucaagaacaaccagauccuggaggagaacguggagguggagaucuggaccaaggagggggagcggaagaagcucaagccgcgcuggcuggacgcccggaucuacagcgacccccuggcgcucaaggaguucaaggaguucgccgccggccgcaagucccugacccugaaccucaucaccgagaugggccggcugcccacguucaugacccagaaggcccgcgacgcccuggacaaccucagcguccugcacaccgcggaggccgggggccgggccuacaaccacgcccuguccgagcuccccgagacccuggagacgcugcuccugcugacccuccuggccaccgugaccgggggcaucuuccuguuccucaugagcggcaaggggaucggcaagaugacgcuggggaugugcugcaucaucaccgcguccauccugcucugguacgcccagauccagccgcacuggaucgccgccagcaucauccuggaguucuuccugaucguccuccugauccccgagcccgagaagcagcgcacgccccaggacaaccagcugaccuacguggugaucgccauccucaccgucguggcggccacgauggccaacgagaugggcuuccuggagaagaccaagaaggaccuggggcucggcagcaucaccacccaggagccggaguccaacauccuggacaucgaccugcggcccgccagcgccuggacgcucuacgcgguggccaccaccuucgucacccccaugcugcgccacuccaucgagaacagcuccgugaacgugagccugacggccaucgccaaccaggcgaccguccucaugggccuggggaagggcuggccccuguccaagauggacaucggggugccgcuccuggccaucggcugcuacagccaggugaaccccaucacccugaccgccgcccuccugcugcucgucgcccacuacgcgaucaucgggcccggccugcaggccaaggccacgcgcgaggcccagaagcgggccgcggccggcaucaugaagaaccccaccguggacgggaucaccgugaucgaccuggagccgauccccuacgaccccaaguucgagaagcagcucggccaggucaugcugcugauccucugcgugacccaggugcugaugaugcgcacgaccugggcccugugcgaggcccucacccuggccaccgggcccaucuccacgcugugggagggcaacccggggcgguucuggaacaccaccaucgcggucagcauggccaacaucuuccgcggcuccuaccucgccggcgccgggcugcuguucagcaucaugaagaacaccacgaacacccggcgcggcaccgggaacaucggcgagacccucggcgagaaguggaagucccggcugaacgcgcugggcaagagcgaguuccagaucuacaagaaguccggcauccaggagguggaccgcacgcucgccaaggaggggaucaagcggggcgagaccgaccaccacgccgugagccgcggguccgccaagcugcggugguucgucgagcgcaacauggugacccccgagggcaagguggucgaccugggcugcgggcggggcggguggagcuacuacugcggcgggcucaagaacgugcgcgaggugaagggccugaccaagggcgggcccggccacgaggagcccaucccgauguccacguacggguggaaccugguccggcuccagagcggcguggacguguucuucacgccgcccgagaagugcgacacccugcugugcgacaucggggagagcucccccaacccgaccaucgaggccggccgcacgcuccggguccugaaccugguggagaacuggcucaacaacaacacccaguucugcaucaaggugcugaaccccuacaugcccagcgucaucgagaagauggagacccugcagcgcaaguacggcggggcgcuggugcggaacccgcucucccgcaacagcacccacgagauguacuggguguccaacgccaccggcaacaucgucagcuccgugaacaugaucagccgcaugcugaucaaccgguucacgaugaagcacaagaaggccaccuacgagcccgacguggaccugggguccggcacccgcaacaucgggaucgagagcgagauccccaaccucgacaucaucggcaagcggaucgagaagaucaagcaggagcacgagaccuccuggcacuacgaccaggaccaccccuacaagacgugggccuaccacggcagcuacgagaccaagcagaccggguccgccagcuccauggucaacggcguggugcgccugcugaccaagccgugggacgucgugcccauggugacgcagauggcgaugaccgacaccacccccuucgggcagcagcgggucuucaaggagaagguggacacgcgcacccaggagcccaaggagggcaccaagaagcucaugaagaucaccgccgaguggcuguggaaggagcugggcaagaagaagacgccgcggaugugcacccgcgaggaguucacccggaaggugcgcagcaacgccgcccucggggccaucuucaccgacgagaacaaguggaaguccgcgcgggaggccgucgaggacagccgcuucugggagcugguggaccgggagcgcaaccugcaccucgagggcaagugcgagacgugcguguacaacaugauggggaagcgggagaagaagcugggcgaguucgggaaggccaagggcucccgcgccaucugguacauguggcugggcgcgcgguuccucgaguucgaggcccugggguuccugaacgaggaccacugguucagccgcggcaacagccucuccggggucgagggcgaggggcugcaccggcugggcuacauccuccgcgacgugagcaagaaggagggcggggccauguacgccgacgacaccgccggcugggacacccggaucacccuggaggaccugaagaacgaggagauggucacgaaccacaugaagggggagcacaagaagcucgcggaggccaucuucaagcugaccuaccagaacaagguggugcgcguccagcgccccacgccccggggcaccgugauggacaucaucucccgccgggaccagcgcgggagcggccaggugggcacguacgggcugaacaccuucaccaacauggaggcccagcucauccggcagauggagggcgaggggaucuucaaguccauccagcaccugaccgucacggaggagaucgccgugcagaacuggcuggcccgcgugggccgggagcgccucagccggauggcgaucuccggcgacgacugcgucgugaagccccuggacgaccgcuucgccagcgcccugaccgcccucaacgacauggggaaggugcggaaggacauccagcagugggagccgucccgcggcuggaacgacuggacccagguccccuucugcagccaccacuuccacgagcuggugaugaaggacgggcgggugcuggucgugcccugccgcaaccaggacgagcucaucggccgggcccgcaucucccagggggcgggcuggagccugaaggagaccgccugccugggcaaguccuacgcccagauguggacgcucauguacuuccaccggcgcgaccugcggcuggccgccaacgcgaucugcagcgccgugcccucccacugggucccgaccagccgcaccaccugguccauccacgccaagcacgaguggaugaccacggaggacaugcucgccguguggaaccgcguguggauccaggagaaccccuggauggaggacaagacccccgucgagagcugggaggaggugcccuaccuggggaagcgggaggaccaguggugcggcagccugaucgggcucaccucccgcgcgaccugggccaagaacauccagacggccaucaaccaggugcggagccugaucggcaacgaggaguacaccgacuacaugccguccaugaagcgcuuccggcgcgaggaggaggaggccgggguccugugguga

SEQ ID NO: 9120 - RNA, 9876 nt, Artificial Sequence
  derived and/or modified CDS sequence (opt1) from DENV-2__GQ868553__SS-prME
accgcgggcgugaucgucaugcugauccccaccgccauggcguuccaccucaccacccgcaacggggagccccacaugaucgugggccggcaggagaaggggaagucccugcuguucaagaccgaggacggcgugaacaugugcacccucauggccaucgaccugggggagcugugcgaggacaccaucaccuacaagugcccccuccugcgccagaacgagcccgaggacaucgacugcuggugcaacagcaccagcaccugggucaccuacgggaccugcaccaccacgggcgagcaccggcgcgagaagcgguccguggcccuggugccccacgucgggaugggccucgagacccgcaccgagaccuggaugagcuccgagggggccuggaagcacgugcagcggaucgagacguggauccugcgccacccgggcuucaccaucauggccgcgauccuggccuacaccaucgggaccacgcacuuccagcgggcccucaucuucauccugcugaccgccguggcgcccagcaugaccaugcgcugcaucggcaucuccaaccgggacuucgucgagggcgugagcgggggcuccuggguggacaucguccucgagcacgggagcugcgugaccacgauggccaagaacaagcccacccuggacuucgagcugaucaagaccgaggccaagcagcccgccacccuccgcaaguacugcaucgaggccaagcugacgaacaccaccaccgagucccggugcccgacgcagggcgagcccagccugaacgaggagcaggacaagcgcuucaucugcaagcacuccaugguggaccggggcugggggaacggcugcgggcuguucggcaagggcgggaucgugaccugcgcgauguucacgugcaagaagaacauggagggcaagguggugcagcccgagaaccuggaguacaccaucgucaucacgccccacagcggggaggagcacgccgugggcaacgacaccgggaagcacggcaaggagaucaagaucaccccgcaguccagcaucaccgaggccgagcugaccggguacggcacggugaccauggagugcagcccccgcaccggccucgacuucaacgagaugguccugcugcagauggaggacaaggccuggcucgugcaccggcagugguuccuggaccugccccuccccuggcugccgggggccgacacccagggcagcaacuggauccagaaggagacgcuggugaccuucaagaacccccacgcgaagaagcaggacgucgugguccucgggucccaggagggcgccaugcacaccgcccugaccggggccacggagauccagaugagcagcggcaaccuccuguucaccggccaccugaagugccgccugcggauggacaagcuccagcugaaggggauguccuacagcaugugcaccggcaaguucaagaucgugaaggagaucgccgagacccagcacgggacgaucgugauccgcguccaguacgagggcgacggcucccccugcaagauccccuucgagaucaccgaccuggagaagcggcacgugcucgggcgccugaucaccgugaacccgaucgucaccgagaaggacagccccgugaacaucgaggcggagccgcccuucggcgacuccuacaucaucaucgggguggagccgggccagcugaagcucaacugguucaagaaggggagcuccaucggccagauguucgagacgaccaugcgcggcgccaagcggauggccauccugggggacaccgccugggacuucggcagccucggcggggucuucaccuccaucgggaaggcccuccaccagguguucggggcgaucuacggcgccgccuucagcgggguguccuggacgaugaagauccugaucggcgucaucaucaccuggaucgggaugaacagccgcuccaccagccuguccgugagccuggugcucgucggcguggugacccuguaccugggggccaugguccaggcggacuccggcugcguggugagcuggaagaacaaggagcucaagugcggcuccgggaucuucaucacggacaacguccacaccuggaccgagcaguacaaguuccagcccgagagccccagcaagcuggccuccgccauccagaaggcccacgaggagggcaucugcgggauccggagcgugacccgccuggagaaccucauguggaagcaggucacgcccgagcugaaccacauccuguccgagaacgaggucaagcucaccaucaugaccggcgacaucaaggggaucaugcaggccggcaagcggagccugcgcccgcagcccaccgagcugaaguacuccuggaagacguggggcaaggcgaagaugcucagcaccgagucccacaaccagaccuuccugaucgacgggcccgagaccgccgagugcccgaacacgaaccgggccuggaacagccuggagguggaggacuacggcuucgggguguucaccaccaacaucuggcucaagcugcgcgagaagcaggacgucuucugcgacuccaagcugaugagcgccgccaucaaggacaaccgggcggugcacgccgacaugggcuacuggaucgaguccgcccucaacgacaccuggaagauggagaaggccagcuucaucgaggugaaguccugccacuggcccaagagccacacccugugguccaacggcguccuggagagcgagaugaucauccccaagaacuucgccgggcccgugucccagcacaacuaccgcccgggcuaccacacgcagaccguggggcccuggcaccucggcaagcuggagauggacuucgacuucugcgaggggaccaccgucguggugacggaggacugcggcaaccggggccccagccugcgcaccaccaccgcgagcgggaagcucaucacggaguggugcugccgguccugcacccugcccccgcugcgcuaccggggcgaggacgggugcugguacggcauggagauccgcccccucaaggagaaggaggagaaccuggucaacagccuggugaccgccgggcacggccagaucgacaacuucucccucggcgugcuggggauggcccuguuccucgaggagaugcugcggacccgcgucggcacgaagcacgccauccugcucguggcggugagcuucgucacccugaucaccgggaacauguccuuccgggaccugggccgcgugauggugauggucggggccaccaugacggacgacaucggcaugggcgugaccuaccucgcccugcuggccgccuucaaggugcgccccaccuucgcggccgggcuccugcugcggaagcucaccagcaaggagcugaugauggccacgaucggcaucgcccugcucucccagagcaccauccccgagaccaucuucgagcugaccgacgcccuggcgcucgggaugaugguccugaagaucgugcgcaacauggagaaguaccagcuggccgugacgaucauggccaucuccugcgucccgaacgccgugauccuccagaacgccuggaaggucagcugcaccauccuggcggccguguccgugagcccccugcuccugaccuccagccagcagaaggccgacuggaucccccuggcccucaccaucaagggccugaaccccacggcgaucuuccugaccacccucucccggaccagcaagaagcgcuccuggccgcugaacgaggccaucauggccgucggcauggugagcauccuggccuccagccuccugaagaacgacauccccaugacggggccccugguggccggcgggcuccugaccgucugcuacgugcugaccggccggagcgcggaccucgagcuggagcgcgccgccgacgugaagugggaggaccaggccgagaucuccgggagcucccccauccugagcaucaccaucuccgaggacggcagcauguccaucaagaacgaggaggaggagcagauccucacgauccugauccggaccggccugcucgucaucagcgggguguucccgguguccauccccaucaccgccgcggccugguaccugugggaggucaagaagcagcgcgccggcgugcugugggacgugcccagcccgccgcccgucgagaaggccgagcucgaggacggggccuaccggaucaagcagcgcggcauccugggguacucccagaucggcgcgggcguguacaaggaggggaccuuccacaccauguggcacgugacgcggggcgccguccugaugcaccgcgggaagcggaucgagcccagcugggccgacgugaagaaggaccucaucuccuacggcgggggcuggaagcuggagggcgaguggaaggagggggaggaggugcagguccuggcccucgagcccggcaagaacccccgcgccgugcagaccaagcccgggaucuuccggaccaacaccggcacgaucggggcggugagccuggacuucucccccggcaccagcggcucccccaucgucgaccgcaaggggaagguggugggccuguacgggaacggcgucgugacccggagcggcgccuacguguccgccaucgcccagaccgagaaguccaucgaggacaaccccgagaucgaggacgacaucuuccgcaagaagcggcucacgaucauggaccugcaccccggggcgggcaagaccaagcgcuaccugcccgccaucguccgggaggccaucaagcgcgggcuccgcacccugauccuggccccgacccgggugguggccgcggagauggaggaggcccugcgcggccuccccauccgguaccagacgcccgccaucaaggccgagcacaccgggcgcgagaucgucgaccugaugugccacgccaccuucaccaugcggcugcucagccccgugcgcgugccgaacuacaaccugaucaucauggacgaggcgcacuucacggaccccgccuccaucgccgcccggggcuacaucagcacccgcgucgagaugggcgaggccgcggggaucuucaugaccgccacgccgcccggcucccgggacccguucccccagagcaacgcccccaucauggacgaggagcgcgagauccccgagcgguccuggaacagcgggcacgagugggugacggacuucaagggcaagaccgugugguucgucccguccaucaaggccgggaacgacaucgcggccugccugcgcaagaacggcaagaaggugauccagcucagccggaagaccuucgacuccgaguacgugaagacccgcgccaacgacugggacuucgucgugacgaccgacaucagcgagaugggcgccaacuucaaggccgagcgggugaucgacccccgccggugcaugaagcccgucauccugaccgacggggaggagcgcgugauccuggcgggccccaugccggugacccacuccagcgccgcccagcggcgcgggcgcaucggccggaaccccaagaacgagaacgaccaguacaucuacaugggggagccccucgagaacgacgaggacugcgcccacuggaaggaggccaagaugcugcuggacaacaucaacacgcccgagggcaucaucccguccauguucgagcccgagcgcgagaaggucgacgcgaucgacggcgaguaccggcuccgcggggaggcccggaagaccuucguggaccugaugcgccggggcgaccugcccguguggcucgccuacaaggucgccgccgaggggaucaacuacgcggaccgcaaguggugcuucgacggcaucaagaacaaccagauccuggaggagaacguggaggucgagaucuggaccaaggagggggagcggaagaagcugaagccgcgcuggcucgacgcccggaucuacagcgacccccuggcccugaaggaguucaaggaguucgccgcgggccgcaagucccucacccugaaccugaucacggagaugggccggcuccccaccuucaugacccagaaggcccgcaacgcccuggacaaccuggccgugcuccacaccgccgaggccgggggccgggccuacaaccacgcccugagcgagcugcccgagacgcucgagacccugcugcuccugacccugcucgccaccgugaccgggggcaucuuccuguuccugauguccggcaaggggaucggcaagaugacccucgggaugugcugcaucaucaccgccagcauccugcugugguacgcgcagauccagccgcacuggaucgccgccuccaucauccucgaguucuuccugaucguccugcucauccccgagcccgagaagcagcgcacgccccaggacaaccagcugaccuacguggugaucgccauccugacggucguggccgcgaccauggccaacgagaugggcuuccucgagaagaccaagaaggaccuggggcugggcagcaucaccacgcaggagagcgaguccaacauccucgacaucgaccugcggccggccagcgccuggacccuguacgccguggcgaccaccuucgucacgcccaugcuccgccacuccaucgagaacagcuccgugaacgugagccugaccgccaucgccaaccaggccaccguccugaugggccucgggaagggcuggccccuguccaagauggacaucggggugccccugcucgcgaucggcugcuacagccaggugaacccgaucacccugacggccgcccugcuccugcuggucgcccacuacgccaucaucgggcccggccuccaggcgaaggccacccgggaggcccagaagcgcgccgccgcgggcaucaugaagaaccccaccguggacgggaucaccgugaucgaccuggagcccaucccguacgaccccaaguucgagaagcagcugggccaggucaugcuccugauccugugcgugacccaggugcucaugaugcggaccaccugggcccugugcgaggcccugacccucgccacggggcccaucuccacccugugggagggcaaccccgggcgcuucuggaacaccaccaucgccgucagcauggcgaacaucuuccgcggcuccuaccuggccggcgccgggcuccuguucagcaucaugaagaacacgaccaacacccggcgcggcaccgggaacaucggcgagacgcugggcgagaaguggaagucccggcucaacgcccugggcaagagcgaguuccagaucuacaagaaguccggcauccaggagguggaccgcacccuggcgaaggaggggaucaagcggggcgagaccgaccaccacgccgugagccgcggguccgccaagcuccggugguucgucgagcgcaacauggugaccccggagggcaagguggucgaccugggcugcgggcggggcggguggagcuacuacugcggcgggcugaagaacgugcgcgaggugaagggccucacgaagggcgggcccggccacgaggagcccauccccauguccaccuacggguggaaccugguccggcugcagagcggcguggacguguucuucaccccgcccgagaagugcgacacccuccugugcgacaucggggagagcucccccaaccccacgaucgaggccggccgcacccugcggguccucaaccugguggagaacuggcugaacaacaacacccaguucugcaucaaggugcucaacccguacaugcccagcgucaucgagaagauggagacccugcagcgcaaguacggcggggcccuggugcggaacccccucucccgcaacagcacccacgagauguacuggguguccaacgcgacgggcaacaucgucagcuccgugaacaugaucagccggaugcugaucaaccgcuucaccaugaagcacaagaaggccaccuacgagccggacguggaccugggguccggcacccggaacaucgggaucgagagcgagauccccaaccuggacaucaucggcaagcgcaucgagaagaucaagcaggagcacgagacguccuggcacuacgaccaggaccaccccuacaagaccugggccuaccacggcagcuacgagaccaagcagaccggguccgccagcuccauggucaacggcguggugcgccuccugacgaagcccugggacgucgugccgauggugacccagauggccaugaccgacaccacgcccuucgggcagcagcgggucuucaaggagaagguggacacccgcacccaggagcccaaggagggcaccaagaagcugaugaagaucacggcggaguggcucuggaaggagcugggcaagaagaagacgccccggaugugcacccgcgaggaguucacccggaaggugcgcagcaacgccgcccugggggccaucuucacggacgagaacaaguggaaguccgcccgggaggcggucgaggacggccgcuucugggagcucguggaccgggagcgcaaccugcaccuggaggggaagugcgagaccugcgucuacaacaugaugggcaagcgggagaagaagcucggggaguucggcaaggccaagggcagccgcgccaucugguacauguggcugggggcccgguuccuggaguucgaggcgcucggcuuccugaacgaggaccacugguucucccgcgggaacagccugagcggcguggagggggagggccuccaccggcugggcuacauccugcgcgacguggggaagaaggagggcggggccauguacgccgacgacaccgccggcugggacacccggaucacgcucgaggaccugaagaacgaggagauggucaccaaccacaugaagggggagcacaagaagcuggccgaggcgaucuucaagcucaccuaccagaacaagguggugcgcguccagcggccgacgccccgcggcacggugauggacaucaucucccggcgcgaccagcgcggcagcggccaggugggcaccuacgggcugaacaccuucaccaacauggaggcccagcugauccggcagauggagggcgagggcaucuucaaguccauccagcaccucacggccaccgaggagaucgccgcccagaacuggcuggcgcgcgucgggcgggagcgccugagccggauggccaucuccggcgacgacugcguggugaagcccaucgacgaccgcuucgccagcgcccucaccgcccugaacgacauggggaagguccggaaggacauccagcagugggagcccucccgcggcuggaacgacuggacccaggugccguucugcagccaccacuuccacgagcuggugaugaaggacgggcggguccucguggugcccugccgcaaccaggacgagcugaucggccgggcgcgcaucucccagggcgccggguggagccugaaggagacggccugccucggcaaguccuacgcccagauguggacccugauguacuuccaccggcgcgaccugcggcucgccgcgaacgccaucugcagcgccguccccucccacugggugcccaccagccgcaccaccugguccauccacgccaagcacgaguggaugacgaccgaggacaugcuggcgguguggaaccgggucuggauccaggagaacccguggauggaggacaagacccccguggagagcugggaggaggugcccuaccuggggaagcgcgaggaccaguggugcggcucccucaucgggcugaccagccgggccacgugggccaagaacauccagaccgccaucaaccagguccgcagccugaucggcaacgaggaguacaccgacuacaugcccuccaugaagcgcuuccggcgcgaggaggaggaggccggcgugcucugguga

SEQ ID NO: 9121 - RNA, 9876 nt, Artificial Sequence
  derived and/or modified CDS sequence (opt1) from DENV-2__GQ868554__SS-prME
accgccggcgugaucgucaugcugauccccaccgccauggcguuccaccucaccacccgcaacggggagccccacaugaucgugggccggcaggagaaggggaagucccugcuguucaagaccgaggacggcgugaacaugugcacccucauggccaucgaccugggggagcugugcgaggacaccaucaccuacaagugcccccuccugcggcagaacgagcccgaggacaucgacugcuggugcaacagcaccagcaccugggucaccuacgggaccugcaccaccacgggcgagcaccggcgcgagaagcgguccguggcccuggugccccacgucgggaugggccucgagacccgcaccgagaccuggaugagcuccgagggggccuggaagcacgugcagcggaucgagaccuggauccugcgccacccgggcuucaccaucauggccgcgauccuggccuacaccaucgggaccacgcacuuccagcgggcccucaucuucauccugcugaccgccguggcgcccagcaugaccaugcgcugcaucggcaucuccaaccgggacuucgucgagggcgugagcgggggcuccuggguggacaucguccucgagcacgggagcugcgugaccacgauggccaagaacaagcccacccuggacuucgagcugaucaagaccgaggccaagcagcccgccacccuccgcaaguacugcaucgaggccaagcugacgaacaccaccaccgagucccggugcccgacgcagggcgagcccagccugaacgaggagcaggacaagcgcuucaucugcaagcacuccaugguggaccggggcugggggaacggcugcgggcuguucggcaagggcgggaucgugaccugcgcgauguucacgugcaagaagaacauggagggcaagguggugcagcccgagaaccuggaguacaccaucgucaucacgccccacagcggggaggagcacgccgugggcaacgacaccgggaagcacggcaaggagaucaagaucaccccgcaguccagcaucaccgaggccgagcugaccggguacggcacggugaccauggagugcagcccccggaccggccucgacuucaacgagaugguccugcugcagauggaggacaaggccuggcucgugcaccggcagugguuccuggaccugccccuccccuggcugccgggggccgacacccagggcagcaacuggauccagaaggagacgcuggugaccuucaagaacccccacgcgaagaagcaggacgucgugguccucgggucccaggagggcgccaugcacaccgcccugaccggggccacggagauccagaugagcagcggcaaccuccuguucaccggccaccugaagugccgccugcggauggacaagcuccagcugaaggggauguccuacagcaugugcaccggcaaguucaagaucgugaaggagaucgccgagacccagcacgggacgaucgugauccgcguccaguacgagggcgacggcucccccugcaagauccccuucgagaucaccgaccuggagaagcggcacgugcucgggcgccugaucaccgugaacccgaucgucaucgagaaggacagccccgugaacaucgaggcggagccgcccuucggcgacuccuacaucaucaucgggguggagccgggccagcugaagcucaacugguucaagaaggggagcuccaucggccagauguucgagaccacgaugcgcggcgccaagcggauggccauccugggggacaccgccugggacuucggcagccucggcggggucuucaccuccaucgggaaggcccuccaccagguguucggggcgaucuacggcgccgccuucagcgggguguccuggaccaugaagauccugaucggcgucgugaucacguggaucgggaugaacagccgcuccaccagccuguccgugagccugguccucgugggcguggucacccuguaccugggggccauggugcaggcggacuccggcugcguggucagcuggaagaacaaggagcucaagugcggcuccgggaucuucaucaccgacaacgugcacacguggaccgagcaguacaaguuccagcccgagagccccagcaagcuggccuccgccauccagaaggcccacgaggagggcaucugcgggauccggagcgugacccgccuggagaaccucauguggaagcagaucacccccgagcugaaccacauccuguccgagaacgaggucaagcucacgaucaugaccggcgacaccaaggggaucaugcaggccggcaagcggagccugcgcccgcagcccaccgagcugaaguacuccuggaagacguggggcaaggcgaagaugcucagcaccgagucccacaaccagaccuuccugaucgacgggcccgagaccguggagugcccgaacacgaaccgggccuggaacagccuggagguggaggacuacggcuucggggucuucaccaccaacaucuggcucaagcugcgcgagaagcaggacguguucugcgacuccaagcugaugagcgccgccaucaaggacaaccgggccgugcacgcggacaugggcuacuggaucgaguccgcccucaacgacaccuggaagauggagaaggccagcuucaucgaggucaaguccugccacuggcccaagagccacacccugugguccaacggcgugcuggagagcgagaugaucauccccaagaacuucgccgggcccgugucccagcacaacuaccgcccgggcuaccacacgcagaccgccgggcccuggcaccucggcaagcuggagauggacuucgacuucugcgaggggaccaccgucguggugacggaggacugcggcaaccggggccccagccugcgcaccaccaccgcgagcgggaagcucaucacggaguggugcugccgguccugcacccugcccccgcugcgcuaccggggcgaggacgggugcugguacggcauggagauccgcccccucaaggagaaggaggagaaccuggucaacagccuggugaccgccgggcacggccagaucgacaacuucucccucggcgugcuggggauggcccuguuccucgaggagaugcugcggacccgcgucggcacgaagcacgccauccugcucguggcggugagcuucgucacccugaucaccgggaacauguccuuccgggaccugggccgcgugauggugauggucggggccaccaugacggacgacaucggcaugggcgugaccuaccucgcccugcuggccgccuucaaggugcgccccaccuucgcggccgggcuccugcugcggaagcucaccagcaaggagcugaugauggccacgaucggcaucacccugcucucccagagcaccauccccgagaccauccuggagcugacggacgcccucgcccuggggaugaugguccugaagaucgugcgcaacauggagaaguaccagcucgcggugaccaucauggccaucuccugcgucccgaacgccgugauccugcggaacgccuggaaggucagcugcaccauccuggccgcgguguccgugagcccccuccugcugaccuccagccagcagaaggccgacuggaucccccucgcccugacgaucaagggccugaaccccaccgccaucuuccucaccacccugucccgcacgagcaagaagcgguccuggccgcugaacgaggcgaucauggccgucggcauggugagcauccucgccuccagccugcugaagaacgacauccccaugaccgggccccucguggccggcgggcugcugaccgucugcuacgugcucaccggccgcagcgccgaccuggagcuggagcgggcggccgacgugaagugggaggaccaggccgagaucuccgggagcucccccauccucagcaucacgaucuccgaggacggcagcauguccaucaagaacgaggaggaggagcagacccugaccauccugauccgcaccggccuccuggucaucagcgggguguucccgguguccauccccaucaccgccgccgcgugguaccugugggaggucaagaagcagcgggccggcgugcucugggacgugcccagcccgccgcccgucgggaaggccgagcuggaggacggcgccuaccgcaucaagcagcgggggauccugggcuacucccagaucggcgccgggguguacaaggagggcacguuccacaccauguggcacgugacccgcggggcgguccucaugcaccggggcaagcgcaucgagcccagcugggccgacgugaagaaggaccugaucuccuacgggggcggcuggaagcuggagggggaguggaaggagggcgaggaggugcagguccucgcccuggagcccgggaagaacccccgggccgugcagaccaagcccggcaucuucaagacgaacaccgggaccaucggcgccgugagccuggacuucucccccggcaccagcgggucccccaucgucgaccgcaagggcaaggugguggggcucuacggcaacggcgucgugacgcggagcggggcguacguguccgccaucgcccagaccgagaaguccaucgaggacaaccccgagaucgaggacgacaucuuccgcaagaagcggcugaccaucauggaccugcaccccggcgccgggaagaccaagcgcuaccuccccgcgaucguccgggaggccaucaagcgcggccugcgcacgcugauccuggccccgacccgggugguggccgccgagauggaggaggcgcuccgcgggcugcccauccgguaccagacccccgccaucaaggccgagcacaccggccgcgagaucgucgaccugaugugccacgccacguucaccaugcggcuccugagccccgugcgcgugccgaacuacaaccugaucaucauggacgaggcccacuucaccgaccccgcguccaucgccgcccggggcuacaucagcacccgcgucgagaugggggaggccgccggcaucuucaugacggcgacgccgcccgggucccgggacccguucccccagagcaacgcccccaucauggacgaggagcgcgagauccccgagcgguccuggaacagcggccacgagugggugaccgacuucaaggggaagaccgugugguucgucccguccaucaaggccggcaacgacaucgccgcgugccuccgcaagaacggcaagaaggugauccagcugagccggaagacguucgacuccgaguacgugaagacccgcgccaacgacugggacuucgucgugaccaccgacaucagcgagaugggggccaacuucaaggccgagcgggugaucgacccccgccggugcaugaagcccgucauccugacggacggcgaggagcgcgugauccucgccgggcccaugccggugacccacuccagcgcggcccagcggcgcggccgcaucgggcggaaccccaagaacgagaacgaccaguacaucuacaugggcgagccccuggagaacgacgaggacugcgcccacuggaaggaggccaagaugcugcucgacaacaucaacacccccgagggcaucaucccguccauguucgagcccgagcgcgagaaggucgacgccaucgacggggaguaccggcugcgcggcgaggcgcggaagaccuucguggaccugaugcgccgcggggaccuccccguguggcuggccuacaaggucgccgccgagggcaucaacuacgccgaccgcaaguggugcuucgacgggaucaagaacaaccagauccuggaggagaacguggaggucgagaucuggacgaaggagggcgagcggaagaagcucaagccgcgcuggcuggacgcgcggaucuacagcgacccccuggcccucaaggaguucaaggaguucgccgccggccgcaagucccugacccugaaccucaucaccgagauggggcggcugcccaccuucaugacgcagaaggcgcgcaacgcccuggacaaccucgccgugcugcacaccgccgaggccggcgggcgggcguacaaccacgcccugagcgagcuccccgagacccuggagacccugcuccugcugacgcuccuggccaccgugaccggcggcaucuuccuguuccucauguccgggaagggcaucgggaagaugacccugggcaugugcugcaucaucaccgccagcguccugcucugguacgcccagauccagccgcacuggaucgcggccuccaucauccuggaguucuuccugaucgugcuccugauccccgagcccgagaagcagcgcacgccccaggacaaccagcugaccuacguggucaucgccauccucaccgugguggccgccaccauggcgaacgagaugggguuccuggagaagacgaagaaggaccugggccucggcagcaucaccacccaggagagcgaguccaacauccuggacaucgaccugcggccggccagcgccuggacccucuacgccgucgccacgaccuucgugacccccaugcugcgccacuccaucgagaacagcuccgugaacgucagccugaccgcgaucgccaaccaggccacggugcucauggggcugggcaagggguggccccuguccaagauggacaucggcgugccccuccuggccaucgggugcuacagccaggucaacccgaucacccugaccgcggcccuccugcugcucguggcccacuacgccaucaucggccccggccugcaggccaaggcgacccgggaggcccagaagcgcgccgccgccgggaucaugaagaaccccacgguggacggcaucaccgucaucgaccuggagcccaucccguacgaccccaaguucgagaagcagcucgggcaggucaugcugcugauccucugcgugacccagguccugaugaugcggaccacgugggcgcugugcgaggcccucacccuggccaccggccccaucuccacccugugggaggggaaccccggccgcuucuggaacacgaccaucgccgugagcauggccaacaucuuccgcggcuccuaccucgcgggggccggccugcuguucagcaucaugaagaacaccaccaacacgcggcgcgggaccggcaacaucggcgagacccucggggagaaguggaagucccggcugaacgcccugggcaagagcgaguuccagaucuacaagaaguccgggauccaggagguggaccgcacccucgccaaggagggcaucaagcgcggggagacggaccaccacgcggucagccgcggcuccgccaagcugcggugguucguggagcgcaacauggugaccccggagggcaaggucguggaccuggggugcggccgcgggggcuggagcuacuacugcgggggccucaagaacgugcgcgaggucaagggccugaccaagggcggccccgggcacgaggagcccauccccauguccaccuacggcuggaaccuggugcggcuccagagcgggguggacgucuucuucacgccgcccgagaagugcgacacccugcugugcgacaucggcgagagcucccccaaccccaccaucgaggccggccgcacccuccgggugcugaaccugguggagaacuggcucaacaacaacacccaguucugcaucaagguccugaacccguacaugcccagcgugaucgagaagauggagacgcugcagcgcaaguacgggggcgcccucgugcggaacccccugucccgcaacagcacccacgagauguacugggucuccaacgccaccgggaacaucgugagcuccgugaacaugaucagccggaugcugaucaaccgcuucaccaugaagcacaagaaggcgacguacgagccggacgucgaccugggcuccgggacccggaacaucggcaucgagagcgagauccccaaccucgacaucaucggcaagcgcaucgagaagaucaagcaggagcacgagaccuccuggcacuacgaccaggaccaccccuacaagaccugggccuaccacgggagcuacgagacgaagcagaccggcuccgccagcuccauggugaacggggugguccgccugcugaccaagcccugggacguggugccgauggucacccagauggccaugacggacaccacccccuucggccagcagcggguguucaaggagaagguggacacccgcacgcaggagcccaaggagggcaccaagaagcucaugcggaucaccgccgaguggcuguggaaggagcuggggaagaagaagacgccccggaugugcacgcgggaggaguucacccgcaagguccggagcaacgcggcccucggcgccaucuucaccgacgagaacaaguggaaguccgcccgcgaggccguggaggacgggcgguucugggagcuggucgaccgcgagcggaaccugcaccucgagggcaagugcgagaccugcguguacaacaugauggggaagcgcgagaagaagcugggcgaguucggcaaggcgaaggggagccgggccaucugguacauguggcugggcgcccgcuuccucgaguucgaggcccugggguuccugaacgaggaccacugguucucccggggcaacagccucagcgggguggagggcgagggccugcaccgccugggguacauccuccgggacgucggcaagaaggagggcggcgcgauguacgccgacgacacggccgggugggacacccgcaucacccuggaggaccugaagaacgaggagauggugaccaaccacaugaagggcgagcacaagaagcucgccgaggccaucuucaagcugacguaccagaacaaggugguccgggugcagcgcccgacgccccggggcaccgugauggacaucaucucccgccgcgaccagcgggggagcggccaggucgggaccuacggccugaacacguucaccaacauggaggcgcagcucauccgccagauggagggcgaggggaucuucaaguccauccagcaccugaccgccaccgaggagaucgccgugcagaacuggcuggcccgggugggccgcgagcggcucagccgcauggccaucuccggggacgacugcgucgugaagcccaucgacgaccgguucgcgagcgcccugacggcccugaacgacaugggcaaggugcgcaaggacauccagcagugggagcccucccggggguggaacgacuggacccaggucccguucugcagccaccacuuccacgagcucgugaugaaggacggccgcgugcuggucgugcccugccggaaccaggacgagcugaucggccgcgcccggaucucccagggggccggcuggagccucaaggagaccgcgugccuggggaaguccuacgcccagauguggacccugauguacuuccaccgccgggaccuccgccuggccgccaacgccaucugcagcgcggugcccucccacuggguccccaccagccggacgaccugguccauccacgccaagcacgaguggaugaccaccgaggacaugcuggccguguggaaccgcguguggauccaggagaacccguggauggaggacaagacgcccgucgagagcugggaggaggugcccuaccucggcaagcgggaggaccaguggugcgggucccugaucggccugaccagccgcgccaccugggcgaagaacauccagaccgccaucaaccaggugcgcagccucaucggcaacgaggaguacacggacuacaugcccuccaugaagcgguuccgccgggaggaggaggaggccgggguccugugguga

SEQ ID NO: 9122 - RNA, 9876 nt, Artificial Sequence
  derived and/or modified CDS sequence (opt1) from DENV-2__GQ868555__SS-prME
accgccggcgugaucgucaugcugauccccaccgccaucgcguuccaccucaccacccgcaacggggagccccacaugaucgugggccggcaggagaaggggaagucccugcuguucaagaccgaggacggcgugaacaugugcacccucauggccaucgaccugggggagcugugcgaggacaccaucaccuacaagugcccccuccugcggcagaacgagcccgaggacaucgacugcuggugcaacagcaccagcaccugggucaccuacgggaccugcaccaccacgggcgagcaccggcgcgagaagcgguccguggcccuggugccccacgucgggaugggccucgagacccgcaccgagaccuggaugagcuccgagggggccuggaagcacgugcagcggaucgagaccuggauccugcgccacccgggcuucaccaucauggccgcgauccuggccuacaccaucgggaccacgcacuuccagcgggcccucaucuucauccugcugaccgccguggcgcccagcaugaccaugcgcugcaucggcaucuccaaccgggacuucgucgagggcgugagcgggggcuccuggguggacaucguccucgagcacgggagcugcgugaccacgauggccaagaacaagcccacccuggacuucgagcugaucaagaccgaggccaagcagcccgccacccuccgcaaguacugcaucgaggccaagcugacgaacaccaccaccgagucccggugcccgacgcagggcgagcccagccugaacgaggagcaggacaagcgcuucaucugcaagcacuccaugguggaccggggcugggggaacggcugcgggcuguucggcaagggcgggaucgugaccugcgcgauguucacgugcaagaagaacauggagggcaagguggugcagcccgagaaccuggaguacaccaucgucaucacgccccacagcggggaggagcacgccgugggcaacgacaccgggaagcacggcaaggagaucaagaucaccccgcaguccagcaucaccgaggccgagcugaccggguacggcacggugaccauggagugcagcccccggaccggccucgacuucaacgagaugguccugcugcagauggaggacaaggccuggcucgugcaccggcagugguuccuggaccugccccuccccuggcugccgggggccgacacccagggcagcaacuggauccagaaggagacgcuggugaccuucaagaacccccacgcgaagaagcaggacgucgugguccucgggucccaggagggcgccaugcacaccgcccugaccggggccacggagauccagaugagcagcggcaaccuccuguucaccggccaccugaagugccgccugcggauggacaagcuccagcugaaggggauguccuacagcaugugcaccggcaaguucaagaucgugaaggagaucgccgagacccagcacgggacgaucgugauccgcguccaguacgagggcgacggcucccccugcaagauccccuucgagaucaccgaccuggagaagcggcacgugcucgggcgccugaucaccgugaacccgaucgucaccgagaaggacagccccgugaacaucgaggcggagccgcccuucggcgacuccuacaucaucaucgggguggagccgggccagcugaagcucaacugguucaagaaggggagcuccaucggccagauguucgagacgaccaugcgcggcgccaagcggauggccauccugggggacaccgccugggacuucggcagccucggcggggucuucaccuccaucgggaaggcccuccaccagguguucggggcgaucuacggcgccgccuucagcgggguguccuggacgaugaagauccugaucggcgucgugaucaccuggaucgggaugaacagccgcuccaccagccuguccgugagccugguccucgugggcguggucacccuguaccugggggccauggugcaggcggacuccggcugcguggucagcuggaagaacaaggagcucaagugcggcuccgggaucuucaucacggacaacgugcacaccuggaccgagcaguacaaguuccagcccgagagccccagcaagcuggccuccgccauccagaaggcccacgaggagggcaucugcgggauccggagcgugacccgccuggagaaccucauguggaagcagaucacgcccgagcugaaccacauccuguccgagaacgaggucaagcucaccaucaugaccggcgacaccaaggggaucaugcaggccggcaagcggagccugcgcccgcagcccacggagcugaaguacuccuggaagaccuggggcaaggcgaagaugcucagcaccgagucccacaaccagaccuuccugaucgacgggcccgagacggccgagugcccgaacaccaaccgggccuggaacagccuggagguggaggacuacggcuucgggguguucaccaccaacaucuggcucaagcugcgcgagaagcaggacgucuucugcgacuccaagcugaugagcgccgccaucaaggacaaccgggcggugcacgccgacaugggcuacuggaucgaguccgcccucaacgacaccuggaagauggagaaggccagcuucaucgaggugaaguccugccacuggcccaagagccacacgcugugguccaacggcguccuggagagcgagaugaucauccccaagaacuucgccgggcccgugucccagcacaacuaccgcccgggcuaccacacccagaccgcggggcccuggcaccucggcaagcuggagauggacuucgaccugugcgaggggaccacgguggucgugaccgaggacugcggcaaccggggccccagccuccgcaccaccacggccagcgggaagcugaucaccgaguggugcugccgguccugcacccugcccccgcuccgcuaccggggcgaggacgggugcugguacggcauggagauccgcccccugaaggagaaggaggagaaccuggugaacagccucgucaccgccgggcacggccagaucgacaacuucucccugggcgugcuggggauggcccucuuccuggaggagaugcugcggacgcgcgugggcaccaagcacgcgauccuccuggucgccgugagcuucgugacccugaucaccgggaacauguccuuccgggaccucggccgcgucauggugauggugggggccacgaugaccgacgacaucggcaugggcgucaccuaccuggcccugcucgccgcguucaaggugcgccccaccuucgccgccgggcugcugcuccggaagcugacgagcaaggagcugaugauggccaccaucggcaucgcccuccugucccagagcaccauccccgagaccauccuggagcucacggacgcgcuggcccuggggaugauggugcucaagaucguccgcaacauggagaaguaccagcuggccgugaccaucauggccaucuccugcgugccgaacgccgucauccugcggaacgcguggaaggugagcugcaccauccucgccgccgucuccgugagcccccugcugcucaccuccagccagcagaaggccgacuggaucccccuggcgcugacgaucaagggccucaaccccaccgccaucuuccugaccacccugucccgcacgagcaagaagcgguccuggccgcucaacgaggccaucauggccgugggcauggucagcauccuggccuccagccugcucaagaacgacauccccaugaccgggccccugguggcgggcgggcugcucaccgugugcuacguccugaccggccgcagcgccgaccuggagcucgagcgggccgccgaggugaagugggaggaccaggccgagaucuccgggagcucccccauccugagcaucacgaucuccgaggacggcagcauguccaucaagaacgaggaggaggagcagacccugaccauccucauccgcaccggccugcuggugaucagcggggucuucccgguguccauccccaucaccgcggccgccugguaccucugggaggugaagaagcagcgggccggcguccugugggacgugcccagcccgccgcccguggggaaggccgagcuggaggagggcgcguaccgcaucaagcagcgggggauccucggcuacucccagaucggcgccggggucuacaaggagggcacguuccacaccauguggcacgugacccgcggggccgugcugaugcaccggggcaagcgcaucgagcccagcugggccgacgucaagaaggaccugaucuccuacgggggcggcuggaagcucgagggggaguggaaggagggcgaggagguccaggugcuggcccuggagcccgggaagaacccccgggcgguccagaccaagcccggcaucuucaagacgaacaccgggaccaucggcgccgugagccucgacuucucccccggcaccagcgggucccccaucguggaccgcaagggcaaggucguggggcuguacggcaacggcguggucacgcggagcggggccuacguguccgccaucgcgcagaccgagaaguccaucgaggacaaccccgagaucgaggacgacaucuuccgcaagaagcggcugaccaucauggaccuccaccccggcgccgggaagaccaagcgcuaccugcccgccaucgugcgggaggccaucaagcgcggccugcgcacgcugauccucgccccgacccgggucguggcggccgagauggaggaggcccugcgcgggcugcccauccgguaccagacccccgccaucaaggccgagcacaccggccgcgagaucguggaccucaugugccacgcgacguucaccaugcggcugcugagccccguccgcgugccgaacuacaaccucaucaucauggacgaggcccacuucaccgaccccgccuccaucgccgcccggggcuacaucagcacccgcguggagaugggggaggcggccggcaucuucaugacggccacgccgcccgggucccgggacccguucccccagagcaacgcccccaucauggacgaggagcgcgagauccccgagcgguccuggaacagcggccacgagugggucaccgacuucaaggggaagaccgugugguucgugccguccaucaaggcgggcaacgacaucgccgccugccugcgcaagaacggcaagaaggucauccagcugagccggaagacguucgacuccgaguacgugaagacccgcgccaacgacugggacuucguggucaccaccgacaucagcgagaugggggccaacuucaaggcggagcgggugaucgacccccgccggugcaugaagcccgugauccucacggacggcgaggagcgcgucauccuggccgggcccaugccggugacccacuccagcgccgcccagcggcgcggccgcaucgggcggaaccccaagaacgagaacgaccaguacaucuacaugggcgagccccuggagaacgacgaggacugcgcccacuggaaggaggcgaagaugcuccuggacaacaucaacacccccgagggcaucaucccguccauguucgagcccgagcgcgagaagguggacgccaucgacggggaguaccggcugcgcggcgaggcccggaagaccuucgucgaccucaugcgccgcggggaccugcccguguggcuggccuacaagguggccgcggagggcaucaacuacgccgaccgcaaguggugcuucgacgggaucaagaacaaccagauccucgaggagaacgucgagguggagaucuggacgaaggagggcgagcggaagaagcugaagccgcgcuggcuggacgcccggaucuacagcgacccccucgcccugaaggaguucaaggaguucgcggccggccgcaagucccugacccucaaccugaucaccgagauggggcggcugcccaccuucaugacgcagaaggcccgcaacgcccucgacaaccuggccguccugcacaccgcggaggccggcgggcgggccuacaaccacgcccucagcgagcugcccgagacccuggagacccuccugcugcucacgcugcuggccaccgugaccggcggcaucuuccucuuccugauguccgggaagggcaucgggaagaugacccugggcaugugcugcaucaucaccgcgagcgugcuccugugguacgcccagauccagccgcacuggaucgccgccuccaucauccuggaguucuuccucaucguccugcugauccccgagcccgagaagcagcgcacgccccaggacaaccagcucaccuacguggugaucgccauccugaccgucguggcggccaccauggccaacgagaugggguuccuggagaagacgaagaaggaccucggccugggcagcaucaccacccaggagagcgaguccaacauccuggacaucgaccuccggccggccagcgccuggacccuguacgcgguggccacgaccuucgucacccccaugcugcgccacuccaucgagaacagcuccgugaacgugagccucaccgccaucgccaaccaggcgacgguccugauggggcugggcaagggguggccccucuccaagauggacaucggcgugccccugcuggccaucgggugcuacagccaggugaacccgaucacccucaccgccgcccugcugcuccuggucgcccacuacgcgaucaucggccccggccugcaggccaaggccacccgggaggcccagaagcgcgccgcggccgggaucaugaagaaccccacgguggacggcaucaccgugaucgaccucgagcccaucccguacgaccccaaguucgagaagcagcuggggcaggucaugcugcucauccugugcgugacccaggugcugaugaugcggaccacgugggcccucugcgaggcccugacccuggccaccggccccaucuccacccucugggaggggaaccccggccgcuucuggaacacgaccaucgcggucagcauggccaacaucuuccgcggcuccuaccuggccggggccggccuccuguucagcaucaugaagaacaccaccaacacgcggcgcgggaccggcaacaucggcgagacccugggggagaaguggaagucccggcugaacgcgcucggcaagagcgaguuccagaucuacaagaaguccgggauccaggagguggaccgcacccuggccaaggagggcaucaagcgcggggagacggaccaccacgccgugagccgcggcuccgccaagcugcggugguucgucgagcgcaacauggugaccccggagggcaagguggucgaccucgggugcggccgcgggggcuggagcuacuacugcgggggccugaagaacgugcgcgaggugaagggccugaccaagggcggccccgggcacgaggagcccauccccauguccaccuacggcuggaaccucguccggcugcagagcgggguggacguguucuucacgccgcccgagaagugcgacacccugcucugcgacaucggcgagagcucccccaaccccaccaucgaggccggccgcacccugcggguccugaaccucguggagaacuggcugaacaacaacacccaguucugcaucaaggugcugaacccguacaugcccagcgucaucgagaagauggagacgcuccagcgcaaguacgggggcgcgcuggugcggaacccccugucccgcaacagcacccacgagauguacuggguguccaacgccaccgggaacaucgucagcuccgugaacaugaucagccggaugcugaucaaccgcuucaccaugaagcacaagaaggccacguacgagccggacguggaccucggcuccgggacccggaacaucggcaucgagagcgagauccccaaccuggacaucaucggcaagcgcaucgagaagaucaagcaggagcacgagaccuccuggcacuacgaccaggaccaccccuacaagaccugggccuaccacgggagcuacgagacgaagcagaccggcuccgccagcuccauggucaacgggguggugcgccugcucaccaagcccugggacgucgugccgauggugacccagauggcgaugacggacaccacccccuucggccagcagcgggucuucaaggagaagguggacacccgcacgcaggagcccaaggagggcaccaagaagcugaugaagaucaccgccgaguggcuguggaaggagcucgggaagaagaagacgccccggaugugcacgcgcgaggaguucacccggaaggugcgcagcaacgccgcccugggcgccaucuucaccgacgagaacaaguggaaguccgcgcgggaggccgucgaggacgggcgcuucugggagcugguggaccgggagcgcaaccuccaccuggagggcaagugcgagaccugcgucuacaacaugauggggaagcgggagaagaagcugggcgaguucggcaaggccaaggggagccgcgccaucugguacauguggcucggcgcgcgguuccuggaguucgaggcccugggguuccucaacgaggaccacugguucucccgcggcaacagccugagcgggguggagggcgagggccugcaccggcucggguacauccugcgcgacguguccaagaaggagggcggggccauguacgccgacgacacggccggcugggacacccggaucacccuggaggaccucaagaacgaggagauggucaccaaccacaugaagggggagcacaagaagcuggcggaggccaucuucaagcugacguaccagaacaagguggugcgcguccagcggccgacgccccggggcaccgugauggacaucaucagccggcgcgaccagcgcggcuccggccaggugggcaccuacgggcucaacacguucaccaacaucgaggcccagcugauccggcagauggagggcgagggcaucuucaagagcauccagcaccugaccgccaccgaggagaucgccguccagaacuggcucgcgcgcguggggcgggagcgccugucccggauggccaucagcggcgacgacugcguggucaagcccaucgacgaccgcuucgccuccgcccugacggcccucaacgacauggggaaggugcggaaggacauccagcagugggagcccagccgcggcuggaacgacuggacccaggugccguucugcucccaccacuuccacgagcuggucaugaaggacgggcgggugcuggugguccccugccgcaaccaggacgagcucaucggccgggcgcgcaucagccagggcgccggguggucccugaaggagaccgccugccugggcaagagcuacgcccagauguggacccucauguacuuccaccggcgcgaccugcggcuggccgcgaacgccaucugcuccgccgugcccagccacugggugcccaccucccgcacgaccuggagcauccacgccaagcacgaguggaugaccaccgaggacaugcucgcggucuggaaccggguguggauccaggagaacccguggauggaggacaagacgcccguggaguccugggaggagguccccuaccuggggaagcgcgaggaccaguggugcggcagccugaucgggcucaccagccgggccaccugggccaagaacauccagaccgccaucaaccaggugcgcucccugaucggcaacgaggaguacacggacuacaugcccagcaugaagcgcuuccggcgcgaggaggaggaggccggcgugcugugguga

SEQ ID NO: 9123 - RNA, 9876 nt, Artificial Sequence
  derived and/or modified CDS sequence (opt1) from DENV-2__GQ868556__SS-prME
accgccggcgugaucgucaugcugauccccaccgccauggcguuccaccucaccacccgcaacggggagccccacaugaucgugggccggcaggagaaggggaagucccugcuguucaagaccgaggacggcgugaacaugugcacccucauggccaucgaccugggggagcugugcgaggacaccaucaccuacaagugcccccuccugcggcagaacgagcccgaggacaucgacugcuggugcaacagcaccagcaccugggucaccuacgggaccugcaccaccacgggcgagcaccggcgcgagaagcgguccguggcccuggugccccacgucgggaugggccucgagacccgcaccgagaccuggaugagcuccgagggggccuggaagcacgugcagcggaucgagaccuggauccugcgccacccgggcuucaccaucauggccgcgauccuggccuacaccaucgggaccacgcacuuccagcgggcccucaucuucauccugcugaccgccguggcgcccagcaugaccaugcgcugcaucggcaucuccaaccgggacuucgucgagggcgugagcgggggcuccuggguggacaucguccucgagcacgggagcugcgugaccacgauggccaagaacaagcccacccuggacuucgagcugaucaagaccgaggccaagcagcccgccacccuccgcaaguacugcaucgaggccaagcugacgaacaccaccaccgagucccggugcccgacgcagggcgagcccagccugaacgaggagcaggacaagcgcuucaucugcaagcacuccaugguggaccggggcugggggaacggcugcgggcuguucggcaagggcgggaucgugaccugcgcgauguucacgugcaagaagaacauggagggcaagguggugcagcccgagaaccuggaguacaccaucgucaucacgccccacagcggggaggagcacgccgugggcaacgacaccgggaagcacggcaaggagaucaagaucaccccgcaguccagcaucaccgaggccgagcugaccggguacggcacggugaccauggagugcagcccccggaccggccucgacuucaacgagaugguccugcugcagauggaggacaaggccuggcucgugcaccggcagugguuccuggaccugccccuccccuggcugccgggggccgacacccagggcagcaacuggauccagaaggagacgcuggugaccuucaagaacccccacgcgaagaagcaggacgucgugguccucgggucccaggagggcgccaugcacaccgcccugaccggggccacggagauccagaugagcagcggcaaccuccuguucaccggccaccugaagugccgccugcggauggacaagcuccagcugaaggggauguccuacagcaugugcaccggcaaguucaagaucgugaaggagaucgccgagacccagcacgggacgaucgugauccgcguccaguacgagggcgacggcucccccugcaagauccccuucgagaucaccgaccuggagaagcggcacgugcucgggcgccugaucaccgugaacccgaucgucaucgagaaggacagccccgugaacaucgaggcggagccgcccuucggcgacuccuacaucaucaucgggguggagccgggccagcugaagcucaacugguucaagaaggggagcuccaucggccagauguucgagaccacgaugcgcggcgccaagcggauggccauccugggggacaccgccugggacuucggcagccucggcggggucuucaccuccaucgggaaggcccuccaccagguguucggggcgaucuacggcgccgccuucagcgggguguccuggaccaugaagauccugaucggcgucgugaucacguggaucgggaugaacagccgcuccaccagccuguccgugagccugguccucgugggcguggucacccuguaccugggggccauggugcaggcggacuccggcugcguggucagcuggaagaacaaggagcucaagugcggcuccgggaucuucaucaccgacaacgugcacacguggaccgagcaguacaaguuccagcccgagagccccagcaagcuggccuccgccauccagaaggcccacgaggagggcaucugcgggauccggagcgugacccgccuggagaaccucauguggaagcagaucacccccgagcugaaccacauccuguccgagaacgaggucaagcucacgaucaugaccggcgacaccaaggggaucaugcaggccggcaagcggagccugcgcccgcagcccaccgagcugaaguacuccuggaagacguggggcaaggcgaagaugcucagcaccgagucccacaaccagaccuuccugaucgacgggcccgagaccgccgagugcccgaacacgaaccgggccuggaacagccuggagguggaggacuacggcuucgggguguucaccaccaacaucuggcucaagcugcgcgagaagcaggacgucuucugcgacuccaagcugaugagcgccgccaucaaggacaaccgggcggugcacgccgacaugggcuacuggaucgaguccgcccucaacgacaccuggaagauggagaaggccagcuucaucgaggugaaguccugccacuggcccaagagccacacccugugguccaacggcguccuggagagcgagaugaucauccccaagaacuucgccgggcccgugucccagcacaacuaccgcccgggcuaccacacgcagaccgcggggcccuggcaccucggcaagcuggagauggacuucgacuucugcgaggggaccaccguggucgugacggaggacugcggcaaccggggccccagccugcgcaccaccaccgccagcgggaagcucaucacggaguggugcugccgguccugcacccugcccccgcugcgcuaccggggcgaggacgggugcugguacggcauggagauccgcccccucaaggagaaggaggagaaccuggugaacagccuggucaccgccgggcacggccagaucgacaacuucucccucggcgugcuggggauggcccuguuccucgaggagaugcugcggacccgcgugggcacgaagcacgcgauccugcucgucgccgugagcuucgugacccugaucaccgggaacauguccuuccgggaccugggccgcgucauggugauggugggggccaccaugacggacgacaucggcaugggcgucaccuaccucgcccugcuggccgcguucaaggugcgccccaccuucgccgccgggcuccugcugcggaagcucaccagcaaggagcugaugauggccacgaucggcaucacccugcucucccagagcaccauccccgagaccauccuggagcugacggacgcccucgcgcuggggaugauggugcugaagaucguccgcaacauggagaaguaccagcucgccgugaccaucauggccaucuccugcgugccgaacgccgucauccugcggaacgccuggaaggugagcugcaccauccuggcggccgucuccgugagcccccuccugcugaccuccagccagcagaaggccgacuggaucccccucgcccugacgaucaagggccugaaccccaccgcgaucuuccucaccacccugucccgcacgagcaagaagcgguccuggccgcugaacgaggccaucauggccgugggcauggucagcauccucgccuccagccugcugaagaacgacauccccaugaccgggccccucguggccggcgggcugcugaccgugugcuacguccucaccggccgcagcgcggaccuggagcuggagcgggccgccgacgugaagugggaggaccaggccgagaucuccgggagcucccccauccucagcaucacgaucuccgaggacggcagcauguccaucaagaacgaggaggaggagcagacccugaccauccugauccgcaccggccuccuggugaucagcggggucuucccgguguccauccccaucaccgccgcggccugguaccugugggaggugaagaagcagcgggccggcguccucugggacgugcccagcccgccgcccguggggaaggccgagcuggaggacggcgccuaccgcaucaagcagcgggggauccugggcuacucccagaucggcgcgggggucuacaaggagggcacguuccacaccauguggcacgugacccgcggggccgugcucaugcaccggggcaagcgcaucgagcccagcugggccgacgucaagaaggaccugaucuccuacgggggcggcuggaagcuggagggggaguggaaggagggcgaggagguccaggugcucgcccuggagcccgggaagaacccccgggccguccagaccaagcccggcaucuucaagacgaacaccgggaccaucggcgcggugagccuggacuucucccccggcaccagcgggucccccaucguggaccgcaagggcaaggucguggggcucuacggcaacggcguggucacgcggagcggggccuacguguccgccaucgcccagaccgagaaguccaucgaggacaaccccgagaucgaggacgacaucuuccgcaagaagcggcugaccaucauggaccugcaccccggcgcggggaagaccaagcgcuaccuccccgccaucgugcgggaggccaucaagcgcggccugcgcacgcugauccuggccccgacccgggucguggccgcggagauggaggaggcccuccgcgggcugcccauccgguaccagacccccgccaucaaggccgagcacaccggccgcgagaucguggaccugaugugccacgccacguucaccaugcggcuccugagccccguccgcgugccgaacuacaaccugaucaucauggacgaggcgcacuucaccgaccccgccuccaucgccgcccggggcuacaucagcacccgcguggagaugggggaggccgcgggcaucuucaugacggccacgccgcccgggucccgggacccguucccccagagcaacgcccccaucauggacgaggagcgcgagauccccgagcgguccuggaacagcggccacgagugggucaccgacuucaaggggaagaccgugugguucgugccguccaucaaggccggcaacgacaucgcggccugccuccgcaagaacggcaagaaggucauccagcugagccggaagacguucgacuccgaguacgugaagacccgcgccaacgacugggacuucguggucaccaccgacaucagcgagaugggggccaacuucaaggccgagcgggugaucgacccccgccggugcaugaagcccgugauccugacggacggcgaggagcgcgucauccucgcggggcccaugccggugacccacuccagcgccgcccagcggcgcggccgcaucgggcggaaccccaagaacgagaacgaccaguacaucuacaugggcgagccccuggagaacgacgaggacugcgcccacuggaaggaggccaagaugcugcucgacaacaucaacacccccgagggcaucaucccguccauguucgagcccgagcgcgagaagguggacgcgaucgacggggaguaccggcugcgcggcgaggcccggaagaccuucgucgaccugaugcgccgcggggaccuccccguguggcuggccuacaagguggccgccgagggcaucaacuacgcggaccgcaaguggugcuucgacgggaucaagaacaaccagauccuggaggagaacgucgagguggagaucuggacgaaggagggcgagcggaagaagcucaagccgcgcuggcuggacgcccggaucuacagcgacccccuggcccucaaggaguucaaggaguucgccgcgggccgcaagucccugacccugaaccucaucaccgagauggggcggcugcccaccuucaugacgcagaaggcccgcaacgcccuggacaaccucgccguccugcacaccgccgaggcgggcgggcgggccuacaaccacgcccugagcgagcuccccgagacccuggagacccugcuccugcugacgcuccuggccaccgugaccggcggcaucuuccuguuccucauguccgggaagggcaucgggaagaugacccugggcaugugcugcaucaucaccgccagcgugcugcucugguacgcgcagauccagccgcacuggaucgccgccuccaucauccuggaguucuuccugaucguccuccugauccccgagcccgagaagcagcgcacgccccaggacaaccagcugaccuacguggugaucgccauccucaccgucguggccgcgaccauggccaacgagaugggguuccuggagaagacgaagaaggaccugggccucggcagcaucaccacccaggagagcgaguccaacauccuggacaucgaccugcggccggccagcgccuggacccucuacgccguggcgacgaccuucgucacccccaugcugcgccacuccaucgagaacagcuccgugaacgugagccugaccgccaucgccaaccaggccacgguccucauggggcugggcaagggguggccccuguccaagauggacaucggcgugccccuccuggcgaucgggugcuacagccaggugaacccgaucacccugaccgccgcccuccugcugcucgucgcccacuacgccaucaucggccccggccugcaggcgaaggccacccgggaggcccagaagcgcgccgccgcggggaucaugaagaaccccacgguggacggcaucaccgugaucgaccuggagcccaucccguacgaccccaaguucgagaagcagcucgggcaggucaugcugcugauccucugcgugacccaggugcugaugaugcggaccacgugggcccugugcgaggcccucacccuggccaccggccccaucuccacccugugggaggggaaccccggccgcuucuggaacacgaccaucgccgucagcauggcgaacaucuuccgcggcuccuaccucgccggggccggccugcuguucagcaucaugaagaacaccaccaacacgcggcgcgggaccggcaacaucggcgagacccucggggagaaguggaagucccggcugaacgcccugggcaagagcgaguuccagaucuacaagaaguccgggauccaggagguggaccgcacccucgcgaaggagggcaucaagcgcggggagacggaccaccacgccgugagccgcggcuccgccaagcugcggugguucgucgagcgcaacauggugaccccggagggcaagguggucgaccuggggugcggccgcgggggcuggagcuacuacugcgggggccucaagaacgugcgcgaggugaagggccugaccaagggcggccccgggcacgaggagcccauccccauguccaccuacggcuggaaccugguccggcuccagagcgggguggacguguucuucacgccgcccgagaagugcgacacccugcugugcgacaucggcgagagcucccccaaccccaccaucgaggccggccgcacccuccggguccugaaccugguggagaacuggcucaacaacaacacccaguucugcaucaaggugcugaacccguacaugcccagcgucaucgagaagauggagacgcugcagcgcaaguacgggggcgcccucgugcggaacccccugucccgcaacagcacccacgagauguacuggguguccaacgcgaccgggaacaucgucagcuccgugaacaugaucagccggaugcugaucaaccgcuucaccaugaagcacaagaaggccacguacgagccggacguggaccugggcuccgggacccggaacaucggcaucgagagcgagauccccaaccucgacaucaucggcaagcgcaucgagaagaucaagcaggagcacgagaccuccuggcacuacgaccaggaccaccccuacaagaccugggccuaccacgggagcuacgagacgaagcagaccggcuccgccagcuccauggucaacgggguggugcgccugcugaccaagcccugggacgucgugccgauggugacccagauggccaugacggacaccacccccuucggccagcagcgggucuucaaggagaagguggacacccgcacgcaggagcccaaggagggcaccaagaagcucaugcggaucaccgcggaguggcuguggaaggagcuggggaagaagaagacgccccggaugugcacgcgggaggaguucacccgcaaggugcggagcaacgccgcccucggcgccaucuucaccgacgagaacaaguggaaguccgcccgcgaggcggucgaggacgggcgguucugggagcugguggaccgcgagcggaaccugcaccucgagggcaagugcgagaccugcgucuacaacaugauggggaagcgcgagaagaagcugggcgaguucggcaaggccaaggggagccgggccaucugguacauguggcugggcgcccgcuuccucgaguucgaggcgcugggguuccugaacgaggaccacugguucucccggggcaacagccucagcgggguggagggcgagggccugcaccgccugggguacauccuccgggacgugggcaagaaggagggcggcgccauguacgccgacgacacggccgggugggacacccgcaucacccuggaggaccugaagaacgaggagauggucaccaaccacaugaagggcgagcacaagaagcucgccgaggcgaucuucaagcugacguaccagaacaagguggugcggguccagcgcccgacgccccggggcaccgugauggacaucaucucccgccgcgaccagcgggggagcggccagguggggaccuacggccugaacacguucaccaacauggaggcccagcucauccgccagauggagggcgaggggaucuucaaguccauccagcaccugaccgccaccgaggagaucgccguccagaacuggcuggcccgggugggccgcgagcggcucagccgcauggcgaucuccggggacgacugcguggucaagcccaucgacgaccgguucgccagcgcccugacggcccugaacgacaugggcaaggugcgcaaggacauccagcagugggagcccucccggggguggaacgacuggacccaggugccguucugcagccaccacuuccacgagcucgucaugaaggacggccgcgugcuggugguccccugccggaaccaggacgagcugaucggccgcgcccggaucucccagggggcgggcuggagccucaaggagaccgccugccuggggaaguccuacgcccagauguggacccugauguacuuccaccgccgggaccuccgccuggccgccaacgcgaucugcagcgccgugcccucccacugggugcccaccagccggacgaccugguccauccacgccaagcacgaguggaugaccaccgaggacaugcuggccgucuggaaccgcguguggauccaggagaacccguggauggaggacaagacgcccguggagagcugggaggagguccccuaccucggcaagcgggaggaccaguggugcgggucccugaucggccugaccagccgcgcgaccugggccaagaacauccagaccgccaucaaccaggugcgcagccucaucggcaacgaggaguacacggacuacaugcccuccaugaagcgguuccgccgggaggaggaggaggccggggugcugugguga

SEQ ID NO: 9124 - RNA, 9876 nt, Artificial Sequence
  derived and/or modified CDS sequence (opt1) from DENV-2__GQ868557__SS-prME
accgccggcgugaucgucaugcugauccccaccgccaucgcguuccaccucaccacccgcaacggggagccccacaugaucgugggccggcaggagaaggggaagucccugcuguucaagaccgaggacggcgugaacaugugcacccucauggccaucgaccugggggagcugugcgaggacaccaucaccuacaagugcccccuccugcggcagaacgagcccgaggacaucgacugcuggugcaacagcaccagcaccugggucaccuacgggaccugcaccaccacgggcgagcaccggcgcgagaagcgguccguggcccuggugccccacgucgggaugggccucgagacccgcaccgagaccuggaugagcuccgagggggccuggaagcacgugcagcggaucgagaccuggauccugcgccacccgggcuucaccaucauggccgcgauccuggccuacaccaucgggaccacgcacuuccagcgggcccucaucuucauccugcugaccgccguggcgcccagcaugaccaugcgcugcaucggcaucuccaaccgggacuucgucgagggcgugagcgggggcuccuggguggacaucguccucgagcacgggagcugcgugaccacgauggccaagaacaagcccacccuggacuucgagcugaucaagaccgaggccaagcagcccgccacccuccgcaaguacugcaucgaggccaagcugacgaacaccaccaccgagucccggugcccgacgcagggcgagcccagccugaacgaggagcaggacaagcgcuucaucugcaagcacuccaugguggaccggggcugggggaacggcugcgggcuguucggcaagggcgggaucgugaccugcgcgauguucacgugcaagaagaacauggagggcaagguggugcagcccgagaaccuggaguacaccaucgucaucacgccccacagcggggaggagcacgccgugggcaacgacaccgggaagcacggcaaggagaucaagaucaccccgcaguccagcaucaccgaggccgagcugaccggguacggcacggugaccauggagugcagcccccggaccggccucgacuucaacgagaugguccugcugcagauggaggacaaggccuggcucgugcaccggcagugguuccuggaccugccccuccccuggcugccgggggccgacacccagggcagcaacuggauccagaaggagacgcuggugaccuucaagaacccccacgcgaagaagcaggacgucgugguccucgggucccaggagggcgccaugcacaccgcccugaccggggccacggagauccagaugagcagcggcaaccuccuguucaccggccaccugaagugccgccugcggauggacaagcuccagcugaaggggauguccuacagcaugugcaccggcaaguucaagaucgugaaggagaucgccgagacccagcacgggacgaucgugauccgcguccaguacgagggcgacggcucccccugcaagauccccuucgagaucaccgaccuggagaagcggcacgugcucgggcgccugaucaccgugaacccgaucgucaccgagaaggacagccccgugaacaucgaggcggagccgcccuucggcgacuccuacaucaucaucgggguggagccgggccagcugaagcucaacugguucaagaaggggagcuccaucggccagauguucgagacgaccaugcgcggcgccaagcggauggccauccugggggacaccgccugggacuucggcagccucggcggggucuucaccuccaucgggaaggcccuccaccagguguucggggcgaucuacggcgccgccuucagcgggguguccuggacgaugaagauccugaucggcgucgugaucaccuggaucgggaugaacagccgcuccaccagccuguccgugagccugguccucgugggcguggucacccuguaccugggggccauggugcaggcggacuccggcugcguggucagcuggaagaacaaggagcucaagugcggcuccgggaucuucaucacggacaacgugcacaccuggaccgagcaguacaaguuccagcccgagagccccagcaagcuggccuccgccauccagaaggcccacgaggagggcaucugcgggauccggagcgugacccgccuggagaaccucauguggaagcagaucacgcccgagcugaaccacauccuguccgagaacgaggucaagcucaccaucaugaccggcgacaccaaggggaucaugcaggccggcaagcggagccugcgcccgcagcccacggagcugaaguacuccuggaagaccuggggcaaggcgaagaugcucagcaccgagucccacaaccagaccuuccugaucgacgggcccgagacggccgagugcccgaacaccaaccgggccuggaacagccuggagguggaggacuacggcuucgggguguucaccaccaacaucuggcucaagcugcgcgagaagcaggacgucuucugcgacuccaagcugaugagcgccgccaucaaggacaaccgggcggugcacgccgacaugggcuacuggaucgaguccgcccucaacgacaccuggaagauggagaaggccagcuucaucgaggugaaguccugccacuggcccaagagccacacgcugugguccaacggcguccuggagagcgagaugaucauccccaagaacuucgccgggcccgugucccagcacaacuaccgcccgggcuaccacacccagaccgcggggcccuggcaccucggcaagcuggagauggacuucgaccugugcgaggggaccacgguggucgugaccgaggacugcggcaaccggggccccagccuccgcaccaccacggccagcgggaagcugaucaccgaguggugcugccgguccugcacccugcccccgcuccgcuaccggggcgaggacgggugcugguacggcauggagauccgcccccugaaggagaaggaggagaaccuggugaacagccucgucaccgccgggcacggccagaucgacaacuucucccugggcgugcuggggauggcccucuuccuggaggagaugcugcggacgcgcgugggcaccaagcacgcgauccuccuggucgccgugagcuucgugacccugaucaccgggaacauguccuuccgggaccucggccgcgucauggugauggugggggccacgaugaccgacgacaucggcaugggcgucaccuaccuggcccugcucgccgcguucaaggugcgccccaccuucgccgccgggcugcugcuccggaagcugacgagcaaggagcugaugauggccaccaucggcaucgcccuccugucccagagcaccauccccgagaccauccuggagcucacggacgcgcuggcccuggggaugauggugcucaagaucguccgcaacauggagaaguaccagcuggccgugaccaucauggccaucuccugcgugccgaacgccgucauccugcggaacgcguggaaggugagcugcaccauccucgccgccgucuccgugagcccccugcugcucaccuccagccagcagaaggccgacuggaucccccuggcgcugacgaucaagggccucaaccccaccgccaucuuccugaccacccugucccgcacgagcaagaagcgguccuggccgcucaacgaggccaucauggccgugggcauggucagcauccuggccuccagccugcucaagaacgacauccccaugaccgggccccugguggcgggcgggcugcucaccgugugcuacguccugaccggccgcagcgccgaccuggagcucgagcgggccgccgaggugaagugggaggaccaggccgagaucuccgggagcucccccauccugagcaucacgaucuccgaggacggcagcauguccaucaagaacgaggaggaggagcagacccugaccauccucauccgcaccggccugcuggugaucagcggggucuucccgguguccauccccaucaccgcggccgccugguaccucugggaggugaagaagcagcgggccggcguccugugggacgugcccagcccgccgcccguggggaaggccgagcuggaggacggcgcguaccgcaucaagcagcgggggauccucggcuacucccagaucggcgccggggucuacaaggagggcacguuccacaccauguggcacgugacccgcggggccgugcugaugcaccggggcaagcgcaucgagcccagcugggccgacgucaagaaggaccugaucuccuacgggggcggcuggaagcucgagggggaguggaaggagggcgaggagguccaggugcuggcccuggagcccgggaagaacccccgggcgguccagaccaagcccggcaucuucaagacgaacaccgggaccaucggcgccgugagccucgacuucucccccggcaccagcgggucccccaucguggaccgcaagggcaaggucguggggcuguacggcaacggcguggucacgcggagcggggccuacguguccgccaucgcgcagaccgagaaguccaucgaggacaaccccgagaucgaggacgacaucuuccgcaagaagcggcugaccaucauggaccuccaccccggcgccgggaagaccaagcgcuaccugcccgccaucgugcgggaggccaucaagcgcggccugcgcacgcugauccucgccccgacccgggucguggcggccgagauggaggaggcccugcgcgggcugcccauccgguaccagacccccgccaucaaggccgagcacaccggccgcgagaucguggaccucaugugccacgcgacguucaccaugcggcugcugagccccguccgcgugccgaacuacaaccucaucaucauggacgaggcccacuucaccgaccccgccuccaucgccgcccggggcuacaucagcacccgcguggagaugggggaggcggccggcaucuucaugacggccacgccgcccgggucccgggacccguucccccagagcaacgcccccaucauggacgaggagcgcgagauccccgagcgguccuggaacagcggccacgagugggucaccgacuucaaggggaagaccgugugguucgugccguccaucaaggcgggcaacgacaucgccgccugccugcgcaagaacggcaagaaggucauccagcugagccggaagacguucgacuccgaguacgugaagacccgcgccaacgacugggacuucguggucaccaccgacaucagcgagaugggggccaacuucaaggcggagcgggugaucgacccccgccggugcaugaagcccgugauccucacggacggcgaggagcgcgucauccuggccgggcccaugccggugacccacuccagcgccgcccagcggcgcggccgcaucgggcggaaccccaagaacgagaacgaccaguacaucuacaugggcgagccccuggagaacgacgaggacugcgcccacuggaaggaggcgaagaugcuccuggacaacaucaacacccccgagggcaucaucccguccauguucgagcccgagcgcgagaagguggacgccaucgacggggaguaccggcugcgcggcgaggcccggaagaccuucgucgaccucaugcgccgcggggaccugcccguguggcuggccuacaagguggccgcggagggcaucaacuacgccgaccgcaaguggugcuucgacgggaucaagaacaaccagauccucgaggagaacgucgagguggagaucuggacgaaggagggcgagcggaagaagcugaagccgcgcuggcuggacgcccggaucuacagcgacccccucgcccugaaggaguucaaggaguucgcggccggccgcaagucccugacccucaaccugaucaccgagauggggcggcugcccaccuucaugacgcagaaggcccgcaacgcccucgacaaccuggccguccugcacaccgcggaggccggcgggcgggccuacaaccacgcccucagcgagcugcccgagacccuggagacccuccugcugcucacgcugcuggccaccgugaccggcggcaucuuccucuuccugauguccgggaagggcaucgggaagaugacccugggcaugugcugcaucaucaccgcgagcgugcuccugugguacgcccagauccagccgcacuggaucgccgccuccaucauccuggaguucuuccucaucguccugcugauccccgagcccgagaagcagcgcacgccccaggacaaccagcucaccuacguggugaucgccauccugaccgucguggcggccaccauggccaacgagaugggguuccuggagaagacgaagaaggaccucggccugggcagcaucaccacccaggagagcgaguccaacauccuggacaucgaccuccggccggccagcgccuggacccuguacgcgguggccacgaccuucgucacccccaugcugcgccacuccaucgagaacagcuccgugaacgugagccucaccgccaucgccaaccaggcgacgguccugauggggcugggcaagggguggccccucuccaagauggacaucggcgugccccugcuggccaucgggugcuacagccaggugaacccgaucacccucaccgccgcccugcugcuccuggucgcccacuacgcgaucaucggccccggccugcaggccaaggccacccgggaggcccagaagcgcgccgcggccgggaucaugaagaaccccacgguggacggcaucaccgugaucgaccucgagcccaucccguacgaccccaaguucgagaagcagcuggggcaggucaugcugcucauccugugcgugacccaggugcugaugaugcggaccacgugggcccucugcgaggcccugacccuggccaccggccccaucuccacccucugggaggggaaccccggccgcuucuggaacacgaccaucgcggucagcauggccaacaucuuccgcggcuccuaccuggccggggccggccuccuguucagcaucaugaagaacaccaccaacacgcggcgcgggaccggcaacaucggcgagacccugggggagaaguggaagucccggcugaacgcgcucggcaagagcgaguuccagaucuacaagaaguccgggauccaggagguggaccgcacccuggccaaggagggcaucaagcgcggggagacggaccaccacgccgugagccgcggcuccgccaagcugcggugguucgucgagcgcaacauggugaccccggagggcaagguggucgaccucgggugcggccgcgggggcuggagcuacuacugcgggggccugaagaacgugcgcgaggugaagggccugaccaagggcggccccgggcacgaggagcccauccccauguccaccuacggcuggaaccucguccggcugcagagcgggguggacguguucuucacgccgcccgagaagugcgacacccugcucugcgacaucggcgagagcucccccaaccccaccaucgaggccggccgcacccugcggguccugaaccucguggagaacuggcugaacaacaacacccaguucugcaucaaggugcugaacccguacaugcccagcgucaucgagaagauggagacgcuccagcgcaaguacgggggcgcgcuggugcggaacccccugucccgcaacagcacccacgagauguacuggguguccaacgccaccgggaacaucgucagcuccgugaacaugaucagccggaugcugaucaaccgcuucaccaugaagcacaagaaggccacguacgagccggacguggaccucggcuccgggacccggaacaucggcaucgagagcgagauccccaaccuggacaucaucggcaagcgcaucgagaagaucaagcaggagcacgagaccuccuggcacuacgaccaggaccaccccuacaagaccugggccuaccacgggagcuacgagacgaagcagaccggcuccgccagcuccauggucaacgggguggugcgccugcucaccaagcccugggacgucgugccgauggugacccagauggcgaugacggacaccacccccuucggccagcagcgggucuucaaggagaagguggacacccgcacgcaggagcccaaggagggcaccaagaagcugaugaagaucaccgccgaguggcuguggaaggagcucgggaagaagaagacgccccggaugugcacgcgcgaggaguucacccggaaggugcgcagcaacgccgcccugggcgccaucuucaccgacgagaacaaguggaaguccgcgcgggaggccgucgaggacgggcgcuucugggagcugguggaccgggagcgcaaccuccaccuggagggcaagugcgagaccugcgucuacaacaugauggggaagcgggagaagaagcugggcgaguucggcaaggccaaggggagccgcgccaucugguacauguggcucggcgcgcgguuccuggaguucgaggcccugggguuccucaacgaggaccacugguucucccgcggcaacagccugagcgggguggagggcgagggccugcaccggcucggguacauccugcgcgacguguccaagaaggagggcggggccauguacgccgacgacacggccggcugggacacccggaucacccuggaggaccucaagaacgaggagauggucaccaaccacaugaagggggagcacaagaagcuggcggaggccaucuucaagcugacguaccagaacaagguggugcgcguccagcggccgacgccccggggcaccgugauggacaucaucagccggcgcgaccagcgcggcuccggccaggugggcaccuacgggcucaacacguucaccaacauggaggcccagcugauccggcagauggagggcgagggcaucuucaagagcauccagcaccugaccgccaccgaggagaacgccguccagaacuggcucgcgcgcguggggcgggagcgccugucccggauggccaucagcggcgacgacugcguggucaagcccaucgacgaccgcuucgccuccgcccugacggcccucaacgacauggggaaggugcggaaggacauccagcagugggagcccagccgcggcuggaacgacuggacccaggugccguucugcucccaccacuuccacgagcuggucaugaaggacgggcgggugcuggugguccccugccgcaaccaggacgagcucaucggccgggcgcgcaucagccagggcgccggguggucccugaaggagaccgccugccugggcaagagcuacgcccagauguggacccucauguacuuccaccggcgcgaccugcggcuggccgcgaacgccaucugcuccgccgugcccagccacugggugcccaccucccgcacgaccuggagcauccacgccaagcacgaguggaugaccaccgaggacaugcucgcggucuggaaccggguguggauccaggagaacccguggauggaggacaagacgcccguggaguccugggaggagguccccuaccuggggaagcgcgaggaccaguggugcggcagccugaucgggcucaccagccgggccaccugggccaagaacauccagaccgccaucaaccaggugcgcucccugaucggcaacgaggaguacacggacuacaugcccagcaugaagcgcuuccggcgcgaggaggaggaggccggcgugcugugguga

SEQ ID NO: 9125 - RNA, 9876 nt, Artificial Sequence
  derived and/or modified CDS sequence (opt1) from DENV-2__GU131947__SS-prME
accgccggcgugaucgucaugcugauccccaccgccaucgcguuccaccucaccacccgcaacggggagccccacaugaucgugggccggcaggagaaggggaagucccugcuguucaagaccgaggacggcgugaacaugugcacccucauggccaucgaccugggggagcugugcgaggacaccaucaccuacaagugcccccuccugcgccagaacgagcccgaggacaucgacugcuggugcaacagcaccagcaccugggucaccuacgggaccugcaccaccacgggcgagcaccggcgcgagaagcgguccguggcccuggugccccacgucgggaugggccucgagacccgcaccgagaccuggaugagcuccgagggggccuggaagcacgugcagcggaucgagacguggauccugcgccacccgggcuucaccaucauggccgcgauccuggccuacaccaucgggaccacgcacuuccagcgggcccucaucuucauccugcugaccgccguggcgcccagcaugaccaugcgcugcaucggcaucuccaaccgggacuucgucgagggcgugagcgggggcuccuggguggacaucguccucgagcacgggagcugcgugaccacgauggccaagaacaagcccacccuggacuucgagcugaucaagaccgaggccaagcagcccgccacccuccgcaaguacugcaucgaggccaagcugacgaacaccaccaccgagucccggugcccgacgcagggcgagcccagccugaacgaggagcaggacaagcgcuucaucugcaagcacuccaugguggaccggggcugggggaacggcugcgggcuguucggcaagggcgggaucgugaccugcgcgauguucacgugcaagaagaacauggagggcaagguggugcagcccgagaaccuggaguacaccaucgucaucacgccccacagcggggaggagcacgccgugggcaacgacaccgggaagcacggcaaggagaucaagaucaccccgcaguccagcaucaccgaggccgagcugaccggguacggcacggugaccauggagugcagcccccggaccggccucgacuucaacgagaugguccugcugcagauggaggacaaggccuggcucgugcaccggcagugguuccuggaccugccccuccccuggcugccgggggccgacacccagggcagcaacuggauccagaaggagacgcuggugaccuucaagaacccccacgcgaagaagcaggacgucgugguccucgggucccaggagggcgccaugcacaccgcccugaccggggccacggagauccagaugagcagcggcaaccuccuguucaccggccaccugaagugccgccugcggauggacaagcuccagcugaaggggauguccuacagcaugugcaccggcaaguucaagaucgugaaggagaucgccgagacccagcacgggacgaucgugauccgcguccaguacgagggcgacggcucccccugcaagauccccuucgagaucaccgaccuggagaagcggcacgugcucgggcgccugaucaccgugaacccgaucgucaccgagaaggacagccccgugaacaucgaggcggagccgcccuucggcgacuccuacaucaucaucgggguggagccgggccagcugaagcucaacugguucaagaaggggagcuccaucggccagauguucgagacgaccaugcgcggcgccaagcggauggccauccugggggacaccgccugggacuucggcagccucggcggggucuucaccuccaucgggaaggcccuccaccagguguucggggcgaucuacggcgccgccuucagcgggguguccuggacgaugaagauccugaucggcgucgugaucaccuggaucgggaugaacagccgcuccaccagccuguccgugagccugguccucgugggcguggucacccuguaccugggggccauggugcaggcggacuccggcugcguggucagcuggaagaacaaggagcucaagugcggcuccgggaucuucaucacggacaacgugcacaccuggaccgagcaguacaaguuccagcccgagagccccagcaagcuggccuccgccauccagaaggcccacgaggagggcaucugcgggauccggagcgugacccgccuggagaaccucauguggaagcagaucacgcccgagcugaaccacauccuguccgagaacgaggucaagcucaccaucaugaccggcgacaccaaggggaucaugcaggccggcaagcggagccugcgcccgcagcccacggagcugaaguacuccuggaagaccuggggcaaggcgaagaugcucagcaccgagucccacaaccagaccuuccugaucgacgggcccgagacggccgagugcccgaacaccaaccgggccuggaacagccuggagguggaggacuacggcuucgggguguucaccaccaacaucuggcucaagcugcgcgagaagcaggacgucuucugcgacuccaagcugaugagcgccgccaucaaggacaaccgggcggugcacgccgacaugggcuacuggaucgaguccgcccucaacgacaccuggaagauggagaaggccagcuucaucgaggugaaguccugccacuggcccaagagccacacgcugugguccaacggcguccuggagagcgagaugaucauccccaagaacuucgccgggcccgugucccagcacaacuaccgcccgggcuaccacacccagaccgcggggcccuggcaccucggcaagcuggagauggacuucgaccugugcgaggggaccacgguggucgugaccgaggacugcggcaaccggggccccagccuccgcaccaccacggccagcgggaagcugaucaccgaguggugcugccgguccugcacccugcccccgcuccgcuaccggggcgaggacgggugcugguacggcauggagauccgcccccugaaggagaaggaggagaaccuggugaacagccucgucaccgccgggcacggccagaucgacaacuucucccugggcgugcuggggauggcccucuuccuggaggagaugcugcggacgcgcgugggcaccaagcacgcgauccuccuggucgccgugagcuucgugacccugaucaccgggaacauguccuuccgggaccucggccgcgucauggugauggugggggccacgaugaccgacgacaucggcaugggcgucaccuaccuggcccugcucgccgcguucaaggugcgccccaccuucgccgccgggcugcugcuccggaagcugacgagcaaggagcugaugauggccaccaucggcaucgcccuccugucccagagcaccauccccgagaccauccuggagcucacggacgcgcuggcccuggggaugauggugcucaagaucguccgcaacauggagaaguaccagcuggccgugaccaucauggccaucuccugcgugccgaacgccaugauccugcggaacgcguggaaggucagcugcaccauccucgccgccguguccgucagcccccugcugcucaccuccagccagcagaaggccgacuggaucccccuggcgcugacgaucaagggccucaaccccaccgccaucuuccugaccacccugucccgcacgagcaagaagcgguccuggccgcucaacgaggccaucauggccgugggcauggugagcauccuggccuccagccugcucaagaacgacauccccaugaccgggccccuggucgcgggcgggcugcucaccgugugcuacgugcugaccggccgcagcgccgaccuggagcucgagcgggccgccgaggucaagugggaggaccaggccgagaucuccgggagcucccccauccugagcaucacgaucuccgaggacggcagcauguccaucaagaacgaggaggaggagcagacccugaccauccucauccgcaccggccugcuggugaucagcgggguguucccggucuccauccccaucaccgcggccgccugguaccucugggaggugaagaagcagcgggccggcgugcugugggacguccccagcccgccgcccguggggcgcgccgagcuggaggacggcgcguaccggaucaagcagcgcgggauccucggcuacucccagaucggcgccgggguguacaaggagggcacguuccacaccauguggcacgucacccgcggggccgugcugaugcaccgcggcaagcggaucgagcccagcugggccgacgugaagaaggaccugaucuccuacgggggcggcuggaagcucgagggggaguggaaggagggcgaggagguccaggugcuggcccuggagcccgggaagaacccccgcgcggugcagaccaagcccggcaucuucaagacgaacaccgggaccaucggcgccgucagccucgacuucucccccggcaccagcgggucccccaucguggaccggaagggcaagguggucgggcuguacggcaacggcguggugacgcgcagcggggccuacgucuccgccaucgcgcagaccgagaaguccaucgaggacaaccccgagaucgaggacgacaucuuccggaagaagcgccugaccaucauggaccuccaccccggcgccgggaagaccaagcgguaccugcccgccaucgugcgcgaggccaucaagcgcggccugcggacgcugauccucgccccgacccgcguggucgcggccgagauggaggaggcccugcgggggcugcccauccgcuaccagacccccgccaucaaggccgagcacaccggccgggagaucguggaccucaugugccacgcgacguucaccaugcgccugcugagccccgugcgggucccgaacuacaaccucaucaucauggacgaggcccacuucaccgaccccgccuccaucgccgcccgcggcuacaucagcacccggguggagaugggggaggcggccggcaucuucaugacggccacgccgcccgggucccgcgacccguucccccagagcaacgcccccaucauggacgaggagcgggagauccccgagcgcuccuggaacagcggccacgagugggugaccgacuucaaggggaagaccgucugguucgugccguccaucaaggcgggcaacgacaucgccgccugccugcggaagaacggcaagaaggugauccagcugagccgcaagacguucgacuccgaguacgucaagacccgggccaacgacugggacuucguggugaccaccgacaucagcgagaugggggccaacuucaaggcggagcgcgucaucgacccccggcgcugcaugaagcccgugauccucacggacggcgaggagcgggugauccuggccgggcccaugccggucacccacuccagcgccgcccagcgccgcggccggaucgggcgcaaccccaagaacgagaacgaccaguacaucuacaugggcgagccccuggagaacgacgaggacugcgcccacuggaaggaggcgaagaugcuccuggacaacaucaacacccccgagggcaucaucccguccauguucgagcccgagcgggagaagguggacgccaucgacggggaguaccgccugcggggcgaggcccgcaagaccuucguggaccucaugcggcgcggggaccugcccgucuggcuggccuacaagguggccgcggagggcaucaacuacgccgaccggaaguggugcuucgacgggaucaagaacaaccagauccucgaggagaacguggaggucgagaucuggacgaaggagggcgagcgcaagaagcugaagccgcgguggcuggacgcccgcaucuacagcgacccccucgcccugaaggaguucaaggaguucgcggccggccggaagucccugacccucaaccugaucaccgagauggggcgccugcccaccuucaugacgcagaaggcccggaacgcccucgacaaccuggccgugcugcacaccgcggaggccggcgggcgcgccuacaaccacgcccucagcgagcugcccgagacccuggagacccuccugcugcucacgcugcuggccaccgucaccggcggcaucuuccucuuccugauguccgggaagggcaucgggaagaugacccugggcaugugcugcaucaucaccgcgagcgugcuccugugguacgcccagauccagccgcacuggaucgccgccuccaucauccuggaguucuuccucaucgugcugcugauccccgagcccgagaagcagcggacgccccaggacaaccagcucaccuacgucgugaucgccauccugaccguggucgcggccaccauggccaacgagaugggguuccuggagaagacgaagaaggaccucggccugggcagcaucaccacccaggagagcgaguccaacauccuggacaucgaccuccgcccggccagcgccuggacccuguacgcgguggccacgaccuucgugacccccaugcugcggcacuccaucgagaacagcuccgucaacgugagccucaccgccaucgccaaccaggcgacggugcugauggggcugggcaagggguggccccucuccaagauggacaucggcgucccccugcuggccaucgggugcuacagccaggugaacccgaucacccucaccgccgcccugcugcuccugguggcccacuacgcgaucaucggccccggccugcaggccaaggccacccgcgaggcccagaagcgggccgcggccgggaucaugaagaaccccacggucgacggcaucaccgugaucgaccucgagcccaucccguacgaccccaaguucgagaagcagcuggggcaggucaugcugcucauccugugcgucacccaggugcugaugaugcgcaccacgugggcccucugcgaggcccugacccuggccaccggccccaucuccacccucugggaggggaaccccggccgcuucuggaacacgaccaucgcggugagcauggccaacaucuuccggggcuccuaccuggccggggccggccuccuguucagcaucaugaagaacaccaccaacacgcgccgggggaccggcaacaucggcgagacccugggggagaaguggaagucccgccugaacgcgcucggcaagagcgaguuccagaucuacaagaaguccgggauccaggaggucgaccggacccuggccaaggagggcaucaagcgcggggagacggaccaccacgccgugagccggggcuccgccaagcugcgcugguucguggagcggaacauggucaccccggagggcaaggugguggaccucgggugcggccgcgggggcuggagcuacuacugcgggggccugaagaacguccgggaggugaagggccugaccaagggcggccccgggcacgaggagcccauccccauguccaccuacggcuggaaccucgugcgccugcagagcggggucgacguguucuucacgccgcccgagaagugcgacacccugcucugcgacaucggcgagagcucccccaaccccaccaucgaggccggccggacccugcgcgugcugaaccucgucgagaacuggcugaacaacaacacccaguucugcaucaaggugcugaacccguacaugcccagcgugaucgagaagauggagacgcuccagcggaaguacgggggcgcgcugguccgcaacccccugucccggaacagcacccacgagauguacuggguguccaacgccaccgggaacaucgugagcuccgucaacaugaucagccgcaugcugaucaaccgguucaccaugaagcacaagaaggccacguacgagccggacguggaccucggcuccgggacccgcaacaucggcaucgagagcgagauccccaaccuggacaucaucggcaagcgcaucgagaagaucaagcaggagcacgagaccuccuggcacuacgaccaggaccaccccuacaagaccugggccuaccacgggagcuacgagacgaagcagaccggcuccgccagcuccauggugaacggggucgugcggcugcucaccaagcccugggacguggucccgauggugacccagauggcgaugacggacaccacccccuucggccagcagcgcguguucaaggagaaggucgacacccggacgcaggagcccaaggagggcaccaagaagcugaugaagaucaccgccgaguggcuguggaaggagcucgggaagaagaagacgccccgcaugugcacgcgggaggaguucacccgcaaggugcggagcaacgccgcccugggcgccaucuucaccgacgagaacaaguggaaguccgcgcgcgaggccguggaggacgggcgguucugggagcuggucgaccgcgagcggaaccuccaccuggagggcaagugcgagaccugcguguacaacaugauggggaagcgcgagaagaagcugggcgaguucggcaaggccaaggggagccgggccaucugguacauguggcucggcgcgcgcuuccuggaguucgaggcccugggguuccucaacgaggaccacugguucucccggggcaacagccugagcggggucgagggcgagggccugcaccgccucggguacauccugcgggacguguccaagaaggagggcggggccauguacgccgacgacacggccggcugggacacccgcaucacccuggaggaccucaagaacgaggagauggugaccaaccacaugaagggggagcacaagaagcuggcggaggccaucuucaagcugacguaccagaacaaggucgugcgggugcagcgcccgacgccccggggcaccgucauggacaucaucagccgccgcgaccagcggggcuccggccaggugggcaccuacgggcucaacacguucaccaacauggaggcccagcugauccgccagauggagggcgagggcaucuucaagagcauccagcaccugaccgccaucgaggagaucgccgugcagaacuggcucgcgcgggucgggcgcgagcggcugucccgcauggccaucagcggcgacgacugcguggugaagcccaucgacgaccgguucgccuccgcccugaccgcccucaacgacauggggaagguccgcaaggacauccagcagugggagcccagccggggcuggaacgacuggacccaggugccguucugcucccaccacuuccacgagcuggugaugaaggacgggcgcguccugguggugcccugccggaaccaggacgagcucaucggccgcgcgcggaucagccagggcgccggguggucccugaaggagaccgccugccugggcaagagcuacgcccagauguggacccucauguacuuccaccgccgggaccugcgccuggccgcgaacgccaucugcuccgccguccccagccacugggugcccaccucccggaccacguggagcauccacgccaagcacgaguggaugaccaccgaggacaugcucgcgguguggaaccgcgucuggauccaggagaacccguggauggaggacaagacccccguggaguccugggaggaggugcccuaccuggggaagcgggaggaccaguggugcggcagccugaucgggcucacgagccgcgccaccugggccaagaacauccagaccgccaucaaccagguccgcucccugaucggcaacgaggaguacaccgacuacaugcccagcaugaagcgguuccgccgggaggaggaggaggccggcgugcugugguga

SEQ ID NO: 9126 - RNA, 9876 nt, Artificial Sequence
  derived and/or modified CDS sequence (opt1) from DENV-2__GQ868558__SS-prME
accgccggcgugaucgucaugcugauccccaccgccaucgcguuccaccucaccacccgcaacggggagccccacaugaucgugggccggcaggagaaggggaagucccugcuguucaagaccgaggacggcgugaacaugugcacccucauggccaucgaccugggggagcugugcgaggacaccaucaccuacaagugcccccuccugaagcagaacgagcccgaggacaucgacugcuggugcaacagcaccagcaccugggucaccuacgggaccugcaccaccacgggcgagcaccgccgggagaagcgcuccguggcccuggugccccacgucgggaugggccucgagacccggaccgagaccuggaugagcuccgagggggccuggaagcacgugcagcgcaucgagacguggauccugcggcacccgggcuucaccaucauggccgcgauccuggccuacaccaucgggaccacgcacuuccagcgcgcccucaucuucauccugcugaccgccguggcgcccagcaugaccaugcggugcaucggcaucuccaaccgcgacuucgucgagggcgugagcgggggcuccuggguggacaucguccucgagcacgggagcugcgugaccacgauggccaagaacaagcccacccuggacuucgagcugaucaagaccgaggccaagcagcccgccacccuccggaaguacugcaucgaggccaagcugacgaacaccaccaccgagucccgcugcccgacgcagggcgagcccagccugaacgaggagcaggacaagcgguucaucugcaagcacuccaugguggaccgcggcugggggaacggcugcgggcuguucggcaagggcgggaucgugaccugcgcgauguucacgugcaagaagaacauggagggcaagguggugcagcccgagaaccuggaguacaccaucgucaucacgccccacagcggggaggagcacgccgugggcaacgacaccgggaagcacggcaaggagaucaagaucaccccgcaguccagcaucaccgaggccgagcugaccggguacggcacggugaccauggagugcagcccccggaccggccucgacuucaacgagaugguccugcugcagauggaggacaaggccuggcucgugcaccgccagugguuccuggaccugccccuccccuggcugccgggggccgacacccagggcagcaacuggauccagaaggagacgcuggugaccuucaagaacccccacgcgaagaagcaggacgucgugguccucgggucccaggagggcgccaugcacaccgcccugaccggggccacggagauccagaugagcagcggcaaccuccuguucaccggccaccugaagugccggcugcgcauggacaagcuccagcugaaggggauguccuacagcaugugcaccggcaaguucaagaucgugaaggagaucgccgagacccagcacgggacgaucgugauccggguccaguacgagggcgacggcucccccugcaagauccccuucgagaucaccgaccuggagaagcgccacgugcucgggcggcugaucaccgugaacccgaucgucaccgagaaggacagccccgugaacaucgaggcggagccgcccuucggcgacuccuacaucaucaucgggguggagccgggccagcugaagcucaacugguucaagaaggggagcuccaucggccagauguucgagacgaccaugcgcggcgccaagcgcauggccauccugggggacaccgccugggacuucggcagccucgggggcgucuucaccuccaucgggaaggcccuccaccagguguucggcgcgaucuacggcgccgccuucagcgggguguccuggacgaugaagauccugaucggcgucgugaucaccuggaucgggaugaacagccgguccaccagccuguccgugagccugguccucgugggcguggucacccuguaccugggggccauggugcaggcggacuccggcugcguggucagcuggaagaacaaggagcucaagugcggcuccgggaucuucaucacggacaacgugcacaccuggaccgagcaguacaaguuccagcccgagagccccagcaagcuggccuccgccauccagaaggcccacgaggagggcaucugcgggauccgcagcgugacccggcuggagaaccucauguggaagcagaucacgcccgagcugaaccacauccuguccgagaacgaggucaagcucaccaucaugaccggcgacaccaaggggaucaugcaggccggcaagcgcagccugcggccgcagcccacggagcugaaguacuccuggaagaccuggggcaaggcgaagaugcacagcaccgagucccacaaccagaccuuccucaucgacgggcccgagacggccgagugcccgaacaccaaccgcgccuggaacagccuggagguggaggacuacggcuucgggguguucaccaccaacaucuggcugaagcuccgggagaagcaggacgucuucugcgacuccaagcugaugagcgccgccaucaaggacaaccgcgcggugcacgccgacaugggcuacuggaucgaguccgcccugaacgacaccuggaagauggagaaggccagcuucaucgaggugaaguccugccacuggcccaagagccacacgcucugguccaacggcguccuggagagcgagaugaucauccccaagaacuucgccgggcccgugucccagcacaacuaccggccgggcuaccacacccagaccgcggggcccuggcaccugggcaagcucgagauggacuucgaccugugcgaggggaccacgguggucgugaccgaggacugcggcaaccgcggccccagccugcggaccaccacggccagcgggaagcucaucaccgaguggugcugccgcuccugcacccugcccccgcugcgguaccgcggcgaggacgggugcugguacggcauggagauccggccccucaaggagaaggaggagaaccuggugaacagccuggucaccgccgggcacggccagaucgacaacuucucccucggcgugcuggggauggcccuguuccucgaggagaugcugcgcacgcgggugggcaccaagcacgcgauccugcucgucgccgugagcuucgugacccugaucaccgggaacauguccuuccgcgaccugggccgggucauggugauggugggggccacgaugaccgacgacaucggcaugggcgucaccuaccucgcccugcuggccgcguucaaggugcgccccaccuucgccgccgggcuccugcugcgcaagcucacgagcaaggagcugaugauggccaccaucggcaucgcccugcucucccagagcaccauccccgagaccauccuggagcugacggacgcgcucgcccuggggaugauggugcugaagaucguccggaacauggagaaguaccagcucgccgugaccaucauggccaucuccugcgugccgaacgccgucauccugcgcaacgcguggaaggugagcugcaccauccuggccgccgucuccgugagcccccuccugcugaccuccagccagcagaaggccgacuggaucccccucgugcugacgaucaagggccugaaccccaccgcgaucuuccucaccacccugucccggacgagcaagaagcgcuccuggccgcugaacgaggccaucauggccgucggcauggugagcauccucgccuccagccugcugaagaacgacauccccaugaccgggccccucguggccggcgggcugcugaccgucugcuacgugcucaccggccggagcgcggaccuggagcuggagcgcgccgccgaggugaagugggaggaccaggccgagaucuccgggagcucccccauccucagcaucacgaucuccgaggacggcagcauguccaucaagaacgaggaggaggagcagacccugaccauccugauccggaccggccuccuggucaucagcgggguguucccgguguccauccccaucaccgccgcggccugguaccugugggaggucaagaagcagcgcgccggcgugcucugggacgugcccagcccgccgcccgucgggaaggccgagcuggaggacggcgccuaccggaucaagcagcgcgggauccugggcuacucccagaucggcgcggggguguacaaggagggcacguuccacaccauguggcacgugacccgcggggccguccucaugcaccgcggcaagcggaucgagcccagcugggccgacgugaagaaggaccugaucuccuacgggggcggcuggaagcuggagggggaguggaaggagggcgaggaggugcagguccucgcccuggagcccgggaagaacccccgcgccgugcagaccaagcccggcaucuucaagacgaacgcggggaccaucggcgccgugagccuggacuucucccccggcaccagcgggucccccaucgucgaccggaagggcaaggugguggggcucuacggcaacggcgucgugacccgcagcggggccuacguguccgccaucgcgcagacggagaaguccaucgaggacaaccccgagaucgaggacgacaucuuccggaagaagcgccugaccaucauggaccugcaccccggcgccgggaagaccaagcgguaccuccccgccaucguccgcgaggccaucaagcggggccugcgcacccugauccuggccccgacgcgcgugguggcggccgagauggaggaggcccuccgggggcugcccauccgcuaccagacccccgccaucaaggccgagcacaccggccgggagaucgucgaccugaugugccacgcgaccuucacgaugcgccuccugagccccgugcgggugccgaacuacaaccugaucaucauggacgaggcccacuucaccgaccccgccuccaucgccgcccgcggcuacaucagcacccgggucgagaugggggaggcggccggcaucuucaugaccgccacgccgcccgggucccgcgacccguucccccagagcaacgcccccaucauggacgaggagcgggagauccccgagcgcuccuggaacagcggccacgagugggugaccgacuucaaggggaagaccgugugguucgucccguccaucaaggcgggcaacgacaucgccgccugccuccggaagaacggcaagaaggugauccagcugagccgcaagaccuucgacuccgaguacgugaagacgcgggccaacgacugggacuucgucgugaccaccgacaucagcgagaugggggccaacuucaaggcggagcgcgugaucgacccccggcgcugcaugaagcccgucauccugaccgacggcgaggagcgggugauccucgccgggcccaugccggugacgcacuccagcgccgcccagcgccggggccgcaucgggcgcaaccccaagaacgagaacgaccaguacaucuacaugggcgagccccuggagaacgacgaggacugcgcccacuggaaggaggcgaagaugcugcucgacaacaucaacacccccgagggcaucaucccguccauguucgagcccgagcgggagaaggucgacgccaucgacggggaguaccgccugcggggcgaggcccgcaagaccuucguggaccugaugcggcgcggggaccuccccguguggcuggccuacaaggucgccgcggagggcaucaacuacgccgaccggaaguggugcuucgacgggaucaagaacaaccagauccuggaggagaacguggaggucgagaucuggaccaaggagggcgagcgcaagaagcucaagccgcgguggcuggacgcccgcaucuacagcgacccccuggcccucaaggaguucaaggaguucgcggccggccggaagucccugacgcugaaccucaucaccgagauggggcgccugcccaccuucaugacccagaaggcccggaacgcccuggacaaccucgccgugcugcacacggcggaggccggcgggcgcgccuacaaccacgcccugagcgagcuccccgagacccuggagacccugcuccugcugacccuccuggccacggugaccggcggcaucuuccuguuccucauguccgggaagggcaucgggaagaugacccugggcaugugcugcaucaucaccgcgagcguccugcucugguacgcccagauccagccgcacuggaucgccgccuccaucauccuggaguucuuccugaucgugcuccugauccccgagcccgagaagcagcggacgccccaggacaaccagcugacguacguggucaucgccauccucaccgugguggcggccaccauggccaacgagaugggguuccuggagaagaccaagaaggaccugggccucggcagcaucacgacccaggagagcgaguccaacauccuggacaucgaccugcgcccggccagcgccuggacccucuacgcggucgccaccacguucgugacccccaugcugcggcacuccaucgagaacagcuccgugaacgucagccugaccgccaucgccaaccaggcgaccgugcucauggggcugggcaagggguggccccuguccaagauggacaucggcgugccccuccuggccaucgggugcuacagccaggucaacccgaucacgcugaccgccgcccuccugcugcucguggcccacuacgcgaucaucggccccggccugcaggccaaggccacccgcgaggcccagaagcgggccgcggccgggaucaugaagaaccccaccguggacggcaucacggucaucgaccuggagcccaucccguacgaccccaaguucgagaagcagcucgggcaggucaugcugcugauccucugcgugacccagguccugaugaugcgcaccaccugggcccugugcgaggcccucacgcuggccaccggccccaucuccacccugugggaggggaaccccggccgguucuggaacaccacgaucgcggugagcauggccaacaucuuccgcggcuccuaccucgccggggccggccugcuguucagcaucaugaagaacaccaccaacacccgccgggggacgggcaacaucggcgagacccucggggagaaguggaagucccgccugaacgcgcugggcaagagcgaguuccagaucuacaagaaguccgggauccaggagguggaccggacccucgccaaggagggcaucaagcgcggggagaccgaccaccacgccgucagccggggcuccgccaagcugcgcugguucguggagcggaacauggugacgccggagggcaaggucguggaccuggggugcggccgcgggggcuggagcuacuacugcgggggccucaagaacgugcgggaggucaagggccugaccaagggcggccccgggcacgaggagcccauccccauguccaccuacggcuggaaccuggugcgccuccagagcgggguggacgucuucuucaccccgcccgagaagugcgacacgcugcugugcgacaucggcgagagcucccccaaccccaccaucgaggccggccggacccuccgcgugcugaaccugguggagaacuggcucaacaacaacacccaguucugcaucaagguccugaacccguacaugcccagcgugaucgagaagauggagacccugcagcggaaguacgggggcgcgcucgugcgcaacccccugucccggaacagcacgcacgagauguacugggucuccaacgccaccgggaacaucgugagcuccgugaacaugaucagccgcaugcugaucaaccgguucaccaugaagcacaagaaggccaccuacgagccggacgucgaccugggcuccgggacgcgcaacaucggcaucgagagcgagauccccaaccucgacaucaucggcaagcggaucgagaagaucaagcaggagcacgagaccuccuggcacuacgaccaggaccaccccuacaagaccugggccuaccacgggagcuacgagaccaagcagacgggcuccgccagcuccauggugaacggggugguccgccugcugaccaagcccugggacguggugccgauggucacccagauggcgaugaccgacacgacccccuucggccagcagcgcguguucaaggagaagguggacacccggacccaggagcccaaggagggcacgaagaagcucaugaagaucaccgccgaguggcuguggaaggagcuggggaagaagaagacgccccggaugugcacccgggaggaguucacgcgcaagguccggagcaacgccgcccucggcgccaucuucaccgacgagaacaaguggaaguccgcgcgcgaggccguggaggacgggcgguucugggagcuggucgaccgcgagcggaaccugcaccucgagggcaagugcgagaccugcguguacaacaugauggggaagcgcgagaagaagcugggcgaguucggcaaggccaaggggagccgggccaucugguacauguggcugggcgcgcgcuuccucgaguucgaggcccugggguuccugaacgaggaccacugguucucccggggcaacagccucagcgggguggagggcgagggccugcaccgccugggguacauccuccgggacgucuccaagaaggagggcggggccauguacgccgacgacaccgccggcugggacacgcgcaucacccuggaggaccugaagaacgaggagauggugaccaaccacaugaagggggagcacaagaagcucgcggaggccaucuucaagcugaccuaccagaacaaggugguccgggugcagcgcccgacgccccggggcaccgugauggacaucaucagccgccgggaccagcgcggcuccgggcaggucggcaccuacgggcugaacaccuucacgaacauggaggcccagcucauccgccagauggagggcgagggcaucuucaagagcauccagcaccugaccgccaucgaggagaucgccgugcagaacuggcuggcgaagguggggcgggagcgccucucccggauggccaucagcggcgacgacugcgucgugaagcccaucgacgaccgcuucgccuccgcccugaccgcccugaacgacauggggaaggugcggaaggacauccagcagugggagcccagccgcggcuggaacgacuggacccaggucccguucugcucccaccacuuccacgagcucgugaugaaggacgggcgggugcuggucgugcccugccgcaaccaggacgagcugaucggccgggcgcgcaucagccagggcgccggguggucccucaaggagacggccugccugggcaagagcuacgcccagauguggacccugauguacuuccaccggcgcgaccuccggcuggccgcgaacgccaucugcuccgccgugcccagccacuggguccccaccucccgcaccaccuggagcauccacgccaagcacgaguggaugacgaccgaggacaugcuggcgguguggaaccggguguggauccaggagaacccguggauggaggacaagacccccgucgaguccugggaggaggugcccuaccucgggaagcgcgaggaccaguggugcggcagccugaucgggcugaccagccgggccacgugggccaagaacauccagaccgccaucaaccaggugcgcucccucaucggcaacgaggaguacaccgacuacaugcccagcaugaagcgguuccgccgcgaggaggaggaggccggcguccugugguga

SEQ ID NO: 9127 - RNA, 9876 nt, Artificial Sequence
  derived and/or modified CDS sequence (opt1) from DENV-2__KJ189305__SS-prME
accgccggcgucaucgucaugcugauccccaccgccauggcguuccaccucaccacccgcaacggggagccccacaugaucgugggccggcaggagaaggggaagucccugcuguucaagaccgaggacggcgugaacaugugcacccucauggccaucgaccugggggagcugugcgaggacaccaucaccuacaagugcccccuccugcgccagaacgagcccgaggacaucgacugcuggugcaacagcaccagcaccugggucaccuacgggaccugcaccaccacgggcgagcaccggcgcgagaagcgguccguggcccuggugccccacgucgggaugggccucgagacccgcaccgagaccuggaugagcuccgagggggccuggaagcacgugcagcggaucgagaccuggauccugcgccacccgggcuucaccaucauggccgcgauccuggccuacaccaucgggaccacgcacuuccagcgggcccucaucuucauccugcugaccgccguggcgcccagcaugaccaugcgcugcaucggcaucuccaaccgggacuucgucgagggcgugagcgggggcuccuggguggacaucguccucgagcacgggagcugcgugaccacgauggccaagaacaagcccacccuggacuucgagcugaucaagaccgaggccaagcagcccgccacccuccgcaaguacugcaucgaggccaagcugacgaacaccaccaccgagucccggugcccgacgcagggcgagcccagccugaacgaggagcaggacaagcgcuucaucugcaagcacuccaugguggaccggggcugggggaacggcugcgggcuguucggcaagggcgggaucgugaccugcgcgauguucacgugcaagaagaacauggagggcaagguggugcagcccgagaaccuggaguacaccaucgucaucacgccccacagcggggaggagcacgccgugggcaacgacaccgggaagcacggcaaggagaucaagaucaccccgcaguccagcaucaccgaggccgagcugaccggguacggcacggugaccauggagugcagcccccgcaccggccucgacuucaacgagaugguccugcugcagauggaggacaaggccuggcucgugcaccggcagugguuccuggaccugccccuccccuggcugccgggggccgacacccagggcagcaacuggauccagaaggagacgcuggugaccuucaagaacccccacgcgaagaagcaggacgucgugguccucgggucccaggagggcgccaugcacaccgcccugaccggggccacggagauccagaugagcagcggcaaccuccuguucaccggccaccugaagugccgccugcggauggacaagcuccagcugaaggggauguccuacagcaugugcaccggcaaguucaagaucgugaaggagaucgccgagacccagcacgggacgaucgugauccgcguccaguacgagggcgacggcucccccugcaagauccccuucgagaucaccgaccuggagaagcggcacgugcucgggcgccugaucaccgugaacccgaucgucaccgagaaggacagccccgugaacaucgaggcggagccgcccuucggcgacuccuacaucaucaucgggguggagccgggccagcugaagcucaacugguucaagaaggggagcuccaucggccagauguucgagacgaccaugcgcggcgccaagcggauggccauccugggggacaccgccugggacuucggcagccucggcggggucuucaccuccaucgggaaggcccuccaccagguguucggggcgaucuacggcgccgccuucagcgggguguccuggacgaugaagauccugaucggcgucaucaucaccuggaucgggaugaacagccgcuccaccagccuguccgugagccuggugcucgucggcguggugacccuguaccugggggccaugguccaggcggacuccggcugcguggugagcuggaagaacaaggagcucaagugcggcuccgggaucuucaucacggacaacguccacaccuggaccgagcaguacaaguuccagcccgagagccccagcaagcuggccuccgccauccagaaggcccacgaggagggcaucugcgggauccggagcgugacccgccuggagaaccucauguggaagcagaucacgcccgagcugaaccacauccuguccgagaacgaggugaagcucaccaucaugaccggcgacaucaaggggaucaugcaggccggcaagcggagccugcgcccgcagcccaccgagcugaaguacuccuggaagacguggggcaaggcgaagaugcucagcaccgagucccacaaccagaccuuccugaucgacgggcccgagaccgccgagugcccgaacacgaaccgggccuggaacagccuggaggucgaggacuacggcuucgggguguucaccaccaacaucuggcucaagcugaaggagaagcaggacguguucugcgacuccaagcugaugagcgccgccaucaaggacaaccgcgcgguccacgccgacaugggcuacuggaucgaguccgcccucaacgacaccuggaagauggagaaggccagcuucaucgaggugaaguccugccacuggcccaagagccacacccugugguccaacggcgugcuggagagcgagaugaucauccccaagaacuucgccgggcccgcgucccagcacaacuaccggccgggcuacuacacgcagaccgccgggcccuggcaccucggcaagcuggagauggacuucgacuucugcgaggggaccaccgucguggugacggaggacugcggcaaccgcggccccagccugcggaccaccaccgccagcgggaagcucaucacggaguggugcugccgcuccugcacccugcccccgcugcgguaccgcggcgaggacgggugcugguacggcauggagauccggccccucaaggagaaggaggagaaccuggucaacagccuggugaccgccgggcacggccagaucgacaacuucucccucggcgugcuggggauggcgcuguuccucgaggagaugcugcgcacccgggucggcacgaagcacgccauccugcucguggccgugagcuucgucacccugaucaccgggaacauguccuuccgcgaccugggccgggugauggugauggucggggccaccaugacggacgacaucggcaugggcgugaccuaccucgcccugcuggcggccuucaaggugcgccccaccuucgccgccgggcuccugcugcgcaagcucaccagcaaggagcugaugauggccacgaucggcaucgcgcugcucucccagagcaccauccccgagaccauccuggagcugaccgacgcccucgcccuggggaugaugguccugaagaucgugcggaacauggagaaguaccagcucgccgugacgaucauggccaucuccugcgucccgaacgcggugauccugcagaacgccuggaaggugagcugcaccauccuggccgccgucuccgugagcccccuccugcugaccuccagccagcagaaggcggacuggaucccccucgcccugaccaucaagggccugaaccccacggccaucuuccucaccacccugucccgcaccagcaagaagcgguccuggccgcugaacgaggccaucauggccgucggcauggugagcauccucgcguccagccugcugaagaacgacauccccaugacggggccccucguggccggcgggcugcugaccgucugcuacgugcucaccggccgcagcgccgaccuggagcuggagcgggccgccgacgugaagugggaggaccaggcggagaucuccgggagcucccccauccucagcaucaccaucuccgaggacggcagcauguccaucaagaacgaggaggaggagcagacgcugaccauccugauccgcaccggccuccuggucaucagcgggguguucccgguguccauccccaucaccgccgccgccugguaccugugggaggucaagaagcagcgggccggcgugcucugggacgugcccagcccgccgcccgucgggaaggcggagcuggaggacggcgccuaccgcaucaagcagcgggggauccugggcuacucccagaucggcgccgggguguacaaggagggcaccuuccacacgauguggcacgugacccgcggggccguccucaugcaccggggcaagcgcaucgagcccagcugggccgacgugaagaaggaccugaucuccuacgggggcggcuggaagcuggagggggaguggaaggagggcgaggaggugcagguccucgcgcuggagcccgggaagaacccccgggccgugcagaccaagcccggcaucuucaagaccaacacggggaccaucggcgccgugagccuggacuucucccccggcaccagcgggucccccaucgucgacaagaagggcaaggugguggggcucuacggcaacggcgucgugacccgcagcggggccuacguguccgcgaucgcccagacggagaaguccaucgaggacaaccccgagaucgaggacgacaucuuccggaagaagcgccugaccaucauggaccugcaccccggcgccgggaagaccaagcgguaccuccccgccaucguccgcgaggccaucaagcggggccugcgcacccugauccuggcgccgacgcgggugguggccgccgagauggaggaggcccuccgcgggcugcccauccgcuaccagacccccgccaucaaggcggagcacaccggccgggagaucgucgaccugaugugccacgccaccuucacgaugcgccuccugagccccgugcgggugccgaacuacaaccugaucaucauggacgaggcccacuucaccgaccccgccuccaucgccgcgcgcggcuacaucagcacccgggucgagaugggggaggccgccggcaucuucaugaccgccacgccgcccgggucccgcgacccguucccccagagcaacgcgcccaucauggacgaggagcgggagauccccgagcgcuccuggaacagcggccacgagugggugaccgacuucaaggggaagaccgugugguucgucccguccaucaaggccggcaacgacaucgccgccugccuccggaagaacggcaagaaggugauccagcugagccgcaagaccuucgacuccgaguacgugaagacgcgggccaacgacugggacuucgucgugaccaccgacaucagcgagaugggggcgaacuucaaggccgagcgcgugaucgacccccggcgcugcaugaagcccgucauccugaccgacggcgaggagcgggugauccucgccgggcccaugccggugacgcacuccagcgccgcccagcgccggggccgcaucgggcggaaccccaagaacgagaacgaccaguacaucuacaugggcgagccccuggagaacgacgaggacugcgcgcacuggaaggaggccaagaugcugcucgacaacaucaacacccccgagggcaucaucccguccauguucgagcccgagcgcgagaaggucgacgccaucgacggggaguaccgccugcggggcgaggcccgcaagaccuucguggaccugaugcggcgcggggaccuccccguguggcuggccuacaaggucgcggccgagggcaucaacuacgccgaccggaaguggugcuucgacgggaucaagaacaaccagauccuggaggagaacguggagguggagaucuggaccaaggagggcgagcgcaagaagcucaagccgcgguggcuggacgcccgcaucuacagcgacccccuggcgcucaaggaguucaaggaguucgccgccggccggaagucccugacgcugaaccucaucaccgagauggggcgccugcccaccuucaugacccagaaggcccggaacgcccuggacaaccucgcgguccugcacacggccgaggccggcgggcgcgccuacaaccacgcccugagcgagcuccccgagacccuggagacccugcuccugcugacccuccuggcgacggugaccggcggcaucuuccuguuccucauguccgggaagggcaucgggaagaugacccugggcaugugcugcaucaucaccgccagcauccugcucugguacgcccagauccagccgcacuggaucgccgccuccaucauccuggaguucuuccugaucguccuccugauccccgagcccgagaagcagcggacgccccaggacaaccagcugacguacguggugaucgcgauccucaccgucguggccgccaccauggccaacgagaugggguuccuggagaagaccaagaaggaccugggccucggcagcaucacgacccaggagagcgaguccaacauccuggacaucgaccugcgcccggccagcgcguggacccucuacgccguggccaccacguucgucacccccaugcugcggcacuccaucgagaacagcuccgugaacgugagccugaccgccaucgcgaaccaggccaccguccucauggggcugggcaagggguggccccuguccaagauggacaucggcgugccccuccuggccaucgggugcuacagccaggugaacccgaucacgcugaccgccgcccuccugcugcucgucgcgcacuacgccaucaucggccccggccugcaggccaaggccacccgcgaggcccagaagcgggcggccgccgggaucaugaagaaccccaccguggacggcaucacggugaucgaccuggagcccaucccguacgaccccaaguucgagaagcagcucgggcaggucaugcugcugauccucugcgugacccaggugcugaugaugcgcaccaccugggcccugugcgaggcccucacgcuggcgaccggccccaucuccacccugugggaggggaaccccggccgguucuggaacaccacgaucgccgucagcauggccaacaucuuccgcggcuccuaccucgccggggcgggccugcuguucagcaucaugaagaacaccaccaacacccggcgcgggacgggcaacaucggcgagacccucggggagaaguggaagucccgccugaacacccugggcaagagcgaguuccagaucuacaagaaguccgggauccaggagguggaccggacccucgccaaggagggcaucaagcgcggggagacggaccaccacgccgugagccggggcuccgccaagcugcgcugguucgucgagcggaacauggugaccccggagggcaagguggucgaccuggggugcggccgcgggggcuggagcuacuacugcgggggccucaagaacgugcgggaggugaagggccugaccaagggcggccccgggcacgaggagcccauccccauguccaccuacggcuggaaccugguccgccuccagagcgggguggacguguucuucacgccgcccgagaagugcgacacccugcugugcgacaucggcgagagcucccccaaccccaccaucgaggccggccggacccuccgcguccugaaccugguggagaacuggcucaacaacaacacccaguucugcaucaaggugcugaacccguacaugcccagcgucaucgagaagauggagacgcugcagcggaaguacgggggcgcgcucgugcgcaacccccugucccggaacagcacccacgagauguacuggguguccaacgccaccgggaacaucgucagcuccgugaacaugaucagccgcaugcugaucaaccgguucaccaugaagcacaagaaggccacguacgagccggacguggaccugggcuccgggacccgcaacaucggcaucgagagcgagauccccaaccucgacaucaucggcaagcggaucgagaagaucaagcaggagcacgagaccuccuggcacuacgaccaggaccaccccuacaagaccugggccuaccacgggagcuacgagacgaagcagaccggcuccgccagcuccauggucaacgggguggugcgccugcugaccaagcccugggacgucgugccgauggugacccagauggcgaugacggacaccacccccuucggccagcagcgggucuucaaggagaagguggacacccgcacgcaggagcccaaggagggcaccaagaagcucaugaagaucaccgccgaguggcuguggaaggagcuggggaagaagaagacgccccgcaugugcacgcgggaggaguucacccgcaaggugcggagcaacgccgcccucggcgccaucuucaccgacgagaacaaguggaaguccgcgcgcgaggccgucgaggacgggcgguucugggagcugguggaccgcgagcggaaccugcaccucgagggcaagugcgagaccugcguguacaacaugauggggaagcgcgagaagaagcugggcgaguucggcaaggccaaggggagccgggccaucugguacauguggcugggcgcgcgcuuccucgaguucgaggcccugggguuccugaacgaggaccacugguucucccggggcaacagccucagcggggucgagggcgagggccugcaccgccugggguacauccuccgggacgugggcaagaaggagggcggcgccauguacgccgacgacacggccgggugggacacccgcaucacccuggaggaccugaagaacgaggagauggucaccaaccacaugaagggcgagcacaagaagcucgcggaggccaucuucaagcugacguaccagaacaagguggugcggguccagcgcccgacgccccggggcaccgugauggacaucaucucccgccgggaccagcgcgggagcggccagguggggaccuacggccugaacacguucaccaacauggaggcccagcucauccggcagauggagggcgaggggaucuucaaguccauccagcaccugaccgccaccgaggagaucgccguccagaacuggcuggcgcgcgugggccgcgagcggcucagccgcauggccaucuccggggacgacugcguggucaagcccaucgacgaccgguucgccagcgcccugacggcccugaacgacaugggcaaggugcgcaaggacauccagcagugggagcccucccggggguggaacgacuggacccaggugccguucugcagccaccacuuccacgagcucgucaugaaggacggccgcgugcuggugguccccugccggaaccaggacgagcugaucggccgcgcgcggaucucccagggggccggcuggagccucaaggagaccgccugccuggggaaguccuacgcccagauguggacccugauguacuuccaccgccgggaccuccgccuggccgcgaacgccaucugcagcgccgugcccucccacugggugcccaccagccggacgaccugguccauccacgccaagcacgaguggaugaccaccgaggacaugcuggcggucuggaaccgcguguggauccaggagaacccguggauggaggacaagacgcccguggagagcugggaggagguccccuaccucggcaagcgggaggaccaguggugcgggucccugaucggccugaccagccgcgccaccugggccaagaacauccagaccgccaucaaccaggugcggagccucaucggcaacgaggaguacacggacuacaugcccuccaugaagcgcuuccggcgcgaggaggaggaggccggggugcugugguga

SEQ ID NO: 9128 - RNA, 9876 nt, Artificial Sequence
  derived and/or modified CDS sequence (opt1) from DENV-2__FJ898451__SS-prME
accgccggcgugaucgucaugcugauccccaccgccauggcguuccaccucaccacccggaacggggagccccacaugaucgugggccggcaggagaaggggaagucccugcuguucaagaccgaggacggcgugaacaugugcacccucauggccaucgaccugggggagcugugcgaggacaccaucaccuacaagugcccccuccugcggcagaacgagcccgaggacaucgacugcuggugcaacagcaccagcaccugggucacguacgggaccugcaccaccacgggcgagcaccggcgcgagaagcgguccguggcccuggugccccacgucgggaugggccucgagacccgcaccgagaccuggaugagcagcgagggggccuggaagcacgugcagcggaucgagacguggauccugcggcacccgggcuucaccaucauggccgcgauccuggccuacaccaucgggaccacgcacuuccagcgggcccucaucuucauccugcugaccgccguggcgcccagcaugaccaugcgcugcaucggcaucuccaaccgggacuucgucgagggcgugagcgggggcuccuggguggacaucguccucgagcacgggagcugcgugaccacgauggccaagaacaagcccacccuggacuucgagcugaucaagaccgaggccaagcagcccgccacccuccgcaaguacugcaucgaggccaagcugacgaacaccaccaccgagucccggugcccgacgcagggcgagcccagccugaacgaggagcaggacaagcgcuucaucugcaagcacuccaugguggaccggggcugggggaacggcugcgggcuguucggcaagggcgggaucgugaccugcgcgauguucacgugcaagaagaacauggagggcaagaucgugcagcccgagaaccuggaguacaccaucgugaucacgccccacagcggggaggagcacgccgucggcaacgacaccgggaagcacggcaaggagaucaagaucaccccgcaguccagcaccaccgaggccgagcugacgggguacggcaccgugaccauggagugcagcccccggaccggccucgacuucaacgagauggugcugcugcagauggaggacaaggccuggcucguccaccggcagugguuccuggaccugccccuccccuggcugccgggggccgacacgcagggcagcaacuggauccagaaggagacccuggugaccuucaagaacccccacgcgaagaagcaggacguggucgugcucgggucccaggagggcgccaugcacaccgcccugacgggggccaccgagauccagaugagcagcggcaaccuccuguucaccggccaccugaagugccgccugcggauggacaagcuccagcugaaggggauguccuacagcaugugcaccggcaaguucaagaucgucaaggagaucgccgagacgcagcacgggaccaucgugauccgcgugcaguacgagggcgacggcucccccugcaagauccccuucgagaucaccgaccuggagaagcggcacguccucgggcgccugaucaccgugaacccgaucgugacggagaaggacagccccgucaacaucgaggcggagccgcccuucggcgacuccuacaucaucguggggguggagccgggccagcugaagcucaacugguucaagaaggggagcuccaucggccagauguucgagaccaccaugcgcggcgccaagcggauggccauccugggggacaccgccugggacuucggcagccucggcggggucuucacguccaucgggaaggcccuccaccagguguucggggcgaucuacggcgccgccuucagcgggguguccuggaccaugaagauccugaucggcgucaucaucaccuggaucgggaugaacagccgcuccaccagccuguccgugagccuggugcucgucggcguggugacgcuguaccugggggucauggugcaggccgacuccggcugcaucgugagcuggaagaacaaggagcucaagugcggcuccgggaucuucaucaccgacaacguccacaccuggaccgagcaguacaaguuccagcccgagagccccagcaagcuggcguccgccauccagaaggcccacgaggagggcaucugcgggauccggagcgugacgcgccuggagaaccucauguggaagcagaucacccccgagcugaaccacauccuguccgagaacgaggugaagcucaccaucaugaccggcgacaucaaggggaucaugcaggccggcaagcggagccugcgcccgcagcccacggagcugaaguacuccuggaagaccuggggcaaggccaagaugcucagcaccgagucccacaaccagaccuuccugaucgacgggcccgagacggcggagugcccgaacaccaaccgggccuggaacagccuggaggucgaggacuacggcuucgggguguucuccaccaacaucuggcucaagcugcgcgagaagcaggacguguucugcgacagcaagcugauguccgccgccaucaaggacaaccgggccguccacgcggacaugggcuacuggaucgagagcgugcucaacgacaccuggaagauggagaaggccuccuucaucgaggucaagagcugccacuggcccaagucccacacccuguggagcaacggcgugcuggaguccgagaugaucauccccaagaacuucgccgggcccgugagccagcacaacuaccgcccgggcuaccacacgcagaccgccgggcccuggcaccucggcaagcuggagauggacuucgacuucugcgaggggaccaccguggucgugacggaggacugcggcaaccggggccccagccugcgcaccaccaccgccuccgggaagcucaucacggaguggugcugccggagcugcacccugcccccgcugcgcuaccggggcgaggacgggugcugguacggcauggagauccgcccccucaaggagaaggaggagaaccuggugaacucccuggucaccgcggggcacggccagaucgacaacuucagccucggcgugcuggggauggcccuguuccucgaggagaugcugcggacccgcgugggcacgaagcacgccauccugcucgucgcccuguccuucgugacccugaucaccgggaacaugagcuuccgggaccucggccgcgugauggucauggugggggcgaccaugacggacgacaucggcaugggcgugaccuaccuggcccugcucgccgccuucaagguccgccccaccuucgccgcggggcugcugcuccggaagcugaccuccaaggagcugaugauggccacgaucggcaucgcccuccugagccaguccacccugcccgagaccauccucgagcugaccgacgcccuggcccucgggaugauggugcugaagaucgugcgcaacauggagaaguaccagcuggcggucacgaucauggccaucagcugcgugccgaacgccgugauccuccagaacgccuggaaggucuccugcaccauccuggccgcggugagcgucagcccccugcuccugaccagcucccagcagaaggccgacuggaucccccuggcccucaccaucaagggccugaaccccacggccaucuuccugaccacccucagccggaccuccaagaagcgcagcuggccgcugaacgaggcgaucauggccgugggcaugguguccauccuggccagcagccuccugaagaacgacauccccaugacggggccccuggucgccggcgggcuccugaccgugugcuacgugcugaccggccgguccgccgaccucgagcuggagcgcgcggccgacgucaagugggaggaccaggccgagaucagcggguccagccccauccuguccaucaccaucagcgaggacggcuccaugagcaucaagaacgaggaggaggagcagacgcucaccauccugauccggaccggccugcucgugaucuccgggguguucccggucagcauccccaucaccgccgccgcgugguaccugugggaggugaagaagcagcgcgccggcgugcugugggacguccccagcccgccgcccguggggaaggccgagcucgaggacggcgccuaccggaucaagcagcgcgggauccugggcuacagccagaucggcgccgggguguacaaggagggcaccuuccacacgauguggcacgucacccgcggggcggugcugaugcaccgcggcaagcggaucgagcccuccugggccgacgugaagaaggaccucaucagcuacgggggcggcuggaagcuggagggggaguggaaggagggcgaggagguccaggugcuggcccucgagcccgggaagaacccccgcgccgugcagaccaagcccggcaucuucaagaccaacacggggaccaucggcgccgucucccuggacuucagccccggcaccuccgggagccccaucguggaccggaagggcaagguggucgggcuguacggcaacggcguggugacccgcuccggggcguacgucagcgccaucgcccagacggagaaguccaucgaggacaaccccgagaucgaggacgacaucuuccggaagaagcgccucaccaucauggaccugcaccccggcgccgggaagaccaagcgguaccugcccgcgaucgugcgcgaggccaucaagcggggccugcgcacccucauccuggccccgacgcgcguggucgccgccgagauggaggaggcgcugcgggggcuccccauccgcuaccagacccccgccauccgggccgagcacaccggccgcgagaucguggaccugaugugccacgccaccuucacgaugcggcugcucucccccgugcgcgucccgaacuacaaccugaucaucauggacgaggcccacuucaccgaccccgcgagcaucgccgcccggggcuacaucuccacccgcguggagaugggggaggccgccggcaucuucaugaccgcgacgccgcccgggagccgggacccguucccccaguccaacgcccccaucauggacgaggagcgcgagauccccgagcggagcuggaacuccggccacgagugggugaccgacuucaaggggaagaccgucugguucgugccgagcaucaaggccggcaacgacaucgccgcgugccugcgcaagaacggcaagaaggugauccagcucucccggaagaccuucgacagcgaguacgucaagacgcgcgccaacgacugggacuucguggugaccaccgacaucuccgagaugggggccaacuucaaggccgagcgggucaucgacccccgccggugcaugaagcccgugauccugaccgacggcgaggagcgcgugauccuggccgggcccaugccggucacgcacagcuccgcggcccagcggcgcggccgcaucgggcggaaccccaagaacgagaacgaccaguacaucuacaugggcgagccccucgagaacgacgaggacugcgcccacuggaaggaggccaagaugcugcuggacaacaucaacacccccgagggcaucaucccgagcauguucgagcccgagcgcgagaagguggacgccaucgacggggaguaccggcuccgcggcgaggcgcggaagaccuucguggaccugaugcgccgcggggaccugcccgucuggcucgccuacaagguggccgccgagggcaucaacuacgccgaccgcaaguggugcuucgacgggaucaagaacaaccagauccuggaggagaacguggaggucgagaucuggaccaaggagggcgagcggaagaagcugaagccgcgcuggcucgacgcgcggaucuacuccgacccccuggcccugaaggaguucaaggaguucgccgccggccgcaagagccucacgcugaaccugaucaccgagauggggcggcuccccaccuucaugacccagaaggcgcgcaacgcccuggacaaccuggccgugcuccacacggccgaggucggcgggcgggccuacaaccacgcgcuguccgagcugcccgagacccucgagacccugcugcuccugacccugcucgccacggugaccggcggcaucuuccuguuccugaugagcgggaagggcaucgggaagaugacccucggcaugugcugcaucaucaccgccuccauccugcugugguacgcccagauccagccgcacuggaucgccgcgagcaucauccucgaguucuuccugaucgugcugcucauccccgagcccgagaagcagcgcacgccccaggacaaccagcugacguacgucgugaucgccauccugaccguggucgccgccaccauggccaacgagaugggguuccucgagaagaccaagaaggaccugggcuucggcagcaucacgacccaggaguccgagagcaacauccuggacaucgaccuccggccggcguccgccuggacccuguacgccguggccaccacguucgugacccccaugcugcgccacagcaucgagaacuccagcgucaacgugucccucaccgccaucgcgaaccaggccaccgugcugauggggcugggcaagggguggccccucagcaagauggacaucggcgucccccugcuggccaucgggugcuacucccaggugaacccgaucacgcucaccgccgcgcugcugcuccugguggcccacuacgccaucaucggccccggccugcaggccaaggccacccgggaggcgcagaagcgcgccgccgccgggaucaugaagaaccccaccgucgacggcaucacggugaucgaccucgagcccaucccguacgaccccaaguucgagaagcagcuggggcaggucaugcugcucauccugugcgucacccaggugcugaugaugcggaccaccugggcccucugcgaggcgcugacgcuggccaccggccccaucagcacccucugggaggggaaccccggccgcuucuggaacaccacgaucgccguguccauggccaacaucuuccgcggcagcuaccuggccggggcgggccuccuguucuccaucaugaagaacaccaccaacacccggcgcgggacgggcaacgucggcgagacccugggggagaaguggaagucccggcugaacgcccucggcaaguccgaguuccagaucuacaagaaguccgggauccaggagguggaccgcacccuggccaaggagggcaucaagcgcggggagaccgaccaccacgccgugucccgcggcagcgcgaagcugcggugguucgucgagcgcaacauggugacgccggagggcaagguggucgaccucgggugcggccgcggcgggugguccuacuacugcggcgggcugaagaacgugcgcgaggugaaggggcugaccaagggcggccccgggcacgaggagcccauccccaugagcaccuacggcuggaaccucguccggcugcagagcgggguggacguguucuucaccccgcccgagaagugcgacacgcugcucugcgacaucggcgaguccagccccaaccccaccaucgaggccggccgcacccugcggguccugaaccucguggagaacuggcugaacaacaacacccaguucugcaucaaggugcugaacccguacaugcccuccgucaucgagaagauggagacccuccagcgcaaguacgggggcgcccuggugcggaacccccugagccgcaacuccacgcacgagauguacugggugagcaacgccaccgggaacaucgucuccagcgugaacaugaucucccggaugcugaucaaccgcuucaccaugaagcacaagaaggccaccuacgagccggacguggaccucggcagcgggacgcggaacaucggcaucgaguccgagauccccaaccuggacaucaucggcaagcgcaucgagaagaucaagcaggagcacgagaccagcuggcacuacgaccaggaccaccccuacaagaccugggcguaccacggguccuacgagaccaagcagacgggcagcgccuccagcauggucaacgggguggugcgccugcucaccaagcccugggacgucgugccgauggugacccagauggccaugaccgacacgacccccuucggccagcagcgggucuucaaggagaagguggacacccgcacccaggagcccaaggagggcacgaagaagcugaugaagaucaccgccgaguggcuguggaaggagcucgggaagaagaagacgccccggaugugcacccgcgaggaguucacgcggaaggugcgcuccaacgccgcgcugggcgccaucuucaccgacgagaacaaguggaaguccgcccgggaggccgucgaggacgggcgcuucugggagcugguggaccgggagcgcaaccuccaccuggagggcaagugcgagaccugcgucuacaacaugauggggaagcgggagaagaagcugggcgaguucggcaaggccaaggggucccgcgcgaucugguacauguggcucggcgcccgguuccuggaguucgaggcccugggguuccucaacgaggaccacugguucagccgcggcaacagccuguccgggguggagggcgagggccugcaccggcucggguacauccugcgcgaggugggcaagaaggagggcggcgccauguacgcggacgacaccgccgggugggacacgcggaucacccuggaggaccucaagaacgaggagauggucaccaaccacaugaagggcgagcacaagaagcuggccgaggccaucuucaagcugaccuaccagaacaagguggugcgcguccagcggccgacgccccgcggcaccgugauggacaucaucagccggaaggaccagcgcggguccggccagguggggaccuacggccucaacaccuucacgaacauggaggcccagcugauccgccagauggagggcgaggggaucuucaagagcauccagcaccugaccgcgaccgaggagaucgccguccagaacuggcucgcccgggugggccgcgagcggcugucccgcauggccaucagcggggacgacugcguggucaagcccaucgacgaccgguucgccuccgcgcugaccgcccucaacgacaugggcaaggugcgcaaggacauccagcagugggagcccagccggggguggaacgacuggacccaggugccguucugcucccaccacuuccacgagcuggucaugaaggacggccgcgugcuggugguccccugccggaaccaggacgagcucaucggccgcgcccggaucagccagggggccggcuggucccugaaggagaccgccugccugggcaagagcuacgcgcagauguggacccucauguacuuccaccgccgggaccugcgccuggccgccaacgccaucugcuccgccgugcccagccacugggugcccaccucccggaccacguggagcauccacgcgaagcacgaguggaugaccaccgaggacaugcucgccgucuggaaccgcguguggauccaggagaacccguggauggaggacaagacccccguggaguccugggaggagguccccuaccugggcaagcgggaggaccaguggugcgggagccugaucggccucacgagccgcgccaccugggccaagaacauccagaccgcgaucaaccaggugcggucccugaucggcaacgaggaguacaccgacuacaugcccagcaugaagcgcuuccgccgggaggaggaggaggccggggugcugugguga

SEQ ID NO: 9129 - RNA, 9876 nt, Artificial Sequence
  derived and/or modified CDS sequence (opt1) from DENV-2__HM488257__SS-prME
accgccgggaucaucaucaugaugauccccaccgugauggccuuccaccugaccacccggaacggggagccccacaugaucgucagccggcaggagaagggcaagagccuccuguucaagaccgagaacggggugaacaugugcacccugauggcgauggaccucggcgagcugugcgaggacaccaucaccuacaacugcccccugcuccgccagaacgagcccgaggacaucgacugcuggugcaacagcaccagcaccugggugacguacgggaccugcaccgucaccggcgagcaccggcgcgagaagcggagcguggcccuggugccccacgucggcauggggcuggagacgcgcaccgagaccuggauguccagcgagggcgccuggaagcacgcccagcggaucgagaccugggugcuccgccaccccggguucacgaucauggccgcgauccuggccuacaccaucggcaccaccuacuuccagcgggugcugaucuucauccuccugacggccgucgcccccuccaugaccaugcgcugcaucgggaucagcaaccgggacuucguggagggcguguccggcgggagcugggucgacaucgugcuggagcacggcuccugcgugaccaccauggcgaagaacaagcccacgcucgacuucgagcugaucaagaccgaggccaagcaccccgccacccugcgcaaguacugcaucgaggccaagcucaccaacacgaccaccgccagccggugcccgacccagggggagcccucccugaacgaggagcaggacaagcgcuucgucugcaagcacagcaugguggaccggggcuggggcaacgggugcggccuguucgggaagggcgggaucgugacgugcgcgauguucacgugcaagaagaacauggagggcaagaucguccagcccgagaaccucgaguacaccaucgugaucacgccccacuccggcgaggagaacgccguggggaacgacacgggcaagcacgggaaggagaucaaggucaccccgcagagcuccaucaccgaggccgagcugaccggcuacgggaccgugacgauggagugcagcccccgcaccggccuggacuucaacgagauggugcuccugcagauggagaacaaggccuggcugguccaccggcagugguuccucgaccugccccugcccuggcucccgggcgccgacacccagggguccaacuggauccagaaggagacccuggugacguucaagaacccccacgcgaagaagcaggacgucguggugcugggcagccaggagggggccaugcacaccgcccucaccggcgccaccgagauccagaugagcuccgggaaccugcuguucacgggccaccucaagugccgccugcggauggacaagcugcagcucaagggcaugagcuacuccaugugcaccgggaaguucaaggucgugaaggagaucgccgagacccagcacggcaccaucgugauccgcguccaguacgagggggacggcagccccugcaagauccccuucgagaucauggaccuggagaagcggcacgugcugggccgccucaucacggugaacccgaucgucaccgagaaggacucccccgugaacaucgaggcggagccgcccuucggggacagcuacaucaucgugggcgucgagccggggcagcugaagcuguccugguucaagaagggcagcuccaucgggcagauguucgagaccaccaugcgcggcgccaagcggauggccauccucggcgacacggccugggacuucgggagccugggcgggguguucaccuccaucggcaaggcccugcaccagguguucggggcgaucuacggcgccgccuucagcggcgucuccuggaccaugaagauccucaucgggguggugaucaccuggaucggcaugaacagccgcuccacgagccuguccgucagccuggugcuggugggggucgugacccucuaccugggcgugaugguccaggccgacuccgggugcguggugagcuggaagaacaaggagcugaagugcggcagcggcaucuucaucaccgacaacguccacaccuggacggagcaguacaaguuccagcccgagucccccagcaagcucgcguccgccauccagaaggcccacgaggaggggaucugcggcauccggagcgugacccgccuggagaaccugauguggaagcagaucacccccgagcucaaccacauccuguccgagaacgaggugaagcugaccaucaugacgggggacaucaagggcaucaugcaggccgggaagcggagccuccgcccgcagcccaccgagcugaaguacuccuggaaggccuggggcaaggcgaagaugcugagcaccgagcuccacaaccacaccuuccugaucgacggccccgagacggccgagugcccgaacaccaaccgggccuggaacucccuggaggucgaggacuacggguucggcguguucaccaccaacaucuggcucaagcugaaggagcgccaggacguguucugcgacagcaagcugauguccgccgccaucaaggacaaccgggcgguccacgccgacaugggguacuggaucgagagcgcccucaacgacacguggaagaucgagaaggccuccuucaucgaggucaagagcugccacuggcccaagucccacacccuguggagcaacggcgugcuggaguccgagaugaucauccccaagaacuucgccggccccgugagccagcacaacuaccgcccgggguaccacacccagaccgcgggccccuggcaccucgggcggcuggagauggacuucgacuucugcgagggcaccacggugguggucaccgaggacugcgggaaccgcggccccagccugcggaccaccacggccuccggcaagcucaucaccgaguggugcugccgcagcugcacccugcccccgcugcgguaccgcggggaggacggcugcugguacgggauggagauccggccccucaaggagaaggaggagaaccuggugaacucccuggugaccgccggccacgggcagaucgacaacuucagccucggcguccugggcauggcccuguuccucgaggagaugcugcgcacgcggguggggaccaagcacgcgauccugcucguggccgucuccuucgugacccugaucaccggcaacaugagcuuccgcgaccuggggcgcgugauggucauggugggcgccacgaugaccgacgacaucgggaugggcgugaccuaccucgcccugcuggccgcguucaagguccggcccaccuacgccgccggccuccugcugcgcaagcucacguccaaggagcugaugaugaccaccaucgggaucgugcugcucagccaguccaccauccccgagacgauccuggagcugaccgacgcccucgcccugggcaugaugguccugaagaucgugcggaacauggagaaguaccagcucgcggugaccaucauggccauccugugcgucccgaacgccgugauccugcagaacgccuggaaggugagcugcaccacgcucgccauggucuccgugagcccccugcugcucaccuccagccagcagaaggcggacuggaucccccuggcccugaccaucaaggggcucaaccccaccgccaucuuccugacgacccugucccgcaccagcaagaagcgguccuggccgcucaacgaggccaucauggcggugggcauggucagcauccuggccuccagccugcucaagaacgacauccccaugaccggcccccugguggccgggggccugcucacggugugcuacguccugaccgggcgcagcgccgaccuggagcucgagcgggccgcggacgugcgcugggaggagcaggccgagaucuccggcagcucccccauccugagcaucaccaucuccgaggacgggagcauguccaucaagaacgaggaggaggagcagacccugacgauccucauccggaccggccugcuggugaucagcggccucuucccggucuccauccccaucaccgccgccgccugguaccugugggaggugaagaagcagcgcgcgggggugcugugggacguccccagcccgccgcccgugggcaaggccgagcucgaggacggggccuaccggaucaagcagaagggcauccugggguacucccagaucggcgccggcguguacaaggaggggaccuuccacaccauguggcacgucacgcgcggcgccgugcugaugcacaaggggaagcggaucgagcccagcugggcggacgugaagaaggaccucaucuccuacggcgggggcuggaagcuggagggcgaguggaaggagggggaggagguccaggugcuggcccucgagcccggcaagaacccccgcgccgugcagaccaagcccgggcuguucaagaccaacaccggcacgaucggggccgucagccuggacuucucccccggcaccagcggcucccccaucguggacaagaaggggaagguggucggccucuacgggaacggcguggugacccggagcggcaccuacgucuccgccaucgcgcagacggagaaguccaucgaggacaaccccgagaucgaggacgacaucuuccgcaagaagcggcugaccaucauggaccugcaccccggggccggcaagaccaagcgcuaccugcccgccaucgugcgggaggccaucaagcgcgggcuccggacccugauccuggcgccgacgcgcguggucgccgccgagauggaggaggcccuccgcggccugcccauccgguaccagacccccgccauccgcgcggagcacaccgggcgggagaucguggaccugaugugccacgccaccuucacgaugcgccuccugagccccauccgggugccgaacuacaaccugaucaucauggacgaggcccacuucaccgaccccgccuccaucgccgcgcgcggcuacaucagcacccgggucgagaugggcgaggccgccgggaucuucaugaccgccacgccgcccggcucccgcgacccguucccccagagcaacgcccccaucauggacgaggagcgggagauccccgagcgcuccuggaacagcgggcacgagugggugaccgacuucaagggcaagaccgugugguucgucccguccaucaaggcggggaacgacaucgccgccugccuccggaagaacggcaagaaggugauccagcugagccgcaagaccuucgacuccgaguacaucaagacgcggaccaacgacugggacuucguggucaccaccgacaucagcgagaugggcgccaacuucaaggcggagcgcgugaucgacccccggcgcugcaugaagcccgugauccugacggacggggaggagcgggucauccucgccggccccaugccggugacccacuccagcgccgcccagcgccgggggcgcgugggccgcaaccccaagaacgagaacgaccaguacaucuacaugggggagccccuggagaacgacgaggacugcgcccacuggaaggaggcgaagaugcugcucgacaacaucaacacccccgagggcaucaucccguccauguucgagcccgagcgggagaaggucgacgccaucgacggcgaguaccgccugcgcggggaggcccgcaagaccuucguggaccugaugcggcgcggcgaccuccccgucuggcuggccuaccggguggccgcggaggggaucaacuacgccgaccgccgguggugcuucgacggcgugaagaacaaccagauccuggaggagaacgucgagguggagaucuggacgaaggagggggagcgcaagaagcucaagccgcgguggcuggacgcccgcaucuacagcgacccccuggcccucaaggaguucaaggaguucgccgcgggccggaagucccugacccugaaccucaucaccgagaugggccgccugcccaccuucaugacgcagaaggcccggaacgcccuggacaaccucgccgugcugcacaccgcggaggccgggggccgcgccuacaaccacgcccugagcgagcuccccgagacccuggagacccugcuccugcugacgcuccuggccaccgucaccgggggcaucuuccuguuccucauguccggcaaggggaucggcaagaugacccuggggaugugcugcaucaucaccgcgagcauccugcucugguacgcccagauccagccgcacuggaucgccgccuccaucauccuggaguucuuccugaucgugcuccugauccccgagcccgagaagcagcggacgccccaggacaaccagcugaccuacguggucaucgccauccucaccgugguggcggccaccauggccaacgagaugggcuuccuggagaagacgaagaaggacuucgggcugggcagcaucaccacccagcagccggagagcaacauccucgacaucgaccugcgccccgccuccgccuggacccuguacgcggucgccacgaccuucaucacccccaugcuccggcacagcaucgagaacuccagcgugaacgugucccugaccgccaucgccaaccaggccacgguccugaugggccucgggaagggcuggccccugagcaagauggacaucggggugccgcugcucgcgaucggcugcuacucccaggugaaccccaucacccugaccgccgcccugcuccugcuggucgcccacuacgcgaucaucgggcccggccuccaggccaaggccacccgcgaggcccagaagcgggccgcggccggcaucaugaagaaccccacgguggacgggaucaccgugaucgaccuggacccgauccccuacgaccccaaguucgagaagcagcugggccaggucaugcuccuggugcugugcgugacccagguccucaugaugcgcaccacgugggcccugugcgaggcccugacccucgccaccgggcccaucagcacccugugggagggcaacccggggcgcuucuggaacacgaccaucgcgguguccauggccaacaucuuccggggcagcuaccuggccggcgccgggcuccuguucuccaucaugaagaacaccgccaacacccgccggggcacggggaacaccggcgagacccugggcgagaaguggaagcaccgccucaacgcgcugggcaagagcgaguuccagaucuacaagaaguccggcauccaggagguggaccggacccuggccaaggaggggaucaagcgcggcgagacggaccaccacgccgucagccggggguccgccaagcuccgcugguucguggagcggaaccuggugacccccgagggcaaggucguggaccugggcugcgggcgcggcggguggagcuacuacugcggcgggcucaagaacgugaaggaggucaagggccugaccaagggcgggcccggccacgaggagcccaucccgauguccaccuacggguggaaccuggugcggcuccagagcggcguggacgucuucuucacgccgcccgagaagugcgacacccugcugugcgacaucggggaguccagccccaacccgaccguggaggcgggccgcacccuccgggugcugaaccuggucgagaacuggcucaacaacaacacccaguucugcaucaaggugcugaaccccuacaugcccagcgugaucgagaagauggaggcccugcagcgcaaguacggcggggcccugguccggaacccgcucucccgcaacagcacgcacgagauguacuggguguccaacgccagcggcaacaucguguccagcgucaacaugaucucccggaugcugaucaaccgcuucaccaugcggcacaagaaggccaccuacgagcccgacguggaccuggggagcggcacccgcaacaucgggaucgaguccgagacgcccaaccucgacaucaucggcaagcgcaucgagaagaucaagcaggagcacgagaccagcuggcacuacgaccaggaccaccccuacaagaccugggcguaccacggcuccuacgagaccaagcagacggggagcgccuccagcauggugaacggcgucgugcggcugcugaccaagccgugggacgugauccccauggucacccagauggccaugaccgacacgacccccuucgggcagcagcgcguguucaaggagaaggucgacacccggacccaggagcccaaggagggcacgaagaagcucaugaagaucaccgccgaguggcuguggaaggagcugggcaagaagaagaccccgcgcaugugcacccgggaggaguucacgcgcaaggugcgguccaacgccgcgcucggggccaucuucaccgacgagaacaaguggaaguccgcccgcgaggccguggaggacuccggcuucugggagcuggucgacaaggagcggaaccugcaccucgaggggaagugcgagaccugcguguacaacaugaugggcaagcgcgagaagaagcugggggaguucggcaaggccaagggcagccgggcgaucugguacauguggcugggggcccgcuuccucgaguucgaggcccugggcuuccugaacgaggaccacugguucucccggaagaacagccucagcgggguggagggcgaggggcugcacaagcugggcuacauccuccgcgacgucuccaagaaggagggcggggccauguacgcggacgacaccgccggcugggacacgcggaucacccuggaggaccugaagaacgaggagauggugaccaaccacauggagggggagcacaagaagcucgccgaggccaucuuccgccugaccuaccagaacaaggugguccgggugcagcgccccacgccccggggcaccgugauggacaucaucagccgccgggaccagcgcggguccggccaggucgugaccuacggccugaacaccuucacgaacauggaggcccagcucauccgccagauggagggggagggcguguucaagagcauccagcaccugaccgcgaccgaggagaucgccgucaagaccuggcuggugcggguggggcgcgagcggcucucccgcauggccaucagcggcgacgacugcgucgugaagccccuggacgaccgguucgccuccgcccugacggcgcucaacgacaugggcaaggugcgcaaggacauccagcagugggagccgagccggggguggaacgacuggacccagguccccuucugcucccaccacuuccacgagcugaucaugaaggacggccgcgugcuggugguccccugccggaaccaggacgagcucaucgggcgcgcccggaucagccagggcgccggguggucccugcgcgagaccgccugccugggcaagagcuacgcccagauguggucccucauguacuuccaccggcgcgaccugcggcuggcggccaacgccaucugcagcgccgugcccucccacugggugccgaccagccgcaccacgugguccauccacgccacccacgaguggaugaccaccgaggacaugcucacggucuggaaccggguguggauccaggagaaccccuggauggaggacaagacccccguggagagcugggaggagauccccuaccugggcaagcgcgaggaccaguggugcgggagccugaucggccucaccucccgggcgaccugggccaagaacauccagacggccaucaaccagguccgcagccugaucgggaacgaggaguacaccgacuacaugccguccaugaagcgcuuccggcgcgaggaggaggaggccggcgugcugugguga

SEQ ID NO: 9130 - RNA, 9876 nt, Artificial Sequence
  derived and/or modified CDS sequence (opt1) from DENV-2__HQ999999__SS-prME
accgcgggcgugaucgugaugcugauccccaccgccauggcguuccaccucaccacccgcaacggggagccccacaugaucgugggccggcaggagaaggggaagucccugcuguucaagaccgaggacggcgugaacaugugcacccucauggccaucgaccugggggagcugugcgaggacaccaucaccuacaagugcccccuccugcgccagaacgagcccgaggacaucgacugcuggugcaacagcaccagcaccugggucaccuacgggaccugcaccaccacgggcgagcaccggcgcgagaagcgguccguggcccuggugccccacgucgggaugggccucgagacccgcaccgagaccuggaugagcagcgagggggccuggaagcacauccagcggaucgagaccuggauccugcgccacccgggcuucaccaucauggccgcgauccuggccuacaccaucgggaccacccacuuccagcgggcccucaucuucauccugcugaccgccguggcgcccagcaugaccaugcgcugcaucggcaucagcaaccgggacuucguggagggcgucagcgggggcagcuggguggacaucgugcucgagcacgggagcugcgucaccacgauggccaagaacaagcccacccuggacuucgagcugaucaagaccgaggccaagcagcccgccacccuccgcaaguacugcaucgaggccaagcugacgaacaccaccaccgagucccggugcccgacgcagggcgagcccagccugaacgaggagcaggacaagcgcuucaucugcaagcacuccaugguggaccggggcugggggaacggcugcgggcuguucggcaagggcgggaucgugaccugcgcgauguucacgugcaagaagaacauggagggcaaggucgugcagcccgagaaccuggaguacaccaucgugaucacgccccacagcggggaggagcacgccgucggcaacgacaccgggaagcacggcaaggagaucaagaucaccccgcaguccagcaucaccgaggccgagcugaccggguacggcacggugaccauggagugcagcccccgcaccggccucgacuucaacgagauggugcugcugcagauggaggacaaggccuggcucguccaccggcagugguuccuggaccugccccuccccuggcugccgggggccgacacccagggcagcaacuggauccagaaggagacgcuggugaccuucaagaacccccacgcgaagaagcaggacguggucgugcucgggucccaggagggcgccaugcacaccgcccugaccggggccacggagauccagaugagcagcggcaaccuccuguucaccggccaccugaagugccgccugcggauggacaagcuccagcugaaggggauguccuacagcaugugcaccggcaaguucaagaucgucaaggagaucgccgagacccagcacgggacgaucgugauccgcgugcaguacgagggcgacggcucccccugcaagauccccuucgagaucaccgaccuggagaagcggcacguccucgggcgccugaucaccgugaacccgaucgugaccgagaaggacagccccaucaacaucgaggcggagccgcccuucggcgacuccuacaucaucaucggggucgagccgggccagcugaagcucaacugguucaagaaggggagcuccaucggccagauguucgagacgaccaugcgcggcgccaagcggauggccauccugggggacaccgccugggacuucggcagccucgggggcguguucaccuccaucgggaaggcccuccaccagguguucggcgcgaucuacggcgccgccuucagcggggucuccuggacgaugaagauccugaucggcgugaucaucaccuggaucgggaugaacagccgcuccaccagccuguccgugagccugguccucgugggcguggucacccuguaccugggggccauggugcaggcggacuccggcugcguggucagcuggaagaacaaggagcucaagugcggcuccgggaucuucaucacggacaacgugcacaccuggaccgagcaguacaaguuccagcccgagagccccagcaagcuggccuccgccauccagaaggcccacgaggagggcaucugcgggauccggagcgugacccgccuggagaaccucauguggaagcagaucacgcccgagcugaaccacauccuguccgagaacgaggucaagcucaccaucaugaccggcgacaucaaggggaucaugcaggccggcaagcggagccugcgcccgcagcccaccgagcugaaguacuccuggaagacguggggcaaggcgaagaugcucagcaccgagucccacaaccagaccuuccugaucgacgggcccgagaccgccgagugcccgaacacgaaccgggccuggaacagccuggagguggaggacuacggcuucgggguguucaccaccaacaucuggcucaagcugaaggagaagcaggacgucuucugcgacuccaagcugaugagcgccgccaucaaggacaaccgcgcggugcacgccgacaugggcuacuggaucgaguccgcccucaacgacaccuggaagauggagaaggccagcuucaucgaggugaaguccugccacuggcccaagagccacacccugugguccaacggcguccuggagagcgagaugaucauccccaagaacuucgccgggcccgugucccagcacaacuaccggccgggcuaccacacgcagaccgcggggcccuggcaccucggcaagcuggagauggacuucgaccugugcgaggggaccaccguggucgugacggaggacugcggcaaccgcggccccagccuccggaccaccaccgccagcgggaagcugaucacggaguggugcugccgcuccugcacccugcccccgcuccgguaccgcggcgaggacgggugcugguacggcauggagauccggccccugaaggagaaggaggagaaccuggugaacagccucgucaccgccgggcacggccagaucgacaacuucucccugggcgugcuggggauggcccucuuccuggaggagaugcugcgcacccggaucggcacgaagcacgcgauccuccugguggccgucagcuucgugacccugaucaccgggaacauguccuuccgcgaccucggccgggugauggucauggugggggccaccaugacggacgacaucggcaugggcgugaccuaccuggcccugcucgccgcguucaagguccgccccaccuucgccgccgggcugcugcuccgcaagcugaccagcaaggagcugaugauggccacgaucggcaucgcccuccugucccagagcaccauccccgagaccauccuggagcucaccgacgcgcuggcccuggggaugauggugcucaaggugguccggaacauggagaaguaccagcuggccgugacgaucauggccaucuccugcgugccgaacgccgucauccugcagaacgcguggaaggugagcugcaccauccucgccgccguguccgucagcccccugcugcucaccuccagccagcagaaggccgacuggaucccccuggcgcugaccaucaagggccucaaccccacggccaucuuccugaccacccugucccgcaccagcacgaagcgguccuggccgcucaacgaggccaucauggccgugggcauggucagcauccuggccuccagccugcucaagaacgacauccccaugaccgggccccugguggcgggcgggcugcucaccgugugcuacguccugaccggccgcagcgccgaccuggagcucgagcgggccgccgacgugaagugggaggaccaggccgagaucuccgggagcucccccauccugagcaucacgaucuccgaggacggcagcauguccaucaagaacgaggaggaggagcagacccugaccauccucauccgcaccggccugcuggugaucagcggggucuucccgguguccauccccaucaccgcggccgccugguaccucugggaggugaagaagcagcgggccggcguccugugggacgugcccagcccgccgcccguggagaaggccgagcuggaggacggggcguaccgcaucaagcagcggggcauccucggguacucccagaucggcgccggcgucuacaaggaggggacguuccacaccauguggcacgugacccgcggcgccgugcugaugcaccgggggaagcgcaucgagcccagcugggccgacgucaagaaggaccugaucuccuacggcgggggcuggaagcucgagggcgaguggaaggagggggaggagguccaggugcuggcccuggagcccggcaagaacccccgggcgguccagaccaagcccgggaucuucaagacgaacaccggcaccaucggggccgugagccucgacuucucccccggcaccagcggcucccccaucguggaccgcaaggggaaggucgugggccuguacgggaacggcguggucacgcggagcggcgccuacguguccgccaucgcgcagaccgagaaguccaucgaggacaaccccgagaucgaggacgacaucuuccgcaagaagcggcugaccaucauggaccuccaccccggggccggcaagaccaagcgcuaccugcccgccaucgugcgggaggccaucaagcgcgggcugcggacgcugauccucgccccgacccgcgucguggcggccgagauggaggaggcccugcgcggccugcccauccgguaccagacccccgccaucaagaccgagcacacggggcgcgagaucguggaccucaugugccacgccaccuucaccaugcggcugcugagccccguccgcgugccgaacuacaaccucaucaucauggacgaggcgcacuucaccgaccccgccuccaucgccgcccggggcuacaucagcacgcgcguggagaugggcgaggccgcggggaucuucaugaccgccacgccgcccggcucccgggacccguucccccagagcaacgcccccaucauggacgaggagcgcgagauccccgagcgguccuggaacagcgggcacgagugggucaccgacuucaagggcaagacggugugguucgugccguccaucaaggccgggaacgacaucgcggccugccugcgcaagaacggcaagaaggucauccagcugagccggaagaccuucgacuccgaguacgugaagacccgcgccaacgacugggacuucguggucaccacggacaucagcgagaugggcgccaacuucaaggccgagcgggugaucgacccccgccggugcaugaagcccgugauccucaccgacggggaggagcgcgucauccuggcgggccccaugccggugacccacuccagcgccgcccagcggcgcgggcggaucggccgcaaccccaagaacgagaacgaccaguacaucuacaugggggagccccuggagaacgacgaggacugcgcccacuggaaggaggccaagaugcuccuggacaacaucaacacccccgagggcaucaucccguccauguucgagcccgagcgcgagaagguggacgcgaucgacggcgaguaccggcugcgcggggaggcccggaagacguucgucgaccucaugcgccggggcgaccugcccguguggcuggccuacaagguggccgccgaggggaucaacuacgcggaccgccgguggugcuucgacggcaucaagaacaaccagauccucgaggagaacauggaggucgagaucuggaccaaggagggggagcgcaagaagcugaagccgcgguggcuggacgcccgcaucuacagcgacccccucgcccugaaggaguucaaggaguucgccgcgggccggaagucccugacccucaaccugaucaccgagaugggccgccugcccacguucaugacccagaaggcccggaacgcccucgacaaccuggccgugcugcacaccgccgaggccgggggccgcgccuacaaccacgcccucagcgagcugcccgagacccuggagacgcuccugcugcucacccugcuggccaccgugaccgggggcaucuuccucuuccugauguccggcaaggggaucggcaagaugacccuggggaugugcugcaucaucacggccagcauccuccugugguacgcgcagauccagccgcacuggaucgccgccuccaucauccuggaguucuuccucaucguccugcugauccccgagcccgagaagcagcggacgccccaggacaaccagcucaccuacguggucaucgccauccugaccgugguggccgcgacgauggccaacgagaugggcuuccuggagaagaccaagaaggaccucgggcugggcagcaucaccacccaggagagcgaguccaacauccuggacaucgaccuccgcccggccagcgccuggacgcuguacgccgucgcgaccaccuuccugacccccaugcuccggcacuccaucgagaacagcuccgugaacgugagccugacggccaucgccaaccaggccaccguccugaugggccucgggaagggcuggccccuguccaagauggacaucggggcgccccugcucgccaucggcugcuacagccaggugaacccgaucacccugaccgccgcccugcuccugcugguggcccacuacgcgaucaucgggcccggccuccaggccaaggccacgcgcgaggcccagaagcgggccgcggccggcaucaugaagaaccccaccgucgacgggaucaccgugaucgaccuggaccccaucccguacgaccccaaguucgagaagcagcugggccaggugaugcuccugauccugugcgucacccaggugcucaugaugcgcacgaccugggcccugugcgaggcccugacccucgccaccgggcccaucuccacgcugugggagggcaaccccgggcgguucuggaacaccaccaucgcggugagcauggccaacaucuuccgcggcuccuaccuggccggcgccgggcuccuguucagcaucaugaagaacaccacguccacccgccggggcaccgggaacaucggcgagacccugggcgagaaguggaagucccgccucaacgcgcuggggaaguccgaguuccagaucuacaagaaguccggcauccaggaggucgaccggacgcuggccaaggaggggaucaagcgcggcgagaccgaccaccacgccgugucccgggggagcgccaagcuccgcugguucguggagcggaacauggucaccccggagggcaaggugguggaccugggcugcgggcgcggcgggugguccuacuacugcggcgggcugaagaacguccgggaggugaagggccucaccaagggcgggcccggccacgaggagcccauccccaugagcacguacggguggaaccuggugcgccugcagagcggcgucgacguguucuucaccccgcccgagaagugcgacacccuccugugcgacaucggggaguccagccccaaccccaccaucgaggccggccggacccugcgcgugcucaaccuggucgagaacuggcugaacaacaacacgcaguucugcaucaaggugcucaacccguacaugcccuccgugaucgagaagauggaggcgcugcagcggaaguacggcggggcccugguccgcaacccccugagccggaacuccacccacgagauguacugggugagcaacgccaccggcaacaucguguccagcgucaacaugaucucccgcaugcucaucaaccgguucaccaugaagcacaagaaggccacguacgagccggacguggaccuggggagcggcacccgcaacaucgggaucgaguccgaggugcccaaccuggacaucaucggcaagcggaucgagaagaucaagcaggagcacgagaccagcuggcacuacgaccaggaccaccccuacaagaccugggccuaccacggcuccuacgagacgaagcagaccgggagcgcguccagcauggucaacggcguggugcgccuccugaccaagcccugggacgucgugccgauggugacccagauggccaugacggacaccacccccuucgggcagcagcgcgucuucaaggagaagguggacacccggacgcaggagcccaaggagggcaccaagaagcugaugaagaucaccgccgaguggcucuggaaggagcugggcaagaagaagacgccccgcaugugcacgcgggaggaguucacccgcaaggugcgguccaacgccgcccugggggcgaucuucaccgacgagaacaaguggaaguccgcccgcgaggccgucgaggacggccgguucugggagcucguggaccgcgagcggaaccugcaccuggaggggaagugcgagaccugcguguacaacaugaugggcaagcgcgagaagaagcucggggaguucggcaaggccaagggcucccgggcgaucugguacauguggcugggggcccgcuuccuggaguucgaggcccucggcuuccugaacgaggaccacugguucagccgggggaacagccuguccggcgucgagggggagggccuccaccgccugggcuacauccugcgggaggugagcaagaaggagggcggcgccauguacgccgacgacacggcggggugggacacccgcaucacccucgaggaccugaagaacgaggagauggugaccaaccacaugaagggcgagcacaagaagcuggccgaggccaucuucaagcucacguaccagaacaaggucgugcggguccagcgcccgacgccccgggggaccgugauggacaucaucucccgccgggaccagcgcggcagcggccagguggggaccuacggccugaacacguucaccaacauggaggcccagcugauccgccagauggagggggagggcaucuucaaguccauccagcaccucaccgccaccgaggagaucgcgguccagaacuggcuggcccgggugggccgcgagcggcugagccgcauggccaucuccggggacgacugcguggucaagcccaucgacgaccgguucgccagcgcccucacggcgcugaacgacaugggcaaggugcgcaaggacauccagcagugggagcccucccggggguggaacgacuggacccaggugccguucugcagccaccacuuccacgagcuggucaugaaggacggccgcgugcucgugguccccugccggaaccaggacgagcugaucgggcgcgcccggaucucccagggcgccggcuggagccugaaggagaccgccugccucgggaaguccuacgcccagauguggacccugauguacuuccaccgccgggaccugcgccucgcggccaacgccaucugcagcgccgugcccucccacugggugcccaccagccggacgaccugguccauccacgcgaagcacgaguggaugaccaccgaggacaugcuggccgucuggaaccgcguguggauccaggagaacccguggauggaggacaagacgcccguggagagcugggaggagguccccuaccugggcaagcgggaggaccaguggugcgggagccucaucggccugaccucccgcgccaccugggccaagaacauccagaccgccaucaaccaggugcggagccugaucgggaacgaggaguacacggacuacaugcccuccaugaagcgcuuccgccgggaggaggaggaggcgggcgugcucugguga

SEQ ID NO: 9131 - RNA, 9876 nt, Artificial Sequence
  derived and/or modified CDS sequence (opt1) from DENV-2__FJ898449__SS-prME
accgcgggcaugaucaucaugcugauccccaccgugauggccuuccaccucaccacccggaacggggagccccacaugaucgugagccggcaggagaagggcaagagccugcuguucaagaccaaggacgggaccaacaugugcacgcucauggcgauggaccugggcgagcugugcgaggacaccaucaccuacaagugccccuuccucaagcagaacgagcccgaggacaucgacugcuggugcaacagcaccuccaccugggugaccuacgggaccugcaccacgaccggcgagcaccgccgggagaagcgcagcguggcccuggucccccacgugggcauggggcuggagacccggaccgagacguggauguccagcgagggcgccuggaagcacgcccagcgcaucgagaccuggauccuccggcaccccggguucaccaucauggccgcgauccuggccuacaccaucggcacgacccacuuccagcgcgugcugaucuucauccuccugaccgccaucgcccccuccaugaccaugcggugcaucgggaucagcaaccgcgacuucgucgagggcguguccggcgggagcuggguggacaucguccuggagcacggcuccugcgugacgaccauggcgaagaacaagcccacccucgacuucgagcugaucaagaccgaggccaagcagcccgccacgcugcggaaguacugcaucgaggccaagcucaccaacaccaccacggacagccgcugcccgacccagggggagcccacccugaacgaggagcaggacaagcgguucgugugcaagcacuccauggucgaccgcggcuggggcaacgggugcggccuguucgggaagggcgggaucgugaccugcgccauguucacgugcaagaagaacauggagggcaagaucgugcagcccgagaaccucgaguacaccgucgugaucacgccccacagcggcgaggagcacgcgguggggaacgacaccggcaagcacgggaaggaggucaagaucaccccgcaguccagcaucacggaggccgagcugaccggcuacgggaccgugaccauggagugcagcccccggacgggccuggacuucaacgagauggugcuccugcagauggaggacaaggccuggcugguccaccgccagugguuccucgaccugccccugcccuggcucccgggcgccgacacccaggggagcaacuggauccagaaggagacccuggugaccuucaagaacccccacgccaagaagcaggacguggucgugcugggcucccaggagggggcgaugcacacggcccucaccggcgccaccgagauccagaugagcagcgggaaccugcuguucaccggccaccucaagugccggcugcgcauggacaagcugcagcucaagggcauguccuacagcaugugcacggggaaguucaagaucgucaaggagaucgccgagacccagcacggcaccaucgugauccgggugcaguacgagggggacggcucccccugcaagauccccuucgagaucauggaccuggagaagcgccacguccugggccggcucaucaccgugaacccgaucgugacggagaaggacagccccgucaacaucgaggccgagccgcccuucggggacuccuacaucaucaucggcguggagccggggcagcugaagcuggacugguucaagaagggcagcuccaucgggcagauguucgagaccaccaugcgcggcgcgaagcgcauggccauccucggcgacaccgccugggacuucgggagccugggcgggguguucacguccaucggcaaggcccugcaccaggucuucggggccaucuacggcgcggccuucagcggcguguccuggaccaugaagauccucaucggggugaucaucaccuggaucggcaugaacagccgguccaccagccuguccgucagccuggugcugguggggaucgucacgcucuaccugggcgugauggugcaggccgacuccgggugcgucgugagcuggaagaacaaggagcugaagugcggcuccggcaucuucgugaccgacaacguccacaccuggaccgagcaguacaaguuccagcccgagagccccagcaagcucgccuccgcgauccagaaggcccacgaggaggggaucugcggcauccgcagcgugacgcggcuggagaaccugauguggaagcagaucaccuccgagcucaaccacauccugagcgagaacgaggugaagcugaccaucaugaccggggacaucaagggcaucaugcaggucgggaagcgcucccuccggccccagccgacggagcugcgcuacagcuggaagaccuggggcaaggccaagaugcuguccaccgagcuccacaaccagaccuuccugaucgacggccccgagacggccgagugccccaacaccaaccgggccuggaacagccuggagguggaggacuacggguucggcguguucaccaccaacaucuggcuccgccugcgggagaagcaggacgucuucugcgacuccaagcugaugagcgcggccaucaaggacaaccgcgccgugcacgccgacaugggguacuggaucgaguccgcccucaacgacaccuggaagaucgagaaggcgagcuucaucgaggugaaguccugccacuggcccaagucccacacgcugugguccaacggcguccuggagagcgagaugaucauccccaagaacuucgccggccccgugucccagcacaacaaccggcccggguaccacacccagaccgccggcccguggcaccucgggaagcuggagauggacuucgacuucugcgagggcaccacgguggucgugaccgaggagugcgggaaccgcggccccagccugcggaccaccacggccagcggcaagcucaucaccgaguggugcugccgcuccugcacccugccgccccugcgguaccgcggggaggacggcugcugguacgggauggagauccggccgcucaaggagaaggaggagaaccuggugagcucccuggucaccgccggccacgggcagaucgacaacuucagccucggcauccugggcauggcgcuguuccucgaggagaugcugcgcacgcggguggggaccaagcacgccauccugcucguggccgucuccuucgugacccugaucaccggcaacaugagcuuccgcgaccuggggcgcgugauggucauggugggcgccacgaugaccgacgacaucgggaugggcgugaccuaccucgcgcugcuggccgccuucaagguccggcccaccuucgccgccggccuccugcugcgcaagcucacguccaaggagcugaugaugaccaccaucgggaucgugcugcucagccaguccagcauccccgagaccauccuggagcugacggacgcgcucgcccugggcaugauggugcugaagaugguccggaacauggagaaguaccagcucgccgugaccaucauggccauccugugcgugcccaacgccgucauccugcagaacgcguggaagguguccugcaccauccucgccgucgugagcguguccccgcugcugcucaccagcucccagcagaaggccgacuggaucccccuggcccugacgaucaaggggcucaaccccaccgccaucuuccugaccacccugagccgcacguccaagaagcggagcuggccccucaacgaggcgaucauggccgucggcaugguguccauccuggccagcagccugcucaagaacgacaucccgaugaccggcccccugguggccgggggccugcucaccgucugcuacgugcugaccgggcgcuccgcggaccuggagcucgagcgggccacggacgugaagugggacgaccaggccgagaucagcggcuccagccccauccuguccaucaccaucagcgaggacggguccaugagcaucaagaacgaggaggaggagcagacccugaccauccucauccgcaccggccugcuggucaucuccggccucuuccccgugagcaucccgaucacggccgccgcgugguaccugugggaggugaagaagcagcgggccgggguccugugggacgugcccagcccgccgcccgugggcaaggccgagcucgaggacggggccuaccgcaucaagcagaagggcauccugggguacagccagaucggcgccggcgucuacaaggaggggaccuuccacaccauguggcacgugacccggggcgcggugcugaugcacaaggggaagcgcaucgagcccuccugggccgacgucaagaaggaccucaucagcuacggcgggggcuggaagcuggagggcgaguggaaggagggggaggagguccaggugcuggcccucgagcccggcaagaacccccgggccguccagacgaagcccgggcuguuccgcaccaacaccggcaccaucggggccgugucccuggacuucagccccggcacguccggcagccccaucguggacaagaaggggaaggucgugggccucuacgggaacggcguggucacccgguccggcgcguacgugagcgccaucgcccagaccgagaaguccaucgaggacaacccggagaucgaggacgacaucuuccgcaagcggcgccugaccaucauggaccugcaccccggggccggcaagacgaagaaguaccugcccgccaucgugcgggaggcgaucaagcgcgggcuccggacccugauccuggcccccacccgcgucguggccgccgagauggaggaggcgcuccgcggccugccgauccgguaccagacccccgccauccgcgccgagcacacggggcgggagaucguggaccugaugugccacgccaccuucaccaugcgccuccugagccccauccggguccccaacuacaaccugaucaucauggacgaggcccacuucaccgacccggcgagcaucgccgcccgcggcuacaucuccacgcggguggagaugggcgaggccgccgggaucuucaugaccgcgacgccgcccggcagccgcgaccccuucccgcaguccaacgcccccaucauggacgaggagcgggagauccccgagcgcagcuggaacuccgggcacgagugggugaccgacuucaagggcaagacggucugguucgugcccagcaucaagaccgggaacgacaucgccgccugccuccggaagaacggcaagcgcgugauccagcugucccggaagaccuucgacagcgaguacgucaagacccgcacgaacgacugggacuucguggugaccaccgacaucuccgagaugggcgccaacuucaaggcggagcgggucaucgacccgcgccggugcaugaagcccgugauccugaccgacggggaggagcgcgugauccucgccggccccaugcccgucacgcacagcuccgccgcccagcggcgcgggcgcaucggccggaacccgcgcaacgagaacgaccaguacaucuacaugggggagccccuggagaacgacgaggacugcgcgcacuggaaggaggccaagaugcugcucgacaacaucaacacccccgagggcaucauccccagcauguucgagccggagcgggagaagguggacgccaucgacggcgaguaccgccugcgcggggaggcccgcaagaccuucguggaccugaugcggcgcggcgaccuccccgucuggcuggccuacaagguggcguccgaggggaucaacuacgccgaccggcgcuggugcuucgacggcacccggaacaaccagauccuggaggagaacguggaggucgagaucuggacgaaggagggggagcgcaagaagcucaagccccgguggcuggacgcccgcaucuacagcgacccgcuggcccucaaggaguucaaggaguucgccgcgggccggaagucccugacccugaaccucaucaccgagaugggccgccugcccaccuucaugacgcagaaggcccgggacgcccuggacaaccucgccgugcugcacaccgccgaggccggcgggaaggccuacaaccacgcccugagcgagcuccccgagacccuggagacccugcuccugcugacccuccuggccacggucaccggcgggaucuuccuguuccucauguccgggcgcgggaucggcaagaugacccuggggaugugcugcaucaucaccgcgagcauccugcucugguacgcccagauccagccccacuggaucgccgccagcaucauccuggaguucuuccugaucgugcuccugaucccggagcccgagaagcagcggacgccccaggacaaccagcugaccuacgugaucaucgccauccucaccgucguggcggccaccauggccaacgagaugggcuuccuggagaagacgaagaaggaccuggggcucggccacaucgccacccagcagcccgaguccaacauccuggacaucgaccugcgcccggccagcgcguggacccucuacgccguggccaccacguucaucacccccaugcugcggcacuccaucgagaacagcuccgucaacgugagccugaccgccaucgccaaccaggcgaccgugcucaugggccuggggaagggcuggccccuguccaagauggacaucggggucccccuccuggccaucggcugcuacagccaggugaacccgaucacgcugaccgccgcccuccugcugcucguggcccacuacgcgaucaucgggcccggccugcaggccaaggccacccgcgaggcccagaagcgcgcggccgccggcaucaugaagaaccccaccgucgacgggaucacggugaucgaccuggaccccaucccguacgaccccaaguucgagaagcagcucggccaggugaugcugcugguccucugcgugacccaggugcugaugaugcggaccaccugggcccugugcgaggcccucacgcuggcgaccgggcccgucuccacccugugggagggcaaccccgggcgcuucuggaacaccacgaucgccgugagcauggccaacaucuuccggggcuccuaccucgccggcgccgggcugcuguucagcaucaugaagaacaccaccuccacccgccggggcacggggaacaucggcgagacccucggcgagaaguggaagucccgccugaacgcgcuggggaaguccgaguuccagaucuacaagaaguccggcauccaggagguggaccggacccucgccaaggaggggaucaagcgcggcgagaccgaccaccacgccgucucccgggggagcgccaagcugcgcugguucguggagcggaaccuggugacgccggagggcaaggucguggaccucggcugcgggcgcggcgggugguccuacuacugcggcgggcugaagaacgugcgggaggucaagggccugaccaagggcgggcccggccacgaggagcccauccccaugagcaccuacggguggaaccucgugcgccugcagagcggcguggacgucuucuucgugccgcccgagcggugcgacacccugcucugcgacaucggggaguccagccccaaccccaccguggaggccggccgcacgcugcggguccugaaccucguggagaacuggcugaacaacaacacccaguucugcgugaagguccugaacccguacaugcccuccgugaucgagcgcauggagacccugcagcggaaguacggcggggcgcucgugcgcaacccccugagccgcaacuccacccacgagauguacugggucagcaacgccuccggcaacaucgugagcuccgugaacaugaucagccggaugcugaucaaccgcuucacgaugcggcacaagaaggccaccuacgagccggacgucgaccucggguccggcacccgcaacaucgggaucgagagcgagacccccaaccuggacaucaucggcaagcggaucgagaagaucaagcaggagcacgaggccuccuggcacuacgaccaggaccaccccuacaagacgugggcguaccacggcagcuacgagaccaagcagaccggguccgccagcuccauggugaacggcgugguccgccugcucaccaagcccugggacguggugccgauggucacgcagauggccaugaccgacaccacccccuucgggcagcagcggguguucaaggagaagguggacacgcgcacccaggagcccaaggagggcaccaagaagcugaugaagaucaccgccgaguggcuguggaaggagcucggcaaggagaagacgccccggaugugcacccgcgaggaguucaccaagaagguccggagcaacgccgcgcugggggccaucuucaccgacgagaacaaguggaaguccgcccgcgaggccguggaggacaaccgguucugggagcuggucgacaaggagcgcaaccuccaccuggagggcaagugcgagacgugcguguacaacaugauggggaagcgggagaagaagcugggcgaguucgggaaggccaagggcagccgcgcgaucugguacauguggcucggcgcccgguuccuggaguucgaggcccugggguuccucaacgaggaccacugguucagccgcgagaacucccugagcggcguggagggggagggccugcacaagcucggguacauccugcgggaggucuccaagaaggagggcggcgccauguacgccgacgacaccgcggggugggacacccgcaucaccaucgaggaccugaagaacgaggagaugaucacgaaccacauggccggcgagcacaagaagcucgccgaggccaucuucaagcugaccuaccagaacaagguggugcggguccagcgcccgacgccccgcgggaccgugauggacaucaucagccggcgcgaccagcggggcuccggccaggugggcaccuacggccugaacaccuucaccaacauggaggcgcagcucauccgccagauggagggggagggcaucuucaagagcauccagcaccugaccgccuccgaggagaucgccguccaggacuggcuggugcggguggggcgcgagcggcucagccgcauggccaucuccggcgacgacugcgucgugaagccccuggacgaccgguucgcccgcgcgcugacggcccucaacgacaugggcaaggugcggaaggacauccagcagugggagcccagccgcggguggaacgacuggacccaggucccguucugcucccaccacuuccacgagcugaucaugaaggacggccggacccugguggugcccugccgcaaccaggacgagcucaucgggcgggcccgcaucagccagggcgccggguggucccugcgggagaccgccugccugggcaagagcuacgcgcagauguggucccucauguacuuccaccgccgggaccugcgccuggccgccaacgccaucugcagcgccguccccucccacugggugcccaccagccgcacgaccuggagcauccacgcgucccacgaguggaugaccaccgaggacaugcucacgguguggaaccgggucuggauccuggagaacccguggauggaggacaagacccccguggagagcugggaggagauccccuaccugggcaagcgcgaggaccaguggugcgggucccucaucggccugaccagccgggccaccugggccaagaacauccagacggccaucaaccaggugcgcucccugaucgggaacgaggaguacaccgacuacaugcccagcaugaagcgguuccgccgggaggaggaggaggccggcguccucugguga

SEQ ID NO: 9132 - RNA, 9876 nt, Artificial Sequence
  derived and/or modified CDS sequence (opt1) from DENV-2__FJ906966__SS-prME
accgccgggaugaucaucaugcugauccccaccgugauggccuuccaccucaccacccggaacggggagccccacaugaucgucagccggcaggagaagggcaagagccugcuguucaagaccgaggacggggugaacaugugcacccucauggcgauggaccugggcgagcugugcgaggacaccaucaccuacaagugccccuuccucaagcagaacgagcccgaggacaucgacugcuggugcaacagcaccagcaccugggugaccuacgggaccugcaccaccacgggcgagcaccggcgggagaagcgcagcgucgcccuggugccccacgugggcauggggcuggagacccggaccgagaccuggauguccagcgagggcgccuggaagcacgcccagcgcaucgagacguggauccuccggcaccccggguucaccaucauggccgcgauccuggccuacaccaucggcaccacgcacuuccagcgcgcccugaucuucauccuccugaccgccgucgcgcccuccaugaccaugcggugcaucgggaucagcaaccgcgacuucguggagggcguguccggcgggagcugggucgacaucgugcuggagcacggcuccugcgugaccacgauggccaagaacaagcccacccucgacuucgagcugaucaagaccgaggccaagcagcccgccacccugcggaaguacugcaucgaggccaagcucacgaacaccaccaccgacagccgcugcccgacgcagggggagcccucccugaacgaggagcaggacaagcgguucgucugcaagcacagcaugguggaccgcggcuggggcaacgggugcggccuguucgggaagggcgggaucgugaccugcgcgauguucacgugcaagaagaacauggagggcaaggucgugcagcccgagaaccucgaguacaccaucgugaucacgccccacuccggcgaggagcacgccgucgggaacgacaccggcaagcacgggaaggagaucaagaucaccccgcagagcuccaucaccgaggccgagcugaccggcuacgggacggugaccauggagugcagcccccggaccggccuggacuucaacgagauggugcuccugcagauggagaacaaggccuggcugguccaccgccagugguuccucgaccugccccugcccuggcucccgggcgccgacacccaggggcugaacuggauccagaaggagacgcuggugaccuucaagaacccccacgcgaagaagcaggacguggucgugcucggcucccaggagggggccaugcacaccgcccugaccggcgccacggagauccagaugagcagcgggaaccuccuguucaccggccaccugaagugccggcugcgcauggacaagcuccagcugaagggcauguccuacagcaugugcaccgggaaguucaaggucgugaaggagaucgccgagacccagcacggcacgaucgugauccggguccaguacgagggggacggcucccccugcaagauccccuucgagaucauggaccuggagaagcgccacgugcucggccggcugaucaccgugaacccgaucgucaccgagaaggacagccccgugaacaucgaggcggagccgcccuucggggacuccuacaucaucaucggcguggagccggggcagcugaagcucaacugguucaagaagggcagcuccaucgggcagaugaucgagaccacgaugcgcggcgccaagcgcauggccauccugggcgacaccgccugggacuucgggagccugggcggggucuucaccuccaucggcaaggcccuccaccagguguucggggcgaucuacggcgccgccuucagcggcguguccuggaucaugaagauccugaucggggucaucaucaccuggaucggcaugaacagccgguccacgagccuguccgugagccuggugcucgucgggguggugacccuguaccugggcgucauggugcaggccgacuccgggugcguggucagcuggaagaacaaggagcucaagugcggcuccggcaucuucaucaccgacaacgugcacaccuggacggagcaguacaaguuccagcccgagagccccagcaagcuggcguccgccauccagaaggcccacgaggaggggaucugcggcauccgcagcgugacccggcuggagaaccucauguggaagcagaucacccccgagcugaaccacauccuguccgagaacgaggucaagcucaccaucaugacgggggacaucaagggcaucaugcaggccgggaagcgcagccugcagccgcagcccaccgagcugaaguacuccuggaagaccuggggcaaggccaagaugcucagcaccgagucccacaaccagacguuccugaucgacggccccgagaccgcggagugcccgaacaccaaccgggccuggaacagccuggagguggaggacuacggguucggcguguucaccacgaacaucuggcucaagcugcgcgagaagcaggacgucuucugcgacuccaagcugaugagcgccgccaucaaggacaaccgggccgugcacgcggacaugggguacuggaucgaguccgcccucaacgacaccuggaagaucgagaaggccagcuucaucgaggugaaguccugccacuggcccaagagccacacccugugguccaacggcguccuggagagcgagaugaucauccccaagaacuucgccggccccgugucccagcacaacuaccgcccgggguaccacacccagaccgccggccccuggcaccucgggaagcuggagauggacuucgacuucugcgagggcacgaccguggucgugaccgaggacugcgggaaccggggccccagccugcgcaccacgaccgcgagcggcaagcucaucaccgaguggugcugccgguccugcacccugcccccgcugcgcuaccgcggggaggacggcugcugguacgggauggagauccgcccccucaaggagaaggaggagaaccuggugaacagccuggucacggccggccacgggcagaucgacaacuucucccucggcgugcugggcauggcccuguuccucgaggagaugcugcggacccgcguggggaccaagcacgccauccugcucgucgcggugagcuucgugacccugaucacgggcaacauguccuuccgggaccuggggcgcgucauggugauggugggcgccaccaugaccgacgacaucgggaugggcgucaccuaccucgcccugcuggccgccuucaaggugcggcccacguucgcggccggccuccugcugcgcaagcucaccagcaaggagcugaugaugaccaccaucgggaucgugcugcucucccagagcacgauccccgagaccauccuggagcugaccgacgcccucgcccugggcaugaugguccugaagauggugcgcaagauggagaaguaccagcucgccgugaccaucauggcgauccugugcgucccgaacgccgugauccugcagaacgccuggaaggucuccugcacgauccucgccguggugagcgucagcccccuguuccugaccagcucccagcagaaggccgacuggaucccccucgcgcugaccaucaaggggcugaaccccaccgccaucuuccucacgacccugagccggaccaacaagaagcgcuccuggccgcugaacgaggccaucauggccgugggcauggugagcauccucgcguccagccugcugaagaacgacauccccaugaccggcccccucgucgccgggggccugcugacggugugcuacgugcucaccgggcgguccgccgaccuggagcuggagcgcgccgccgacgucaagugggaggaccaggcggagaucagcggcagcucccccauccucagcaucaccaucuccgaggacgggagcauguccaucaagaacgaggaggaggagcagacccugacgauccugauccggaccggccuccuggugaucagcggccuguucccgguguccauccccaucaccgccgccgccugguaccucugggaggucaagaagcagcgcgccggggugcugugggacgugcccuccccgccgcccgucggcaaggcggagcuggaggacggggccuaccggaucaagcagaagggcauccucggguacucccagaucggcgccggcguguacaaggaggggaccuuccacaccauguggcacgugacgcgcggcgccguccugaugcacaaggggaagcggaucgagcccagcugggccgacgugaagaaggaccugaucuccuacggcgggggcuggaagcucgagggcgaguggaaggagggggaggaggugcagguccuggcgcuggagcccggcaagaacccccgcgccgugcagaccaagcccggccuguucaagaccaacgccggcaccaucggggccgugagccuggacuucucccccggcacgagcggcucccccaucaucgacaagaaggggaaggucgugggccuguacgggaacggcguggucacccggagcggcgccuacguguccgcgaucgcccagaccgagaaguccaucgaggacaaccccgagaucgaggacgacaucuuccgcaagcggaagcucaccaucauggaccugcaccccggggccggcaagacgaagcgcuaccugcccgccaucgugcgggaggcgaucaagcgcgggcugcggacccucauccuggccccgacccgcgucguggccgccgagauggaggaggcccugcggggccuccccauccgcuaccagacccccgcgauccgggccgagcacacggggcgcgagaucguggaccugaugugccacgccaccuucaccaugcgccugcucucccccguccgggugccgaacuacaaccugaucaucauggacgaggcccacuucaccgaccccgccagcaucgcggcccgcggcuacaucagcacgcggguggagaugggcgaggccgccgggaucuucaugaccgccacgccgcccggcucccgcgacccguucccccagagcaacgcgcccaucauggacgaggagcgggagauccccgagcgcuccuggagcuccgggcacgagugggucaccgacuucaagggcaagacggugugguucgugccgagcaucaaggccgggaacgacaucgccgccugccugcggaagaacggcaagaaggucauccagcucucccgcaagaccuucgacagcgaguacgugaagacccggaccaacgacugggacuucguggucacgaccgacaucuccgagaugggcgcgaacuucaaggccgagcgcgugaucgacccccggcgcugcaugaagcccgugauccugaccgacggggaggagcgggucauccuggccggccccaugccggugacccacagcuccgccgcccagcgccgggggcgcaucggccggaaccccaagaacgagaacgaccaguacaucuacaugggggagccccucgagaacgacgaggacugcgcgcacuggaaggaggccaagaugcugcuggacaacaucaacacgcccgagggcaucaucccgagcauguucgagcccgagcgcgagaagguggacgccaucgacggcgaguaccggcuccgcggggaggcccgcaagaccuucgucgaccugaugcggcgcggcgaccugcccguguggcucgccuaccggguggcggccgaggggaucaacuacgccgaccgccgguggugcuucgacggcaucaagaacaaccagauccuggaggagaacgucgagguggagaucuggaccaaggagggggagcgcaagaagcugaagccgcgguggcucgacgcccgcaucuacuccgacccccuggcccugaaggaguucaaggaguucgcggccggccgcaagagccucacccugaaccugaucacggagaugggccgccuccccaccuucaugacccagaaggcccgggacgcccuggacaaccuggcgguccuccacaccgccgaggccgggggccgcgccuacaaccacgcccuguccgagcugcccgagacgcucgagacccugcugcuccugacccugcucgcgaccgugaccggcgggaucuuccuguuccugaugagcgggcgggggaucggcaagaugacccucgggaugugcugcaucaucaccgccuccauccugcugugguacgcccagauccagccgcacuggaucgccgccagcaucauccucgaguucuuccugaucgugcugcucauccccgagcccgagaagcagcgcacgccccaggacaaccagcugaccuacgucgugaucgcgauccugacgguggucgccgccaccauggccaacgagaugggcuuccucgagaagaccaagaaggaccuggggcugggcuccaucaccacgcagcagccggagagcaacauccucgacaucgaccugcggcccgccagcgcguggacccuguacgccguggccaccaccuucgugacgcccaugcuccgccacuccaucgagaacagcuccgucaacgugagccugaccgccaucgccaaccaggcgaccgugcugaugggccucgggaagggcuggccccuguccaagauggacaucggggucccgcugcucgccaucggcugcuacagccaggugaaccccaucacccugacggccgcccuguuccuccugguggcgcacuacgccaucaucgggcccggccugcaggccaaggccacccgggaggcccagaagcgcgcggccgccggcaucaugaagaaccccaccgucgacgggaucaccgugaucgaccucgacccgauccccuacgaccccaaguucgagaagcagcugggccaggugaugcugcucguccugugcgugacccaggugcugaugaugcggaccaccugggcccucugcgaggcccugacccuggcgacggggcccaucuccacccucugggagggcaacccggggcgcuucuggaacaccaccaucgccgucagcauggccaacaucuuccggggcuccuaccuggccggcgccgggcuccucuucagcaucaugaagaacacgaccaacacccgccgcggcaccgggaacaucggcgagacgcugggcgagaaguggaagucccggcugaacgcgcucggcaagagcgaguuccagaucuacaagaaguccggcauccaggagguggaccgcacccuggccaaggaggggaucaagcggggcgagaccgaccaccacgccgugagccgcggguccgccaagcugcggugguucgucgagcgcaacauggugacccccgagggcaagguggucgaccucggcugcgggcggggcggguggagcuacuacugcggcgggcugaagaacgugcgcgaggugaagggccugacgaagggcgggcccggccacgaggagcccaucccgauguccaccuacggguggaaccucguccggcugcagagcggcguggacguguucuucacgccgcccgagaagugcgacacccugcucugcgacaucggggaguccagccccaacccgacggucgaggcgggccgcacccugcgggugcugaaccucguggagaacuggcugaacaacaacacccaguucugcaucaagguccugaaccccuacaugcccagcgugaucgagaagauggaggcccuccagcgcaaguacggcggggcccuggugcggaacccgcugucccgcaacagcacccacgagauguacugggucuccaacgccagcggcaacaucguguccagcgugaacaugaucucccggaugcugaucaaccgcuucaccaugcggcacaagaaggccacguacgagcccgacgucgaccucgggagcggcacccgcaacaucgggaucgaguccgagauccccaaccuggacaucaucggcaagcggaucgagaagaucaagcaggagcacgagaccagcuggcacuacgaccaggaccaccccuacaagaccugggcguaccacggcuccuacgagacgaagcagaccgggagcgccuccagcauggugaacggcgugguccgccugcucaccaagccgugggacguggugcccauggucacccagauggccaugacggacaccacccccuucgggcagcagcgcguguucaaggagaagguggacacccggacgcaggagcccaaggagggcaccaagaagcugaugaagaucaccgccgaguggcuguggaaggagcucggcaagaagaagaccccgcgcaugugcacgcggcaggaguucacccgcaagguccgguccaacgccgcgcugggggccaucuucaccgacgagaacaaguggaaguccgcccgcgaggccguggaggacucccgguucugggagcuggucgacaaggagcgcaaccuccaccuggagggcaagugcgagaccugcguguacaacaugauggggaagcgggagaagaagcugggcgaguucgggaaggccaagggcagccgcgcgaucugguacauguggcucggcgcccgguuccuggaguucgaggcccugggguuccucaacgaggaccacugguucucccgcgagaacagccugagcggcguggagggggagggccugcacaagcucggguacauccugcgggacgucuccaagaaggagggcggcgccauguacgcggacgacacggccgggugggacacccgcaucacccuggaggaccucaagaacgaggagauggugaccaaccacauggagggcgagcacaagaagcuggccgaggccaucuucaagcugacguaccagaacaaggugguccgggugcagcgccccacgccccgggggaccgugauggacaucaucagccgccgggaccagcgcggcuccgggcaggucggcaccuacggccucaacacguucaccaacauggaggcccagcugauccggcagauggagggggagggcguguucaagagcauccagcaccugaccgugaccgaggagaucgcgguccagaacuggcucgcccgcguggggcgcgagcggcugucccgcauggccaucagcggcgacgacugcguggucaagccccuggacgaccgguucgccuccgcccucacggcgcugaacgacaugggcaaggugcgcaaggacauccagcagugggagccgagccggggguggaacgacuggacccaggugcccuucugcucccaccacuuccacgagcugaucaugaaggacggccgcguccucguggugcccugccggaaccaggacgagcugaucgggcgcgcccggaucagccagggcgccggguggucccugcgcgagaccgccugccucggcaagagcuacgcccagauguggucccugauguacuuccaccggcgcgaccugcggcucgcggccaacgccaucugcagcgccguccccucccacugggugccgaccagccgcacgaccugguccauccacgccaagcacgaguggaugaccaccgaggacaugcugaccguguggaaccgggucuggauccaggagaaccccuggauggaggacaagacgcccguggagagcugggaggagauccccuaccugggcaagcgcgaggaccaguggugcgggagccucaucggccugaccucccgggcgaccugggccaagaacauccagaccgccaucaaccaggugcgcagccugaucgggaacgaggaguacacggacuacaugccguccaugaagcgguuccgccgcgaggaggaggaggccggcguccucugguga

SEQ ID NO: 9133 - RNA, 9876 nt, Artificial Sequence
  derived and/or modified CDS sequence (opt1) from DENV-2__FJ906968__SS-prME
accgccggcaugaucaucaugcugauccccaccgugauggccuuccaccucaccacccggaacggggagccccacaugaucgucagccggcaggagaagggcaagucccugcuguucaagaccgaggacggggugaacaugugcacccucauggcgauggaccugggcgagcugugcgaggacaccaucaccuacaagugccccuuccucaagcagaacgagcccgaggacaucgacugcuggugcaacagcaccuccaccugggugaccuacgggaccugcaccaccacgggcgagcaccgccgggagaagcggagcgucgcccuggugccccacgugggcauggggcuggagacccggaccgagaccuggauguccagcgagggcgccuggaagcacgcccagcgcaucgagacguggauccuccggcacccgggguucaccaucauggccgcgauccuggccuacaccaucggcaccacgcacuuccagcgcgcccugaucuucauccuccugaccgccgucgcgcccuccaugaccaugcggugcaucgggaucagcaaccgcgacuucguggagggcguguccggcgggagcugggucgacaucgugcuggagcacggcuccugcgugaccacgauggccaagaacaagcccacccucgacuucgagcugaucaagaccgaggccaagcagcccgccacccugcggaaguacugcaucgaggccaagcucacgaacaccaccaccgacagccgcugcccgacgcagggggagcccucccugaacgaggagcaggacaagcgguucgucugcaagcacagcaugguggaccgcggcuggggcaacgggugcggccuguucgggaagggcgggaucgugaccugcgcgauguucacgugcaagaagaacaugaagggcaaggucgugcagcccgagaaccucgaguacaccaucgugaucacgccccacuccggcgaggagcacgccgucgggaacgacaccggcaagcacgggaaggagaucaagaucaccccgcagagcuccaucaccgaggccgagcugaccggcuacgggacggugaccauggagugcagcccccggaccggccuggacuucaacgagauggugcuccugcagauggagaacaaggccuggcugguccaccgccagugguuccucgaccugccccugcccuggcucccgggcgccgacacccagggguccaacuggauccagaaggagacgcuggugaccuucaagaacccccacgcgaagaagcaggacguggucgugcugggcagccaggagggggccaugcacaccgcccucaccggcgccacggagauccagaugagcuccgggaaccugcuguucaccggccaccucaagugccggcugcgcauggacaagcugcagcucaagggcaugagcuacuccaugugcaccgggaaguucaaggucgugaaggagaucgccgagacccagcacggcacgaucgugauccggguccaguacgagggggacggcagccccugcaagauccccuucgagaucauggaccuggagaagcgccacgugcugggccggcucaucaccgugaacccgaucgucaccgagaaggacucccccgugaacaucgaggcggagccgcccuucggggacagcuacaucaucaucggcguggagccggggcagcugaagcugaacugguucaagaagggcuccagcaucgggcagaugaucgagaccacgaugcgcggcgccaagcgcauggccauccucggcgacaccgccugggacuucgggucccugggcggggucuucaccagcaucggcaaggcccugcaccagguguucggggcgaucuacggcgccgccuucuccggcgugagcuggaucaugaagauccucaucggggucaucaucaccuggaucggcaugaacucccggagcacgucccugagcgugucccuggugcuggucgggguggugacccucuaccugggcgucauggugcaggccgacagcgggugcguggucuccuggaagaacaaggagcugaagugcggcagcggcaucuucaucaccgacaacgugcacaccuggacggagcaguacaaguuccagcccgagagccccuccaagcucgcgagcgccauccagaaggcccacgaggaggggaucugcggcauccgcuccgugacccggcuggagaaccugauguggaagcagaucacccccgagcucaaccacauccugagcgagaacgaggucaagcugaccaucaugacgggggacaucaagggcaucaugcaggccgggaagcgcucccuccagccgcagcccaccgagcugaaguacagcuggaagaccuggggcaaggccaagaugcuguccaccgagagccacaaccagacguuccucaucgacggccccgagaccgcggagugcccgaacaccaaccgggccuggaacucccuggagguggaggacuacggguucggcguguucaccacgaacaucuggcugaagcuccgcgagaagcaggacgucuucugcgacagcaagcugauguccgccgccaucaaggacaaccgggccgugcacgcggacaugggguacuggaucgagagcgcccugaacgacaccuggaagaucgagaaggccuccuucaucgaggucaagagcugccacuggcccaagucccacacccucuggagcaacgaggugcuggaguccgagaugaucauccccaagaacuucgccggccccgugagccagcacaacuaccgcccgggcuaccacacccagaccgccgggcccuggcaccugggcaagcucgagauggacuucgacuucugcgaggggacgaccguggucgugaccgaggacugcggcaaccgggggcccagccugcgcaccacgaccgcguccggcaagcugaucaccgaguggugcugccggagcugcacccucccgccccugcgcuaccggggcgaggacgggugcugguacggcauggagauccgcccccugaaggagaaggaggagaaccucgugaacucccuggucacggccgggcacggccagaucgacaacuucagccugggggugcucggcauggcccuguuccuggaggagaugcuccggacccgcgugggcaccaagcacgccauccugcuggucgcgguguccuucgugacccucaucacggggaacaugagcuuccgggaccugggccgcgucauggugauggugggggccaccaugaccgacgacaucggcaugggggucaccuaccuggcccuccuggccgccuucaaggugcggcccacguucgcggccggccugcuccugcgcaagcugaccuccaaggagcucaugaugaccaccaucggcaucgugcugcugagccaguccacgauccccgagaccauccucgagcugaccgacgcccuggcccucgggaugaugguccugaagauggugcgcaagauggagaaguaccagcuggccgugaccaucauggcgauccucugcguccccaacgccgugauccugcagaacgccuggaaggucagcugcacgauccuggccgugguguccgucagcccccucuuccugaccuccagccagcagaaggccgacuggaucccccuggcgcucaccaucaagggccugaaccccaccgccaucuuccugacgacccucucccggaccaacaagaagcgcagcuggccgcugaacgaggccaucauggccguggggaugguguccauccuggcgagcucccuccugaagaacgacauccccaugaccggcccccuggucgccggcgggcuccugacggugugcuacgugcugaccggccggagcgccgaccucgagcuggagcgcgccgccgacgucaagugggaggaccaggcggagaucagcggguccagccccauccuguccaucaccaucagcgaggacggcuccaugagcaucaagaacgaggaggaggagcagauccucaccauccugauccggacggggcugcucgugaucuccggccuguucccggugagcauccccaucaccgccgccgccuggugccugugggaggucaagaagcagcgcgccggcgugcucugggacgugcccagcccgccgcccgucgggaaggcggagcuggaggacggcgccuaccggaucaagcagaaggggauccugggcuacagccagaucggggccggcguguacaaggagggcaccuuccacaccauguggcacgugacccgcggggccguccucaugcacaagggcaagcggaucgagcccuccugggccgacgugaagaaggaccugaucagcuacgggggcggguggaagcuggagggcgaguggaaggagggcgaggaggugcagguccucgcgcuggagcccgggaagaacccccgcgccgugcagacgaagcccggccuguucaagaccaacgccgggaccaucggcgccgugucccucgacuucagccccgggaccuccggcagccccaucaucgacaagaagggcaaggucguggggcuguacggcaacgggguggucacgcgguccggcgccuacgugagcgcgaucgcccagaccgagaaguccaucgaggacaaccccgagaucgaggacgacaucuuccgcaagcggaagcugaccaucauggaccuccaccccggcgccgggaagaccaagcgcuaccugcccgccaucgugcgggaggcgaucaagcgcggccugcggacgcugauccucgccccgacccgcgucguggccgccgagauggaggaggcccugcgggggcugcccauccgcuaccagacccccgcgauccgggccgagcacaccggccgcgagaucguggaccucaugugccacgccacguucaccaugcgccugcugagccccguccgggugccgaacuacaaccucaucaucauggacgaggcccacuucaccgaccccgccagcaucgcggcccgcggguacaucuccacccggguggagaugggcgaggccgccggcaucuucaugacggccacgccgcccgggagccgcgacccguucccccaguccaacgcgcccaucauggacgaggagcgggagauccccgagcgcagcugguccagcggccacgagugggucaccgacuucaaggggaagaccgugugguucgugccguccaucaaggccggcaacgacaucgccgccugccugcggaagaacgggaagaaggucauccagcugagccgcaagacguucgacuccgaguacgugaagacccggaccaacgacugggacuucguggucaccacggacaucagcgagaugggcgcgaacuucaaggccgagcgcgugaucgacccccggcgcugcaugaagcccgugauccucaccgacggcgaggagcgggucauccuggccgggcccaugccggugacccacuccagcgccgcccagcgccggggccgcaucgggcggaaccccaagaacgagaacgaccaguacaucuacaugggcgagccccuggagaacgacgaggacugcgcgcacuggaaggaggccaagaugcuccuggacaacaucaacacccccgaggggaucaucccguccauguucgagcccgagcgcgagaagguggacgccaucgacggcgaguaccggcugcgcggcgaggcccgcaagacguucgucgaccucaugcggcgcggggaccugcccguguggcuggccuaccggguggcggccgagggcaucaacuacgccgaccgccgguggugcuucgacgggaucaagaacaaccagauccucgaggagaacgucgagguggagaucuggaccaaggagggcgagcgcaagaagcugaagccgcgguggcuggacgcccgcaucuacagcgacccccucgcccugaaggaguucaaggaguucgcggccgggcggaagucccugacccucaaccugaucaccgagaugggccgccugcccacguucaugacccagaaggcccgggacgcccucgacaaccuggcgguccugcacaccgccgaggccggcgggcgcgccuacaaccacgcccucagcgagcugcccgagacccuggagacgcuccugcugcucacccugcuggcgaccgugaccggcgggaucuuccucuuccugauguccggccggggcaucgggaagaugacgcugggcaugugcugcaucaucaccgccagcauccuccugugguacgcccagauccagccgcacuggaucgccgccuccaucauccuggaguucuuccucaucgugcugcugauccccgagcccgagaagcagcgcacgccccaggacaaccagcucaccuacgucgugaucgcgauccugaccguggucgccgccacgauggccaacgagaugggguuccuggagaagaccaagaaggaccucggccuggggagcaucaccacccagcagccggagagcaacauccuggacaucgaccuccggcccgccuccgcguggacgcuguacgccguggccaccaccuucgugacccccaugcugcgccacagcaucgagaacuccagcgucaacgugucccucacggccaucgccaaccaggcgaccgugcugaugggccugggcaagggguggccccucagcaagauggacaucggcgucccgcugcuggccaucgggugcuacucccaggugaaccccaucacccucaccgccgcccuguuccugcucguggcgcacuacgccaucaucggccccgggcugcaggccaaggccacgcgggaggcccagaagcgcgcggccgccggcaucaugaagaaccccaccgucgacggcaucaccgugaucgaccuggacccgauccccuacgaccccaaguucgagaagcagcucggccaggugaugcugcugguccucugcgugacccaggugcugaugaugcggacgaccugggcccugugcgaggcccucacccuggcgaccggccccaucagcacgcugugggaggggaacccgggccgcuucuggaacaccaccaucgccgucuccauggccaacaucuuccgggggagcuaccucgccggcgccggccugcuguucuccaucaugaagaacaccacgaacacccgccgcgggaccggcaacaucggggagacccucggcgagaaguggaagucccggcugaacgcgcugggcaagagcgaguuccagaucuacaagaaguccgggauccaggagguggaccgcacgcucgccaaggagggcaucaagcgcggggagaccgaccaccacgccgugucccgcggcagcgccaagcugcggugguucgucgagcgcaacauggugacccccgaggggaagguggucgaccugggcugcggccgcggcgggugguccuacuacugcggcgggcucaagaacgugcgcgaggugaaggggcugaccaagggcgggcccgggcacgaggagcccaucccgaugagcacguacggcuggaaccugguccggcuccaguccgggguggacguguucuucacgccgcccgagaagugcgacacccugcugugcgacaucggcgagagcagccccaacccgaccgucgaggcggggcgcacgcuccgggugcugaaccugguggagaacuggcucaacaacaacacccaguucugcaucaagguccugaaccccuacaugcccuccgugaucgagaagauggaggcccugcagcgcaaguacggcggcgcccucgugcggaacccgcugagccgcaacuccacccacgagauguacugggucagcaacgccuccgggaacaucgugagcuccgugaacaugaucagccggaugcugaucaaccgcuucaccaugcggcacaagaaggccaccuacgagcccgacgucgaccugggcuccgggacgcgcaacaucggcaucgagagcgagauccccaaccucgacaucaucgggaagcggaucgagaagaucaagcaggagcacgagaccuccuggcacuacgaccaggaccaccccuacaagaccugggcguaccacggcagcuacgagaccaagcagacgggcuccgccagcuccauggugaacggggugguccgccugcugaccaagccgugggacguggugcccauggucacccagauggccaugaccgacacgacccccuucggccagcagcgcguguucaaggagaagguggacacccggacccaggagcccaaggaggggacgaagaagcucaugaagaucaccgccgaguggcuguggaaggagcugggcaagaagaagaccccgcgcaugugcacccgggaggaguucacgcgcaagguccggagcaacgccgcgcucggcgccaucuucaccgacgagaacaaguggaaguccgcccgcgaggccguggaggacagccgguucugggagcuggucgacaaggagcgcaaccugcaccucgaggggaagugcgagaccugcguguacaacaugaugggcaagcgggagaagaagcugggggaguucggcaaggccaaggggucccgcgcgaucugguacauguggcugggcgcccgguuccucgaguucgaggcccugggcuuccugaacgaggaccacugguucagccgcgagaacagccucuccgggguggagggcgaggggcugcacaagcugggcuacauccuccgggacgucagcaagaaggagggcggggccauguacgcggacgacaccgccggcugggacacgcgcaucacccuggaggaccugaagaacgaggagauggugaccaaccacauggagggggagcacaagaagcucgccgaggccaucuucaagcugaccuaccagaacaaggugguccgggugcagcgccccacgccccggggcaccgugauggacaucaucucccgccgggaccagcgcgggagcggccaggucgggaccuacggccugaacaccuucacgaacauggaggcccagcucauccggcagauggagggcgaggggguguucaaguccauccagcaccugaccgugaccgaggagaucgcgguccagaacuggcuggcccgcgugggccgcgagcggcucagccgcauggccaucuccggggacgacugcguggucaagccccuggacgaccgguucgccagcgcccugaccgcgcucaacgacaugggcaaggugcgcaaggacauccagcagugggagccgucccggggcuggaacgacuggacccaggugcccuucugcagccaccacuuccacgagcugaucaugaaggacgggcgcguccugguggugcccugccggaaccaggacgagcucaucggccgcgcccggaucucccagggggccggcuggagccugcgcgagaccgccugccuggggaaguccuacgcccagauguggagccucauguacuuccaccggcgcgaccugcggcuggcggccaacgccaucugcuccgccguccccagccacugggugccgaccucccgcaccacguggagcauccacgccaagcacgaguggaugaccaccgaggacaugcucaccguguggaaccgggucuggauccaggagaaccccuggauggaggacaagacccccguggagagcugggaggagauccccuaccugggcaagcgcgaggaccaguggugcggcucccugaucgggcucacgagccgggcgaccugggccaagaacauccagaccgccaucaaccaggugcgcucccugaucggcaacgaggaguacaccgacuacaugccgagcaugaagcgguuccgccgcgaggaggaggaggccgggguccugugguga

SEQ ID NO: 9134 - RNA, 9876 nt, Artificial Sequence
  derived and/or modified CDS sequence (opt1) from DENV-2__FJ906969__SS-prME
accgccggcaugaucaucaugcugauccccaccgugauggccuuccaccucaccacccggaacggggagccccacaugaucgucagccggcaggagaagggcaagucccugcuguucaagaccgaggacggggugaacaugugcacccucauggcgauggaccugggcgagcugugcgaggacaccaucaccuacaagugccccuuccucaagcagaacgagcccgaggacaucgacugcuggugcaacagcaccuccaccugggugaccuacgggaccugcaccaccacgggcgagcaccgccgggagaagcgcagcgucgcccuggugccccacgugggcauggggcuggagacccggaccgagaccuggauguccagcgagggcgccuggaagcacgcccagcgcaucgagacguggauccuccggcacccgggguucaccaucauggccgcgauccuggccuacaccaucggcaccacgcacuuccagcgcgcccugaucuucauccuccugaccgccgucgcgcccuccaugaccaugcggugcaucgggaucagcaaccgcgacuucguggagggcguguccggcgggagcugggucgacaucgugcuggagcacggcuccugcgugaccacgauggccaagaacaagcccacccucgacuucgagcugaucaagaccgaggccaagcagcccgccacccugcggaaguacugcaucgaggccaagcucacgaacaccaccaccgacagccgcugcccgacgcagggggagcccucccugaacgaggagcaggacaagcgguucgucugcaagcacagcaugguggaccgcggcuggggcaacgggugcggccuguucgggaagggcgggaucgugaccugcgcgauguucacgugcaagaagaacaugaagggcaaggucgugcagcccgagaaccucgaguacaccaucgugaucacgccccacuccggcgaggagcacgccgucgggaacgacaccggcaagcacgggaaggagaucaagaucaccccgcagagcuccaucaccgaggccgagcugaccggcuacgggacggugaccauggagugcagcccccggaccggccuggacuucaacgagauggugcuccugcagauggagaacaaggccuggcugguccaccgccagugguuccucgaccugccccugcccuggcucccgggcgccgacacccagggguccaacuggauccagaaggagacgcuggugaccuucaagaacccccacgcgaagaagcaggacguggucgugcugggcagccaggagggggccaugcacaccgcccucaccggcgccacggagauccagaugagcuccgggaaccugcuguucaccggccaccucaagugccggcugcgcauggacaagcugcagcucaagggcaugagcuacuccaugugcaccgggaaguucaaggucgugaaggagaucgccgagacccagcacggcacgaucgugauccggguccaguacgagggggacggcagccccugcaagauccccuucgagaucauggaccuggagaagcgccacgugcugggccggcucaucaccgugaacccgaucgucaccgagaaggacucccccgugaacaucgaggcggagccgcccuucggggacagcuacaucaucaucggcguggagccggggcagcugaagcugaacugguucaagaagggcuccagcaucgggcagauguucgagaccacgaugcgcggcgccaagcgcauggccauccucggcgacaccgccugggacuucgggucccugggcggggucuucaccagcaucggcaaggcccugcaccagguguucggggcgaucuacggcgccgccuucuccggcgugagcuggaucaugaagauccucaucggggucaucaucaccuggaucggcaugaacucccggagcacgucccugagcgugucccuggugcuggucgggguggugacccucuaccugggcgucauggugcaggccgacagcgggugcguggucuccuggaagaacaaggagcugaagugcggcagcggcaucuucaucaccgacaacgugcacaccuggacggagcaguacaaguuccagcccgagagccccuccaagcucgcgagcgccauccagaaggcccacgaggaggggaucugcggcauccgcuccgugacccggcuggagaaccugauguggaagcagaucacccccgagcucaaccacauccugagcgagaacgaggucaagcugaccaucaugacgggggacaucaagggcaucaugcaggccgggaagcgcucccuccagccgcagcccaccgagcugaaguacagcuggaagaccuggggcaaggccaagaugcuguccaccgagagccacaaccagacguuccucaucgacggccccgagaccgcggagugcccgaacaccaaccgggccuggaacucccuggagguggaggacuacggguucggcguguucaccacgaacaucuggcugaagcuccgcgagaagcaggacgucuucugcgacagcaagcugauguccgccgccaucaaggacaaccgggccgugcacgcggacaugggguacuggaucgagagcgcccugaacgacaccuggaagaucgagaaggccuccuucaucgaggucaagagcugccacuggcccaagucccacacccucuggagcaacggcgugcuggaguccgagaugaucauccccaagaacuucgccggccccgugagccagcacaacuaccgcccgggguaccacacccagaccgccggccccuggcaccuggggaagcucgagauggacuucgacuucugcgagggcacgaccguggucgugaccgaggacugcgggaaccggggccccagccugcgcaccacgaccgcguccggcaagcugaucaccgaguggugcugccggagcugcacccucccgccccugcgcuaccgcggggaggacggcugcugguacgggauggagauccgcccccugaaggagaaggaggagaaccucgugaacucccuggucacggccggccacgggcagaucgacaacuucagccugggcgugcucggcauggcccuguuccuggaggagaugcuccggacccgcguggggaccaagcacgccauccugcuggucgcgguguccuucgugacccucaucacgggcaacaugagcuuccgggaccuggggcgcgucauggugauggugggcgccaccaugaccgacgacaucgggaugggcgucaccuaccuggcccuccuggccgccuucaaggugcggcccacguucgcggccggccugcuccugcgcaagcugaccuccaaggagcucaugaugaccaccaucgggaucgugcugcugagccaguccacgauccccgagaccauccucgagcugaccgacgcccuggcccucggcaugaugguccugaagauggugcgcaagauggagaaguaccagcuggccgugaccaucauggcgauccucugcguccccaacgccgugauccugcagaacgccuggaaggucagcugcacgauccuggccgugguguccgucagcccccucuuccugaccuccagccagcagaaggccgacuggaucccccuggcgcucaccaucaaggggcugaaccccaccgccaucuuccugacgacccucucccggaccaacaagaagcgcagcuggccgcugaacgaggccaucauggccgugggcaugguguccauccuggcgagcucccuccugaagaacgacauccccaugaccggcccccuggucgccgggggccuccugacggugugcuacgugcugaccgggcggagcgccgaccucgagcuggagcgcgccgccgacgucaagugggaggaccaggcggagaucagcggcuccagccccauccuguccaucaccaucagcgaggacggguccaugagcaucaagaacgaggaggaggagcagauccucaccauccugauccggacgggccugcucgugaucuccggccuguucccggugagcauccccaucaccgccgccgccuggugccugugggaggucaagaagcagcgcgccggggugcucugggacgugcccagcccgccgcccgucggcaaggcggagcuggaggacggggccuaccggaucaagcagaagggcauccugggguacagccagaucggcgccggcguguacaaggaggggaccuuccacaccauguggcacgugacccgcggcgccguccucaugcacaaggggaagcggaucgagcccuccugggccgacgugaagaaggaccugaucagcuacggcgggggcuggaagcuggagggcgaguggaaggagggggaggaggugcagguccucgcgcuggagcccggcaagaacccccgcgccgugcagacgaagcccgggcuguucaagaccaacgccggcaccaucggggccgugucccucgacuucagccccggcaccuccggcagccccaucaucgacaagaaggggaaggucgugggccuguacgggaacggcguggucacgcgguccggcgccuacgugagcgcgaucgcccagaccgagaaguccaucgaggacaaccccgagaucgaggacgacaucuuccgcaagcggaagcugaccaucauggaccuccaccccggggccggcaagaccaagcgcuaccugcccgccaucgugcgggaggcgaucaagcgcgggcugcggacgcugauccucgccccgacccgcgucguggccgccgagauggaggaggcccugcggggccugcccauccgcuaccagacccccgcgauccgggccgagcacaccgggcgcgagaucguggaccucaugugccacgccacguucaccaugcgccugcugagccccguccgggugccgaacuacaaccucaucaucauggacgaggcccacuucaccgaccccgccagcaucgcggcccgcggcuacaucuccacccggguggagaugggcgaggccgccgggaucuucaugacggccacgccgcccggcagccgcgacccguucccccaguccaacgcgcccaucauggacgaggagcgggagauccccgagcgcagcugguccagcgggcacgagugggucaccgacuucaagggcaagaccgugugguucgugccguccaucaaggccgggaacgacaucgccgccugccugcggaagaacggcaagaaggucauccagcugagccgcaagacguucgacuccgaguacgugaagacccggaccaacgacugggacuucguggucaccacggacaucagcgagaugggcgcgaacuucaaggccgagcgcgugaucgacccccggcgcugcaugaagcccgugauccucaccgacggggaggagcgggucauccuggccggccccaugccggugacccacuccagcgccgcccagcgccgggggcgcaucggccggaaccccaagaacgagaacgaccaguacaucuacaugggggagccccuggagaacgacgaggacugcgcgcacuggaaggaggccaagaugcuccuggacaacaucaacacccccgagggcaucaucccguccauguucgagcccgagcgcgagaagguggacgccaucgacggcgaguaccggcugcgcggggaggcccgcaagacguucgucgaccucaugcggcgcggcgaccugcccguguggcuggccuaccggguggcggccgaggggaucaacuacgccgaccgccgguggugcuucgacggcaucaagaacaaccagauccucgaggagaacgucgagguggagaucuggaccaaggagggggagcgcaagaagcugaagccgcgguggcuggacgcccgcaucuacagcgacccccucgcccugaaggaguucaaggaguucgcggccggccggaagucccugacccucaaccugaucaccgagaugggccgccugcccacguucaugacccagaaggcccgggacgcccucgacaaccuggcgguccugcacaccgccgaggccgggggccgcgccuacaaccacgcccucagcgagcugcccgagacccuggagacgcuccugcugcucacccugcuggcgaccgugaccgggggcaucuuccucuuccugauguccggccgggggaucggcaagaugacgcuggggaugugcugcaucaucaccgccagcauccuccugugguacgcccagauccagccgcacuggaucgccgccuccaucauccuggaguucuuccucaucgugcugcugauccccgagcccgagaagcagcgcacgccccaggacaaccagcucaccuacgucgugaucgcgauccugaccguggucgccgccacgauggccaacgagaugggcuuccuggagaagaccaagaaggaccucgggcugggcagcaucaccacccagcagccggagagcaacauccuggacaucgaccuccggcccgccuccgcguggacgcuguacgccguggccaccaccuucgugacccccaugcugcgccacagcaucgagaacuccagcgucaacgugucccucacggccaucgccaaccaggcgaccgugcugaugggccuggggaagggcuggccccucagcaagauggacaucggggucccgcugcuggccaucggcugcuacucccaggugaaccccaucacccucaccgccgcccuguuccugcucguggcgcacuacgccaucaucgggcccggccugcaggccaaggccacgcgggaggcccagaagcgcgcggccgccggcaucaugaagaaccccaccgucgacgggaucaccgugaucgaccuggacccgauccccuacgaccccaaguucgagaagcagcucggccaggugaugcugcugguccucugcgugacccaggugcugaugaugcggacgaccugggcccugugcgaggcccucacccuggcgaccgggcccaucagcacgcugugggagggcaacccggggcgcuucuggaacaccaccaucgccgucuccauggccaacaucuuccggggcagcuaccucgccggcgccgggcugcuguucuccaucaugaagaacaccacgaacacccgccgcggcaccgggaacaucggcgagacccucggcgagaaguggaagucccggcugaacgcgcugggcaagagcgaguuccagaucuacaagaaguccgggauccaggagguggaccgcacgcucgccaaggaggggaucaagcggggcgagaccgaccaccacgccgugucccgcgggagcgccaagcugcggugguucgucgagcgcaacauggugacccccgagggcaagguggucgaccugggcugcgggcggggcgggugguccuacuacugcggcgggcucaagaacgugcgcgaggugaagggccugaccaagggcgggcccggccacgaggagcccaucccgaugagcacguacggguggaaccugguccggcuccaguccggcguggacguguucuucacgccgcccgagaagugcgacacccugcugugcgacaucggggagagcagccccaacccgaccgucgaggcgggccgcacgcuccgggugcugaaccugguggagaacuggcucaacaacaacacccaguucugcaucaagguccugaaccccuacaugcccuccgugaucgagaagauggaggcccugcagcgcaaguacggcggggcccucgugcggaacccgcugagccgcaacuccacccacgagauguacugggucagcaacgccuccggcaacaucgugagcuccgugaacaugaucagccggaugcugaucaaccgcuucaccaugcggcacaagaaggccaccuacgagcccgacgucgaccugggguccggcacgcgcaacaucgggaucgagagcgagauccccaaccucgacaucaucggcaagcggaucgagaagaucaagcaggagcacgagaccuccuggcacuacgaccaggaccaccccuacaagaccugggcguaccacggcagcuacgagaccaagcagacgggguccgccagcuccauggugaacggcgugguccgccugcugaccaagccgugggacguggugcccauggucacccagauggccaugaccgacacgacccccuucgggcagcagcgcguguucaaggagaagguggacacccggacccaggagcccaaggagggcacgaagaagcucaugaagaucaccgccgaguggcuguggaaggagcugggcaagaagaagaccccgcgcaugugcacccgggaggaguucacgcgcaagguccggagcaacgccgcgcucggggccaucuucaccgacgagaacaaguggaaguccgcccgcgaggccguggaggacagccgguucugggagcuggucgacaaggagcgcaaccugcaccucgagggcaagugcgagaccugcguguacaacaugauggggaagcgggagaagaagcugggcgaguucgggaaggccaagggcucccgcgcgaucugguacauguggcugggcgcccgguuccucgaguucgaggcccugggguuccugaacgaggaccacugguucagccgcgagaacagccucuccggcguggagggggagggccugcacaagcugggguacauccuccgggacgucagcaagaaggagggcggcgccauguacgcggacgacaccgccgggugggacacgcgcaucacccuggaggaccugaagaacgaggagauggugaccaaccacauggagggcgagcacaagaagcucgccgaggccaucuucaagcugaccuaccagaacaaggugguccgggugcagcgccccacgccccgggggaccgugauggacaucaucucccgccgggaccagcgcggcagcgggcaggucggcaccuacggccugaacaccuucacgaacauggaggcccagcucauccggcagauggagggggagggcguguucaaguccauccagcaccugaccgugaccgaggagaucgcgguccagaacuggcuggcccgcguggggcgcgagcggcucagccgcauggccaucuccggcgacgacugcguggucaagccccuggacgaccgguucgccagcgcccugaccgcgcucaacgacaugggcaaggugcgcaaggacauccagcagugggagccgucccggggguggaacgacuggacccaggugcccuucugcagccaccacuuccacgagcugaucaugaaggacggccgcguccugguggugcccugccggaaccaggacgagcucaucgggcgcgcccggaucucccagggcgccggguggagccugcgcgagaccgccugccugggcaaguccuacgcccagauguggagccucauguacuuccaccggcgcgaccugcggcuggcggccaacgccaucugcuccgccguccccagccacugggugccgaccucccgcaccacguggagcauccacgccaagcacgaguggaugaccaccgaggacaugcucaccguguggaaccgggucuggauccaggagaaccccuggauggaggacaagacccccguggagagcugggaggagauccccuaccugggcaagcgcgaggaccaguggugcgggucccugaucggccucacgagccgggcgaccugggccaagaacauccagaccgccaucaaccaggugcgcucccugaucgggaacgaggaguacaccgacuacaugccgagcaugaagcgguuccgccgcgaggaggaggaggccggcguccugugguga

SEQ ID NO: 9135 - RNA, 9876 nt, Artificial Sequence
  derived and/or modified CDS sequence (opt1) from DENV-2__FJ898454__SS-prME
accgcgggcgugaucaucaugcugauccccaccgccauggcguuccaccucaccacccggaacggggagccccacaugaucgugagccggcaggagaagggcaagagccugcuguucaagaccgaggacggggugaacaugugcacccucauggccauggaccugggcgagcugugcgaggacaccaucaccuacaacugcccccuccugcggcagaacgagcccgaggacaucgacugcuggugcaacagcaccuccaccugggugaccuacgggaccugcaccgccaccggcgagcaccggcgcgagaagcggagcgucgcccuggugccccacgugggcauggggcucgagacccgcaccgagaccuggauguccagcgagggcgccuggaagcacgcgcagcggaucgagaccuggauccugcgccaccccggguucacgaucauggccgccauccuggccuacaccaucggcaccaccuacuuccagcggguccucaucuucauccugcugacggcgguggcccccuccaugaccaugcgcugcaucgggaucagcaaccgggacuucguggagggcgucuccggcgggagcuggguggacaucgugcucgagcacggcuccugcgucaccaccauggccaagaacaagcccacgcuggacuucgagcugaucaagaccgaggccaagcagcccgccacccuccgcaaguacugcaucgaggcgaagcugaccaacacgaccaccgccagccggugccccacccagggggagcccucccugaacgaggagcaggacaagcgcuucgugugcaagcacagcaugguggaccggggcuggggcaacgggugcggccucuucgggaagggcgggaucgucacgugcgccauguucacgugcaagaagaacauggagggcaagaucgugcagcccgagaaccuggaguacaccaucguggucacgccccacuccggcgaggagaacgccguggggaacgacacgggcaagcacgggaaggagaucaaggugaccccgcagagcuccaucaccgaggccgagcugaccggcuacgggaccgucacgauggagugcagcccccgcaccggccucgacuucaacgagauggugcugcugcagauggagaacaaggcguggcucgugcaccggcagugguuccuggaccugccccuccccuggcugccgggcgccgacacccagggguccaacuggauccagaaggagacccuggucacguucaagaacccccacgccaagaagcaggacguggucgugcucggcagccaggagggggccaugcacaccgcccugaccggcgcgaccgagauccagaugagcuccgggaaccuccuguucacgggccaccugaagugccgccugcggauggacaagcuccagcugaagggcaugagcuacuccaugugcaccgggaaguucaagguggucaaggagaucgccgagacccagcacggcaccaucguggugcgcguccaguacgagggggacggcagccccugcaagauccccuucgagaucauggaccuggagaagcggcacgugcucggccgccugaucacggugaacccgaucgucaccgagaaggacucccccgugaacaucgaggccgagccgcccuucggggacagcuacaucaucaucggcguggagccggggcagcugaagcucuccugguucaagaagggcagcuccaucgggcagauguucgagaccaccaugcgcggcgccaagcggauggccauccugggcgacacggcgugggacuucgggagccugggcggggucuucaccuccaucggcaaggcccuccaccagguguucggggccaucuacggcgccgcguucagcggcguguccuggaccaugaagauccugaucggggucgugaucaccuggaucggcaugaacagccgcuccacgagccuguccgugagccugguccucguggggguggucacccuguaccugggcgugauggugcaggccgacuccgggugcgucgugagcuggaagaacaaggagcucaagugcggcagcggcaucuucaucaccgacaacgugcacaccuggacggagcaguacaaguuccagcccgagucccccagcaagcuggccuccgccauccagaaggccuacgaggaggggaucugcggcauccggagcgucacccgccuggagaaccucauguggaagcagaucacccccgagcugaaccacauccuguccgagaacgaggcgaagcucaccaucaugacgggggacaucaagggcaucaugcaggccgggaagcggagccugcgcccgcagcccaccgagcugaaguacuccuggaagaccuggggcaaggccaagaugcucagcaccgagccccacaaccagacguuccugaucgacggcccggagaccgccgagugccccaacaccaaccgggccuggaacucccuggagguggaggacuacggguucggcguguucaccacgaacaucuggcucaagcugaaggagcgccaggacgucuucugcgacagcaagcugauguccgcggccaucaagaacaaccgggccgugcacgccgacaugggguacuggaucgagagcgcccucaacgacaccuggaagaucgagaaggcguccuucaucgaggucaagagcugccacuggcccaagucccacacccuguggagcaacggcgugcuggaguccgagaugaucauccccaagaacuucgccggcccggugagccagcacaacuaccgccccggguaccacacccagaccgccggccccuggcaccucgggaagcuggagauggacuucgacuucugcgagggcacgaccguggucgugaccgaggacugcgggaaccggggccccagccugcgcaccacgaccgccuccggcaagcucaucaccgaguggugcugccggagcugcacccugccgccccugcgcuaccgcggggaggacggcugcugguacgggauggagauccgcccccucaaggagaaggaggagaaccuggugaacucccuggucacggcgggccacgggcagaucgacaacuucagccucggcgugcugggcauggcccuguuccucgaggagaugcugcggacccgcguggggaccaagcacgccguccugcucguggccguguccuucaugacccugaucacgggcaacaugagcuuccgggaccuggggcgcgucauggugauggugggcgccgcgaucaccgacgacaucgggaugggcgucaccuaccucgcccugcuggccgccuucaaggugcgccccaccuucgccgcgggccuccugcugcggaagcucacguccaaggagcugaugaugaccaccaucgggaucgugcugcucagccaguccaccaucccggagacgauccuggagcugaccgacgcccucgcccugggcaugaugauccugaagaucguccgcaacauggagaaguaccagcucgccgugaccaucauggccacccugugcguccccaacgcggugauccugcagaacgccuggaaggugagcugcacgauccucgccgucguguccgugagcccccugcugcucaccuccagccagcagaaggccgacuggaucccccuggcgcugaccaucaaggggcucaacccgaccgccaucuuccugacgacccugucccggaccaacaagaagcgcagcuggccccucaacgaggccaucauggccgucggcaugguguccauccuggccagcucccugcucaagaacgacauccccaugaccggcccccugguggccggcgggcugcucacggucugcuacgugcugaccgggcggagcgccgaccuggagcucgagcgcgccgccgacgugcggugggaggaccaggccgagaucagcggguccagcccgauccuguccaucaccaucagcgaggacggguccaugagcaucaagaacgaggaggaggagcagacccugacgauccucauccgcaccggccugcuggucaucuccggccucuuccccgugagcauccccaucaccgcggccgccugguaccugugggaggugaagaagcagcgggccgggguccugugggacgugcccuccccgccgcccgugggcaaggccgagcucgaggacggggcguaccgcaucaagcagaagggcauccugggguacagccagaucggcgccggcgucuacaaggaggggaccuuccacaccauguggcacgugacgcggggcgccgugcugaugcacaaggggaagcgcaucgagccguccugggccgacguccggaaggaccucaucagcuacggcgggggcuggaagcuggagggcgaguggaaggagggggaggagguccaggugcuggcccucgagcccggcaagaacccccgcgcgguccagaccaagcccgggcuguucaagaccaacaccggcacgaucggggccgugucccuggacuucagcccgggcaccuccggcagccccaucguggacaagaaggggaaggucgugggccucuacgggaacggcguggucacccgguccggcaccuacgugagcgccaucgcccagacggagaaguccaucgaggacaaccccgagaucgaggacgacaucuuccgcaagaagcggcugaccaucauggaccugcaccccggggcgggcaagaccaagcgcuaccugccggccaucgugcgggaggccaucaagcgcgggcuccggacccugauccuggcccccacgcgcgucguggccgcggagauggaggaggcccuccgcggccugcccauccgguaccagacccccgccauccgcgccgagcacaccgggcgggagaucguggaccugaugugccacgccaccuucacgaugcgccuccugagcccgguccgggugcccaacuacaaccugaucaucauggacgaggcgcacuucaccgaccccgccagcaucgccgcccgcggcuacaucuccacccggguggagaugggcgaggccgcggggaucuucaugaccgccacgcccccgggcagccgcgaccccuucccccaguccaacgcccccaucauggacgaggagcgggagaucccggagcgcagcuggaacuccgggcacgagugggucaccgacuucaagggcaagaccgugugguucgugcccagcaucaaggccgggaacgacaucgcggccugccuccggaagaacggcaagaaggucauccagcugucccgcaagaccuucgacagcgaguacaucaagacgcggaccaacgacugggacuucguggugaccaccgacaucuccgagaugggcgccaacuucaaggccgagcgcgucaucgacccccggcgcugcaugaagcccgugauccugacggacggggaggagcgggugauccucgccggcccgaugcccgucacccacagcuccgcggcccagcgccgggggcgcaucggccgcaaccccaagaacgagaacgaccaguacaucuacaugggggagccccuggagaacgacgaggacugcgcccacuggaaggaggccaagaugcugcucgacaacaucaacaccccggagggcaucauccccagcauguucgagcccgagcgggagaagguggacgccaucgacggcgaguaccgccugcgcggggaggcgcgcaagaccuucguggaccugaugcggcgcggcgaccucccggucuggcuggccuaccggguggccgccgaggggaucaacuacgccgaccgccgguggugcuucgacggcaucaagaacaaccagauccuggaggagaacgucgagguggagaucuggacgaaggagggggagcgcaagaagcucaagccccgguggcuggacgcgcgcaucuacuccgacccccuggcccucaaggaguucaaggaguucgccgccggccgcaagagccugacccugaaccucaucaccgagaugggccgccugcccaccuucaugacgcagaaggcgcggaacgcccuggacaaccucgccgugcugcacaccgccgaggccgggggccgcgcguacaaccacgcccuguccgagcucccggagacccuggagacccugcuccugcugacgcuccuggccaccgucaccgggggcaucuuccuguuccucaugagcggcaaggggaucggcaagaugacccuggggaugugcugcaucaucaccgccuccauccugcucugguacgcccagauccagccccacuggaucgcggccagcaucauccuggaguucuuccugaucgugcuccugauccccgagcccgagaagcagcggacgccgcaggacaaccagcugaccuacguggucaucgccauccucaccgugguggccgccaccauggcgaacgagaugggcuuccuggagaagacgaagcgcgacuucgggcugggcuccaucgccacccagcagcccgagagcaacauccucgacaucgaccugcggcccgccagcgccuggacccuguacgccgucgcgaccacguucaucacccccaugcuccgccacuccaucgagaacagcuccgugaacgugagccugaccgccaucgccaaccaggccaccguccugaugggccucgggaagggcuggccgcuguccaagauggacaucggggugccccugcucgcgaucggcugcuacagccaggugaaccccaucacgcugaccgccgcccugcuccugcuggucgcccacuacgccaucaucgggcccggccuccaggcgaaggccacccgggaggcccagaagcgcgccgccgcgggcaucaugaagaacccgaccguggacgggaucacggugaucgaccuggaccccauccccuacgaccccaaguucgagaagcagcugggccaggucaugcuccuggugcugugcgugacccagguccucaugaugcgcaccaccugggcccugugcgaggcccugacgcucgccaccgggccgaucuccacccugugggagggcaaccccgggcgguucuggaacaccacgaucgccgugagcauggcgaacaucuuccgcggcuccuaccuggccggcgccgggcuccuguucagcaucaugaagaacaccaccaacacccggcgcggcacggggaacaccggcgagacccugggcgagaaguggaagaaccggcucaacucccugggcaagagcgaguuccagaucuacaagcgcuccggcauccaggagguggaccggacccuggccaaggaggggaucaagcgcggcgagacggaccaccacgcggucagccggggguccgccaagcuccgcugguucguggagcggaaccuggugacccccgagggcaaggucguggaccugggcugcgggcgcggcggguggagcuacuacugcggcgggcucaagaacgugcgggaggucaagggccugaccaagggcgggcccggccacgaggagccgauccccauguccaccuacggguggaaccuggugcgccuccagagcggcguggacgucuucuucacgccgcccgagaagugcgacacccugcugugcgacaucggggaguccagcccgaaccccaccguggaggccggccggacccuccgcgugcugaaccuggucgagaacuggcucaacaacaacacccaguucugcaucaaggugcugaaccccuacaugccgagcgugaucgagaagauggagacgcugcagcggaaguacggcggggcccugguccgcaacccccucucccggaacagcacccacgagauguacuggguguccaacgccagcggcaacaucguguccagcgucaacaugaucucccgcaugcugaucaaccgcuucaccaugcggcacaagaaggcgaccuacgagcccgacguggaccuggggagcggcacgcgcaacaucgggaucgaguccgagacccccaaccucgacaucaucggcaagcggaucgagaagaucaagcaggagcacgagaccagcuggcacuacgaccaggaccacccguacaagaccugggccuaccacggcuccuacgagacgaagcagaccgggagcgccuccagcauggugaacggcgucgugcgccugcugaccaagcccugggacgugauccccauggucacccagauggccaugacggacaccacccccuucgggcagcagcggguguucaaggagaagguggacacccgcacgcaggagccgaaggagggcaccaagaagcucaugaagaucaccgccgaguggcuguggaaggagcugggcaagaagaagacgccccggaugugcacgcgcgaggaguucacccggaagguccgcuccaacgcggcccucggggccaucuucaccgacgagaacaaguggaaguccgcccgggaggccguggaggacucccgcuucugggagcuggucgacaaggagcggaaccugcaccucgagggcaagugcgagaccugcguguacaacaugauggggaagcgcgagaagaagaucggcgaguucgggaaggcgaagggcagccgggccaucugguacauguggcugggcgcccgcuuccuggaguucgaggcccucggguuccugaacgaggaccacugguucucccgggagaacagccugagcggcguggagggggagggccuccacaagcugggguacauccugcgcgaggucuccaagaaggagggcggcgcgauguacgccgacgacacggccgggugggacacccggaucacccucgaggaccugaagaacgaggagauggugaccaaccacauggagggcgagcacaagaagcuggccgaggccaucuucaagcucacguaccagaacaaggugguccgcgugcagcggcccacgccccgggggaccgugauggacaucaucagccgccgggaccagcgcggcuccgggcaggucggcaccuacggccugaacacguucaccaacaugggggcgcagcugauccggcagauggagggcgaggggguguucaagggcauccagcaccucaccgccaccgaggagguggccguccaggacuggcuggcccgcgugggccgggagcgccugagccggauggccaucuccggggacgacugcguggucaagccgcucgacgaccgcuucgcgagcgcccugacggcccugaacgacaugggcaagauccggaaggacauccagcagugggagcccucccgcggguggaacgacuggacccaggugcccuucugcagccaccacuuccacgagcucaucaugaaggacggccgggugcuggucgugcccugccgcaaccaggacgagcugaucgggcgggcccgcaucucccagggcgccggcuggagccuccgggagaccgcgugccuggggaaguccuacgcccagauguggagccugauguacuuccaccgccgggaccuccgccuggccgccaacgccaucugcuccgcggugccgagccacuggguccccaccucccggaccacguggagcauccacgcccgccacgaguggaugaccaccgaggacaugcugaccguguggaaccgcguguggauccaggagaaccccuggauggaggacaagacgcccgucgaguccugggaggagaucccguaccucggcaagcgggaggaccaguggugcgggagccugaucggccugaccagccgcgccaccugggccaagaacauccagaccgcgaucaaccaggugcggucccucaucgggagcgaggaguacacggacuacaugcccuccaugaagcgcuuccggcgcgaggaggaggaggccggcgugcugugguga

SEQ ID NO: 9136 - RNA, 9876 nt, Artificial Sequence
  derived and/or modified CDS sequence (opt1) from DENV-2__JQ922551__SS-prME
accguggggaugaucaucaugcucauccccaccgccauggccuuccaccucaccacccggaacggggagccccacaugaucgucagccggcaggagaagggcaagagccugcuguucaagaccgaggacggggugaacaugugcacccucauggcgauggaccugggggagcugugcgaggacaccaucaccuacaacugcccccuccugaagcagaacgagcccgaggacaucgacugcuggugcaacagcaccagcaccugggugaccuacgggaccugcaccgccaccggggagcaccggcgggagaagcgcagcgucgcccuggugccccacgugggcauggggcucgagacccggaccgagaccuggaugagcagcgagggcgccugcaagcacgcccagcgcaucgagaccuggauccugcggcacccguccuucacgaucauggcggccauccuggccuacaccaucgggaccaccuacuuccagcgcgucguguuccucauggugcugacggccgucgcgcugagcaugaccaugcggugcaucggcaucuccaaccgcgacuucguggagggggugagcggcggcuccugggucgacaucgugcucgagcacgggagcugcgugaccaccauggccaagaacaagcccacgcuggacuucgagcugaucaagaccgaggccaagcagcccgccacccuccggaaguacugcaucgaggccaagcugaccaacacgaccaccgcgucccgcugccccacccagggcgagccgagccugaacgaggagcaggacaagcgguucguccgcaagcacuccaugguggaccggggguggggcaacggcugcggccucuucggcaagggcgggaucgugacgugcgccauguucacgugcaagaagaacauggaggggaagaucguccagcccgagaaccuggaguacacccuggugaucacgccccacagcggcgaggagaacgccgugggcaacgacacggggaaccacggcaaggagaucaaggucacgccccaguccagcaucaccgaggccgcccucaccggguacggcaccgugacgauggagugcuccccgcgcaccgggcugaacuuccacgagauggugagccugcccauggagaacaaggcguggaugguccaccggcagugguuccucgaccugccccugcccuggcucccgggcgccgacacccagggcagcaacuggauccagaaggagacccuggugacguucaagaacccccacgccaagaagcaggacgucguggugcuggggucccaggagggcgccaugcacaccgcccucaccggggcgaccgagauccagaugagcuccggcaaccugcuguucacggggcaccucaagugccgccugcggauggacaagcugcagcucaagggcaugagcuacuccaugugcaccggcaaguucaaggucgugugggggaucgcccgcacccagcacggcaccaucgugcaccggguccaguacgagggggacggcagccccugcaagaucccccugaacaucaugggccuggagaagcgccacgugcucgggcgcccgaucacggugaaccccaucgucaccggcaaggacucccccgugaacaucgaggccgagcccccgcugggggacagcuacaucaucaucggcguggagcccgggcaggucaagcugaccugcucccagaagggcagcuccaucggccagauguucgagaccacgaugcgcggggcgaagcgcauggccauccucggcgacaccgcgugggacuucgggagccugggcgggguguucaccuccaucggcaaggcccugcaccagguguucggcgccaucuacggggccgcguucagcggcgucuccuggaccaugaagauccucaucgggguggugaucacguggaucggcaugaacagccgguccaccagccuguccgucagccuggugcuggugggggucgugacccucuaccugggcgugaugguccaggccgacagcggcugcgugguguccuggaagaacaaggagcugaagugcgggagcggcaucuucgucaccgacaacgugcacacguggaccgagcaguacaaguuccagcccgagucccccagcaagcucgccuccgccauccagaaggcccacgaggaggggaucugcggcauccgcagcgugacccggcuggagaaccugauguggaagcagaucaccccggagcucaaccacauccuguccgagaacgaggucaagcugacgaucaugaccggggacaucaagggcaucaugcaggcgggcaagcgcagccuccggccccagcccaccgagcugaaguacuccuggaagaccugggggaaggccaagaugcugagcacggagccgcacaaccagaccuuccucaucgacggccccgagaccgccgagugccccuccaccaaccgcgccuggaacagccugaagggcggggacuacggcuucgggguguucacgaccaacaucuggcugaagcucaaggagcggcaggacguguccugcgacagcaagcugauguccgccgcgaucaaggacaaccgcgccguccacgccgacaugggcuacuggaucgagagcgcccugaacgacaccuggaagaucgagaaggccuccuucaucgaggucaagagcugccacuggcccaagagccacacccucugguccaacggggugcuggagagcgagaugaucaucccgaagaaccuggcgggccccgugucccagcacaacuaccggcccggguaccacacccagacggccggccccuggcaccucggcaagcuggagauggacuucgaccugugcgaggggaccaccgugguggucaccgaggacugcggcaaccgcgggccgagccuccggacgaccaccgccuccggcaagcugaucaccgaguggugcugccgcagcugcacgcugccgccccuccgguaccgcggggaggacggcugcugguacggcauggagauccggccccugaaggagaaggaggagaaccuggugaacucccucgugaccgccgagcacgagcagaucgacaacuucagccuggggguccugggcauggcccucuuccuggaggagaugcugcgcacccggguggggaccaagcacgccgugcuccuggucgccguguccuucaugacgcugaucaccggcaacaugagcuuccgcgaccucgggcgcgugauggucauggugggcgccgccaugaccgacgacaucggcaugggggugaccuaccuggcgcugcucgccgccuucaagguccggccgacguucgccgccggccugcugcuccgcaagcugaccuccaaggagcugaugaugaccaccaucgggaucgugcuccugagccaguccacgauccccgagaccauccuggagcucaccgacgcgcuggcccugggcaugaugauccucaagaucguccggaacauggagaaguaccagcuggccgugaccaucauggccauccugugcgugcccaacgccaugauccuccagaacgcguggaaggucagcugcacgauccuggccgugguguccgucagcccccugcuccugaccuccagccagcagaaggccgacuggaucccgcuggcccucaccaucaagggccugaaccccaccgcgaucuuccugacgacccucucccgcaccaacaagaagcggagcuggccccugaacgaggccaucauggccguggggauggugagcauccuggccuccagccuccugaagaacgacauccccaugaccggcccgcuggucgccgggggccuccugacggugugcuaccugcuccccgggcgcuccgcggaccuggagcuggagcgggccgccgaccuccgcugggaggaccaggccgagaucagcggcuccagccccauccuguccaucaccaucagcgaggacggcuccaugagcaucaagaaccaggaggagaagcagacccugaccauccucaucaagacggggcugcuggugaucuccgagcuguuccccguccagaucccgaucaccgccgcggccugguaccugugggaggugaagaagcagcgggccggcgugcugugggacguccccagcccgccgcccguggggaaggccgagcucgaggacggcgccuacgggaucaagcagaagggcauccugggcuacucccagaucggggcgggcguguacaaggaggggaccuuccacaccauguggcacgucacccgcggcgccgugcugaugcacaaggggaagcggaucgagcccagcugggccgacgugcgcaaggaccucaucuccuacggcggcggguggaagcuggagggcgaguggaaggagggggaggagguccaggugcuggcccucgagcccggcaagaacccccgggccgugcagacgcgccccgggcuguucaagaccaacaccggcaccaucggcgcggucagccuggacuucucccccgggacgagcggcucccccaucguggacaagaaggggaagguggucggccuguacggcaacgggguggugacccggagcggcaccuacgucagcgccaucgcccagaccgagaaguccaucgaggacaaccccgagaucgaggacgacaucuuccgcaagaagcggcucacgaucauggaccugcaccccggggccggcaagaccaagcgcuaccugcccgcgaucgugcgggaggccaucaagcgcgggcuccggacccugauccuggcccccacccgcguggucgccgccgagauggaggaggcgcuccgcggccugccgauccgguaccagacgcccgccauccgcgccgagcacaccggccgggagaucguggaccugaugugccacgccaccuucaccaugcgccuccugagccccgugcggguccccaacuacaaccugaucaucauggacgaggcccacuucacggacccggcguccaucgccgcccgcggguacaucagcacccggguggagaugggcgaggccgccgggaucuucaugaccgcgacgccgcccggcucccgcgaccccuucccgcagagcaacgcccccaucauggacgaggagcgggagauccccgagcgcuccuggaacagcgggcacgagugggugacggacuucaagggcaagaccgucugguucgugcccuccaucaaggccggcaacgacaucgccgcgugccuccggaagaacgggaagaaggugauccagcugagccgcaagaccuucgacuccgaguacaucaagacccggacgaacgacugggacuucgucgugaccaccgacaucagcgagaugggcgccaacuucaaggccgagcgcgugaucgacccgcggcgcugcaugaagcccgucauccugaccgacggggaggagcgggugauccucgccggccccaugcccgugacgcacuccagcgccgcgcagcgccgggggcgcaucggccgcaacccgaagaacgagaacgaccaguacaucuacaugggcgagccccuggagaacgacgaggacugcgcccacuggaaggaggccaagaugcugcucgacaacaucaacacccccgaggggaucaucccguccauguucgagcccgagcgggagaaggucgacgccaucgacggcgaguaccgccugcgcggggaggcccgcaagaccuucguggaccugaugcggcgcggcgaccuccccguguggcuggcguaccgggucgccgccgaggggaucaacuacgccgaccgccgguggugcuucgacggcaucaagaacaaccagauccuggaggagaacguggaggucgagaucuggaccaaggagggcgagaagaagaagcucaagccccgcuggcuggacgcccggaucuacagcgacccgcuggcgcucaaggaguucaaggaguucgccgccgggcgcaagucccugacgcugaaccucaucaccgagaugggccggcugcccaccuucaugacccagaaggcccgcaacgcgcuggacaaccucgccgugcugcacacggccgaggccgggggccgggccuacaaccacgcgcugagcgagcuccccgagacccuggagacccugcuccugcugacccuccuggccacggugaccggcgggaucuuccuguuccucauguccggcaaggggaucggcaagaugacccuggggaugugcugcaucaucaccgccagcauccugcucugguacgcccagauccagccccacuggaucgccgcgagcaucauccuggaguucuuccugaucguccuccugaucccggagcccgagaagcagcgcacgccccaggacaaccagcugacguacguggugaucgccauccucaccgccgucgccgccaccauggcgaacgagaugggcuuccuggagaagaccaagaaggacuucggccugggguccaucgccacgcagcccccggagagcaacauccucgacaucgaccugcggcccgccuccgccuggacccuguacgccguggcgaccaccuucaucacgagcaugcuccgccacuccaucgagaacagcuccgugaacgucagccugaccgccaucgccaaccaggccaccgugcugaugggccucgggaagggcuggccccuguccaagauggacaucggggugccccugcucgcgaucggcugcuacagccaggucaacccgaucacccugacggccgcccugcuccugcugguggcccacuacgccaucaucggccccgggcuccaggcgaaggccacccgggaggcccagaagcgcgccgccgcgggcaucaugaagaaccccaccguggacgggaucaccgucaucgaccuggaccccaucccguacgaccccaaguucgagaagcagcugggccaggugaugcuccuggugcugugcgucacccaggugcucaugaugcggaccaccugggcccugugcgaggcccugacccucgccacggggcccaucuccacccugugggagggcaaccccggccgcuucuggaacaccaccaucgccgugagcauggcgaacaucuuccgcggguccuaccuggccggcgccgggcuccuguucagcaucaugaagaacacgaccaacacccggcgcggcaccggcaacacgggggagacccugggcgagaaguggaagaaccggcucaacgcccuggggaaguccgaguuccagaucuacaagaaguccggcauccaggaggucgaccgcacccuggcgaaggaggggaucaagcggggcgagaccgaccaccacgccgugucccgcggcagcgccaagcuccggugguucguggagcgcaaccuggucacgccggaggggaaggugguggaccugggcugcgggcggggcgggugguccuacuacugcggcggccucaagaacguccgcgaggugaaggggcugaccaagggcgggcccggccacgaggagcccauccccaugagcaccuacggguggaaccuggugcggcuccagagcggcgucgacguguucuucaccccgcccgagaagugcgacacgcugcugugcgacaucggcgaguccagccccaacccgaccguggaggccgggcgcacccuccggguccugaaccugguggagaacuggcugaacaacaacacccaguucugcgugaagguccucaaccccuacaugcccuccgugaucgagaagauggagacccugcagcgcaaguacggcggggcccuggugcggaacccccucagccgcaacuccacgcacgagauguacugggucagcaacgcguccggcaacaucgugagcuccgugaacaugaucagccggaugcugaucaaccgcuucaccaugcggcacaagaaggccaccuacgagccggacgucgaccugggguccggcacccgcaacaucggcaucgagagcgagacgcccaaccucgacaucaucgggaagcgcaucgagaagaucaagcaggagcacgagaccuccuggcacuacgaccaggaccaccccuacaagaccugggccuaccacggcagcuacgagaccaagcagacgggguccgccagcuccauggugaacggcgugguccggcugcugaccaagcccugggacgugaucccgauggugacccagauggccaugaccgacacgacccccuucggccagcagcgcgucuucaaggagaaguccgacacccggacccaggagcccaaggaggggacgaagaagcucaugaagaucacccccaaguggcuguggaaggagcugggcaagaagaagaccccgcgcaugugcacccgggaggaguucacgcgcaaggugcgguccaacgcggcccucggggccaucuucaccgacgagaacaaguggaaguccgcccgcgaggccguggaggacagccgguucugggagcuggucgacaaggagcgcaaccugcaccucgagggcaagugcgagaccugcguguacaacaugauggggaagcgggagaagaagcugggcgaguucggcaaggcgaaggggucccgcgccaucugguacauguggcugggcgcccgguuccucgaguucgaggcccugggguuccugaacgaggaccacugguucagccgcgagaacucccucagcggcgucgagggggagggccugcacaagcugggcuacauccuccgggacguguccaagaaggagggcggggcgauguacgccgacgacaccgccgggugggacacgcgcaucacccuggaggaccugaagaacgaggagaugggcgccaaccaccucgagggggagcccaagaagcuguacgaggccaucuucaagcugaccuaccagaacaagggcgugcggguccagcgccccacgccccggggcccgcucauggacaucauccugcgccgggaccagggcgggagcggccaggugggcaccuacggccugaacaccuucaccaacaugggggcgcagcucauccgccagauggagggcgaggggguguucaagggcauccagcaccugaucgccaccgaggagaucgccguccaggacuggcuggcccgcguggggcgggagcgcuucucccggauggccaucagcggcgacgacugcguggucaagccccucgacgaccgcuucgcguccgcccugacggcccugaacgacaugggcaaggagcggaaggugcuccagcagugggagcccagccgcgaguggaacgacuggacccaggugcccuucugcucccaccacuuccacgagcugaucaugaaggacgggcggguccugguggugccgugccgcaaccaggacgagcucaucggccgggcccgcaucagccagggggccggcuggucccugcgggagaccgcgugccugggcaagagcuacgcccagauguggucccagauguacuuccaccgccgggaccuccgccuggccgccaacgccaucugcagcgcgguccccucccacugggugcccaccagccggacgaccuggagcauccacgcccgccacgaguggaugaccaccgaggacaugcugaccguguggaaccgggucuggauccaggagaaccccuggauggaggacaagacgccgguggaguccugggaggagauccccuaccucggcaagcgcgaggaccaguggugcggcagccugaucgggcugaccucccgggccaccugggccaagaacauccagaccgcgaucaaccaggugcgcagccucaucggcaacgaggaguacacggacuacaugcccuccaugaagcgcuuccggcgcgaggaggaggaggccgggguccugugguga

SEQ ID NO: 9137 - RNA, 9876 nt, Artificial Sequence
  derived and/or modified CDS sequence (opt1) from DENV-2__JQ922550__SS-prME
accgugggcaugaucaucaugcugauccccaccgugauggccagccaccucaccacccggaacgggggcccccacaugaucgugaucgggcagcagaagcggaagaccuccuucuucaagaccaagaagggccacgacaugugcacccugauggccauggcguucggggaguucugcgagaacaccaucaccuacaagugccccuuccugaagcagaacgagcccgaggacaucgacugcuggugcaacagcaccuccaccugggugaccuacgggaccugcaccaccaccggcgagcaccgccgggagaagcggagcgucgcccucgugccccacguggggaugggccuggagacccggaccgagacguggauguccagcgagggggccuggaagcacgcccagcgcaucgagaccuggauccugcggcaccccggcuucaccaucauggccgcgauccucgccuacaccaucgggacgacccacuuccagcgcguccugaucuucauccugcucaccgccaucgcccccuccaugaccaugcggugcaucggcaucagcaaccgcgacuucguggagggcguguccgggggcagcugggucgacaucgugcuggagcacggguccugcgugacgaccauggcgaagaacaagcccacccuggacuucgagcucaucaagaccgaggccaagcagcccgccacgcugcggaaguacugcaucgaggccaagcugaccaacaccaccacggacagccgcugccccacccagggcgagcccacccucaacgaggagcaggacaagcgguucgucugcaagcacuccaugguggaccgcggcugggggaacggcugcgggcuguucggcaagggcgggaucgugaccugcgccauguucacgugcaagaagaacaugaagggcaagaucguccagcccgagaaccuggaguacaccguggugaucacgccccacagcggggaggagcacgcggucggcaacgacaccgggaagcacggcaaggaggugaagaucaccccgcaguccagcaucacggaggccgagcucaccggguacggcaccgugaccauggagugcagcccccggacgggccuggacuucaacgagaugguccugcuccagauggaggacaaggccuggcuggugcaccgccagugguuccuggaccucccccugcccuggcugccgggggccgacacccagggcagcaacuggauccagaaggagacccucgugaccuucaagaacccccacgccaagaagcaggacgucgugguccuggggucccaggagggcgcgaugcacacggcccugaccggggccaccgagauccagaugagcagcggcaaccuccuguucaccggccaccugaagugccggcuccgcauggacaagcugcagcugaaggggauguccuacagcaugugcacgggcaaguucaagguggugaaggagaucgccgagacccagcacgggaccaucgucauccgggugcaguacgagggcgacggcucccccugcaagauccccuucgagaucaaggaccucgagaagcgccacgugcuggggcggcugaucaccgucaacccgaucgugacggagaaggacagccccgugaacaucgaggccgagccgccccugggcgacuccuacaucaucaucggggucgagccgggccagcugaagcuggacugguucaagaaggggagcuccaucggccagauguucgagaacaccaugcgcggcgcgaagcgcauggccauccucggggacaccgccugggacuucggcagccucggcgggguguucaccuccaucgggaaggcccugcaccagguguucggggccaucuacggcgcggccuucagcggggucuccuggacgaugaagauccucaucggcgugaucaucaccuggaucgggaugaacagccgguccaccagccuguccgugagccugguccucgugggcaucgugacccuguaccugggggucauggugcaggccgacuccggcugcggcgggugcgagcgcaagacgaagaccaagugcggcagcgggaucuucgugaccgacaacguccacaccuggacggagcaguacaaguuccagcccgagucccccagcaagcuggccagcgcgauccagaaggcccacgaggagggcaucugcgggauccgguccgugacccgccucgagaaccugauguggaagcagaucacccccgagcugaaccacauccucagcgagaacgaggugaagcugaccaucaugacgggcgacaucaagggcaucaugcaggccgggaagcggucccugcgcccgcagcccaccgagcuccgguacagcuggaagaccuggggcaaggccaagaugcuguccaccgagcugcacaaccagacguuccucaucgacgggcccgagaccgccgagugcccgaacaccaaccgcgcguggaacagccuggaggucgaggacuacggcuucggcguguucaccaccaacaucuggcugcggcuccgcgagaagcaggacguguucugcgacuccaagcugaugagcgccgccaucaaggacaaccgggccguccacgccgacaugggguacuggaucgaguccgcgcugaacgacacguggaagaucgagaaggccagcuucaucgaggugaaguccugccacuggcccaagagccacacccucuggggcaacggggugcuggaguccgagauggucauccccaagaacuucgccggccccgugagccagcacaacaaccgcccgggguacuacacccagaccgccggccccuggcaccugggcaagcucgagauggacuucgacuucugcgaggggacgaccguggucgugaccgaggacugcggcaaccgggggcccucccugcgcaccacgaccgccagcggcaagcugaucaccgaguggugcugccgguccugcacccucccgccgcccaaguaccgcggggaggacggcugcugguacggcauggagauccggccccugaaggagaaggaggagaaccuggugagcagccucgucacggcggggcacggccagaucgacaacuucucccuggggauccugggcauggcccucuuccuggaggagaugcugcgcacccggguggggaccaagcacgccauccuccugguggccgucagcuucgugacccugaucacgggcaacauguccuuccgcgaccucggccgcgugauggucauggugggggcgaccaugaccgacgacaucggcaugggggugaccuaccuggcccugcucgccgccuucaagguccggcccacguucgccgcgggccugcugcuccgcaagcugaccagcaaggagcugaugaugaccaccaucggcaucgugcucuccagccaguccagcauccccgagacgauccuggagcugaccgacgcccucgcccuggggaugauggugcugaagaugguccggaacauggagaaguaccagcucgccgugaccaucauggccauccugugcgugcccaacgcggucauccugcagaacgccuggaagguguccugcaccauccucgccgucgugagcgugagcccccugcugcucacgagcucccagcagaaggccgacuggaucccccuggcccugaccaucaagggccucaacccgaccgcgaucuuccugaccacgcugagcgggaccuccaagcgccggagcuggccccucaacgaggccaucauggccgucggcaugguguccauccuggccagcucccugcucaagaacgacauccccaugaccgggccccugguggcgggcggccugcucaccgucugcuacgugcugacggggcgcagcgccgaccuggagcucgagcgggccaccgacgugaagugggacgaccaggccgagaucagcggcuccagcccgauccuguccaucaccaucagcgaggacggguccaugagcaucaagaacgaggaggaggagcagacccugaccauccucauccgcacgggccugcuggucaucuccggccucuuccccgugagcauccccaucaccgccgcggccugguaccugugggaggugaagaagcagcgggccggcguccugugggacgugcccuccccgccccucgugggcaaggccgagcuggaggacggggccuaccgcaucaagcagaagggcauccugggguacagccagaucggcgcgggggucuacaaggagggcaccuuccacaccauguggcacgugacgcggggcgccgugcucaugcacaaggggaagcgcaucgagcccuccugggccgacgucaagaaggaccugaucagcuacggcgggggcuggaagcuggagggggaguggaaggagggcgaggagguccaggugcucgcccuggagccgggcaagaacccccgggccguccagaccaagcccgggcuguuccgcaccaacaccggcacgaucggggcggugucccucgacuucagccccggcaccuccggcagcccgaucguggacaagaaggggaaggucgugggccuguacgggaacggcguggucacccgguccggggccuacgugagcgccaucgcccagaccgagaaguccaucgaggacaaccccgagaucgaggacgacaucuuccgcaagcggcgccugacgaucauggaccuccaccccggcgccggcaagaccaagcgguaccugcccgcgaucgugcgcgaggccaucaagcgggggcugcgcacccucauccuggccccgacccgcgucguggccgcggagauggaggaggcccugcggggccugcccauccgcuaccagacgcccgccauccgggccgagcacaccgggcgcgagaucguggaccucaugugccacgccaccuucaccaugcggcugcugagccccauccgcgucccgaacuacaaccucaucaucauggacgaggcgcacuucacggaccccgccagcaucgccgcccggggcuacaucuccacccgcguggagaugggggaggccgcgggcaucuucaugaccgccacgccgcccggcagccgggacccguucccccaguccaacgcccccaucauggacgaggagcgcgagauccccgagcggagcuggaacuccgggcacgagugggugacggacuucaagggcaagaccgucugguucgugccgagcaucaagaccgggaacgacaucgccgccugccugcgcaagaacggcaagcgggugauccagcugucccgcaagaccuucgacagcgaguacgucaagacgcggaccaacgacugggacuucguggugaccaccgacaucuccgagaugggggcgaacuucaaggccgagcgcgucaucgacccccggcgcugcaugaagcccgugauccucacggacggcgaggagcgggugauccuggccggccccaugccggucacccacagcuccgccgcgcagcgccgcgggcggaucggccgcaaccccaagaacgagaacgaccaguacaucuacaugggggagccccuggagaacgacgaggacugcgcccacuggaaggaggccaagaugcuccuggacaacaucaacacccccgagggcaucaucccgagcauguucgagcccgagcgggagaagguggacgccaucgacggggaguaccgccugcggggcgaggcccgcaagacccuccuggagcugauccggggcgggcccaucccgguguaccucggcuacaaguggcccggggagggcaucaacuacgcggacucccgccugugcgucggccggacgcagaacaaccagauccuggaggagaacguggagguggagaucuggaccaaggaggggaagggcaagaagcucaagccccgcuggcuggacgcccggaucuacagcgacccccuggcccucaaggaguucaaggaguucgccgccgggcgcaagucccugacccugaaccucaucaccgagaugggccggcugccgacguucaugacccagaaggcgcgcgacgcccuggacaaccucgccguccugcacaccgccgaggccgggggcaaggcguacaaccacgcccugagcgagcuccccgagacccuggagacccugcuccugcugacgcuccuggccaccgugaccggcgggaucuuccuguuccucauguccggccgggggaucggcaagaugacccuggggaugugcugcaucaucacggccagcauccugcucugguacgcgcagauccagccccacuggaucgccgccuccaucauccuggaguucuuccugaucguccuccugauccccgagccggagaagcagcgcacgccccaggacaaccagcugaccuacgugaucaucgccauccucaccguggucgccgcgacgauggccaacgagaugggcuuccuggagaagaccaagaaggaccugggccucgggaacaucgccacccagcagcccgagagcaacauccuggacaucgaccugcggcccgccagcgccuggacccucuacgcgguggccacgaccuucaucaccccgaugcugcgccacuccaucgagaacagcuccgugaacgucagccugaccgccaucgccaaccaggccacggugcucaugggccuggggaagggcuggccccuguccaagauggacaucggggugccccuccuggcgaucggcugcuacagccaggucaaccccaucacccugaccgccgcccuccugcugcucguggcccacuacgccaucaucggcccggggcugcaggcgaaggccacccgggaggcccagaagcgcgccgcggccggcaucaugaagaaccccacgguggacgggaucaccgucaucgaccuggaccccauccccuacgacccgaaguucgagaagcagcucggccaggugaugcugcuggugcucugcgucacccaggugcugaugaugcggaccacgugggcccugugcgaggcccucacccuggccaccggccccguguccacccugugggaggggaaccccggccgcuucuggaacacgaccauccucauccagauggcgaacauccugcgcgggagcuaccuggccggcgccgggccccucuucuccaucauggagaacaccaccggcccgcggcgccggacgggccagcuggggcgcgagcugcuccggcgcuggaagucccggcugaacgcccugggcaaguccgaguuccagaucuacaagaaguccgggauccaggaggucgaccgcacccucgccaaggagggcaucaagcgcggggagaccgaccaccacgcggugucccgcggcagcgccaagcugcggugguucguggagcgcaaccuggucacccccgagggcaaggugguggaccucgggugcggccgcggcgggugguccuacuacugcggcgggcugaagaacguccgcgaggugaaggggcugacgaagggcgggcccgggcacgaggagcccaucccgaugagcaccuacggcuggaaccucgugcggcugcaguccggggucgacguguucuucaucccgcccgagcgcugcgacacccugcucugcgacaucggcgagagcuccccgaaccccaccguggaggccggccggacccugcgcguccugaaccucguggagaacuggcugaacaacaacacgcaguucugcaucaaggugcugaaccccuacaugcccagcgucaucgagaagauggagacccugcagcggaaguacgggggcgcccucgugcgcaacccgcugagccgcaacuccacccacgagauguacugggugagcaacgccuccgggaacaucgucagcuccgugaacaugaucagccggaugcugaucaaccgcuucaccaugcggcacaagaaggcgacguacgagcccgacguggaccucggcuccggcacccgcaacaucgggaucgagagcgagauccccaaccuggacaucaucggcaagcggaucgagaagaucaagcaggagcacgagaccuccuggcacuacgaccaggaccaccccuacaagaccugggccuaccacgggagcuacgagacgaagcagaccggcuccgccagcuccauggucaacgggguggugcgccugcucaccaagccgugggacgucgugcccauggugacccagauggccaugacggacaccacccccuucggccagcagcgggucuucaaggagaagguggacacccgcauccaggagcccaaggagggcacgaagaagcugaugaagaucauggcggaguggcuguggaaggagcucgggaagaagaagaccccgcggaugugcacccgcgaggaguucaccaagaaggugcggagcaacgccgcccugggcgccaucuucacggacgagaacaaguggaaguccgcccgcgaggcggucgaggacgggcgguucugggagcugguggaccgcgagcggaaccuccaccuggagggcaagugcgagaccugcguguacaacaugauggggaagcgcgagaagaagcugggcgaguucggcaaggccaaggggagccgggccaucugguacauguggcucggcgcccgcuuccuggaguucgaggcccugggguuccucaacgaggaccacugguucucccgggagaacagccuguccggcgucgagggggagggccugcacaagcucggcuacauccugcgcgaggugagcaagaaggagggcggcgcgauguacgccgacgacaccgccgggugggacacccggaucacgcugggcgcccucaagaacgagcgcaagugcaccgagcacauggagggcgagccccgcaagcccgggcggggccacuucaaguggcgcaaccagaaccgggucgugggggugcagggccccacccccgggggcaccgucauggacaucaucagccgcaagaaccagcggggcuccggccaggugggcacguacgggcugaacaccuucaccaacauggaggcccagcugauccgccagauggagggcgagggguucuucaucgagcaccagcaccucaccgcgagcgaggagaacgccgugcaggacuggcuggcccgggucggccgcgagaaggugucccggaugcccaucagcggcgacgacugcguggucaagccccuggacgaccgcuucgcccgggcgcucacggcccugaacgacauggggaaggugcgcaaggacauccagcagugggagcccucccggggcuggaacgacuggacccaggugccguucugcagccaccacuuccacgagcugaucaugaaggacgggcgcacccucgucgugcccugccggaaccaggacgagcugaucggccgcgcccggaucucccagggggccggcuggagcuucggcgagaccgccugccuggggaaguccuacgcgcagauguggagccucaucaacuuccgcauccccgaccugcggcuggccgccaacgugaucugcuccgucgugcccagccacugggugccgacgucccgcaccaccuggagcauccacgccaaccacgaguggaugaccaccgaggacaugcucacggucuggaaccgcguguggauccuggagaaccccuggauggaggacaagacccccguggaguccugggaggagaucccguaccuggagaagcgggaggaccaguggugcggcagccucaucgggcugacgccccagccgcccugggccaagaacaucgagaccgcgaucaaccagguccgcucccugaucggcaacgaggaguacaucgacuaccucccgagcaugaagcgguuccgcaucgaggaggaggagagcggguuccugugguga

SEQ ID NO: 9138 - RNA, 9876 nt, Artificial Sequence
  derived and/or modified CDS sequence (opt1) from DENV-2__JQ922553__SS-prME
accgccggcaugaucaucaugcugauccccaccgugauggccuuccaccucaccacccgcaacgucgagccgcccaugaucuucagccggcaggagaagggcaagagcuuccuguucaagaccaaggacgggcacgacaugugcaccuucauggcgauggaccugggggagcucugcgaggacaccaucaccuacaagugccccuuccugaagcagaacgagcccgaggacaucgacugcuggugcaacagcaccagcaccugggugaccuacgggaccugcaccaccaccggggagcaccgccgggagaagcgcagcguggcccuggucccccacgugggcaugggccucgagacccggaccgagaccuggaugagcagcgagggggccuggaagcacgugcagcgcaucgagaccuggauccugcggcaccccggcuucaccaucauggccgccauccuggcguacaccaucgggaccacgcacuuccagcgcguccucaucuucauccugcugaccggcguggcccccagcaugcggaugcgcugcaucgggaucagcaaccgggacuucguggagggcgucuccggcgggagcuggguggacaucgugcucgagcacggcuccugcgucaccaccauggccaagaacaagcccacgcuggaccuggagcucaucaagaccgaggccaagcagccggcgacccugcgcaaguacugcaucgaggccaagcugaccaacacgaccaccgacagccggugccccacccagggggagcccacgcucaacgaggagcaggacaagcgcuucgugugcaagcacuccaugguggaccggggcuggggcaacgggugcggccuguucgggaagggcgccaucgugaccugcgccauguucacgugcaagaaguccaugaaggggaagaucgugcagcccgagaaccuggaguacaccguggucaucacgccgcacuccggcgaggaguacgccgugggcaacgacaccgggaagcacggcaaggaggugaagaucacgccccagagcuccaucaccgaggcggagcucaccggguacggcacggucaccauggagugcagcccccgcaccgggcuggacuucaacgagauggugcugcuccagauggaggacaaggccuggcuggugcaccggcagugguuccuggaccucccccugccguggcugcccggcgccgacacccagggcuccaacuggauccagaaggagacgcucgucaccuucaagaacccccacgccaagaagcaggacguggucgugcuggggagccaggagggcgccaugcacaccgcgcugaccggggccacggagauccagaugagcuccggcaaccuccuguucaccgggcaccugaagugccgccuccggauggacaagcugcagcugaagggcaugagcuacuccaugugcaccggcaaguucaagguggucaaggagaucgccgagacccagcacgggacgaucgugauccgcgugcaguacgagggcgacgggagccccugcaagaucccguucgagaucauggaccucgagaagcggcacguccugggccgccugaucaccgugaaccccaucgugaccgagaaggacucccccgucaacaucgaggccgagcccccguucggcgacagcuacaucaucaucgggguggagcccggccagcucaagcuggacugguucaagaagggguccagcaucggccagaugcuggagaccacgaugcgcggggccaagcggauggcgauccucggcgacaccgccugggacuucggcucccucggcgggguguucaccagcaucgggaaggcccugcaccaggucuucggggccaucuacggggccgcguucuccggcgugagcuggaccaugaagauccucaucggcgugaucaucacguggaucgggaugaacucccgcagcaccucccugagcgucucccuggugcuggugggcaucgucacccucuaccugggggugauggugcaggccgacagcggcugcgucguguccuggaagaacaaggagcugaagugcgggagcggcaucuucgugaccgacaacguccacacguggaccgagcaguacaaguuccagcccgagagccccuccaagcucgccagcgccauccagaaggcgcacgaggagggcaucugcgggauccgguccgugacccgccuggagaaccugauguggaagcagaucacccucgagcugaaccacauccugagcgagaacgaggugaagcucacgaucaugaccggcgacaucaaggggaucaugcaggucggcaagcggucccugcgcccgcagcccaccgagcugcgguacagcuggaagaccugggggaaggccaagaugcucuccacggagcugcacaaccagaccuuccugaucgacggccccgagaccgccgagugcccgaacgccaaccgcgccuggaacagccucgagguggaggacuacggcuuccggaaguacaagaccaagaucuggcccacgcugaaggaguggcgcaagguguucugcgacuccaagcugaugagcgcggccaucaaggacaaccgggccguccacgccgacaugggguacuggaucgaguccgcccucaacgacaccuggaagaucgagaaggcgagcuucaucgaggugaaguccugccacuggcccaagagccacacccuguggggcaacggggugcaggaguccgagauggucauccccaagaacuucgccggcccggugagccagcacaacaaccgccccggcuacuacacccagaccgccgggcccuggcaccugggcaagcucgagauggacuucgacuucugcgaggggacgaccguggucgugaccgaggacugcggcaaccgggggcccucccugcgcaccacgaccgccagcggcaagcugaucaccgaguggugcugccggagcugcacccucccgccccugcgcuaccggggcgaggccgggugcugguacuggauggacauccgcccccugaaggagaaggagaagaaccucguguccagccuggucacggcgggccacgggcagaucgacaacuucucccugcggauccucggcauggcccuguuccuggagaagaugcucaugacccgccuggggaccaagcacgccauccugcucguggccgugagcuucgucacccugaucacgcgcaacauguccuucaaggaccugggccgggugauggugauggucggcgcgaccaugaccgacgacaugcgcaugggggugaccuaccucgcccugcugcccgccuucaaggugcggccgacguucgccaccggccuccugcugcgcaagcucaccagcaaggagcugaugaugaccacgaucgggaucguccuguucucccagagcuccauccccgagaccauccucgagcugaccgacgcccuggcgcucggcaugauggugcugaagauggugcggaacauggagaaguaccagcuggccgucaccaucauggccauccucugcgugcccaacgccgucauccugcagaacgccuggcgcgugagcugcacgauccuggcgguggucuccgugagcccccucuuccugaccuccagccggcagaaggccgacuggaucccgcuggcccucaccaucaaggggcugaaccccaccgccaucuuccugacgacccucucccgcaccagcaagaagcgguccuggccccugaacgaggccaucauggcggugggcauggucagcauccuggccuccagccuccugaagaacgacauccccaugaccggcccgcugguggccgggggccuccugacggugugcuacguccugaccgggcgcagcgccgaccucgagcuggagcgggcggccgacgugaagugggacgaccaggccgagaucuccggcagcucccccauccugagcaucaccaucuccgaggacggcagcauguccaucaagaacgaggaggaggagcagacccucacgauccugauccgcaccgggcugcucgugaucagcggccuguuccccgucuccauccccaucaccgccgccgcgugguaccugugggaggugaagaagcagcgggccggggugcucugggacgucccguccccgccgcccgugggcaaggccgagcuggaggacggggccuaccgcauccagcagaagggcaucuucggcuacucccagaucggggccggcguguacaaggaggggaccuuccccaccauguggcacgucacgcggggcgcggugcugaugcacaaggggaagcgcaucgagcccagcugggccgacgugaagaaggaccucaucuccuacggcggcggguggaagcuggagggcgaguggaaggagggggaggagguccaggugcuggcccucgagcccggcaagaacccccgggccgugcagaccaagcccgggcuguucaagaccaacaccggcacgaucggcgccgucagccuggacuucucccccgggaccagcggcucccccaucguggacaagaaggggaagguggucggccucuacgggaacggcguggugacccgcagcggcgcguacgucuccgccaucgcccagaccgagaaguccaucgaggacuacccggagguggagauggacaucuuccggaagaagcgccugacgaucauggacuuccaccccggggccggccggcagaagcgcuacuuccccgccaucgugcgcgaggcgaucaagcgggggcugcgcacccucauccuggcccccacccgggucguggccgccgagauggaggaggcgcugcgcggccugccgauccgguaccagacccccgccauccgcgccgagcacacgggccgggagaucguggaccucaugugccacgccaccuucaccaugcgccugcugagccccauccggguccccaacuacaaccucaucaucauggacgaggcccacuucaccgacccggcguccaucgccgcccgcggguacaucagcacgcggguggagaugggcgaggccgccgggaucuucaugaccgcgacgccgcccggcucccgcgaccccuucccgcagagcaacgcccccaucauggacgaggagcgggagauccccgagcgcuccuggaacagcgggcacgagugggugaccgacuucaagggcaagaucgucugguucgugcccucccugaagacgggcaaguacaucgccgccugccugcggaagaacgggaagcgcgugauccagcucagccggaagaccuucgacuccgaguacgucaagacccgcaccaacgacugggacuucguggugacgaccgacaucagcgagaugggcgccaacuucaaggcggagcgggucaucgacccgcgccgcugcaugaagcccgugauccugaccgacggggaggagcgggugauccuggccggccccaugcccgucacccacuccagcgccgcccagcgccgggggcgcaucggccggaacccgaagaacgagaacgaccaguacaucuacaugggcgagccccucgagaacgacgaggacugcgcgcacuggaaggaggccaagaugcugcuggacaacaucaacacgcccgaggggaucaucccguccauguucgagcccgagcgcgagaagguggacgccaucgacggcgaguaccggcuccgcggggaggcccggaagacccugcuggagcucauccgcggcgggcccauccccguguaccugggcuacaaguggccgggcgaggggaucaacuacgccgacagccggcugugcuucgacggcaucaagaacaaccagauccucgaggagaacgucgagguggagaucuggaccaaggagggggagcgcaaggagcugaagccccgguggcuggacgcgcgcaucuacuccgacccccucgcccugaaggaguucaaggaguucgccgccggccgcaagagccugacccucaaccugaucacggagauggggcgccugcccaccuucaugacccagaaggcccggggcgcgcucgccucccugaugguccugcacaccgccgaggccggcgggcgcgccuacaaccacgcgcucagcgagcugccggagacgcuggagacccuccugcugcucacccugcuggccaccgugacgggcgggaucuuccucuuccugauguccggccggggcaucgggaagaugacccugggcaugugcugcaucaucaccgccagcauccuccugugguacgcccagauccagccccacuggaucgcggccagcaucauccuggaguucuuccucaccgugcugcugauccccgagcccgagaagcagcgcaccccgcaggacaaccagcucacguacgucaucaucgccauccugaccgugguggccgccaccauggcgaacgagaugggguuccuggagaagaccaagaaggaccucggccuggggaacaucgccacgcagcaguccugcaagaagauccuggacaucuaccucggccccgcccugcccuggaagcuguacgccggcgggaccaccuucaucacccccaugcuccggcacagcaucgagaacuccagcgucaacgugucccugacggccaucgcgaaccaggccaccgugcugaugggccucgggaagggcuggccgcugagcaagauggacaucggggucccccugcucgccaucggcugcuacucccaggugaaccccaucacccugaccgccgcccuguuccuccugguggcgcacuacgccaucaucggccccgggcugcaggccaagccgacgcgcgaggcccagaagcgcgccgcggccggcaucaugaagaaccccaccgucgacgggaucaccgugaucgaccucgaccccauccccuacgacccgaaguucgagaagcagcugggccaggugaugcugcucguccugugcgugacccaggugcugaugaugcggacgaccugggcccucugcgaggcccugacccuggcgaccgggcccgucagcacgcucugggagggcaaccccggccgcuucuggaacaccaccaucgccguguccauggccaacaucuuccgggggagcuaccuggccggcgccgggcugcuguucuccaucaugaagaacaccacgagcacccgccggggcaccggcaacaucggggagacccugggcgagaaguggaagucccgccugaacgcgcucggcaagagcgaguuccagaucuacaagaaguccggcauccaggagguggaccggacgcuggccaaggaggggaucaagcgcggcgagaccgaccaccacgccgucagccggggcuccgccaagcugcgcugguucgacgagcggaaccucgugacccccgaggggaagguggucgaccugggcugcgggcgcggcggguggagcuucuucugcggcggccugaagaacgugcgggaggugaaggcccucaccaucgggggcccggggcacgaggagcccauccugauguccacguacggccgcaaccugguccggagccagagcggggugguggucuuccacacgccgcccgagaagugcgacaccucccuccgcgacaucggcgagagcucccccaaccccaccguggaggcgggccggacgcugcgcgugcugaaccucgucgagaacuggcugaacaacaacacccaguucugcaucaaggugcugaaccccuacaugcccagcgugaucgagaagauggaggcccuccagcggaaguacgggggcgcccugguccgcaacccccugucccgcaacagcacccacgagauguacuggguguccaacgccagcgggaacaucguguccagcgucaacaugaucucccggaugcugaucaaccgcuucaccaugcggcacaagaaggccaccuacgagcccgacguggaccucggcagcgggacgcgcaacaucggcaucgaguccgagacccccaaccuggacaucaucggcaagcggaucgagaagaucaagcaggagcacgagaccagcuggcacuacgaccaggaccacccguacaagaccugggggucccacggcagcuacgagacgaagcagaccggguccgcgagcuccauggugaacggcgucgugcgccugcucaccaagcccugggacgugguccccauggugacccagauggccaugacggacaccacccccuucggccagcagcggguguucaaggagaaggucgacacccgcacgcaggagccgaaggaggggaccaagaagcugaugaagaucaccgccgaguggcuguggaaggagcucggcaagaagaagacgccccggaugugcacgcgcgaggaguucaucaagaaggugcggagcaacgccgcgcugggggccaucuucaccgacgagaacaaguggaaguccgcccgcgaggccguggaggacggccgguucugggagcuggucgacaaggagcgcaaccuccaccuggaggggaagugcgagaccugcguguacaacaugaugggcaagcgggagaagaagcugggcgaguucgggaaggccaagggcucccgcgcgaucugguacauguggcucggggcccgguuccuggaguucgaggcccugggcuuccucaacgaggaccacugguucagccgcgagaacucccugagcggggucgagggcgagggccugcacaagcucggguacauccugcgggagguguccaagaaggagggcggggccauguacgccgacgacaccgcgggcugggacacgcgcaucacccuggaggaccucaagaacgaggagcggaagaccaaccacaugggcggcgagcaccgcaagcuggcccgcggcaucuucaagaugaaccugaccaacaaggugguccgggugcagcgccccacgcccgggggcacccucauggacaucaucagccggaagacccagcgcggguccgagcaggucggcaccuacggccugacgacccugaccaaccucgaggccccgcccauccggcagauggaggggaagggcgucuucaaggggcaccagcaccgcaccgccagcgaggagaacgccgugcaggacuggcuggcgcgggugggcggggagcgccugucccggcucgccaucagcggcgacgacugcgucgugaagccccuggacgaccgcuucgcccgggcccugacggcgcucaacgacaugggcaaggugcgcaaggacauccagcagugggagcccucccggggguggaacgacuggacccaggucccguucugcagccaccacuuccacgagcugaucaugaaggacggccgcacccugguggugcccugccggaaccaggacgagcucaucgggcgcgcccggaucucccagggcgccggguggagccugcgcgagaccgccugccugggcaaguucuacgcccagcgguggucccucauguacuuccaccgccgcgaccugcggcuggcgcccaacgccaucugcagcgccguccgcacgcacugggugcccaccucccggaagaccuggccgauccacgccagccacgacuggaugaccaccgaggugaugcucacggucuggaacaagcugugguuccaggagaaccccuggauggaggacaagacccccgugggcuucugggaggagaucccguuccuggagaaggggaaggaccaguggggcgggagccucaucggccugaccucccggccgcccugggccaagaacuuccagcccgcgaucaaccaggugcggagccugcucugcaacgaggaguccgccgacuucaugccgagcaugaagcgcuuccggcgcgaggaggaggaggccgggguccugugguga

SEQ ID NO: 9139 - RNA, 9876 nt, Artificial Sequence
  derived and/or modified CDS sequence (opt1) from DENV-2__JQ922549__SS-prME
accgccggcgugaucaucaugcugauccccaccgccauggcguuccaccugaccacccgcaacggggagccccacaugaucgugagccggcaggagaagggcaagagccugcuguucaagaccgaggacggggugaacaugugcacccucauggccauggaccugggcgagcugugcgaggacaccaucaccuacaacugcccccuccugcgccagaacgagcccgaggacaucgacugcuggugcaacagcaccagcaccugggugacguacgggaccugcaccgcccccggcgaccaccggcgcgagaagcggagcgucgcccuggugccccacgugggcauggggcucgagacccgcacggagaccuggaugagcagcgagggcgccuggaagcacgcgcagcggaucgagaccuggauccugcgccaccccggguucaccaucauggccgccauccuggccuacacgaucggcaccaccuacuuccagcggguccucauccugauccugcucaccgcgguggcccccuccaugacgaugcgcugcaucgggaucagcaaccgggacuucguggagggcgucuccggcgggagcuggguggacaucgugcuggagcacggcuccugcgucaccaccauggccaagaacaagcccacccuggacuucgagcucaucaagacggaggccaagcagcccgccacccugaccaaguacugcaucgaggcgaagcugaccaacacgaccaccgccagccgcugccccacccagggggagcccucccucaacgaggagcagcacaagcgguucgugugcaagcacagcaugguggaccgcggcuggggcaacgggugcggccuguucgggaagggcgggaucgucacgugcgccauguucacgugcaagaagaacaugaagggcaagaucgugcagcccgagaaccuggaguacaccaucguggucaccccgcacuccggcgaggagaacgccguggggaacgacacgggcaagcacgggaaggagaucaaggugcggccccagagcuccaucaccgaggccgagcucaccggcuacgggaccgucaccauggagugcagcccccgcacgggcuucgcguucaacgagauggugcugcugcagauggagaacaaggccuggcucgugcaccggcagugguuccuggaccugccccuccccuggcugcccggcgccgacacccagggguccaacuggauccagaaggagacccuggucaccuucaagaacccccacgccaagaagcaggacguggucgugcucggcagccaggagggggccaugcacacggcgcugaccggcgccaccgagauccagaugagcuccgggaaccugcuguucaccggccaccugaagugccgccugcggauggacaagcuccagcugaagggcaugagcuacuccaugugcacggggaaguucaagguggucaaggagaucgccgagacccagcacggcaccaucgugauccgcgugcaguacgagggggacggcagccccugcaagaucccguucgagaucauggaccuggagaagcggcucguccugggccgccugaucaccgugaaccccaucgugacggagaaggacucccccgucaacaucgaggccgagcccccguucggggacagcuacaucaucaucggcguggagcccgggcagcucaagcccuccugguucaagaagggcagcuccauccgccagauguucgagaccaccaugcgcggggcgaagcgcauggcgauccugggcgacaccgccugggacuucggcagccucgggggcguguucacguccaucgggaaggcccuccaccaggucuucggcgccaucuacggggcggccuucagcggcguguccuggaccaugaagauccugaucggcguggucaucaccuggaucgggaccaacagccgguccacgagccuguccgugagccuggugcucgucggcguggugacccuguaccugggggucauggugcaggccgacuccggcugcguggucagcuggaagaacaaggagcucaagugcgggagcggcaucuucaucaccgacaacgugcacaccuggacggagcaguacaaguuccagcccgaguccccgagcaagcuggccuccgccauccagaaggcgcacgaggagggcaucugcgggauccgcagcgugacccggcuggagaaccucauguggaagcagaucacccccgagcugaaccacauccuguccgagaacgaggucaagcucaccaucaugacgggcgacaucaaggggaucaugcaggccggcaagcgcagccugcggccccagccgaccgagcugaaguacuccuggaagaccugggggaaggccaagaugcucagcaccgagccccacaaccagacguuccugaucggcggccccgagaccgccgagugccccaacaccaaccgcgccuggaacucccuggagguggaggacuacggguucggcguguucaccacgaacaucuggcucaagcugaaggagcggcaggacgucuucugcgacagcaagcugauguccgcggccaucaaggacaaccgcgccgugcacgccgacaugggguacuggaucgagagcgcccucaacgacaccuggaagaucgagaaggcguccuucaucgaggucaagagcugccacuggccgaagucccacacccuguggagcaacggcgugcuggaguccgagaugaucauccccaagaacuucgccggccccgugagccagcacaacuaccggcccggguaccacacccagaccgccggcccguggcaccucgggaagcuggagauggacuuccacuucugcgagggcacgaccguggucgugaccgaggacugcgggaaccgcggccccagccugcggaccacgaccgccuccggcaagcucaucaccgaguggugcugccgcagcugcacccugccgccccugcgguaccgcggggaggacggcugcugguacgggauggagauccggccgcucgagggcgaggagggggaccuggugcacucccuggucacggcgggccacggccagaucgacaacuucagccucggggugcugggcauggcccuguuccucgaggagaugcugcgcacccggguggggaccaagcacgccguccugcucguggccguguccuucaugacccugaucacgggcaacaugagcuuccgcgaccuggggcgcgucauggugauggugggcgccgcgaugaccgacgacaucggcaugggggucaccuaccucgcccugcuggccgccuucaaggugcggcccaccuucgccgcgggccuccugcugcgcaagcucacguccaaggagcugaugaugaccaccaucgggaucgugcugcucagccaguccaccauccccgagacgauccuggagcugaccgacgcccucgcccugggccggaugauccugaagaucguccgcaacauggagaaguaccagcucgccgugaccaucauggccauccugugcguccccaacgcggugauccugcagaacgccuggaaggugagcugcaccauccucgccgucguguccgugagcccgcugcugcucacguccagccagcagaaggccgacuggaucccccuggcgcugaccaucaagggccucaaccccaccgccaucuuccugaccacgcugucccggaccaacaagaagcgcagcuggccccucaacgaggccaucauggccgucgggaugguguccauccuggccagcucccugcucgagaacgacaucccgaugaccggcccccugguggccgggggccugcucaccgucugcuacgugcugacggggcggagcgccgaccuggagcucgagcgcgccgccgacgugcggugggaggaccaggccgagaucagcggcuccagccccauccuguccaucaccaucagcgaggacggcuccaugagcaucaaguacgaggaggaggagcccacccugaccauccucauccgcacggggcugcuggucaucuccggccucuucccggugagcauccccaucaccgcggccgccugguaccugugggaggugaagaagcagcgggccgggguccugugggacgugcccuccccgccgcccgugggcaaggccgagcucgaggacggggcguaccgcaucaagcagaagggcauccugggcagcucccagaucggggcccgggucuacaaggagggcaccuuccacaccauguggcacgugacccgcggggccgugcugaugcacaagggcaagcggaucgagcccagcugggccgacguccgcaaggaccucaucuccuacgggggcggcuggaagcuggagggggaguggaaggagggcgaggagguccaggugcuggcccucgagccggggaagaacccccgggcgguccagacgaagcccggccuguucaagaccaacaccgggaccaucggcacggugagccuggacuucucccccggcaccagcgaguccccgaucguggacaagaaggggaaggucgugggccucuacgggaacggcguggucacccgcagcggcaccuacguguccgccaucgcccagacggagaaguccaucgaggacaaccccgagaucgaggacgacaucuuccggaagaagcgccugaccaucauggaccugcaccccggggccggcaagaccaagcgguaccugcccgcgaucgugcgcgaggccaucaagcgcgggcuccggacccugauccuggccccgacgcgcgucguggccgccgagauggaggaggcgcuccggggccugcccauccgcuaccagacccccgccauccgggccgagcacaccgggcgcgagaucguggaccugaugugccacgccaccuucacgaugcggcuccugagccccguccgcgugccgaacuacaaccugaucaucauggacgaggcccacuucaccgaccccgcguccaucgccgcccggggcuacaucagcacccgcguggagaugggcgaggccgccgggaucuucaugaccgcgacgccgcccggcucccgggacccguucccccagagcaacgcccccaucauggacgaggagcgcgagauccccgagcgguccuggaacagcgggcacgagugggucaccgacuucaagggcaagaccgugugguucgugccguccaucaaggccgggaacgacaucgccgcgugccuccgcaagaacggcaagaaggucauccagcugagccggaagaccuucgacuccgaguacaucaagacgcgcaccaacgacugggacuucguggugaccaccgacaucagcgagaugggcgccaacuucaaggccgagcgggucaucgacccccgccggugcaugaagcccgugauccugacggacggggaggagcgcgugauccucgccggccccaugccggucacccacuccagcgccgcgcagcgccgggggcgcaucggccggaaccccaagaacgagaacgaccaguacaucuacaugggggagccccuggagaacgacgaggacugcgcccacuggaaggaggccaagaugcugcucgacaacaucaacaccccggagggcaucauccccuccauguucgagcccgagcgcgagaagguggacgccaucgacggcgaguaccggcugcgcggggaggcccggaagaccuucguggaccugaugcgccggggcgaccuccccgucuggcuggcguaccgcguggccgccgaggggaucaacuacgccgaccggcgcuggugcuucgacggcaucaagaacaaccagauccuggaggagaacgucgagguggagaucuggacgaaggagggggagcggaagaagcucaagccgcgcuggcuggacgcccggaucuacagcgacccccuggcgcucaaggaguucaaggaguucgccgccggccgcaagucccugacccugaaccucaucaccgagaugggccggcugcccaccuucaugacgcagaaggcccgcaacgcgcuggacaaccucgccgugcugcacaccgccgaggccgggggccgggccuacaaccacgcgcugagcgagcuccccgagacccuggagacccugcuccugcugacgcuccuggccaccgucaccgggggcaucuuccuguuccucauguccggcaaggggaucggcaagaugacccuggggaugugcugcaucaucaccgccagcauccugcucugguacgcccagauccagccgcacuggaucgccgcguccaucauccuggaguucuuccugaucgugcuccugauccccgagcccgagaagcagcgcacgccccaggacaaccagcugaccuacguggucaucgccauccucaccgugguggccgccaccauggccaacgagaugggcuuccuggagaagacgaagaaggacuucgggcugggcagcaucgcgacccagcagccggagagcaacauccucgacaucgaccugcggcccgccuccgccuggacccuguacgccgucgccaccacguucaucacccccaugcuccgccacagcaucgagaacucccccgugaacgugagccugaccgcgaucgccaaccaggccaccguccugaugggccucgggaagggcuggccgcuguccaagauggacaucggggugccgccccuggccaucggcugcuacagccaggugaaccccaucacgcucaccgcggcccugcugcuccuggucgcccacuacgccaucaucgggccgggccuccaggugaaggccacccgcgaggcgcagaagcgggccgccgccggcaucaugaagaaccccaccguggacgggaucacggucaucgaccucgaccccauccccuacgacccgaaguucgagaagcagcugggccagaucaugcugcgcgugcucugcgugacccagguccugaugaugcggaccaccugggcccugugcgaggcgcucacgcuggccaccgggcccaucuccacccugugggagggcaaccccgggcgccucggcaacaccacgaucgccgugagcauggccaacaucuuccggggcuccuaccuggccggggcgggccuccuguucagcaucaugaagaacaccaccaacacccgccgggggacguccaaccugggcgagacccugggcgagaaguggaagaaccgccucaacagccuggggaaguccgaguuccagaucuacaagaaguccggcauccaggagguggaccggacccuggccaaggaggggaucaagaagggcgagaccgaccaccacgccgucucccgcgggagcgccaagcuccggugguucguggagcgcaaccuggugacgcccgagggcaaggucguggaccugggcugcgggcggggcgggugguccuacuacugcggcgggcucaagaacgugcgcgaggucaagggccugaccaagggcgggccgggccacgaggagcccauccccaugagcaccuacggguggaaccuggugcggcuccaguccggcgaggacguguucuucaccccgcccgagaagugcgacacgcugcugugcgacaucggggagagcagccccaaccccaccgucgaggcgggccgcacccuccgggugcugaacaugguggagaacuggcugaacaacaacacccaguucugcaucaagguccucaacccguacaugcccuccgugaucgagaagauggaggcccugcagcgcaaguacggcggggcccuggugcggaacccccugagccgcaacuccacccacgagauguacugggucagcaacgccuccggcaacaucgugagcuccgugaacaugaucagccgcaugcucaucaaccgguucacgaugcgccacaagaaggccaccuacgagcccgacgucgaccugggguccggcacccggaacaucgggaucgagagcgagaccccgaaccuggacaucaucggcaagcgcaucgagaagaucaagcaggagcacgagacguccuggcacuacgaccaggaccaccccuacaagaccugggcguaccacggcagcuacgagaccaagcagaccggguccgccagcucccucgugaacggcgugguccggcugcugacgaagcccugggacgugauccccauggugacccagauggccaugaccgacaccacgccguucgggcagcagcgcgucuucaaggagaagguggacacccggacccaggagcccaaggagggcaccaagaagcucaugaagaucacggccgaguggcuguggaaggagcugggcaagaagaagacgccccggaugugcacccgggaggaguucagccgcaaggugcgguccaacgccgcgcucggggccaucuucaccgacgagaacaaguggaaguccgcccgcgaggccgucgaggacggccgguucugggagcugguggacaaggagcgcauccugcaccucgaggggaagugcgagacgugcgucuacaacaugaugggcaagcgggagaagaagaucggggaguucggcaaggccaagggcucccgcgcgaucugguacauguggcugggggcccgguuccuggaguucgaggcccucggcuuccugaacgaggaccacugguucagccgcgagaacagccuguccgggguggagggcgaggggcuccacaagcugggcuacauccugcgggaggugagcaagaaggagggcggggccauguacgcggacgacaccgccggcugggacacccgcaucacccucgaggaccugaagaacgaggagauggucacgaaccacauggagggggagcacaagaagcuggccgaggccaucuucaagcucaccuaccagaacaagguggugcggguccagcgccccaccccgcgcggcaccgugauggacaucaucucccggcgcgaccagcgggggagcggccaggugggcacguacgggcugaacaccuucaccaacaugggcgcccagcugauccgccagauggagggggagggcgucuucaagggcauccagcaccucaccgcgacggaggagaucgccgugcaggacuggcuggcccggguggggcgcgagcggcugucccgcauggccaucagcggcgacgacugcgucgugaagccccucgacgaccgguucgccuccgcgcugaccgcccugaacgacauggggaaggugcgcaaggacauccagcagugggagcccagccggggcuggaacgacuggacccagguccccuucugcucccaccacuuccacgagcucaucaugaaggacgggcgcgugcugguggucccgugccggaaccaggacgagcugaucggccgcgcccggaucagccagggcgccggguggucccuccgcgagaccgccugccugggcaagagcuacgcgcagauguggucccugauguacuuccaccggcgcgaccuccggcuggccgccaacgccaucugcagcgccgugcccucccacugggugcccacgagccgcaccacccgcuccauccacgcgcggcaggaguggaugaccaccgaggucaugcugacgguguggaaccgcguguggauccaggagaaccccuggauggaggacaagaccccggucgagagcugggaggagauccccuaccucgggaagcgggaggaccaguggugcggcagccugaucgggcugaccucccgcgccaccugggccaagaacauccagacggccaucaaccaggugcggagccucaucggcuccgaggaguacaccgacuacaugcccagcaugaagcgcuuccggcgcgaggaggaggaggcgggcgugcugugguga

SEQ ID NO: 9140 - RNA, 9876 nt, Artificial Sequence
  derived and/or modified CDS sequence (opt1) from DENV-2__JQ922552__SS-prME
accgcgggcaugaucaucaugcugauccccaccgugauggccuuccaccucaccacccggaacggggagccgcccaugaucgugagccggcaggagaagggcaagagccugcuguucaagaccgaggacggggugaacaugugcgcgcucauggccauggaccugggcgagcgcugcgaggacaccaucaccuacaacugcccccugcucaaccagaacgagcccgaggacaucgacugcuggugcaacagcaccuccaccugggugaccuacgggaccugcaccaccaccggcgagcugcggcgcgagaagaucagcgucgcccuggugccccacgugggcauggggcucgagacccggaccgagaccuggauguccagcgagggcgccuggaagcacgcccagcgcaucgagaucuggauccugcggcaccccggguucaccaucauggcggccauccuggccuacacgaucggcaccucccacuuccagcgcguccucaucuucauccugcugaccgccaucgcgcccagcaugaccaugcggugcaucgggaucuccaaccgcgacuucguggagggcgugagcggcggguccugggucgacaucgugcucgagcacggcagcugcgugacgaccauggccaagaacaagcccacccuggacuucgagcugaucaagaccgaggccaagcagccggccacgcuccggaaguacugcaucgaggccaagcugaccaacaccaccacggacucccgcugccccacccagggggagcccacccugaacgaggagcaggacaagcgguucgucugcaagcacagcaugguggaccgcggcuggggcaacgggugcggccucuucgggaagggcgggaucgugaccugcgcgauguucacgugcaagaagaucaugaagggcaagaucguccagcccgagaaccuggaguacaccguggugaucaccccgcacuccggcgaggagcacgccgucgggaacgacaccggcaagcacgggaaggaggugaagaucacgccccagagcuccaucaccgaggccgagcugaccggcuacgggaccgugaccauggagugcagcccccggacgggccucgacuucaacgagaugguccugcugcagauggaggacaaggccuggcucgugcaccgccagugguuccuggaccugccccucccguggcugcccggcgccgacacccagggguccaacuggauccagaaggagacccuggugaccuucaagaacccccacgcgaagaagcaggacgucgugguccucggcagccaggagggggccaugcacacggcccugaccggcgccaccgagauccagaugagcuccgggaaccuccucuucaccggccaccugaagugccggcugcgcauggacaagcuccagcugaagggcaugagcuacuccaugugcacggggaaguucaagguggugaaggagaucgccgagacccagcacggcaccaucgucauccgggugcaguacgagggggacggcagccccugcaagaucccguucgagaucauggaccuggagaagcgccacgugcucggccggcugaucaccgucaaccccaucgugacggagaaggacucccccgugaacaucgaggcggagcccccguucggggacagcuacaucaucaucggcgucgagcccgggcagcugaagcucaacugguucaagaagggcuccagcaucgggcagaugcuggagaccaccaugcgcggcgccaagcgcauggccauccugggcgacaccgccugggacuucgggucccucggcgggguguucacgagcaucggcaaggcccugcaccagguguucggggcgaucuacggcgccgccuucuccggcgucagcuggaccaugaagauccugaccggggugaucaucaccuggaucggcaugaacucccggagcacgucccugagcgugucccucguccugguggggaucgugacccuguaccucggcgucauggugcaggccgacagcgggugcguggucuccuggaagaacaaggagcugaagugcggcagcggcaucuucgugaccgacaacgugcacaccuggacggagcaguacauguuccagcccgagagccccuccaagcuggcgagcgccauccagaaggcccacgaggaggggaucugcggcauccgcuccgucacccggcucgagaaccugauguggaagcagaucaccccggagcugaaccacauccucagcgagaacgaggugaagcugaccaucaugacgggggacaucaagggcaucaugcaggucgggaagcgcucccugcggccccagcccaccgagcuccgcuacagcuggaagaccuggggccagccgaagaugcugucccccgagcugcaccaccagaccuuccucaucgacggccccgagacggccgagugccccaacaccaaccggaccugggacagccuggaggucgaggacuacggguucggcguguucaccacgaagaucuggcugcgccuccgggagaagcaggacguguucugcgacuccaagcugaugagcgccgcgaucaaggacaaccgcgccguccacgccgacaugggguacuggaucgaguccgcccugaacgacaccuggaagaucgagaaggccagcuucaucgaggugaaguccugccacuggcccaagagccacacccucugguccaugggcgugcuggagagcgagauggucauccccaagaacuucgcgggccccgugucccagcacaaccaccggcccgggaucccgacccagaccgccggccccuggcaccuggggaagcucgagauggacuucgacuucugcgagggcacgaccguggucgugaccgaggacugcgggaaccgcggccccagccugcggaccagcacggccuccggcaagcugaucaccgaguggugcugccgcagcugcacccugccgccccugcgguaccgcggggaggacggcugcugguacgggauggagauccggccccugaaggagaaggaggagaaccucguguccagccuggucaccgccggccacgggcagaucgacaacuucucccugggcauccucggcauggcccuguuccuggaggagaugcuccgcacgcggguggggaccaagcacgcgauccugcugguggccgucagcuucgugacccucaucaccggcaacauguccgggcgcgaccugggccgcgugauggucauggugggggccacgaugaccgacgacaucggcaugggcgugaccuaccuggcccuccuggcggccuucaagguccggcccaccuucgccgccgggcugcuccugcgcaagcugacgagcaaggagcucaugaugaccaccaucggcaucgugcugcugucccagagcuccauccccgagaccauccucgagcugacggacgcccuggcgcucgggaugauggugcugaagaugguccggaacauggagaaguaccagcuggccgugaccaucauggccauccucugcguccccaacgccgugauccugcagaacgccuggaaggugagcugcaccauccuggcgcucgucuccgugagcccccuguuccugaccuccagccagcagaaggccgacuggaucccccucgcccugacgaucaagggccugaaccccaccgccaucuuccucaccacccugucccgcacgagcaagaagcgguccuggccgcugaacgaggccaucauggcggugggcauggucagcauccucgccagcucccugcugaagaacgacauccccaugaccgggccccucguggccggcgggcugcugaccgugugcuacguccucaccggccgcagcgccgaccuggagcuggagcgggcggccgacgugaagugggacgaccaggccgagaucuccgggagcucccccauccucagcaucacgaucuccgaggacggcagcauguccaucaagaacgaggaggaggagcagacccugaccauccugauccgcaccgagcuccuggugaucagcggccuguucccgaucuccauccccaucacggccgccgcgugguaccucugggaggucaagaagcagcgggccggggugcugugggacgugcccagcccgccgcccgucggcaaggccgagcuggaggacggggccuaccgcaucaagcagaagggcauccucggguacucccagaucggcgccggcguguacaaggaggggaccuuccacaccauguggcacgugacccggggcgcgguccugaugcacaaggggaagcgcaucgagcccagcugggccgacgugaagaaggaccugaucuccuacggcgggggcuggaagcucgagggcgaguggaaggagggggaggaggugcagguccuggcccuggagccgggcaagaacccccgggccgugcagaccaagcccggccucuucaagacgaacaccggcaccaucggggccgugagccuggacuucucccccggcaccagcggcuccccgaucgucgacaagaaggggaagguggugggccuguacgggaacggcgucgugacgcgcagcggcgcguacgugagcgccaucgcccagaccgagaaguccaucgaggacaaccccgagaucgaggacgacaucuuccggcgcaagaagcugaccaucauggaccuccaccccggggccggcaagaccaagcgguaccugcccgccaucguccgcgaggcgaucaagcgggggcugcgcacgcucauccuggccccgacccgggugguggccgccgagauggaggaggcgcugcgcggccuccccauccgcuaccagacccccgccauccgggccgagcacaccgggcgcgagaucgucgaccugaugugccacgccacguucaccaugcggcugcucagccccauccgcgugccgaacuacaaccugaucaucauggacgaggcccacuucaccgaccccgcguccaucgccgcccggggcuacaucagcacccgcguggagaugggcgaggccgccgggaucuucaugacggcgacgccgcccggcucccgggacccguucccccagagcaacgcccccaucauggacgaggagcgcgagauccccgagcgguccuggaacagcgggcacgagugggucaccgacuucaagggcaagaccgugugguucgugccguccaucaagacggggaacgacaucgccgccugccugcgcaagaacggcaagcgggucauccagcucagccgcaagaccuucgacuccgaguacgugaagacccggaccaacgacugggacuucguggucacgaccgacaucagcgagaugggcgccaacuucaaggcggagcgcgugaucgacccccggcgcugcaugaagcccgugauccugaccgacggggaggagcgggucauccuggccggccccaugccggugacccacuccagcgccgcccagcgccgggggcgcaucggccgcaaccccaagaacgagaacgaccaguacaucuacaugggggagccccucgagaacgacgaggacugcgcgcacuggaaggaggccaagaugcugcuggacaacaucaacacgccggagggcaucauccccuccauguucgagcccgagcgggagaagguggacgccaucgacggcgaguaccgccuccgcggggaggcccgcaagaccuucgucgaccugaugcggcgcggcgaccugcccguguggcucgccuaccgggggccggcggagggcaucaacuacgccgaccgccgguggugcuucgacgggaucaagaacagccaguuccuggaggagaacguggaggucgagaucuggcccuccggcggcgagcgcaaggagcugaagccccgguggcucgacgcccgcaucuacagcgacccccuggcccugaaggaguucaaggaguucgccgcggggcggaagucccucacccugaaccugaucaccgagaugggccgccucccgacguucaugacccagaaggcccggaacgcccuggacaaccuggccgugcuccacaccgccgaggccggcgggcgcgccuacaaccacgcccugagcgagcugcccgagacccucgagacgcugcugcuccugacccugcucgccaccgucaccggcgggaucuuccuguuccugaugagcgggcgggggaucggcaagaugacgcucgggaugugcugcaucaucaccgcguccauccugcugugguacgcccagauccagccccacuggaucgccgccagcaucauccucgaguucuuccugaucgugcugcucauccccgagccggagaagcagcgcacgccccaggacaaccagcugaccuacgugaucaucgccauccugaccgucguggcggccacgauggccaacgagaugggcuuccucgagaagaccaagaaggaccugggccuggggaacaucgugacccagcagcccgaguccaacauccucgacaucgaccugcggcccgccagcgccuggacccuguacgcggccgccacgaccuucaucaccccgaugcuccgccacuccaucgagaacagcuccgucaacaugagccugaccgccaucgccaaccaggcgacggugcugaugggccucgggaagggcuggccccuguccaagauggacaucggggugccccugcucgccaucggcugcuacagccaggucaaccccaucacccugaccgccgcccuguuccuccugguggcccacuacgcgaucaagggcccggggcugcaggccaaggccacccgggaggcccagaagcgcgcggccgccggcaucaugaagaaccccacgguggacgggaucaccgucaucgaccucgaccccauccccuacgacccgaaguucgagaagcagcugggccaggugaugcugcucgugcugugcgucacccaggugcugaugaugcgcaccacgugggcccucugcgaggcccugacccuggcgaccgggcccguguccacccucugggagggcaaccccggccgguucuggaacacgaccaucgccgucagcauggccaacaucuuccgcggguccuaccuggccggcagcucccagguguggcccagcaucaacaaccugaagggcgggcggcgcggcaccggggcccagggcgagacccucggggagaaguggaagcggcagcugaaccagcuguccaagagcgaguucaacacguacaagcgcuccggcaucauggagguggaccggagcgaggcgaaggaggggcucaagcgcggcgagaccaccaagcacgccgucagccggggcaccgccaagcugcgcugguucguggagcggaaccuggugaagccggaggggaaggucaucgaccucggcugcgggcgcggcgggugguccuacuacugcgccggccugaagaaggugacggaggugaagggcuacaccaagggcgggcccgggcacgaggagcccaucccgauggccaccuacggcuggaaccuggucaagcuccacagcgggaaggacguguucuucacgccgcccgagaagugcgacacgcugcugugcgacaucggcgaguccagccccaacccgaccguggaggcgggccggacccuccgcguccugaaccugguggagaacuggcucaacaacaacacccaguucugcaucaaggugcugaaccccuacaugcccuccgucaucgagaagauggagacgcugcagcggaaguacgggggcgcccuggugcgcaacccccucagccggaacuccacccacgagauguacugggugagcaacgccuccgggaacaucgucagcuccgugaacaugaucagccgcaugcugaucaaccgguucaccaugcgccacaagaaggccaccuacgagccggacguggaccugggcuccgggacccgcaacaucggcaucgagagcgagacgcccaaccucgacaucaucggcaagcggaucgagaagaucaagcaggagcacgagaccuccuggcacuacgaccaggaccaccccuacaagaccugggcguaccacgggagcuacgagaccaagcagacgggcuccgccagcuccauggucaacgggguggugcgccugcugaccaagcccugggacgucgugccgauggugacccagauggccaugaccgacacgacccccuucggccagcagcgggucuucaaggagaagguggacacccgcacccaggagcccaaggagggcacgaagaagcucaugaagaucaccgccgaguggcuguggaaggagcuggggaagaagaagacgccccggaugugcccgcgcgaggaguucaccaagaaggugcggagcaacgccgcgcucggcgccaucuucacggacgccaccaaguggaaguccgcccgcgaggccgucgaggacgggcgguucugggagcugguggacaaggagcgcaaccugcaccucgagggcaagugcgagaccugcguguacaacaugauggggaagcgggagaagaagcugggcgaguucggcaaggcgaaggggucccgcgccaucugguacauguggcugggcgcccgguuccucgaguucgaggcccugggguuccugaacgaggaccacugguucagccgcgagaacucccucagcggcgucgagggggagggccugcacaagcugggcuacauccuccgggaggugcgcaagaaggagggcggggccauguacgcggacgacuccgccgggugggacacccggaucacgcuggaggaccugaagaacgaggagcgcaucaccaaccacauggaggucgagcacaagaagcucgccgugggccacuucauccugaccuaccccaacaaggugguccgggugcagcgccccacccccguggggacggucauggacaucaucagccggaagucccagcgcggcagcggccagguggggaccuacggccugaacaccuucaccaaccucgaggggccgcgcauccggcagauggagggcgaggaguccuucaagagccaccagcugcagacggccaccgagcgcaacgcggugcaggacuggcuggcccgggucggccgcgagcggcucucccgcauggccaucagcggggacgacugcguggugaagccccuggacgaccgguucgcccgcgcccugaccgcgcucaacgacaugggcaagguccggaaggacauccagcagugggagcccucccgcggguggaacgacuggacccaggugcccuucugcagccaccacuuccacgagcugaucaugaaggacggccggacgcugguggucccgugccgcaaccaggacgagcucaucgggcgggcccgcaucucccagggcgccggcuggagccugcgggagaccgccugccuggggaaguccuacgcccagauguggagccucauguacuuccaccgccgggaccugcgccuggcggccaacgccaucugcagcgccgugcccucccacugggugcccaccagccggaccacgugguccauccacgccagccacgagugggucgcgaccgaggacaugcucaccguguggaaccgcguguggauccaggagaacccguggauggaggacaagacccccgucgaguccugggaggagauccccuaccugggcaagcgcgaggaccaguggugcgggagccugaucggccucaccucccgggccacgugggccaagaacauccagaccgccaucaaccaggugcgcagccugaucgggaacgaggaguacaccgacuacaugcccuccaugaagcgguuccgccgggaggaggaggaggccggcgugcugugguga

SEQ ID NO: 9141 - RNA, 9876 nt, Artificial Sequence
  derived and/or modified CDS sequence (opt1) from DENV-2__GU131896__SS-prME
uccgccgggaugaucaucaugcugauccccaccgugauggccuuccaccucaccacccggaacggggagccgcacaugaucgucggcauccaggagaaggggaagucccugcuguucaagaccgaggacggcgugaacaugugcacccucauggcgauggaccugggggagcugugcgaggacaccaucaccuacaagugcccccuccugcggcagaacgagcccgaggacaucgacugcuggugcaacagcaccuccaccugggugaccuacgggaccugcaccaccaccggcgagcaccgccgggagaagcgcagcgucgcccuggugccccacgugggcaugggccucgagacgcggaccgagaccuggauguccagcgagggggccuggaagcacgcccagcgcaucgagaccuggauccugcggcaccccggcuucacgaucauggccgcgauccuggccuacaccaucgggaccacccacuuccagcgcgcccucaucuucauccugcugacggccgucgcgcccuccaugaccaugcggugcaucggcaucagcaaccgcgacuucguggagggcguguccgggggcagcugggucgacaucgugcucgagcacggguccugcgugaccaccauggccaagaacaagcccacgcuggacuucgagcugaucaagaccgaggccaagcagcccgccacccuccggaaguacugcaucgaggccaagcugaccaacacgaccaccgagagccgcugcccgacccagggcgagcccucccugaaggaggagcaggacaagcgguucgucugcaagcacagcaugguggaccgcggcugggggaacggcugcggccuguucggcaagggcgggaucgugacgugcgcgauguucacgugcaagaagaacauggagggcaagaucguccagcccgagaaccuggaguacaccaucguggugacgccccacuccggggaggagcacgccgucggcaacgacacggggaagcacggcaaggagaucaaggugaccccgcagagcuccaucaccgaggccgagcugaccggguacggcaccgugacgauggagugcagcccccggaccggccucgacuucaacgagaugguccugcugcagauggagaacaaggccuggcucgugcaccgccagugguuccuggaccugccccuccccuggcugccgggggccgacaagcagggcuccaacuggauccagaaggagacccuggugaccuucaagaacccccacgcgaagaagcaggacgucgugguccucgggagccaggagggcgccaugcacacggcccugaccggggccaccgagauccagaugagcuccggcaaccuccucuucaccggccaccugaagugccggcugcgcauggacaagcuccagcugaaggggaugagcuacuccaugugcacgggcaaguucaagguggugaaggagaucgccgagacccagcacgggaccaucgucauccggcugcaguacgagggcgacggcagccccugcaagauccccuucgagaucauggaccucgagaagcgcuacgugcuggggcggcugaucaccgugaacccgaucgucacggagaaggacucccccgugaacaucgaggcggagccgcccuucggcgacagcuacaucaucaucgggguggagccgggccagcucaagcugaacugguucaagaagggguccagcaucggccagauguucgagaccaccaugcgcggcgccaagcgcauggccauccugggggacaccgccugggacuucggcucccucgggggcgucuucacgagcguggggaaggcccugcaccagaucuucggcgcgaucuacggcgccgccuucuccggggugagcuggaccaugaagauccugaucggcgucaucaucaccuggaucgggaugaacucccggagcaccucccugagcgugucccucgugcuggucggcaucgugacgcuguaccucggggugaugguccaggccgacagcggcugcgugguguccuggaagaacaaggagcugaagugcggcagcgggaucuucaucaccgacaacguccacaccuggaccgagcaguacaaguuccagcccgagagccccuccaagcuggcgagcgccauccagaaggcccaggaggagggcaucugcgggauccgcuccgugacgcggcucgagaaccugauguggaagcagaucacccccgagcugaaccacauccucgccgagaacgaggugaagcugaccaucaugaccggcgacaucaaggggaucaugcaggccggcaagcgcagccugcggccgcagcccacggagcucaaguacuccuggaagaccuggggcaaggcgaagaugcugagcaccgagucccacaaccagaccuuccugaucgacgggcccgagacggccgagugcccgaacaccaaccgcgccuggaacagccucgaggucgaggacuacggcuucgggguguucaccaccaacaucuggcugaagcugaaggagaagcaggacgccuucugcgacuccaagcucaugagcgccgcgaucaaggacaaccgggccgugcacgccgacaugggcuacuggaucgaguccgcccugaacgacacguggaagaucgagaaggccagcuucaucgaggucaagaacugccacuggcccaagucccacacccuguggagcaacggcgugcucgaguccgagaugaucauccccaagaaccuggcggggcccgugagccagcacaacuaccgcccgggcuaccacacccagaccgccgggcccuggcaccugggcaagcucgagauggacuucgacuucugcgacgggaccacggucaucgugaccgaggacugcggcaaccggggccccucccugcgcaccaccacggccagcgggaagcugaucaccgaguggugcugccggagcugcacccucccgccccugcgcuaccggggcgaggacgggugcugguacggcauggagauccgcccccugaaggagaaggaggagaaccucgugaacucccuggucaccgccgggcacggccagguggacaacuucagccugggcgugcucgggauggcgcuguuccuggaggagaugcuccggacgcgcgucggcaccaagcacgccauccugcugguggccguguccuucgucacccucaucaccgggaacaugagcuucaaggaccugggccgggugguggucauggugggggccacgaugaccgacgacaucggcaugggcgugaccuaccuggcccuccuggcggccuucaagguccgccccaccuucgccgccgggcugcuccugcggaagcugacguccaaggagcucaugaugaccaccaucggcaucgugcugcugagccaguccaccauccccgagacgauccucgagcugaccgacgcccuggcgcucgggaugauggugcugaagaucguccgcgacauggagaaguaccagcuggccgugaccaucauggccauccucugcgugcccaacgccgucauccugcagaacgccuggaaggugagcugcaccauccuggcggucguguccgugagcccccuccugcugacguccagccagcagaagaccgacuggaucccccucgcccugaccaucaagggccugaaccccaccgccaucuuccucacgacccugucccgcaccaacaagaagcggagcuggccgcugaacgaggccaucauggcggucggcaugguguccauccucgccagcucccugcugaagaacgacauccccaugaccgggccccucguggccggcgggcugcugacggucugcuacgugcucaccggccgcagcgccgaccuggagcuggagcgggccaccgacgugaagugggaggaccaggcggagaucuccgggagcagccccauccucuccaucaccaucagcgaggacggcuccaugagcaucaagaacgaggaggaggagcagacgcugaccauccugauccgcaccggccuccuggucaucuccgggcuguucccggugagcauccccaucaccgccgccgccugguaccucugggaggugaagaagcagcgggccggcguccugugggacgugcccagcccgccgcccauggggaaggcggagcuggaggacggcgccuaccgcaucaagcagaaggggauccucggcuacagccagaucggcgccgggguguacaaggagggcaccuuccacacgauguggcacgucacccgcggggccgugcugaugcacaagggcaagcgcaucgagcccuccugggccgacgugaagaaggaccugaucagcuacgggggcggcuggaagcucgagggggaguggaaggagggcgaggagguccaggugcuggcgcuggagcccgggaagaacccccgggccgugcagaccaagcccggccucuucaagaccaacacggggaccaucggcgccgucucccuggacuucagccccggcaccuccgggagccccaucaucgacaagaagggcaaggugguggggcuguacggcaacggcgucgugacccgcuccggggccuacgugagcgccaucgcgcagacggagaaguccaucgaggacaaccccgagaucgaggacgacaucuuccggaagcgccggcugaccaucauggaccuccaccccggcgccgggaagaccaagcgcuaccugcccgccaucguccgggaggccaucaagcgcggccugcggacccucauccuggcgccgacgcgcgugguggccgccgagauggaggaggcccugcgggggcuccccauccgcuaccagacccccgccauccgggcggagcacaccggccgcgagaucgucgaccugaugugccacgccaccuucacgaugcgccugcucagccccgugcgggugccgaacuacaaccugaucaucauggacgaggcccacuucaccgaccccgccuccaucgccgcgcgcggcuacaucagcacccgggucgagaugggggaggccgccggcaucuucaugaccgccacgccgcccgggagccgcgacccguucccccaguccaacgcccccaucaucgacgaggagcgggagauccccgagcgcagcuggaacuccggccacgagugggugaccgacuucaaggggaagaccgugugguucgucccgagcaucaaggcgggcaacgacaucgccgccugccugcggaagaacggcaagaaggugauccagcucucccgcaagaccuucgacagcgaguacgugaagacgcggaccaacgacugggacuucgucgugaccaccgacaucuccgagaugggggccaacuucaaggcggaccgcgugaucgacccccggcgcugcaugaagcccgucauccugacggacggcgaggagcgggugauccuggccgggcccaugccggugacccacagcuccgccgcccagcgccggggccgcaucgggcggaaccccaagaacgagaacgaccaguacaucuacaugggcgagccccucgagaacgacgaggacugcgcccacuggaaggaggcgaagaugcugcuggacaacaucaacacccccgagggcaucaucccgagcauguucgagcccgagcgcgagaaggucgacgccaucgacggggaguaccggcuccgcggcgaggcccgcaagaccuucguggaccugaugcggcgcggggaccugcccguguggcucgccuacaaggucgccgcggagggcaucaacuacgccgaccggcgcuggugcuucgacgggaucaagaacaaccagauccuggaggagaacguggagguggagaucuggacgaaggagggcgagcggaagaagcugaagccgcgcuggcucgacgcccggaucuacuccgacccccuggcccugaaggaguucaaggaguucgccgcgggccgcaagagccucacccugaaccugaucaccgagauggggcggcuccccaccuucaugacgcagaagacccgcgacgcccuggacaaccuggccguccuccacaccgccgaggcgggcgggcgggccuacaaccacgcccuguccgagcugcccgagacccucgagacgcugcugcuccugacccugcucgccaccgugaccggcggcaucuuccuguuccugaugagcgggcgcggcaucgggaagaugacccucggcaugugcugcaucaucacggccuccauccugcugugguacgcgcagauccagccgcacuggaucgccgccagcaucauccucgaguucuuccugaucguccugcucauccccgagcccgagaagcagcggacgccccaggacaaccagcugaccuacguggugaucgccauccugaccgucguggccgcgacgauggccaacgagaugggguuccucgagaagaccaagaaggaccugggccugggcuccaucgccacccagcagccggagagcaacauccucgacaucgaccugcgccccgccuccgccuggacccuguacgcgguggccacgaccuucgucacccccaugcuccggcacagcaucgagaacagcuccgugaacgugagccugaccgccaucgccaaccaggccacgguccugauggggcucggcaagggguggccccuguccaagauggacaucggcgugccgcugcucgcgaucgggugcuacagccaggugaaccccaucacccugaccgccgcccugcuccugcuggucgcccacuacgcgaucaucggccccggccuccaggccaaggccacccgcgaggcccagaagcgggccgcggccgggaucaugaagaaccccacgguggacggcaucaccgugaucgaccuggacccgauccccuacgaccccaaguucgagaagcagcuggggcaggucaugcuccugauccugugcgugacccaggugcucaugaugcgcaccacgugggcccugugcgaggcccugacccucgccaccggccccaucuccacccugugggaggggaacccgggccgguucuggaacacgaccaucgcggucagcauggccaacaucuuccgcggcuccuaccuggccggggccggccuccuguucagcaucaugaagaacaccaccaacacgcggcgcgggaccggcaacaucggcgagacccugggggagaaguggaagucccgccucaacgcccugggcaagagcgaguuccagaccuacaagaaguccgggauccaggagguggaccggacgcuggcgaaggagggcaucaagcgcggggagaccgaccaccacgccgugagccggggcuccgccaagcuccgcugguucgucgagcggaacauggugacccccgagggcaagguggucgaccuggggugcggccgcgggggcuggagcuacuacugcgggggccugaagaacgugcgggaggugaagggccucaccaagggcgggcccgggcacgaggagcccaucccgauguccacguacggcuggaaccugguccgccugcagagcgggguggacguguucuucaucccgcccgagaagugcgacacccuccugugcgacaucggcgaguccagccccaacccgaccgucgaggccggccggacccugcgcgugcucaaccugguggagaacuggcugaacaacaacacccaguucugcaucaagguccugaaccccuacaugcccuccgugaucgagaagauggaggcgcuccagcggaaguacgggggcgcccuggugcgcaacccgcugagccggaacagcacgcacgagauguacugggucuccaacgccagcgggaacaucguguccagcgugaacaugaucucccgcaugcucaucaaccgguucaccaugcgccacaagaaggccaccuacgagcccgacgucgaccugggcagcgggacccggaacaucggcaucgaguccgagauccccaaccuggacaucaucggcaagcgcaucgagaagaucaagcaggagcacgagacgagcuggcacuacgaccaggaccaccccuacaagaccugggccuaccacggguccuacgagaccaagcagaccggcagcgcguccagcauggugaacggggugguccggcuccugacgaagccgugggacgugcugcccaccgugacccagauggccaugaccgacacgacccccuucggccagcagcgcgucuucaaggagaagguggacacccgcacccaggagcccaaggagggcacgaagaagcucaugaagaucaccgccgaguggcuguggaaggagcuggggaagaagaagaccccgcggaugugcacccgcgaggaguucacgcggaaggugcgcuccaacgccgcccucggcgcgaucuucaccgacgagaacaaguggaaguccgcccgggaggccgucgaggacagccgcuucugggagcugguggacaaggagcggaaccugcaccucgaggggaagugcgagaccugcguguacaacaugaugggcaagcgcgagaagaagcugggggaguucggcaaggccaagggcagccgggccaucugguacauguggcugggggcgcgcuuccucgaguucgaggcccugggcuuccugaacgaggaccacugguucucccgggagaacagccucuccggggucgagggcgaggggcugcacaagcugggcuacauccuccgcgacgugagcaagaaggagggcggggccauguacgccgacgacaccgcgggcugggacacgcggaucacccuggaggaccugaagaacgaggagauggucaccaaccacauggagggggagcacaagaagcucgccgaggccaucuucaagcugaccuaccagaacaagguggugcgcguccagcggcccacgccccgcggcaccgugauggacaucaucagccggcgcgaccagcggggguccggccaggugggcaccuacgggcugaacaccuucacgaacauggaggcccagcucauccgccagauggagggcgagggggucuucaagaacauccagcaccugaccgccaccgaggagguggcggugcagaacuggcuggcccgggucggccgcgagcgccucagccggauggccaucuccggcgacgacugcguggugaagccccuggacgaccgcuucgccaacgcccugaccgcgcucaacgacauggggaagauccggaaggacauccagcagugggagccgagcaagggcuggaacgacuggacgcagguccccuucugcucccaccacuuccacgagcugaucaugaaggacgggcgcgugcuggugguccccugccggaaccaggacgagcucaucggccgcgcccggaucagccagggggccggcuggucccugcgcgagaccgccugccugggcaagagcuacgcccagauguggucccucauguacuuccaccggcgcgaccugcggcuggcggccaacgccaucugcagcgccgugcccucccacugggugccgaccagccgcaccaccugguccauccacgccaagcacgaguggaugacgaccgaggacaugcucaccgucuggaaccggguguggauccgcgagaaccccuggauggaggacaagacccccguggagagcugggaggagauccccuaccuggggaagcgggaggaccaguggugcggcucccugaucgggcucacgagccgcgcgaccugggccaagaacauccaggccgccaucaaccagguccggucccugaucggcaacgaggaguacaccgacuacaugccgagcaugaagcgcuuccggcgcgaggaggaggaggcgggggugcugugguga

SEQ ID NO: 9142 - RNA, 9876 nt, Artificial Sequence
  derived and/or modified CDS sequence (opt1) from DENV-2__GU131897__SS-prME
agcgcgggcaugaucaucaugcugauccccaccgugauggccuuccaccucaccacccggaacggggagccccacaugaucgugggcauccaggagaagggcaagagccugcuguucaagaccgaggacggcgugaacaugugcacccucauggcgauggaccugggggagcugugcgaggacaccaucaccuacaagugcccccuccugcggcagaacgagcccgaggacaucgacugcuggugcaacagcaccuccaccugggugaccuacgggaccugcaccaccaccggcgagcaccgccgggagaagcgcagcguggcccuggugccccacguggggaugggccucgagacgcggaccgagaccuggauguccagcgagggggccuggaagcacgcccagcgcaucgagaccuggauccugcggcacccgggcuucacgaucauggccgcgauccuggccuacaccaucgggaccacccacuuccagcgcguccucaucuucauccugcugacggccguggcccccuccaugaccaugcggugcaucggcaucagcaaccgcgacuucguggagggcgucuccgggggcagcuggguggacaucgugcucgagcacggguccugcgucaccaccauggcgaagaacaagcccacgcuggacuucgagcugaucaagaccgaggccaagcagcccgccacccuccggaaguacugcaucgaggccaagcugaccaacacgaccaccgagagccgcugccccacccagggcgagcccucccugaaggaggagcaggacaagcgguucgugugcaagcacagcaugguggaccgcggcugggggaacggcugcggccuguucggcaagggcgggaucgucacgugcgccauguucacgugcaagaagaacauggagggcaagaucgugcagcccgagaaccuggaguacaccaucguggucacgccccacuccggggaggagcacgcggugggcaacgacacggggaagcacggcauggagaucaaggugaccccgcagagcuccaucaccgaggccgagcugaccggguacggcaccgucacgauggagugcagcccccggaccggccucgacuucaacgagauggugcugcugcagauggagaacaaggccuggcucgugcaccgccagugguuccuggaccugccccuccccuggcugccgggggccgacaagcaggaguccaacuggauccagaaggagacccuggucaccuucaagaacccccacgccaagaagcaggacguggucgugcucggcagccaggagggggcgaugcacacggcccugaccggcgccaccgagauccagaugagcuccgggaaccuccuguucaccggccaccugaagugccggcugcgcauggacaagcuccagcugaagggcaugagcuacuccaugugcacggggaaguucaagguggucaaggagaucgccgagacccagcacggcaccaucgugauccgggugcaguacgagggggacggcagccccugcaagauccccuucgagaucauggaccuggagaagcgcuacguccucggccggcugaucaccgugaacccgaucgugacggagaaggacucccccgucaacaucgaggccgagccgcccuucggggacagcuacaucaucaucggcguggagccggggcagcugaagcucaacugguucaagaagggcuccagcaucgggcagauguucgagaccaccaugcgcggcgcgaagcgcauggccauccugggcgacaccgccugggacuucgggucccugggcgggguguucacgagcaucggcaaggcccuccaccaggucuucggggccaucuacggcgcggccuucuccggcgugagcuggaccaugaagauccugaucggggugaucaucaccuggaucggcaugaacucccggagcaccucccugagcgucucccuggugcucguggggaucgucacgcuguaccugggcgugauggugcaggccgacagcgggugcgucguguccuggaagaacaaggagcucaagugcggcagcggcaucuucaucaccgacaacgugcacaccuggaccgagcaguacaaguuccagcccgagagccccuccaagcuggccagcgcgauccagaaggcccaggaggaggggaucugcggcauccgcuccgucacgcggcuggagaaccucauguggaagcagaucacccccgagcugaaccacauccuggccgagaacgaggugaagcucaccaucaugaccggggacaucaagggcaucaugcaggccgggaagcgcagccugcggccgcagcccacggagcugaaguacuccuggaagaccuggggcaaggccaagaugcucagcaccgaguccuacaaccagaccuuccugaucgacggccccgagacggcggagugcccgaacaccaaccgcgccuggaacagccuggagguggaggacuacggguucggcgucuucaccaccaacaucuggcucaagcugaaggagaagcaggacgccuucugcgacuccaagcugaugagcgccgccaucaaggacaaccgggcggugcacgccgacaugggguacuggaucgaguccgcccucaacgacacguggaagaucgagaaggccagcuucaucgaggugaagaacugccacuggcccaagucccacacccuguggagcaacggcguccuggaguccgagaugaucauccccaagaaccucgccggccccgugagccagcacaacuaccgcccgggguaccacacccagaucgcgggccccuggcaccuggggaagcuggagauggacuucgacuucugcgacggcaccaccgugaucgucacggaggacugcgggaaccggggccccucccuccgcaccaccaccgccagcggcaagcugaucacggaguggugcugccggagcugcacccugcccccgcuccgcuaccgcggggaggacggcugcugguacgggauggagauccgcccccugaaggagaaggaggagaaccugaucaacucccucgugaccgccggccacggccagguggacaacuucagccugggcguccugggcauggcccucuuccuggaggagaugcugcggacccgcguggggacgaagcacgcgauccuccugguggccgucuccuucgugacccugaucaccggcaacaugagcuucaaggaccucgggcggguggucgugauggugggcgccaccauggccgacgacaucgggaugggcgucacguaccuggcccugcucgcggccuucaaggugcgccccaccuucgccgccggccugcugcuccggaagcugaccuccaaggagcugaugaugaccacgaucgggaucgugcuccugagccaguccaccauccccgagaccguccuggagcucaccgacgcccuggcgcugggcaugauggugcucaagaucgugcgcaacauggagaaguaccagcuggccgucacgaucauggccauccugugcgugccgaacgccgucauccuccagaacgccuggaaggugagcugcaccauccuggcgguggucuccgugagcccccugcuccugaccuccagccagcagaagaccgacuggaucccccuggcccucacgaucaaggggcugaaccccaccgccaucuuccugaccacccucucccgcacgaacaagaagcggagcuggccgcugaacgaggccaucauggcggugggcauggucuccauccuggccagcucccuccugaagaacgacauccccaugaccggcccccugguggccgggggccuccugaccgugugcuacguccugaccgggcgcagcgccgaccucgagcuggagcgggccacggacgugaagugggaggaccaggcggagaucuccggcagcagccccauccuguccaucaccaucagcgaggacggguccaugagcaucaagaacgaggaggaggagcagacccucaccauccugauccgcacgggccugcucgugaucuccggccuguucccgaucagcauccccaucaccgccgccgccugguaccugugggaggucaagaagcagcgggccggggugcucugggacgugcccagcccgccgcccaugggcaaggcggagcuggaggacggggccuaccgcaucaagcagaagggcauccugggguacagccagaucggcgccggcgucuacaaggaggggaccuuccacaccauguggcacgugacccggggcgccgugcucaugcacaaggggaagcgcaucgagcccuccugggccgacgucaagaaggaccugaucagcuacggcgggggcuggaagcuggagggcgaguggaaggagggggaggagguccaggugcucgcgcuggagcccggcaagaacccccgggccguccagacgaagcccgggcuguucaagaccaacaccggcaccaucggggccgugucccucgacuucagccccggcacguccggcagccccaucaucgacaagaaggggaagguggucggccuguacgggaacggcguggugacccgcuccggcgccuacgucagcgccaucgcgcagaccgagaaguccaucgaggacaaccccgagaucgaggacgacaucuuccggaagcgccggcugaccaucauggaccugcaccccggggccggcaagacgaagcgcuaccuccccgccaucgugcgggaggccaucaagcgcgggcugcggacccugauccucgcgccgacccgcguggucgccgccgagauggaggaggcccugcggggccugcccauccgcuaccagacccccgccauccgggcggagcacacggggcgcgagaucguggaccucaugugccacgccaccuucaccaugcgccugcugagccccgugcgggucccgaacuacaaccucaucaucauggacgaggcccacuucaccgaccccgccuccaucgccgcgcgcggcuacaucagcacgcggguggagaugggcgaggccgccgggaucuucaugaccgccacgccgcccggcagccgcgacccguucccccaguccaacgcccccaucaucgacgaggagcgggagauccccgagcgcagcuggaacuccgggcacgagugggugauggacuucaagggcaagaccgucugguucgugccgagcaucaaggcggggaacgacaucgccgccugccugcggaagaacggcaagaaggugauccagcugucccgcaagacguucgacagcgaguacgucaagacccggaccaacgacugggacuucguggugaccacggacaucuccgagaugggcgccaacuucaaggcggagcgcgucaucgacccccggcgcugcaugaagcccgugauccucaccgacggggaggagcgggugauccuggccggccccaugccggucacccacagcuccgccgcccagcgccgggggcgcaucggccggaaccccaagaacgagaacgaccaguacaucuacaugggggagccccuggagaacgacgaggacugcgcccacuggaaggaggcgaagaugcuccuggacaacaucaacacccccgagggcaucaucccgagcauguucgagcccgagcgcgagaagguggacgccaucgacggcgaguaccggcugcgcggggaggcccgcaagacguucguggaccucaugcggcgcggcgaccugcccgucuggcuggccuacaagguggccgcggaggggaucaacuacgccgaccggcgcuggugcuucgacggcaucaagaacaaccagauccucgaggagaacguggaggucgagaucuggaccaaggagggggagcggaagaagcugaagccgcgcuggcuggacgcccggaucuacuccgacccccucgcccugaaggaguucaaggaguucgccgcgggccgcaagagccugacccucaaccugaucaccgagaugggccggcugcccacguucaugacccagaagacccgcgacgcccucgacaaccuggccgugcugcacaccgccgaggccggcgggcgggccuacaaccacgcccucuccgagcugcccgagacgcuggagacccuccugcugcucacccugcuggccaccgucaccggcgggaucuuccucuuccugaugagcgggcgcgggaucgggaagaugacccuggggaugugcugcaucaucaccgccuccauccuccugugguacgcgcagauccagccgcacuggaucgccgccagcaucauccuggaguucuuccucaucgugcugcugauccccgagcccgagaagcagcggacgccccaggacaaccagcucaccuacguggucaucgccauccugacggugguggccgcgaccauggccaacgagaugggcuuccuggagaagaccaagaaggaccucgggcugggcuccaucgccacccagcagccggagagcaacauccuggacaucgaccuccgccccgccuccgccuggacgcuguacgcggucgccaccaccuucgugacccccaugcugcggcacagcaucgagaacagcuccgugaacgucagccucacggccaucgccaaccaggccaccgugcugaugggccuggggaagggcuggccccucuccaagauggacaucggggugccgcugcuggcgaucggcugcuacagccaggucaaccccaucacccucaccgccgcccugcugcuccugguggcccacuacgcgaucaucgggcccggccugcaggccaaggccacgcgcgaggcccagaagcgggccgcggccggcaucaugaagaaccccaccguggacgggaucaccgucaucgaccucgacccgauccccuacgaccccaaguucgagaagcagcugggccaggugaugcugcucauccugugcgugacccagguccugaugaugcgcacgaccugggcccucugcgaggcccugacccuggccaccgggcccaucuccacgcucugggagggcaacccggggcgguucuggaacaccaccaucgcggugagcauggccaacaucuuccgcggcuccuaccuggccggcgccgggcuccucuucagcaucaugaagaacaccacgaacacccggcgcggcaccgggaacaucggcgagacccugggcgagaaguggaagucccgccugaacgcccucgggaaguccgaguuccagaucuacaagaaguccggcauccaggagguggaccggacgcuggcgaaggaggggaucaagcgcggcgagaccgaccaccacgccgucagccggggguccgccaagcugcgcugguucguggagcggaacauggugacccccgagggcaaggucguggaccucggcugcgggcgcggcggguggagcuacuacugcggcgggcugaagaacgugcgggaggucaagggccugaccaagggcgggcccggccacgaggagcccaucccgauguccacguacggguggaaccucgugcgccugcagagcggcguggacgucuucuucaucccgcccgagaagugcgacacccugcucugcgacaucggggaguccagccccaacccgaccguggaggccggccggacccugcgcgugcugaaccucgucgagaacuggcugaacaacaacacgcaguucugcaucaaggugcugaaccccuacaugcccuccgugaucgagaagauggaggcgcugcagcggaaguacggcggggcccucguccgcaacccgcugagccggaacagcacccacgagauguacuggguguccaacgccagcggcaacaucguguccagcgucaacaugaucucccgcaugcugaucaaccgguucaccaugcgccacaagaaggccaccuacgagcccgacguggaccucgggagcggcacccggaacaucgggaucgaguccgagauccccaaccuggacaucaucggcaagcgcaucgagaagaucaaggaggagcacgagacgagcuggcacuacgaccaggaccaccccuacaagaccugggccuaccacggcuccuacgagaccaagcagaccgggagcgcguccagcauggugaacggcgucgugcggcugcucacgaagccgugggacgugcugcccaccgucacccagauggccaugaccgacacgacccccuucgggcagcagcgcguguucaaggagaagguggacacccgcacccaggagcccaaggagggcacgaagaagcugaugaagaucaccgccgaguggcucuggaaggagcugggcaagaagaagaccccgcggaugugcacccgcgaggaguucacgcggaagguccgcuccaacgccgcccugggggcgaucuucaccgacgagaacaaguggaaguccgcccgggaggccguggaggacucccgcuucugggagcucguggacaaggagcggaaccugcaccuggagggcaagugcgagaccugcgucuacaacaugauggggaagcgcgagaagaagcucggcgaguucgggaaggccaagggcagccgggccaucugguacauguggcugggcgcgcgcuuccuggaguucgaggcccucggguuccugaacgaggaccacugguucucccgggagaacagccuguccggcguggagggggagggccuccacaagcugggguacauccugcgcgacgucagcaagaaggagggcggcgccauguacgccgacgacaccgcggggugggacacgcggaucacccucgaggaccugaagaacgaggagauggugaccaaccacauggagggcgagcacaagaagcuggccgaggccaucuucaagcucaccuaccagaacaaggugguccgcgugcagcggcccacgccccgcgggaccgugauggacaucaucagccggcgcgaccagcggggcuccgggcaggucggcaccuacggccugaacaccuucacgaacauggaggcccagcugauccgccagauggagggggagggcguguucaagaacauccagcaccucaccgugaccgaggaggccgcgguccagaacuggcuggcccggguggggcgcgagcgccugagccggauggccaucuccggcgacgacugcguggucaagccccucgacgaccgcuucgccaacgcccugaccgcgcugaacgacaugggcaagauccggaaggacauccagcagugggagccgagcaagggguggaacgacuggacgcagguccccuucugcucccaccacuuccacgagcucaucaugaaggacggccgcgugcuggucgugcccugccggaaccaggacgagcugaucgggcgcgcccggaucagccagggcgccggguggucccuccgcgagaccgccugccugggcaagagcuacgcccagauguggucccugauguacuuccaccggcgcgaccuccggcuggcggccaacgccaucugcagcgccgugcccucccacugggucccgaccagccgcaccacgugguccauccacgccaagcacgaguggaugaccaccgaggacaugcugaccguguggaaccggguguggauccgcgagaaccccuggauggaggacaagacccccgucgagagcugggaggagauccccuaccucggcaagcgggaggaccaguggugcgggucccugaucggccugacgagccgcgcgaccugggccaagaacauccaggccgccaucaaccaggugcggucccucaucgggaacgaggaguacaccgacuacaugccgagcaugaagcgcuuccggcgcgaggaggaggaggcgggcgugcugugguga

SEQ ID NO: 9143 - RNA, 9876 nt, Artificial Sequence
  derived and/or modified CDS sequence (opt1) from DENV-2__GQ868631__SS-prME
agcgccgggaugaucaucaugcugauccccaccgugauggccuuccaccucaccacccgcaacggggagccccacaugaucgucggcauccaggagaagggcaagagccugcuguucaagaccgaggacggcgugaacaugugcacccucauggcgauggaccugggggagcugugcgaggacaccaucaccuacaagugcccccuccugcggcagaacgagcccgaggacaucgacugcuggugcaacagcaccuccaccugggugaccuacgggaccugcaccaccaagggcgagcaccgccgggagaagcgcagcgucgcccuggugccccacguggggaugggccucgagacccggacggagaccuggauguccagcgagggggccuggaagcacgcccagcgcaucgagaccuggauccugcggcacccgggcuucaccaucauggccgcgauccuggccuacacgaucgggaccacccacuuccagcgcguccucaucuucauccugcugaccgccguggcccccuccaugacgaugcggugcaucggcaucagcaaccgcgacuucguggagggcgucuccgggggcagcuggguggacaucgugcucgagcacggguccugcgucaccaccauggcgaagaacaagcccacccuggacuucgagcugaucaagacggaggccaagcagcccgccacccuccggaaguacugcaucgaggccaagcugaccaacaccacgaccgagagccgcugccccacccagggcgagcccucccugaaggaggagcaggacaagcgguucgugugcaagcacagcaugguggaccgcggcugggggaacggcugcggccuguucggcaagggcgggaucgugaccugcgccauguucacgugcaagaagaacauggagggcaagaucgugcagcccgagaaccuggaguacaccaucguggucacgccccacuccggggaggagcacgcggugggcaacgacaccgggaagcacggcauggagaucaaggugacgccgcagagcuccaucaccgaggccgagcugaccggguacggcaccgucaccauggagugcagcccccggacgggccucgacuucaacgagauggugcugcugcagauggagaacaaggccuggcucgugcaccgccagugguuccuggaccugccccuccccuggcugccgggggccgacaagcaggaguccaacuggauccagaaggagacccuggucaccuucaagaacccccacgccaagaagcaggacguggucgugcucggcagccaggagggggcgaugcacaccgcccugacgggcgccaccgagauccagaugagcuccgggaaccuccuguucaccggccaccugaagugccggcugcgcauggacaagcuccagcugaagggcaugagcuacuccaugugcaccgggaaguucaagguggucaaggagaucgccgagacgcagcacggcaccaucgugauccgggugcaguacgagggggacggcagccccugcaagauccccuucgagaucauggaccuggagaagcgcuacguccucggccggcugaucaccgugaacccgaucgugaccgagaaggacucccccgucaacaucgaggccgagccgcccuucggggacagcuacaucaucaucggcguggagccggggcagcugaagcucaacugguucaagaagggcuccagcaucgggcagauguucgagacgaccaugcgcggcgcgaagcgcauggccauccugggcgacaccgccugggacuucgggucccugggcgggguguucaccagcaucggcaaggcccuccaccaggucuucggggccaucuacggcguggcguucuccggcgugagcuggacgaugaagauccugaucggggucaucaucaccuggaucggcaugaacucccggagcaccucccugagcgugucccuggugcucgucgggaucgugacccuguaccugggcgugaugguccaggccgacagcgggugcgugguguccuggaagaacaaggagcucaagugcggcagcggcaucuucaucacggacaacguccacaccuggaccgagcaguacaaguuccagcccgagagccccuccaagcuggccagcgccauccagaaggcgcaggaggaggggaucugcggcauccgcuccgugacccggcuggagaaccucauguggaagcagaucacgcccgagcugaaccacauccuggccgagaacgaggugaagcucaccaucaugaccggggacaucaagggcaucaugcaggccgggaagcgcagccugcggccgcagcccaccgagcugaaguacuccuggaagacguggggcaaggccaagaugcucagcaccgaguccuacaaccagaccuuccugaucgacggccccgagaccgccgagugcccgaacacgaaccgcgcguggaacagccuggaggucgaggacuacggguucggcguguucaccaccaacaucuggcucaagcugaaggagaagcaggacgccuucugcgacuccaagcugaugagcgccgccaucaaggacaaccgggccgugcacgcggacaugggguacuggaucgaguccgcccucaacgacaccuggaagaucgagaaggccagcuucaucgaggucaagaacugccacuggcccaagucccacacgcuguggagcaacggcgugcuggaguccgagaugaucauccccaagaaccucgccggccccgugagccagcacaacuaccgcccgggguaccacacccagaucgccggccccuggcaccuggggaagcuggagauggacuucgacuucugcgacggcaccaccgucaucgugaccgaggacugcgggaaccggggccccucccuccgcacgaccaccgcgagcggcaagcugaucaccgaguggugcugccggagcugcacgcugcccccgcuccgcuaccgcggggaggacggcugcugguacgggauggagauccgcccccugaaggagaaggaggagaaccuggugaacucccucgucaccgccggccacgggcaggucgacaacuucagccugggcgugcugggcauggcccucuuccuggaggagaugcugcggacccgcgucgggaccaagcacgccauccuccugguggcgguguccuucgucacgcugaucaccggcaacaugagcuucaaggaccucgggcgggugguggucauggugggcgccaccauggccgacgacaucgggaugggcgugaccuaccuggcccugcucgccgcguucaagguccgccccacguucgccgccggccugcugcuccggaagcugaccuccaaggagcugaugauggccaccaucgggaucgugcuccugagccaguccaccauccccgagacggugcuggagcucaccgacgcccuggcgcugggcaugauggcccucaagaucguccgcaacauggagaaguaccagcuggccgugaccaucauggccauccugugcgucccgaacgccgugauccuccagaacgcguggaaggugagcugcaccauccuggccgucguguccgugagcccccugcuccugacguccagccagcagaagaccgacuggaucccccuggcccucaccaucaaggggcugaaccccaccgccaucuuccugacgacccucucccgcaccaacaagaagcggagcuggccgcugaacgaggcgaucauggccgucggcaugguguccauccuggccagcucccuccugaagaacgacauccccaugaccggcccccugguggccgggggccuccugacggucugcuacgugcugaccgggcgcagcgccgaccucgagcuggagcgggcgaccgacgugaagugggaggaccaggccgagaucuccggcagcagccccauccuguccaucaccaucagcgaggacggguccaugagcaucaagaacgaggaggaggagcagacgcucaccauccugauccgcaccggccugcucgucaucuccggccuguucccgaucagcauccccaucaccgccgccgccugguaccugugggaggugaagaagcagcgggcgggggugcucugggacguccccagcccgccgcccaugggcaaggccgagcuggaggacggggccuaccgcaucaagcagaagggcauccugggguacagccagaucggcgccggcguguacaaggaggggacguuccacaccauguggcacgugacccggggcgccguccucaugcacaaggggaagcgcaucgagcccuccugggcggacgugaagaaggaccugaucagcuacggcgggggcuggaagcuggagggcgaguggaaggagggggaggaggugcagguccucgcccuggagcccggcaagaacccccgggccgugcagaccaagcccgggcuguucaagaccaacacgggcaccaucggggccgugucccucgacuucagccccggcaccuccggcagccccaucaucgacaagaaggggaaggucgugggccuguacgggaacggcguggucacccgcuccggcgccuacgugagcgcgaucgcccagacggagaaguccaucgaggacaaccccgagaucgaggacgacaucuuccggaagcgccggcugaccaucauggaccugcaccccggggccggcaagaccaagcgcuaccuccccgccaucgugcgggaggcgaucaagcgcgggcugcggacccugauccucgccccgacgcgcgucguggccgccgagauggaggaggcccugcggggccugcccauccgcuaccagacccccgcgauccgggccgagcacaccgggcgcgagaucguggaccucaugugccacgccaccuucacgaugcgccugcugagccccguccgggugccgaacuacaaccucaucaucauggacgaggcccacuucaccgaccccgccuccaucgcggcccgcggcuacaucagcacccggguggagaugggcgaggccgccgggaucuucaugaccgccacgccgcccggcagccgcgacccguucccccaguccaacgcgcccaucaucgacgaggagcgggagauccccgagcgcagcuggaacuccgggcacgagugggucaccgacuucaagggcaagaccgugugguucgugccgagcaucaaggccgggaacgacaucgccgccugccugcggaagaacggcaagaaggucauccagcugucccgcaagaccuucgacagcgaguacgugaagacgcggaccaacgacugggacuucguggucaccaccgacaucuccgagaugggcgcgaacuucaaggccgagcgcgugaucgacccccggcgcugcaugaagcccgugauccucacggacggggaggagcgggucauccuggccggccccaugccggugacccacagcuccgccgcccagcgccgggggcgcaucggccggaaccccaagaacgagaacgaccaguacaucuacaugggggagccccuggagaacgacgaggacugcgcgcacuggaaggaggccaagaugcuccuggacaacaucaacacccccgagggcaucaucccgagcauguucgagcccgagcgcgagaagguggacgccaucgacggcgaguaccggcugcgcggggaggcccgcaagaccuucgucgaccucaugcggcgcggcgaccugcccguguggcuggccuacaagguggcggccgaggggaucaacuacgccgaccggcgcuggugcuucgacggcaucaagaacaaccagauccucgaggagaacgucgagguggagaucuggacgaaggagggggagcggaagaagcugaagccgcgcuggcuggacgcccggaucuacuccgacccccucgcccugaaggaguucaaggaguucgcggccggccgcaagagccugacccucaaccugaucaccgagaugggccggcugcccaccuucaugacgcagaagacccgcgacgcccucgacaaccuggccguccugcacaccgcggaggccgggggccgggccuacaaccacgcccucuccgagcugcccgagacccuggagacgcuccugcugcucacccugcuggccaccgugaccgggggcaucuuccucuuccugaugagcggccgcgggaucggcaagaugacgcuggggaugugcugcaucaucaccgcguccauccuccugugguacgcccagauccagccgcacuggaucgccgccagcaucauccuggaguucuuccucaucgugcugcugauccccgagcccgagaagcagcggacgccccaggacaaccagcucaccuacgucgugaucgccauccugaccguggucgcggccacgauggccaacgagaugggcuuccuggagaagaccaagaaggaccucgggcugggcuccaucgccacccagcagccggagagcaacauccuggacaucgaccuccgccccgccuccgcguggacccuguacgccguggccacgaccuucgugacccccaugcugcggcacagcaucgagaacagcuccgucaacgugagccucaccgccaucgccaaccaggcgacggugcugaugggccuggggaagggcuggccccucuccaagauggacaucggggucccgcugcuggccaucggcugcuacagccaggugaaccccaucacccucaccgccgcccugcugcuccugguggcgcacuacgccaucaucgggcccggccugcaggccaaggccacccgcgaggcccagaagcgggcggccgccggcaucaugaagaaccccacggucgacgggaucaccgugaucgaccucgacccgauccccuacgaccccaaguucgagaagcagcugggccaggugaugcugcucauccugugcgucacccaggugcugaugaugcgcaccacgugggcccucugcgaggcccugacccuggcgaccgggcccaucuccacccucugggagggcaacccggggcgguucuggaacacgaccaucgccgugagcauggccaacaucuuccgcggcuccuaccuggccggcgccgggcuccucuucagcaucaugaagaacaccaccaacacgcggcgcggcaccgggaacaucggcgagacccugggcgagaaguggaagucccgccugaacgcgcucgggaaguccgaguuccagaucuacaagaaguccggcauccaggaggucgaccggacccuggccaaggaggggaucaagcgcggcgagacggaccaccacgccgugagccggggguccgccaagcugcgcugguucguggagcggaacauggucacccccgagggcaaggugguggaccucggcugcgggcgcggcggguggagcuacuacugcggcgggcugaagaacguccgggaggugaagggccugaccaagggcgggcccggccacgaggagcccaucccgauguccaccuacggguggaaccucgugcgccugcagagcggcgucgacguguucuucaucccgcccgagaagugcgacacgcugcucugcgacaucggggaguccagccccaacccgaccguggaggcgggccggacccugcgcguccugaaccucguggagaacuggcugaacaacaacacccaguucugcaucaaggugcugaaccccuacaugcccuccgucaucgagaagauggaggccaugcagcggaaguacggcggggcccuggugcgcaacccgcucagccggaacagcacgcacgagauguacuggguguccaacgccagcggcaacaucgucuccagcgugaacaugaucucccgcaugcugaucaaccgguucaccaugcgccacaagaaggccaccuacgagcccgacguggaccuggggagcggcacccggaacaucgggaucgaguccgagauccccaaccucgacaucaucggcaagcgcaucgagaagaucaaggaggagcacgagaccagcuggcacuacgaccaggaccaccccuacaagacgugggcguaccacggcuccuacgagaccaagcagaccgggagcgccuccagcauggucaacggcguggugcggcugcugaccaagccgugggacguccuccccacggugacccagauggccaugaccgacaccacgcccuucgggcagcagcgcguguucaaggagaaggucgacacccgcacccaggagcccaaggagggcaccaagaagcugaugaagaucacggccgaguggcuguggaaggagcucggcaagaagaagaccccgcggaugugcacccgcgaggaguucacccggaaggugcgcuccaacgccgcgcugggggccaucuucacggacgagaacaaguggaaguccgcccgggaggccguggaggacucccgcuucugggagcuggucgacaaggagcggaaccuccaccuggagggcaagugcgagaccugcguguacaacaugauggggaagcgcgagaagaagcugggcgaguucgggaaggccaagggcagccgggcgaucugguacauguggcucggcgcccgcuuccuggaguucgaggcccugggguuccucaacgaggaccacugguucucccgggagaacagccuguccggcgucgagggggagggccugcacaagcucggguacauccugcgcgacgugagcaagaaggagggcggcgccauguacgcggacgacaccgccgggugggacacccggaucacgcuggaggaccucaagaacgaggagauggugaccaaccacauggagggcgagcacaagaagcuggccgaggccaucuucaagcugaccuaccagaacaaggucgugcgcgugcagcggcccacgccccgggggacggucauggacaucaucagccggcgcgaccagcggggcuccggccagguggggaccuacggccucaacaccuucaccaacauggaggcccagcugauccgccagauggagggggagggcguguucaagaacauccagcaccugacggucaccgaggaggcggccgugcagaacuggcucgcccggguggggcgcgagcgccugagccggauggccaucuccggcgacgacugcgucgugaagccccuggacgaccgcuucgccaacgcgcucaccgcccugaacgacaugggcaagauccggaaggacauccagcagugggagccgagcaagggguggaacgacuggacccaggugcccuucugcucccaccacuuccacgagcugaucaugaaggacggccgcguccucguggugcccugccggaaccaggacgagcugaucgggcgcgcccggaucagccagggcgccggguggucccugcgcgagacggccugccucggcaagagcuacgcgcagauguggucccugauguacuuccaccggcgcgaccugcggcucgccgccaacgccaucugcagcgccguccccucccacugggugccgaccagccgcaccaccugguccauccacgcgaagcacgaguggaugacgaccgaggacaugcugaccguguggaaccgggucuggauccgcgagaaccccuggauggaggacaagacccccguggagagcugggaggagauccccuaccugggcaagcgggaggaccaguggugcgggucccucaucggccugaccagccgcgccacgugggccaagaacauccaggccgcgaucaaccaggugcggucccugaucgggaacgaggaguacaccgacuacaugccgagcaugaagcgcuuccggcgcgaggaggaggaggccggcguccucugguga

SEQ ID NO: 9144 - RNA, 9876 nt, Artificial Sequence
  derived and/or modified CDS sequence (opt1) from DENV-2__GU131899__SS-prME
agcgcgggcaugaucaucaugcugauccccaccgugauggccuuccaccucaccacccggaacggggagccccacaugaucgucggcauccaggagaaggggaagucccugcuguucaagaccgaggacggcgugaacaugugcacccucauggcgauggaccugggggagcugugcgaggacaccaucaccuacaagugcccccuccugcggcagaacgagcccgaggacaucgacugcuggugcaacagcaccagcaccugggugaccuacgggaccugcaccaccaccggcgagcaccgccgggagaagcgcagcgucgcccuggugccccacguggggaugggccucgagacccggaccgagaccuggauguccagcgagggggccuggaagcacgcccagcgcaucgagaccuggauccugcggcacccgggcuucacgaucauggccgcgauccuggccuacaccaucgggaccacccacuuccagcgcguccucaucuucauccugcugacggccguggcccccuccaugaccaugcggugcaucggcaucagcaaccgcgacuucguggagggcgucuccgggggcagcuggguggacaucgugcucgagcacggguccugcgucaccaccauggcgaagaacaagcccacgcuggacuucgagcugaucaagaccgaggccaagcagcccgccacccuccggaaguacugcaucgaggccaagcugaccaacacgaccaccgagagccgcugccccacccagggcgagcccucccugaaggaggagcaggacaagcgguucgugugcaagcacagcaugguggaccgcggcugggggaacggcugcggccuguucggcaagggcgggaucgucacgugcgccauguucacgugcaagaagaacauggagggcaagaucgugcagcccgagaaccuggaguacaccaucguggucacgccccacuccggggaggagcacgcggugggcaacgacacggggaagcacggcaaggagaucaaggugaccccgcagagcuccaucaccgaggccgagcugaccggguacggcaccgucacgauggagugcagcccccggaccggccucgacuucaacgagauggugcugcugcagauggagaacaaggccuggcucgugcaccgccagugguuccuggaccugccccuccccuggcugccgggggccgacaagcaggaguccaacuggauccagaaggagacccuggucaccuucaagaacccccacgccaagaagcaggacguggucgugcucggcagccaggagggggcgaugcacacggcccugaccggcgccaccgagauccagaugagcuccgggaaccuccuguucaccggccaccugaagugccggcugcgcauggacaagcuccagcugaagggcaugagcuacuccaugugcacggggaaguucaagguggucaaggagaucgccgagacccagcacggcaccaucgugauccgggugcaguacgagggggacggcagccccugcaagauccccuucgagaucauggaccuggagaagcgcuacguccucggccggcugaucaccgugaacccgaucgugacggagaaggacucccccgucaacaucgaggccgagccgcccuucggggacagcuacaucaucaucggcguggagccggggcagcugaagcucaacugguucaagaagggcuccagcaucgggcagauguucgagaccaccaugcgcggcgcgaagcgcauggccauccugggcgacaccgccugggacuucgggucccugggcgggguguucacgagcaucggcaaggcccuccaccaggucuucggggccaucuacggcgcggccuucuccggcgugagcuggaccaugaagauccugaucggggugaucaucaccuggaucggcaugaacucccggagcaccucccugagcgucucccuggugcucguggggaucgucacgcuguaccugggcgugauggugcaggccgacagcgggugcgucguguccuggaagaacaaggagcucaagugcggcagcggcaucuucaucaccgacaacgugcacaccuggaccgagcaguacaaguuccagcccgagagccccuccaagcuggccagcgcgauccagaaggcccaggaggaggggaucugcggcauccgcuccgucacgcggcuggagaaccucauguggaagcagaucacccccgagcugaaccacauccuggccgagaacgaggugaagcucaccaucaugaccggggacaucaagggcaucaugcaggccgggaagcgcagccugcggccgcagcccacggagcugaaguacuccuggaagaccuggggcaaggccaagaugcucagcaccgaguccuacaaccagaccuuccugaucgacggccccgagacggcggagugcccgaacaccaaccgcgccuggaacagccuggagguggaggacuacggguucggcgucuucaccaccaacaucuggcucaagcugaaggagaagcaggacgccuucugcgacuccaagcugaugagcgccgccaucaaggacaaccgggcggugcacgccgacaugggguacuggaucgaguccgcccucaacgacacguggaagaucgagaaggccagcuucaucgaggugaagaacugccacuggcccaagucccacacccuguggagcaacggcguccuggaguccgagaugaucauccccaagaaccucgccggccccgugagccagcacaacuaccgcccgggguaccacacccagaucgcgggccccuggcaccuggggaagcuggagauggacuucgacuucugcgacggcaccaccgugaucgucacggaggacugcgggaaccggggccccucccuccgcaccaccaccgccagcggcaagcugaucacggaguggugcugccggagcugcacccugcccccgcuccgcuaccgcggggaggacggcugcugguacgggauggagauccgcccccugaaggagaaggaggagaaccuggugaacucccucgugaccgccggccacgggcaggucgacaacuucagccugggcgugcugggcauggcccucuuccuggaggagaugcugcggacccgcguggggacgaagcacgcgauccuccuggucgccguguccuucgugacccugaucaccggcaacaugagcuucaaggaccucgggcgggucguggugauggucggcgccaccauggccgacgacaucgggaugggcgugacguaccuggcccugcucgcggccuucaaggugcgccccaccuucgccgccggccugcugcuccggaagcugaccuccaaggagcugaugaugaccacgaucgggaucguccuccugagccaguccaccauccccgagaccgugcuggagcucaccgacgcccuggcgcugggcaugauggugcucaagaucguccgcaacauggagaaguaccagcuggccgugacgaucauggccauccugugcgucccgaacgccgugauccuccagaacgccuggaaggugagcugcaccauccuggcggucguguccgugagcccccugcuccugaccuccagccagcagaagaccgacuggaucccccuggcccucacgaucaaggggcugaaccccaccgccaucuuccugaccacccucucccgcacgaacaagaagcggagcuggccgcugaacgaggccaucauggcggucggcaugguguccauccuggccagcucccuccugaagaacgacauccccaugaccggcccccugguggccgggggccuccugaccgucugcuacgugcugaccgggcgcagcgccgaccucgagcuggagcgggccacggacgugaagugggaggaccaggcggagaucuccggcagcagccccauccuguccaucaccaucagcgaggacggguccaugagcaucaagaacgaggaggaggagcagacccucaccauccugauccgcacgggccugcucgucaucuccggccuguucccgaucagcauccccgugaccgccgccgccugguaccugugggaggugaagaagcagcgggccgggguccucugggacgugcccagcccgccgcccaugggcaaggcggagcuggaggacggggccuaccgcaucaagcagaagggcauccugggguacagccagaucggcgccggcguguacaaggaggggaccuuccacaccauguggcacgucacccggggcgccgugcucaugcacaaggggaagcgcaucgagcccuccugggccgacgugaagaaggaccugaucagcuacggcgggggcuggaagcuggagggcgaguggaaggagggggaggagguccaggugcucgcgcuggagcccggcaagaacccccgggccgugcagacgaagcccgggcuguucaagaccaacaccggcaccaucggggccgucucccucgacuucagccccggcacguccggcagccccaucaucgacaagaaggggaagguggugggccuguacgggaacggcgucgugacccgcuccggcgccuacgugagcgccaucgcgcagaccgagaaguccaucgaggacaaccccgagaucgaggacgacaucuuccggaagcgccggcugaccaucauggaccugcaccccggggccggcaagacgaagcgcuaccuccccgccaucguccgggaggccaucaagcgcgggcugcggacccugauccucgcgccgacccgcgugguggccgccgagauggaggaggcccugcggggccugcccauccgcuaccagacccccgccauccgggcggagcacacggggcgcgagaucgucgaccucaugugccacgccaccuucaccaugcgccugcugagccccgugcgggugccgaacuacaaccucaucaucauggacgaggcccacuucaccgaccccgccuccaucgccgcgcgcggcuacaucagcacgcgggucgagaugggcgaggccgccgggaucuucaugaccgccacgccgcccggcagccgcgacccguucccccaguccaacgcccccaucaucgacgaggagcgggagauccccgagcgcagcuggaacuccgggcacgagugggugaccgacuucaagggcaagacggugugguucgucccgagcaucaaggcggggaacgacaucgccgccugccugcggaagaacggcaagaaggugauccagcugucccgcaagaccuucgacagcgaguacgugaagacccggaccaacgacugggacuucgucgugacgaccgacaucuccgagaugggcgccaacuucaaggcggagcgcgugaucgacccccggcgcugcaugaagcccgucauccucaccgacggggaggagcgggugauccuggccggccccaugccggugacccacagcuccgccgcccagcgccgggggcgcaucggccggaaccccaagaacgagaacgaccaguacaucuacaugggggagccccuggagaacgacgaggacugcgcccacuggaaggaggcgaagaugcuccuggacaacaucaacacgcccgagggcaucaucccgagcauguucgagcccgagcgcgagaaggucgacgccaucgacggcgaguaccggcugcgcggggaggcccgcaagaccuucguggaccucaugcggcgcggcgaccugcccguguggcuggccuacaaggucgccgcggaggggaucaacuacgccgaccggcgcuggugcuucgacggcaucaagaacaaccagauccucgaggagaacauggagguggagaucuggaccaaggagggggagcggaagaagcugaagccgcgcuggcuggacgcccggaucuacuccgacccccucgcccugaaggaguucaaggaguucgccgcgggccgcaagagccugacccucaaccugaucacggagaugggccggcugcccaccuucaugacccagaagacccgcgacgcccucgacaaccuggccguccugcacacggccgaggccggcgggcgggccuacaaccacgcccucuccgagcugcccgagacccuggagacccuccugcugcucacccugcuggccacggugaccgggggcaucuuccucuuccugaugagcggccgcgggaucggcaagaugacccuggggaugugcugcaucaucaccgccuccauccuccugugguacgcgcagauccagccgcacuggaucgccgccagcaucauccuggaguucuuccucaucgugcugcugauccccgagcccgagaagcagcggacgccccaggacaaccagcucacguacgucgugaucgccauccugaccguggucgccgcgaccauggccaacgagaugggcuuccuggagaagaccaagaaggaccucgggcugggcuccaucgccacgcagcagccggagagcaacauccuggacaucgaccuccgccccgccuccgccuggacccuguacgcgguggccaccaccuucgugacgcccaugcugcggcacagcaucgagaacagcuccgucaacgugagccucaccgccaucgccaaccaggccaccgugcugaugggccuggggaagggcuggccccucuccaagauggacaucggggucccgcugcuggcgaucggcugcuacagccaggugaaccccaucacccucacggccgcccugcugcuccugguggcccacuacgcgaucaucgggcccggccugcaggccaaggccacccgcgaggcccagaagcgggccgcggccggcaucaugaagaaccccaccgucgacgggaucaccgugaucgaccucgacccgauccccuacgaccccaaguucgagaagcagcugggccaggugaugcugcucauccugugcgucacccaggugcugaugaugcgcaccaccugggcccucugcgaggcccugacccuggccacggggcccaucuccacccucugggagggcaacccggggcgguucuggaacaccaccaucgcggugagcauggccaacaucuuccgcggcuccuaccuggccggcgccgggcuccucuucagcaucaugaagaacacgaccaacacccggcgcggcaccgggaacaugggcgagacgcugggcgagaaguggaagucccgccugaacgcccucgggaaguccgaguuccagaucuacaagcgguccggcauccaggaggucgaccgcacccuggcgaaggaggggaucaagcggggcgagaccgaccaccacgccgugagccgcggguccgccaagcugcggugguucguggagcgcaacauggucacccccgagggcaaggugguggaccucggcugcgggcggggcggguggagcuacuacugcggcgggcugaagaacguccgcgaggugaagggccugacgaagggcgggcccggccacgaggagcccaucccgauguccaccuacggguggaaccucgugcggcugcagagcggcgucgacguguucuucaucccgcccgagaagugcgacacccugcucugcgacaucggggaguccagccccaacccgaccguggaggccggccgcacgcugcggguccugaaccucguggagaacuggcugaacaacaacacccaguucugcaucaaggugcugaaccccuacaugcccuccgucaucgagaagauggaggcgcugcagcgcaaguacggcggggcccucgugcggaacccgcugagccgcaacagcacccacgagauguacuggguguccaacgccagcggcaacaucgucuccagcgugaacaugaucucccggaugcugaucaaccgcuucaccaugcggcacaagaaggccaccuacgagcccgacguggaccucgggagcggcacgcgcaacaucgggaucgaguccgagauccccaaccuggacaucaucggcaagcggaucgagaagaucaagcaggagcacgagaccagcuggcacuacgaccaggaccaccccuacaagaccugggccuaccacggcuccuacgagaccaagcagacggggagcgcguccagcauggucaacggcguggugcgccugcucaccaagccgugggacguccugcccaccgugacccagauggccaugacggacaccacccccuucgggcagcagcgcguguucaaggagaaggucgacacccggacgcaggagcccaaggagggcaccaagaagcugaugaagaucaccgccgaguggcucuggaaggagcugggcaagaagaagaccccgcgcaugugcacgcgggaggaguucacccgcaaggugcgguccaacgccgcccugggggcgaucuucaccgacgagaacaaguggaaguccgcccgcgaggccguggaggacucccgguucugggagcucgucgacaaggagcgcaaccugcaccuggagggcaagugcgagaccugcguguacaacaugauggggaagcgggagaagaagcucggcgaguucgggaaggccaagggcagccgcgccaucugguacauguggcugggcgcgcgguuccuggaguucgaggcccucggguuccugaacgaggaccacugguucucccgcgagaacagccuguccggcgucgagggggagggccuccacaagcugggguacauccugcgggacgugagcaagaaggagggcggcgccauguacgccgacgacacggcggggugggacacccgcaucacccucgaggaccugaagaacgaggagauggugaccaaccacaugaagggcgagcacaagaagcuggccgaggccaucuucaagcucacguaccagaacaaggucgugcgggugcagcgccccacgccccgggggaccgucauggacaucaucagccgccgggaccagcgcggcuccggccagguggggaccuacggccugaacacguucaccaacauggaggcccagcugauccggcagauggagggggagggcguguucaagaacauccagcaccucaccgucaccgaggagguggccgugcagaacuggcuggcgcgcgucgggcgcgagcggcugagccgcauggccaucuccggcgacgacugcguggugaagccccucgacgaccgguucgccaacgcccugacggcccugaacgacaugggcaagauccgcaaggacauccagcagugggagccgagcaagggguggaacgacuggacccagguccccuucugcucccaccacuuccacgagcucaucaugaaggacggccgggugcuggugguccccugccgcaaccaggacgagcugaucgggcgggcgcgcaucagccagggcgccggguggucccuccgggagaccgccugccugggcaagagcuacgcccagauguggucccugauguacuuccaccgccgggaccuccgccuggccgcgaacgccaucugcagcgccgugcccucccacugggugccgaccagccggacgaccugguccauccacgccaagcacgaguggaugaccaccgaggacaugcugaccgucuggaaccgcguguggauccgggagaaccccuggauggaggacaagacgcccguggagagcugggaggagauccccuaccucggcaagcgcgaggaccaguggugcgggucccugaucggccugaccagccgggccaccugggcgaagaacauccaggccgccaucaaccagguccgcucccucaucgggaacgaggaguacaccgacuacaugccgagcaugaagcgguuccgccgcgaggaggaggaggccggcgugcugugguga

SEQ ID NO: 9145 - RNA, 9876 nt, Artificial Sequence
  derived and/or modified CDS sequence (opt1) from DENV-2__GU131900__SS-prME
agcgcgggcaugaucaucaugcugauccccaccgugauggccuuccaccucaccacccgcaacggggagccccacaugaucgucggcauccaggagaaggggaagucccugcuguucaagaccgaggacggcgugaacaugugcacccucauggcgauggaccugggggagcugugcgaggacaccaucaccuacaagugcccccuccugcggcagaacgagcccgaggacaucgacugcuggugcaacagcaccagcaccugggugaccuacgggaccugcaccaccaccggcgagcaccgccgggagaagcgcagcgucgcccuggugccccacguggggaugggccucgagacccggaccgagaccuggauguccagcgagggggccuggaagcacgcccagcgcaucgagaccuggauccugcggcacccgggcuucacgaucauggccgcgauccuggccuacaccaucgggaccacccacuuccagcgcguccucaucuucauccugcugacggccguggcccccuccaugaccaugcggugcaucggcaucagcaaccgcgacuucguggagggcgucuccgggggcagcuggguggacaucgugcucgagcacggguccugcgucaccaccauggcgaagaacaagcccacgcuggacuucgagcugaucaagaccgaggccaagcagcccgccacccuccggaaguacugcaucgaggccaagcugaccaacacgaccaccgagagccgcugccccacccagggcgagcccucccugaaggaggagcaggacaagcgguucgugugcaagcacagcaugguggaccgcggcugggggaacggcugcggccuguucggcaagggcgggaucgucacgugcgccauguucacgugcaagaagaacauggagggcaagaucgugcagcccgagaaccuggaguacaccaucguggucacgccccacuccggggaggagcacgcggugggcaacgacacggggaagcacggcauggagaucaaggugaccccgcagagcuccaucaccgaggccgagcugaccggguacggcaccgucacgauggagugcagcccccggaccggccucgacuucaacgagauggugcugcugcagauggagaacaaggccuggcucgugcaccgccagugguuccuggaccugccccuccccuggcugccgggggccgacaagcaggaguccaacuggauccagaaggagacccuggucaccuucaagaacccccacgccaagaagcaggacguggucgugcucggcagccaggagggggcgaugcacacggcccugaccggcgccaccgagauccagaugagcuccgggaaccuccuguucaccggccaccugaagugccggcugcgcauggacaagcuccagcugaagggcaugagcuacuccaugugcacggggaaguucaagguggucaaggagaucgccgagacccagcacggcaccaucgugauccgggugcaguacgagggggacggcagccccugcaagauccccuucgagaucauggaccuggagaagcgcuacguccucggccggcugaucaccgugaacccgaucgugacggagaaggacucccccgucaacaucgaggccgagccgcccuucggggacagcuacaucaucaucggcguggagccggggcagcugaagcucaacugguucaagaagggcuccagcaucgggcagauguucgagaccaccaugcgcggcgcgaagcgcauggccauccugggcgacaccgccugggacuucgggucccugggcgggguguucacgagcaucggcaaggcccuccaccaggucuucggggccaucuacggcgcggccuucuccggcgugagcuggaccaugaagauccugaucggggugaucaucaccuggaucggcaugaacucccggagcaccucccugagcgucucccuggugcucguggggaucgucacgcuguaccugggcgugauggugcaggccgacagcgggugcgucguguccuggaagaacaaggagcucaagugcggcagcggcaucuucaucaccgacaacgugcacaccuggaccgagcaguacaaguuccagcccgagagccccuccaagcuggccagcgcgauccagaaggcccaggaggaggggaucugcggcauccgcuccgucacgcggcuggagaaccucauguggaagcagaucacccccgagcugaaccacauccuggccgagaacgaggugaagcucaccaucaugaccggggacaucaagggcaucaugcaggccgggaagcgcagccugcggccgcagcccacggagcugaaguacuccuggaagaccuggggcaaggccaagaugcucagcaccgaguccuacaaccagaccuuccugaucgacggccccgagacggcggagugcccgaacaccaaccgcgccuggaacagccuggagguggaggacuacggguucggcgucuucaccaccaacaucuggcucaagcugaaggagaagcaggacgccuucugcgacuccaagcugaugagcgccgccaucaaggacaaccgggcggugcacgccgacaugggguacuggaucgaguccgcccucaacgacacguggaagaucgagaaggccagcuucaucgaggugaagaacugccacuggcccaagucccacacccuguggagcaacggcguccuggaguccgagaugaucauccccaagaaccucgccggccccgugagccagcacaacuaccgcccgggguaccacacccagaucgcgggccccuggcaccuggggaagcuggagauggacuucgacuucugcgacggcaccaccgugaucgucacggaggacugcgggaaccggggccccucccuccgcaccaccaccgccagcggcaagcugaucacggaguggugcugccggagcugcacccugcccccgcuccgcuaccgcggggaggacggcugcugguacgggauggagauccgcccccugaaggagaaggaggagaaccuggugaacucccucgugaccgccggccacgggcaggucgacaacuucagccugggcgugcugggcauggcccucuuccuggaggagaugcugcggacccgcguggggacgaagcacgcgauccuccuggucgccguguccuucgugacccugaucaccggcaacaugagcuucaaggaccucgggcgggucguggugauggucggcgccaccauggccgacgacaucgggaugggcgugacguaccuggcccugcucgcggccuucaaggugcgccccaccuucgccgccggccugcugcuccggaagcugaccuccaaggagcugaugaugaccacgaucgggaucguccuccugagccaguccaccauccccgagaccgugcuggagcucaccgacgcccuggcgcugggcaugauggugcucaagaucguccgcaacauggagaaguaccagcuggccgugacgaucauggccauccugugcgucccgaacgccgugauccuccagaacgccuggaaggugagcugcaccauccuggcggucguguccgugagcccccugcuccugaccuccagccagcagaagaccgacuggaucccccuggcccucacgaucaaggggcugaaccccaccgccaucuuccugaccacccucucccgcacgaacaagaagcggagcuggccgcugaacgaggccaucauggcggucggcaugguguccauccuggccagcucccuccugaaggacgacauccccaugaccggcccccugguggccgggggccuccugaccgucugcuacgugcugaccgggcgcagcgccgaccucgagcuggagcgggccacggacgugaagugggaggaccaggcggagaucuccggcagcagccccauccuguccaucaccaucagcgaggacggguccaugagcaucaagaacgaggaggaggagcagacccucaccauccugauccgcacgggccugcucgucaucuccggccuguucccgaucagcauccccaucaccgccgccgccugguaccugugggaggugaagaagcagcgggccggggugcucugggacguccccagcccgccgcccaugggcaaggcggagcuggaggacggggccuaccgcaucaagcagaagggcauccugggguacagccagaucggcgccggcguguacaaggaggggaccuuccacaccauguggcacgugacccggggcgccguccucaugcacaaggggaagcgcaucgagcccuccugggccgacgugaagaaggaccugaucagcuacggcgggggcuggaagcuggagggcgaguggaaggagggggaggaggugcagguccucgcgcuggagcccggcaagaacccccgggccgugcagacgaagcccgggcuguucaagaccaacaccggcaccaucggggccgugucccucgacuucagccccggcacguccggcagccccaucaucgacaagaaggggaaggucgugggccuguacgggaacggcguggucacccgcuccggcgccuacgugagcgccaucgcgcagaccgagaaguccaucgaggacaaccccgagaucgaggacgacaucuuccggaagcgccggcugaccaucauggaccugcaccccggggccggcaagacgaagcgcuaccuccccgccaucgugcgggaggccaucaagcgcgggcugcggacccugauccucgcgccgacccgcgucguggccgccgagauggaggaggcccugcggggccugcccauccgcuaccagacccccgccauccgggcggagcacacggggcgcgagaucguggaccucaugugccacgccaccuucaccaugcgccugcugagccccguccgggugccgaacuacaaccucaucaucauggacgaggcccacuucaccgaccccgccuccaucgccgcgcgcggcuacaucagcacgcggguggagaugggcgaggccgccgggaucuucaugaccgccacgccgcccggcagccgcgacccguucccccaguccaacgcccccaucaucgacgaggagcgggagauccccgagcgcagcuggaacuccgggcacgagugggucaccgacuucaagggcaagacggugugguucgugccgagcaucaaggcggggaacgacaucgccgccugccugcggaagaacggcaagaaggucauccagcugucccgcaagaccuucgacagcgaguacgugaagacccggaccaacgacugggacuucguggucacgaccgacaucuccgagaugggcgccaacuucaaggcggagcgcgugaucgacccccggcgcugcaugaagcccgugauccucaccgacggggaggagcgggucauccuggccggccccaugccggugacccacagcuccgccgcccagcgccgggggcgcaucggccggaaccccaagaacgagaacgaccaguacaucuacaugggggagccccuggagaacgacgaggacugcgcccacuggaaggaggcgaagaugcuccuggacaacaucaacacgcccgagggcaucaucccgagcauguucgagcccgagcgcgagaagguggacgccaucgacggcgaguaccggcugcgcggggaggcccgcaagaccuucgucgaccucaugcggcgcggcgaccugcccguguggcuggccuacaagguggccgcggaggggaucaacuacgccgaccggcgcuggugcuucgacggcaucaagaacaaccagauccucgaggagaacgucgagguggagaucuggaccaaggagggggagcggaagaagcugaagccgcgcuggcuggacgcccggaucuacuccgacccccucgcccugaaggaguucaaggaguucgccgcgggccgcaagagccugacccucaaccugaucacggagaugggccggcugcccaccuucaugacccagaagacccgcgacgcccucgacaaccuggccguccugcacacggccgaggccggcgggcgggccuacaaccacgcccucuccgagcugcccgagacccuggagacccuccugcugcucacccugcuggccacggugaccgggggcaucuuccucuuccugaugagcggccgcgggaucggcaagaugacccuggggaugugcugcaucaucaccgccuccauccuccugugguacgcgcagauccagccgcacuggaucgccgccagcaucauccuggaguucuuccucaucgugcugcugauccccgagcccgagaagcagcggacgccccaggacaaccagcucacguacgucgugaucgccauccugaccguggucgccgcgaccauggccaacgagaugggcuuccuggagaagaccaagaaggaccucgggcugggcuccaucgccacgcagcagccggagagcaacauccuggacaucgaccuccgccccgccuccgccuggacccuguacgcgguggccaccaccuucgugacgcccaugcugcggcacagcaucgagaacagcuccgucaacgugagccucaccgccaucgccaaccaggccaccgugcugaugggccuggggaagggcuggccccucuccaagauggacaucggggucccgcugcuggcgaucggcugcuacagccaggugaaccccaucacccucacggccgcccugcugcuccugguggcccacuacgcgaucaucgggcccggccugcaggccaaggccacccgcgaggcccagaagcgggccgcggccggcaucaugaagaaccccaccgucgacgggaucaccgugaucgaccucgacccgauccccuacgaccccaaguucgagaagcagcugggccaggugaugcugcucauccugugcgucacccaggugcugaugaugcgcaccaccugggcccucugcgaggcccugacccuggccacggggcccaucuccacccucugggagggcaacccggggcgguucuggaacaccaccaucgcggugagcauggccaacaucuuccgcggcuccuaccuggccggcgccgggcuccucuucagcaucaugaagaacacgaccaacacccggcgcggcaccgggaacaucggcgagacgcugggcgagaaguggaagucccgccugaacgcccucgggaaguccgaguuccagaucuacaagaaguccggcauccaggaggucgaccggacccuggcgaaggaggggaucaagcgcggcgagaccgaccaccacgccgugagccggggguccgccaagcugcgcugguucguggagcggaacauggucacccccgagggcaaggugguggaccucggcugcgggcgcggcggguggagcuacuacugcggcgggcugaagaacguccgggaggugaagggccugacgaagggcgggcccggccacgaggagcccaucccgauguccaccuacggguggaaccucgugcgccugcagagcggcgucgacguguucuucaucccgcccgagaagugcgacacccugcucugcgacaucggggaguccagccccaacccgaccguggaggccggccggacgcugcgcguccugaaccucguggagaacuggcugaacaacaacacccaguucugcaucaaggugcugaaccccuacaugcccuccgucaucgagaagauggaggcgcugcagcggaaguacggcggggcccucgugcgcaacccgcugagccggaacagcacccacgagauguacuggguguccaacgccagcggcaacaucgucuccagcgugaacaugaucucccgcaugcugaucaaccgguucaccaugcgccacaagaaggccaccuacgagcccgacguggaccucgggagcggcacgcggaacaucgggaucgaguccgagauccccaaccuggacaucaucggcaagcgcaucgagaagaucaaggaggagcacgagaccagcuggcacuacgaccaggaccaccccuacaagaccugggccuaccacggcuccuacgagaccaagcagacggggagcgcguccagcauggucaacggcguggugcggcugcucaccaagccgugggacguccugcccaccgugacccagauggccaugacggacaccacccccuucgggcagcagcgcguguucaaggagaaggucgacacccgcacgcaggagcccaaggagggcaccaagaagcugaugaagaucaccgccgaguggcucuggaaggagcugggcaagaagaagaccccgcggaugugcacgcgcgaggaguucacccggaaggugcgcuccaacgccgcccugggggcgaucuucaccgacgagaacaaguggaaguccgcccgggaggccguggaggacucccgcuucugggagcucgucgacaaggagcggaaccugcaccuggagggcaagugcgagaccugcguguacaacaugauggggaagcgcgagaagaagcucggcgaguucgggaaggccaagggcagccgggccaucugguacauguggcugggcgcgcgcuuccuggaguucgaggcccucggguuccugaacgaggaccacugguucucccgggagaacagccuguccggcgucgagggggagggccuccacaagcugggguacauccugcgcgacgugagcaagaaggagggcggcgccauguacgccgacgacacggcggggugggacacccggaucacccucgaggaccugaagaacgaggagauggugaccaaccacauggagggcgagcacaagaagcuggccgaggccaucuucaagcucacguaccagaacaaggucgugcgcgugcagcggcccacgccccgggggaccgucauggacaucaucagccggcgcgaccagcggggcuccggccagguggggaccuacggccugaacacguucaccaacauggaggcccagcugauccgccagauggagggggagggcguguucaagaacauccagcaccucaccgucaccgaggaggccgcggugcagaacuggcuggcccggguggggcgcgagcgccugagccggauggccaucuccggcgacgacugcgucgugaagccccucgacgaccgcuucgccaacgcccugacggcgcugaacgacaugggcaagauccggaaggacauccagcagugggagccgagcaagggguggaacgacuggacccaggugcccuucugcucccaccacuuccacgagcucaucaugaaggacggccgcguccugguggugcccugccggaaccaggacgagcugaucgggcgcgcccggaucagccagggcgccggguggucccuccgcgagaccgccugccugggcaagagcuacgcccagauguggucccugauguacuuccaccggcgcgaccuccggcuggcggccaacgccaucugcagcgccguccccucccacugggugccgaccagccgcacgaccugguccauccacgccaagcacgaguggaugaccaccgaggacaugcugaccguguggaaccgggucuggauccgcgagaaccccuggauggaggacaagacgcccguggagagcugggaggagauccccuaccucggcaagcgggaggaccaguggugcgggucccugaucggccugaccagccgcgcgaccugggccaagaacauccaggccgccaucaaccaggugcggucccucaucgggaacgaggaguacaccgacuacaugccgagcaugaagcgcuuccggcgcgaggaggaggaggcgggcguccugugguga

SEQ ID NO: 9146 - RNA, 9876 nt, Artificial Sequence
  derived and/or modified CDS sequence (opt1) from DENV-2__GU131901__SS-prME
agcgcgggcaugaucaucaugcugauccccaccgugauggccuuccaccucaccacccgcaacggggagccccacaugaucgucggcauccaggagaaggggaagucccugcuguucaagaccgaggacggcgugaacaugugcacccucauggcgauggaccugggggagcugugcgaggacaccaucaccuacaagugcccccuccugcggcagaacgagcccgaggacaucgacugcuggugcaacagcaccagcaccugggugaccuacgggaccugcaccaccaccggcgagcaccgccgggagaagcgcagcgucgcccuggugccccacguggggaugggccucgagacccggaccgagaccuggauguccagcgagggggccuggaagcacgcccagcgcaucgagaccuggauccugcggcacccgggcuucacgaucauggccgcgauccuggccuacaccaucgggaccacccacuuccagcgcguccucaucuucauccugcugacggccguggcccccuccaugaccaugcggugcaucggcaucagcaaccgcgacuucguggagggcgucuccgggggcagcuggguggacaucgugcucgagcacggguccugcgucaccaccauggcgaagaacaagcccacgcuggacuucgagcugaucaagaccgaggccaagcagcccgccacccuccggaaguacugcaucgaggccaagcugaccaacacgaccaccgagagccgcugccccacccagggcgagcccucccugaaggaggagcaggacaagcgguucgugugcaagcacagcaugguggaccgcggcugggggaacggcugcggccuguucggcaagggcgggaucgucacgugcgccauguucacgugcaagaagaacauggagggcaagaucgugcagcccgagaaccuggaguacaccaucguggucacgccccacuccggggaggagcacgcggugggcaacgacacggggaagcacggcauggagaucaaggugaccccgcagagcuccaucaccgaggccgagcugaccggguacggcaccgucacgauggagugcagcccccggaccggccucgacuucaacgagauggugcugcugcagauggagaacaaggccuggcucgugcaccgccagugguuccuggaccugccccuccccuggcugccgggggccgacaagcaggaguccaacuggauccagaaggagacccuggucaccuucaagaacccccacgccaagaagcaggacguggucgugcucggcagccaggagggggcgaugcacacggcccugaccggcgccaccgagauccagaugagcuccgggaaccuccuguucaccggccaccugaagugccggcugcgcauggacaagcuccagcugaagggcaugagcuacuccaugugcacggggaaguucaagguggucaaggagaucgccgagacccagcacggcaccaucgugauccgggugcaguacgagggggacggcagccccugcaagauccccuucgagaucauggaccuggagaagcgcuacguccucggccggcugaucaccgugaacccgaucgugacggagaaggacucccccgucaacaucgaggccgagccgcccuucggggacagcuacaucaucaucggcguggagccggggcagcugaagcucaacugguucaagaagggcuccagcaucgggcagauguucgagaccaccaugcgcggcgcgaagcgcauggccauccugggcgacaccgccugggacuucgggucccugggcgggguguucacgagcaucggcaaggcccuccaccaggucuucggggccaucuacggcgcggccuucuccggcgugagcuggaccaugaagauccugaucggggugaucaucaccuggaucggcaugaacucccggagcaccucccugagcgucucccuggugcucguggggaucgucacgcuguaccugggcgugauggugcaggccgacagcgggugcgucguguccuggaagaacaaggagcucaagugcggcagcggcaucuucaucaccgacaacgugcacaccuggaccgagcaguacaaguuccagcccgagagccccuccaagcuggccagcgcgauccagaaggcccaggaggaggggaucugcggcauccgcuccgucacgcggcuggagaaccucauguggaagcagaucacccccgagcugaaccacauccuggccgagaacgaggugaagcucaccaucaugaccggggacaucaagggcaucaugcaggccgggaagcgcagccugcggccgcagcccacggagcugaaguacuccuggaagaccuggggcaaggccaagaugcucagcaccgaguccuacaaccagaccuuccugaucgacggccccgagacggcggagugcccgaacaccaaccgcgccuggaacagccuggagguggaggacuacggguucggcgucuucaccaccaacaucuggcucaagcugaaggagaagcaggacgccuucugcgacuccaagcugaugagcgccgccaucaaggacaaccgggcggugcacgccgacaugggguacuggaucgaguccgcccucaacgacacguggaagaucgagaaggccagcuucaucgaggugaagaacugccacuggcccaagucccacacccuguggagcaacggcguccuggaguccgagaugaucauccccaagaaccucgccggccccgugagccagcacaacuaccgcccgggguaccacacccagaucgcgggccccuggcaccuggggaagcuggagauggacuucgacuucugcgacggcaccaccgugaucgucacggaggacugcgggaaccggggccccucccuccgcaccaccaccgccagcggcaagcugaucacggaguggugcugccggagcugcacccugcccccgcuccgcuaccgcggggaggacggcugcugguacgggauggagauccgcccccugaaggagaaggaggagaaccuggugaacucccucgugaccgccggccacgggcaggucgacaacuucagccugggcgugcugggcauggcccucuuccuggaggagaugcugcggacccgcguggggacgaagcacgcgauccuccuggucgccguguccuucgugacccugaucaccggcaacaugagcuucaaggaccucgggcgggucguggugauggucggcgccaccauggccgacgacaucgggaugggcgugacguaccuggcccugcucgcggccuucaaggugcgccccaccuucgccgccggccugcugcuccggaagcugaccuccaaggagcugaugaugaccacgaucgggaucguccuccugagccaguccaccauccccgagaccgugcuggagcucaccgacgcccuggcgcugggcaugauggugcucaagaucguccgcaacauggagaaguaccagcuggccgugacgaucauggccauccugugcgucccgaacgccgugauccuccagaacgccuggaaggugagcugcaccauccuggcggucguguccgugagcccccugcuccugaccuccagccagcagaagaccgacuggaucccccuggcccucacgaucaaggggcugaaccccaccgccaucuuccugaccacccucucccgcacgaacaagaagcggagcuggccgcugaacgaggccaucauggcggucggcaugguguccauccuggccagcucccuccugaagaacgacauccccaugaccggcccccugguggccgggggccuccugaccgucugcuacgugcugaccgggcgcagcgccgaccucgagcuggagcgggccacggacgugaagugggaggaccaggcggagaucuccggcagcagccccauccuguccaucaccaucagcgaggacggguccaugagcaucaagaacgaggaggaggagcagacccucaccauccugauccgcacgggccugcucgucaucuccggccuguucccgaucagcauccccaucaccgccgccgccugguaccugugggaggugaagaagcagcgggccggggugcucugggacguccccagcccgccgcccaugggcaaggcggagcuggaggacggggccuaccgcaucaagcagaagggcauccugggguacagccagaucggcgccggcguguacaaggaggggaccuuccacaccauguggcacgugacccggggcgccguccucaugcacaaggggaagcgcaucgagcccuccugggccgacgugaagaaggaccugaucagcuacggcgggggcuggaagcuggagggcgaguggaaggagggggaggaggugcagguccucgcgcuggagcccggcaagaacccccgggccgugcagacgaagcccgggcuguucaagaccaacaccggcaccaucggggccgugucccucgacuucagccccggcacguccggcagccccaucaucgacaagaaggggaaggucgugggccuguacgggaacggcguggucacccgcuccggcgccuacgugagcgccaucgcgcagaccgagaaguccaucgaggacaaccccgagaucgaggacgacaucuuccggaagcgccggcugaccaucauggaccugcaccccggggccggcaagacgaagcgcuaccuccccgccaucgugcgggaggccaucaagcgcgggcugcggacccugauccucgcgccgacccgcgucguggccgccgagauggaggaggcccugcggggccugcccauccgcuaccagacccccgccauccgggcggagcacacggggcgcgagaucguggaccucaugugccacgccaccuucaccaugcgccugcugagccccguccgggugccgaacuacaaccucaucaucauggacgaggcccacuucaccgaccccgccuccaucgccgcgcgcggcuacaucagcacgcggguggagaugggcgaggccgccgggaucuucaugaccgccacgccgcccggcagccgcgacccguucccccaguccaacgcccccaucaucgacgaggagcgggagauccccgagcgcagcuggaacuccgggcacgagugggucaccgacuucaagggcaagacggugugguucgugccgagcaucaaggcggggaacgacaucgccgccugccugcggaagaacggcaagaaggucauccagcugucccgcaagaccuucgacagcgaguacgugaagacccggaccaacgacugggacuucguggucacgaccgacaucuccgagaugggcgccaacuucaaggcggagcgcgugaucgacccccggcgcugcaugaagcccgugauccucaccgacggggaggagcgggucauccuggccggccccaugccggugacccacagcuccgccgcccagcgccgggggcgcaucggccggaaccccaagaacgagaacgaccaguacaucuacaugggggagccccuggagaacgacgaggacugcgcccacuggaaggaggcgaagaugcuccuggacaacaucaacacgcccgagggcaucaucccgagcauguucgagcccgagcgcgagaagguggacgccaucgacggcgaguaccggcugcgcggggaggcccgcaagaccuucgucgaccucaugcggcgcggcgaccugcccguguggcuggccuacaagguggccgcggaggggaucaacuacgccgaccggcgcuggugcuucgacggcaucaagaacaaccagauccucgaggagaacgucgagguggagaucuggaccaaggagggggagcggaagaagcugaagccgcgcuggcuggacgcccggaucuacuccgacccccucgcccugaaggaguucaaggaguucgccgcgggccgcaagagccugacccucaaccugaucacggagaugggccggcugcccaccuucaugacccagaagacccgcgacgcccucgacaaccuggccguccugcacacggccgaggccggcgggcgggccuacaaccacgcccucuccgagcugcccgagacccuggagacccuccugcugcucacccugcuggccacggugaccgggggcaucuuccucuuccugaugagcggccgcgggaucggcaagaugacccuggggaugugcugcaucaucaccgccuccauccuccugugguacgcgcagauccagccgcacuggaucgccgccagcaucauccuggaguucuuccucaucgugcugcugauccccgagcccgagaagcagcggacgccccaggacaaccagcucacguacgucgugaucgccauccugaccguggucgccgcgaccauggccaacgagaugggcuuccuggagaagaccaagaaggaccucgggcugggcuccaucgccacgcagcagccggagagcaacauccuggacaucgaccuccgccccgccuccgccuggacccuguacgcgguggccaccaccuucgugacgcccaugcugcggcacagcaucgagaacagcuccgucaacgugagccucaccgccaucgccaaccaggccaccgugcugaugggccuggggaagggcuggccccucuccaagauggacaucggggucccgcugcuggcgaucggcugcuacagccaggugaaccccaucacccucacggccgcccugcugcuccugguggcccacuacgcgaucaucgggcccggccugcaggccaaggccacccgcgaggcccagaagcgggccgcggccggcaucaugaagaaccccaccgucgacgggaucaccgugaucgaccucgacccgauccccuacgaccccaaguucgagaagcagcugggccaggugaugcugcucauccugugcgucacccaggugcugaugaugcgcaccaccugggcccucugcgaggcccugacccuggccacggggcccaucuccacccucugggagggcaacccggggcgguucuggaacaccaccaucgcggugagcauggccaacaucuuccgcggcuccuaccuggccggcgccgggcuccucuucagcaucaugaagaacacgaccaacacccggcgcggcaccgggaacgucggcgagacgcugggcgagaaguggaagucccgccugaacgcccucgggaaguccgaguuccagaucuacaagaaguccggcauccaggagguggaccggacccuggcgaaggaggggaucaagcgcggcgagaccgaccaccacgccgugagccggggguccgccaagcugcgcugguucgucgagcggaacauggugacccccgagggcaagguggucgaccucggcugcgggcgcggcggguggagcuacuacugcggcgggcugaagaacgugcgggaggugaagggccugacgaagggcgggcccggccacgaggagcccaucccgauguccaccuacggguggaaccucguccgccugcagagcggcguggacguguucuucaucccgcccgagaagugcgacacccugcucugcgacaucggggaguccagccccaacccgaccgucgaggccggccggacgcugcgcgugcugaaccucguggagaacuggcugaacaacaacacccaguucugcaucaagguccugaaccccuacaugcccuccgugaucgagaagauggaggcgcugcagcggaaguacggcggggcccucgugcgcaacccgcugagccggaacagcacccacgagauguacugggucuccaacgccagcggcaacaucguguccagcgugaacaugaucucccgcaugcugaucaaccgguucaccaugcgccacaagaaggccaccuacgagcccgacgucgaccucgggagcggcacgcggaacaucgggaucgaguccgagauccccaaccuggacaucaucggcaagcgcaucgagaagaucaaggaggagcacgagaccagcuggcacuacgaccaggaccaccccuacaagaccugggccuaccacggcuccuacgagaccaagcagacggggagcgcguccagcauggugaacggcgugguccggcugcucaccaagccgugggacgugcugcccaccgugacccagauggccaugacggacaccacccccuucgggcagcagcgcgucuucaaggagaagguggacacccgcacgcaggagcccaaggagggcaccaagaagcugaugaagaucaccgccgaguggcucuggaaggagcugggcaagaagaagaccccgcggaugugcacgcgcgaggaguucacccggaaggugcgcuccaacgccgcccugggggcgaucuucaccgacgagaacaaguggaaguccgcccgggaggccgucgaggacucccgcuucugggagcucguggacaaggagcggaaccugcaccuggagggcaagugcgagaccugcgucuacaacaugauggggaagcgcgagaagaagcucggcgaguucgggaaggccaagggcagccgggccaucugguacauguggcugggcgcgcgcuuccuggaguucgaggcccucggguuccugaacgaggaccacugguucucccgggagaacagccuguccggcguggagggggagggccuccacaagcugggguacauccugcgcgacgugagcaagaaggagggcggcgccauguacgccgacgacacggcggggugggacacccggaucacccucgaggaccugaagaacgaggagauggucaccaaccacauggagggcgagcacaagaagcuggccgaggccaucuucaagcucacguaccagaacaagguggugcgcguccagcggcccacgccccgggggaccgugauggacaucaucagccggcgcgaccagcggggcuccggccagguggggaccuacggccugaacacguucaccaacauggaggcccagcugauccgccagauggagggggagggcgucuucaagaacauccagcaccucaccgugaccgaggaggccgcggugcagaacuggcuggcccgggucgggcgcgagcgccugagccggauggccaucuccggcgacgacugcguggugaagccccucgacgaccgcuucgccaacgcccugacggcgcugaacgacaugggcaagauccggaaggacauccagcagugggagccgagcaagggguggaacgacuggacccagguccccuucugcucccaccacuuccacgagcucaucaugaaggacggccgcgugcuggugguccccugccggaaccaggacgagcugaucgggcgcgcccggaucagccagggcgccggguggucccuccgcgagaccgccugccugggcaagagcuacgcccagauguggucccugauguacuuccaccggcgcgaccuccggcuggcggccaacgccaucugcagcgccgugcccucccacugggugccgaccagccgcacgaccugguccauccacgccaagcacgaguggaugaccaccgaggacaugcugaccgucuggaaccggguguggauccgcgagaaccccuggauggaggacaagacgcccguggagagcugggaggagauccccuaccucggcaagcgggaggaccaguggugcgggucccugaucggccugaccagccgcgcgaccugggccaagaacauccaggccgccaucaaccagguccggucccucaucgggaacgaggaguacaccgacuacaugccgagcaugaagcgcuuccggcgcgaggaggaggaggcgggcgugcugugguga

SEQ ID NO: 9147 - RNA, 9876 nt, Artificial Sequence
  derived and/or modified CDS sequence (opt1) from DENV-2__GU131902__SS-prME
agcgcgggcaugaucaucaugcugauccccaccgugauggccuuccaccucaccacccggaacggggagccccacaugaucgucggcauccaggagaagggcaagagccugcuguucaagaccgaggacggggugaacaugugcacccucauggcgauggaccugggggagcugugcgaggacaccaucaccuacaagugcccccuccugcggcagaacgagcccgaggacaucgacugcuggugcaacagcaccuccaccugggugaccuacggcacgugcaccaccaccggcgagcaccgccgggagaagcgcagcgucgcccuggugccccacguggggaugggccucgagacgcggaccgagaccuggauguccagcgagggggccuggaagcacgcccagcgcaucgagaccuggauccugcggcacccgggcuucacgaucauggccgcgauccuggccuacaccaucgggaccacccacuuccagcgcguccucaucuucauccugcugacggccguggcccccuccaugaccaugcggugcaucggcaucagcaaccgcgacuucguggagggcgucuccgggggcagcuggguggacaucgugcucgagcacggguccugcgucaccaccauggcgaagaacaagcccacgcuggacuucgagcugaucaagaccgaggccaagcagcccgccacccuccggaaguacugcaucgaggccaagcugaccaacacgaccaccgagagccgcugccccacccagggcgagcccucccugaaggaggagcaggacaagcgguucgugugcaagcacagcaugguggaccgcggcugggggaacggcugcggccuguucggcaagggcgggaucgucacgugcgccauguucacgugcaagaagaacauggagggcaagaucgugcagcccgagaaccuggaguacaccaucguggucacgccccacuccggggaggagcacgcggugggcaacgacacggggaagcacggcauggagaucaaggugaccccgcagagcuccaucaccgaggccgagcugaccggguacggcaccgucacgauggagugcagcccccggaccggccucgacuucaacgagauggugcugcugcagauggagaacaaggccuggcucgugcaccgccagugguuccuggaccugccccuccccuggcugccgggggccgacaagcaggaguccaacuggauccagaaggagacccuggucaccuucaagaacccccacgccaagaagcaggacguggucgugcucggcagccaggagggggcgaugcacacggcccugaccggcgccaccgagauccagaugagcuccgggaaccuccuguucaccggccaccugaagugccggcugcgcauggacaagcuccagcugaagggcaugagcuacuccaugugcacggggaaguucaagguggucaaggagaucgccgagacccagcacggcaccaucgugauccgggugcaguacgagggggacggcagccccugcaagauccccuucgagaucauggaccuggagaagcgcuacguccucggccggcugaucaccgugaacccgaucgugacggagaaggacucccccgucaacaucgaggccgagccgcccuucggggacagcuacaucaucaucggcguggagccggggcagcugaagcucaacugguucaagaagggcuccagcaucgggcagauguucgagaccaccaugcgcggcgcgaagcgcauggccauccugggcgacaccgccugggacuucgggucccugggcgggguguucacgagcaucggcaaggcccuccaccaggucuucggggccaucuacggcgcggccuucuccggcgugagcuggaccaugaagauccugaucggggugaucaucaccuggaucggcaugaacucccggagcaccucccugagcgucucccuggugcucguggggaucgucacgcuguaccugggcgugauggugcaggccgacagcgggugcgucguguccuggaagaacaaggagcucaagugcggcagcggcaucuucaucaccgacaacgugcacaccuggaccgagcaguacaaguuccagcccgagagccccuccaagcuggccagcgcgauccagaaggcccaggaggaggggaucugcggcauccgcuccgucacgcggcuggagaaccucauguggaagcagaucacccccgagcugaaccacauccuggccgagaacgaggugaagcucaccaucaugaccggggacaucaagggcaucaugcaggccgggaagcgcagccugcggccgcagcccacggagcugaaguacuccuggaagaccuggggcaaggccaagaugcucagcaccgaguccuacaaccagaccuuccugaucgacggccccgagacggcggagugcccgaacaccaaccgcgccuggaacagccuggagguggaggacuacggguucggcgucuucaccaccaacaucuggcucaagcugaaggagaagcaggacgccuucugcgacuccaagcugaugagcgccgccaucaaggacaaccgggcggugcacgccgacaugggguacuggaucgaguccgcccucaacgacacguggaagaucgagaaggccagcuucaucgaggugaagaacugccacuggcccaagucccacacccuguggagcaacggcguccuggaguccgagaugaucauccccaagaaccucgccggccccgugagccagcacaacuaccgcccgggguaccacacccagaucgcgggccccuggcaccuggggaagcuggagauggacuucgacuucugcgacggcaccaccgugaucgucacggaggacugcgggaaccggggccccucccuccgcaccaccaccgccagcggcaagcugaucgccgaguggugcugccggagcugcacgcugcccccgcuccgcuaccgcggggaggacggcugcugguacgggauggagauccgcccccugaaggagaaggaggagaaccuggugaacucccucgugaccgccggccacgggcaggucgacaacuucagccugggcgugcugggcauggcccucuuccuggaggagaugcugcggacccgcguggggaccaagcacgccauccuccuggucgccguguccuucgugacgcugaucaccggcaacaugagcuucaaggaccucgggcgggucguggugauggucggcgccaccauggccgacgacaucgggaugggcgugaccuaccuggcgcugcucgccgccuucaaggugcgccccacguucgccgccggccugcugcuccggaagcugaccuccaaggagcugaugaugaccaccaucgggaucguccuccugagccaguccacgauccccgagaccgugcuggagcucaccgacgcgcuggcccugggcaugauggugcucaagaucguccgcaacauggagaaguaccagcuggccgugaccaucauggccauccugugcgucccgaacgccgugauccuccagaacgcguggaaggugagcugcacgauccuggccgucguguccgugagcccccugcuccugaccuccagccagcagaagaccgacuggaucccccuggcccucaccaucaaggggcugaaccccacggccaucuuccugaccacccucucccgcaccaacaagaagcggagcuggccgcugaacgaggcgaucauggccgucggcaugguguccauccuggccagcucccuccugaagaacgacauccccaugacgggcccccugguggccgggggccuccugaccgucugcuacgugcugaccgggcgcagcgccgaccucgagcuggagcgggcgaccgacgugaagugggaggaccaggccgagaucuccggcagcagccccauccuguccaucacgaucagcgaggacggguccaugagcaucaagaacgaggaggaggagcagacccucaccauccugauccgcaccggccugcucgucaucuccggccuguucccgaucagcauccccaucacggccgccgccugguaccugugggaggugaagaagcagcgggcgggggugcucugggacguccccagcccgccgcccaugggcaaggccgagcuggaggacggggccuaccgcaucaagcagaagggcauccugggguacagccagaucggcgccggcguguacaaggaggggaccuuccacaccauguggcacgugacccggggcgccguccucaugcacaaggggaagcgcaucgagcccuccugggcggacgugaagaaggaccugaucagcuacggcgggggcuggaagcuggagggcgaguggaaggagggggaggaggugcagguccucgcccuggagcccggcaagaacccccgggccgugcagaccaagcccgggcuguucaagacgaacaccggcaccaucggggccgugucccucgacuucagccccggcaccuccggcagccccaucaucgacaagaaggggaaggucgugggccuguacgggaacggcguggucacgcgcuccggcgccuacgugagcgcgaucgcccagaccgagaaguccaucgaggacaaccccgagaucgaggacgacaucuuccggaagcgccggcugaccaucauggaccugcaccccggggccggcaagaccaagcgcuaccuccccgccaucgugcgggaggcgaucaagcgcgggcugcggacgcugauccucgccccgacccgcgucguggccgccgagauggaggaggcccugcggggccugcccauccgcuaccagacccccgcgauccgggccgagcacaccgggcgcgagaucguggaccucaugugccacgccacguucaccaugcgccugcugagccccguccgggugccgaacuacaaccucaucaucauggacgaggcccacuucaccgaccccgccuccaucgcggcccgcggcuacaucagcacccggguggagaugggcgaggccgccgggaucuucaugacggccacgccgcccggcagccgcgacccguucccccaguccaacgcgcccaucaucgacgaggagcgggagauccccgagcgcagcuggaacuccgggcacgagugggucaccgacuucaagggcaagaccgugugguucgugccgagcaucaaggccgggaacgacaucgccgccugccugcggaagaacggcaagaaggucauccagcugucccgcaagacguucgacagcgaguacgugaagacccggaccaacgacugggacuucguggucaccacggacaucuccgagaugggcgcgaacuucaaggccgagcgcgugaucgacccccggcgcugcaugaagcccgugauccucaccgacggggaggagcgggucauccuggccggccccaugccggugacccacagcuccgccgcccagcgccgggggcgcaucggccggaaccccaagaacgagaacgaccaguacaucuacaugggggagccccuggagaacgacgaggacugcgcgcacuggaaggaggccaagaugcuccuggacaacaucaacacccccgagggcaucaucccgagcauguucgagcccgagcgcgagaagguggacgccaucgacggcgaguaccggcugcgcggggaggcccgcaagacguucgucgaccucaugcggcgcggcgaccugcccguguggcuggccuacaagguggcggccgaggggaucaacuacgccgaccggcgcuggugcuucgacggcaucaagaacaaccagauccucgaggagaacgucgagguggagaucuggaccaaggagggggagcggaagaagcugaagccgcgcuggcuggacgcccggaucuacuccgacccccucgcccugaaggaguucaaggaguucgcggccggccgcaagagccugacccucaaccugaucaccgagaugggccggcugcccacguucaugacccagaagacccgcgacgcccucgacaaccuggccguccugcacaccgcggaggccgggggccgggccuacaaccacgcccucuccgagcugcccgagacgcuggagacccuccugcugcucacccugcuggccaccgugaccggcgggaucuuccucuuccugaugagcgggcgcgggaucggcaagaugacccuggggaugugcugcaucaucaccgcguccauccuccugugguacgcccagauccagccgcacuggaucgccgccagcaucauccuggaguucuuccucaucgugcugcugauccccgagcccgagaagcagcggacgccccaggacaaccagcucaccuacgucgugaucgccauccugacgguggucgcggccaccauggccaacgagaugggcuuccuggagaagaccaagaaggaccucgggcugggcuccaucgccacccagcagccggagagcaacauccuggacaucgaccuccgccccgccuccgcguggacgcuguacgccguggccaccaccuucgugacccccaugcugcggcacagcaucgagaacagcuccgucaacgugagccucacggccaucgccaaccaggcgaccgugcugaugggccuggggaagggcuggccccucuccaagauggacaucggggucccgcugcuggccaucggcugcuacagccaggugaaccccaucacccucaccgccgcccugcugcuccugguggcgcacuacgccaucaucgggcccggccugcaggccaaggccacgcgcgaggcccagaagcgggcggccgccggcaucaugaagaaccccaccgucgacgggaucaccgugaucgaccucgacccgauccccuacgaccccaaguucgagaagcagcugggccaggugaugcugcucauccugugcgucacccaggugcugaugaugcgcacgaccugggcccucugcgaggcccugacccuggcgaccgggcccaucuccacgcucugggagggcaacccggggcgguucuggaacaccaccaucgccgugagcauggccaacaucuuccgcggcuccuaccuggccggcgccgggcuccucuucagcaucaugaagaacaccacgaacacccggcgcggcaccgggaacaucggcgagacccugggcgagaaguggaagucccgccugaacgcgcucgggaaguccgaguuccagaucuacaagaaguccggcauccaggaggucgaccggacgcuggccaaggaggggaucaagcgcggcgagaccgaccaccacgccgugagccggggguccgccaagcugcgcugguucguggagcggaacauggucacccccgagggcaaggugguggaccucggcugcgggcgcggcggguggagcuacuacugcggcgggcugaagaacguccgggaggugaagggccugaccaagggcgggcccggccacgaggagcccaucccgauguccacguacggguggaaccucgugcgccugcagagcggcgucgacguguucuucaucccgcccgagaagugcgacacccugcucugcgacaucggggaguccagccccaacccgaccguggaggcgggccggacccugcgcguccugaaccucguggagaacuggcugaacaacaacacgcaguucugcaucaaggugcugaaccccuacaugcccuccgucaucgagaagauggaggcccugcagcggaaguacggcggggcccucgugcgcaacccgcugagccggaacagcacccacgagauguacuggguguccaacgccagcggcaacaucgucuccagcgugaacaugaucucccgcaugcugaucaaccgguucaccaugcgccacaagaaggccaccuacgagcccgacguggaccucgggagcggcacccggaacaucgggaucgaguccgagauccccaaccuggacaucaucggcaagcgcaucgagaagaucaaggaggagcacgagacgagcuggcacuacgaccaggaccaccccuacaagaccugggcguaccacggcuccuacgagaccaagcagaccgggagcgccuccagcauggucaacggcguggugcggcugcucacgaagccgugggacguccugcccaccgugacccagauggccaugaccgacacgacccccuucgggcagcagcgcguguucaaggagaaggucgacacccgcacccaggagcccaaggagggcacgaagaagcugaugaagaucaccgccgaguggcucuggaaggagcugggcaagaagaagaccccgcggaugugcacccgcgaggaguucacgcggaaggugcgcuccaacgccgcgcugggggccaucuucaccgacgagaacaaguggaaguccgcccgggaggccguggaggacucccgcuucugggagcucgucgacaaggagcggaaccugcaccuggagggcaagugcgagaccugcguguacaacaugauggggaagcgcgagaagaagcucggcgaguucgggaaggccaagggcagccgggcgaucugguacauguggcugggcgcccgcuuccuggaguucgaggcccucggguuccugaacgaggaccacugguucucccgggagaacagccuguccggcgucgagggggagggccuccacaagcugggguacauccugcgcgacgugagcaagaaggagggcggcgccauguacgcggacgacaccgccgggugggacacgcggaucacccucgaggaccugaagaacgaggagauggugaccaaccacauggagggcgagcacaagaagcuggccgaggccaucuucaagcucaccuaccagaacaaggucgugcgcgugcagcggcccacgccccgcgggaccgucauggacaucaucagccggcgcgaccagcggggcuccggccagguggggaccuacggccugaacaccuucacgaacauggaggcccagcugauccgccagauggagggggagggcguguucaagaacauccagcaccucaccgucaccgaggaggcggccgugcagaacuggcuggcccggguggggcgcgagcgccugagccggauggccaucuccggcgacgacugcgucgugaagccccucgacgaccgcuucgccaacgcgcugaccgcccugaacgacaugggcaagauccggaaggacauccagcagugggagccgagcaagggguggaacgacuggacccaggugcccuucugcucccaccacuuccacgagcucaucaugaaggacggccgcguccugguggugcccugccggaaccaggacgagcugaucgggcgcgcccggaucagccagggcgccggguggucccuccgcgagaccgccugccugggcaagagcuacgcgcagauguggucccugauguacuuccaccggcgcgaccuccggcuggccgccaacgccaucugcagcgccguccccucccacugggugccgaccagccgcaccacgugguccauccacgcgaagcacgaguggaugaccaccgaggacaugcugaccguguggaaccgggucuggauccgcgagaaccccuggauggaggacaagacccccguggagagcugggaggagauccccuaccucggcaagcgggaggaccaguggugcgggucccugaucggccugacgagccgcgccaccugggccaagaacauccaggccgcgaucaaccaggugcggucccucaucgggaacgaggaguacaccgacuacaugccgagcaugaagcgcuuccggcgcgaggaggaggaggccggcguccugugguga

SEQ ID NO: 9148 - RNA, 9876 nt, Artificial Sequence
  derived and/or modified CDS sequence (opt1) from DENV-2__GU131924__SS-prME
agcgcgggcaugaucaucaugcugauccccaccgugauggccuuccaccucaccacccgcaacggggagccccacaugaucgucggcauccaggagaaggggaagucccugcuguucaagaccgaggacggcgugaacaugugcacccucauggcgauggaccugggggagcugugcgaggacaccaucaccuacaagugcccccuccugcggcagaacgagcccgaggacaucgacugcuggugcaacagcaccagcaccugggugaccuacgggaccugcaccaccaccggcgagcaccgccgggagaagcgcagcgucgcccuggugccccacguggggaugggccucgagacccggaccgagaccuggauguccagcgagggggccuggaagcacgcccagcgcaucgagaccuggauccugcggcacccgggcuucacgaucauggccgcgauccuggccuacaccaucgggaccacccacuuccagcgcguccucaucuucauccugcugacggccguggcccccuccaugaccaugcggugcaucggcaucagcaaccgcgacuucguggagggcgucuccgggggcagcuggguggacaucgugcucgagcacggguccugcgucaccaccauggcgaagaacaagcccacgcuggacuucgagcugaucaagaccgaggccaagcagcccgccacccuccggaaguacugcaucgaggccaagcugaccaacacgaccaccgagagccgcugccccacccagggcgagcccucccugaaggaggagcaggacaagcgguucgugugcaagcacagcaugguggaccgcggcugggggaacggcugcggccuguucggcaagggcgggaucgucacgugcgccauguucacgugcaagaagaacauggagggcaagaucgugcagcccgagaaccuggaguacaccaucguggucacgccccacuccggggaggagcacgcggugggcaacgacacggggaagcacggcauggagaucaaggugaccccgcagagcuccaucaccgaggccgagcugaccggguacggcaccgucacgauggagugcagcccccggaccggccucgacuucaacgagauggugcugcugcagauggagaacaaggccuggcucgugcaccgccagugguuccuggaccugccccuccccuggcugccgggggccgacaagcaggaguccaacuggauccagaaggagacccuggucaccuucaagaacccccacgccaagaagcaggacguggucgugcucggcagccaggagggggcgaugcacacggcccugaccggcgccaccgagauccagaugagcuccgggaaccuccuguucaccggccaccugaagugccggcugcgcauggacaagcuccagcugaagggcaugagcuacuccaugugcacggggaaguucaagguggucaaggagaucgccgagacccagcacggcaccaucgugauccgggugcaguacgagggggacggcagccccugcaagauccccuucgagaucauggaccuggagaagcgcuacguccucggccggcugaucaccgugaacccgaucgugacggagaaggacucccccgucaacaucgaggccgagccgcccuucggggacagcuacaucaucaucggcguggagccggggcagcugaagcucaacugguucaagaagggcuccagcaucgggcagauguucgagaccaccaugcgcggcgcgaagcgcauggccauccugggcgacaccgccugggacuucgggucccugggcgggguguucacgagcaucggcaaggcccuccaccaggucuucggggccaucuacggcgcggccuucuccggcgugagcuggaccaugaagauccugaucggggugaucaucaccuggaucggcaugaacucccggagcaccucccugagcgucucccuggugcucguggggaucgucacgcuguaccugggcgugauggugcaggccgacagcgggugcgucguguccuggaagaacaaggagcucaagugcggcagcggcaucuucaucaccgacaacgugcacaccuggaccgagcaguacaaguuccagcccgagagccccuccaagcuggccagcgcgauccagaaggcccaggaggaggggaucugcggcauccgcuccgucacgcggcuggagaaccucauguggaagcagaucacccccgagcugaaccacauccuggccgagaacgaggugaagcucaccaucaugaccggggacaucaagggcaucaugcaggccgggaagcgcagccugcggccgcagcccacggagcugaaguacuccuggaagaccuggggcaaggccaagaugcucagcaccgaguccuacaaccagaccuuccugaucgacggccccgagacggcggagugcccgaacaccaaccgcgccuggaacagccuggagguggaggacuacggguucggcgucuucaccaccaacaucuggcucaagcugaaggagaagcaggacgccuucugcgacuccaagcugaugagcgccgccaucaaggacaaccgggcggugcacgccgacaugggguacuggaucgaguccgcccucaacgacacguggaagaucgagaaggccagcuucaucgaggugaagaacugccacuggcccaagucccacacccuguggagcaacggcguccuggaguccgagaugaucauccccaagaaccucgccggccccgugagccagcacaacuaccgcccgggguaccacacccagaucgcgggccccuggcaccuggggaagcuggagauggacuucgacuucugcgacggcaccaccgugaucgucacggaggacugcgggaaccggggccccucccuccgcaccaccaccgccagcggcaagcugaucacggaguggugcugccggagcugcacccugcccccgcuccgcuaccgcggggaggacggcugcugguacgggauggagauccgcccccugaaggagaaggaggagaaccuggugaacucccucgugaccgccggccacgggcaggucgacaacuucagccugggcgugcugggcauggcccucuuccuggaggagaugcugcggacccgcguggggacgaagcacgcgauccuccuggucgccguguccuucgugacccugaucaccggcaacaugagcuucaaggaccucgggcgggucguggugauggucggcgccaccauggccgacgacaucgggaugggcgugacguaccuggcccugcucgcggccuucaaggugcgccccaccuucgccgccggccugcugcuccggaagcugaccuccaaggagcugaugaugaccacgaucgggaucguccuccugagccaguccaccauccccgagaccgugcuggagcucaccgacgcccuggcgcugggcaugauggugcucaagaucguccgcaacauggagaaguaccagcuggccgugacgaucauggccauccugugcgucccgaacgccgugauccuccagaacgccuggaaggugagcugcaccauccuggcggucguguccgugagcccccugcuccugaccuccagccagcagaagaccgacuggaucccccuggcccucacgaucaaggggcugaaccccaccgccaucuuccugaccacccucucccgcacgaacaagaagcggagcuggccgcugaacgaggccaucauggcggucggcaugguguccauccuggccagcucccuccugaagaacgacauccccaugaccggcccccugguggccgggggccuccugaccgucugcuacgugcugaccgggcgcagcgccgaccucgagcuggagcgggccacggacgugaagugggaggaccaggcggagaucuccggcagcagccccauccuguccaucaccaucagcgaggacggguccaugagcaucaagaacgaggaggaggagcagacccucaccauccugauccgcacgggccugcucgucaucuccggccuguucccgaucagcauccccaucaccgccgccgccugguaccugugggaggugaagaagcagcgggccggggugcucugggacguccccagcccgccgcccaugggcaaggcggagcuggaggacggggccuaccgcaucaagcagaagggcauccugggguacagccagaucggcgccggcguguacaaggaggggaccuuccacaccauguggcacgugacccggggcgccguccucaugcacaaggggaagcgcaucgagcccuccugggccgacgugaagaaggaccugaucagcuacggcgggggcuggaagcuggagggcgaguggaaggagggggaggaggugcagguccucgcgcuggagcccggcaagaacccccgggccgugcagacgaagcccgggcuguucaagaccaacaccggcaccaucggggccgugucccucgacuucagccccggcacguccggcagccccaucaucgacaagaaggggaaggucgugggccuguacgggaacggcguggucacccgcuccggcgccuacgugagcgccaucgcgcagaccgagaaguccaucgaggacaaccccgagaucgaggacgacaucuuccggaagcgccggcugaccaucauggaccugcaccccggggccggcaagacgaagcgcuaccuccccgccaucgugcgggaggccaucaagcgcgggcugcggacccugauccucgcgccgacccgcgucguggccgccgagauggaggaggcccugcggggccugcccauccgcuaccagacccccgccauccgggcggagcacacggggcgcgagaucguggaccucaugugccacgccaccuucaccaugcgccugcugagccccguccgggugccgaacuacaaccucaucaucauggacgaggcccacuucaccgaccccgccuccaucgccgcgcgcggcuacaucagcacgcggguggagaugggcgaggccgccgggaucuucaugaccgccacgccgcccggcagccgcgacccguucccccaguccaacgcccccaucaucgacgaggagcgggagauccccgagcgcagcuggaacuccgggcacgagugggucaccgacuucaagggcaagacggugugguucgugccgagcaucaaggcggggaacgacaucgccgccugccugcggaagaacggcaagaaggucauccagcugucccgcaagaccuucgacagcgaguacgugaagacccggaccaacgacugggacuucguggucacgaccgacaucuccgagaugggcgccaacuucaaggcggagcgcgugaucgacccccggcgcugcaugaagcccgugauccucaccgacggggaggagcgggucauccuggccggccccaugccggugacccacagcuccgccgcccagcgccgggggcgcaucggccggaaccccaagaacgagaacgaccaguacaucuacaugggggagccccuggagaacgacgaggacugcgcccacuggaaggaggcgaagaugcuccuggacaacaucaacacgcccgagggcaucaucccgagcauguucgagcccgagcgcgagaagguggacgccaucgacggcgaguaccggcugcgcggggaggcccgcaagaccuucgucgaccucaugcggcgcggcgaccugcccguguggcuggccuacaagguggccgcggaggggaucaacuacgccgaccggcgcuggugcuucgacggcaucaagaacaaccagauccucgaggagaacgucgagguggagaucuggaccaaggagggggagcggaagaagcugaagccgcgcuggcuggacgcccggaucuacuccgacccccucgcccugaaggaguucaaggaguucgccgcgggccgcaagagccugacccucaaccugaucacggagaugggccggcugcccaccuucaugacccagaagacccgcgacgcccucgacaaccuggccguccugcacacggccgaggccggcgggcgggccuacaaccacgcccucuccgagcugcccgagacccuggagacccuccugcugcucacccugcuggccacggugaccgggggcaucuuccucuuccugaugagcggccgcgggaucggcaagaugacccuggggaugugcugcaucaucaccgccuccauccuccugugguacgcgcagauccagccgcacuggaucgccgccagcaucauccuggaguucuuccucaucgugcugcugauccccgagcccgagaagcagcggacgccccaggacaaccagcucacguacgucgugaucgccauccugaccguggucgccgcgaccauggccaacgagaugggcuuccuggagaagaccaagaaggaccucgggcugggcuccaucgccacgcagcagccggagagcaacauccuggacaucgaccuccgccccgccuccgccuggacccuguacgcgguggccaccaccuucgugacgcccaugcugcggcacagcaucgagaacagcuccgucaacgugagccucaccgccaucgccaaccaggccaccgugcugaugggccuggggaagggcuggccccucuccaagauggacaucggggucccgcugcuggcgaucggcugcuacagccaggugaaccccaucacccucacggccgcccugcugcuccugguggcccacuacgcgaucaucgggcccggccugcaggccaaggccacccgcgaggcccagaagcgggccgcggccggcaucaugaagaaccccaccgucgacgggaucaccgugaucgaccucgacccgauccccuacgaccccaaguucgagaagcagcugggccaggugaugcugcucauccugugcgucacccaggugcugaugaugcgcaccaccugggcccucugcgaggcccugacccuggccacggggcccaucuccacccucugggagggcaacccggggcgguucuggaacaccaccaucgcggugagcauggccaacaucuuccgcggcuccuaccuggccggcgccgggcuccucuucagcaucaagaagaacacgaccaacacccggcgcggcaccgggaacaucggcgagacgcugggcgagaaguggaagucccgccugaacgcccucgggaaguccgaguuccagaucuacaagaaguccggcauccaggaggucgaccggacccuggcgaaggaggggaucaagcgcggcgagaccgaccaccacgccgugagccggggguccgccaagcugcgcugguucguggagcggaacauggucacccccgagggcaaggugguggaccucggcugcgggcgcggcggguggagcuacuacugcggcgggcugaagaacguccgggaggugaagggccugacgaagggcgggcccggccacgaggagcccaucccgauguccaccuacggguggaaccucgugcgccugcagagcggcgucgacguguucuucaucccgcccgagaagugcgacacccugcucugcgacaucggggaguccagccccaacccgaccguggaggccggccggacgcugcgcguccugaaccucguggagaacuggcugaacaacaacacccaguucugcaucaaggugcugaaccccuacaugcccuccgucaucgagaagauggaggcgcugcagcggaaguacggcggggcccucgugcgcaacccgcugagccggaacagcacccacgagauguacuggguguccaacgccagcggcaacaucgucuccagcgugaacaugaucucccgcaugcugaucaaccgguucaccaugcgccacaagaaggccaccuacgagcccgacguggaccucgggagcggcacgcggaacaucgggaucgaguccgagauccccaaccuggacaucaucggcaagcgcaucgagaagaucaaggaggagcacgagaccagcuggcacuacgaccaggaccaccccuacaagaccugggccuaccacggcuccuacgagaccaagcagacggggagcgcguccagcauggucaacggcguggugcggcugcucaccaagccgugggacguccugcccaccgugacccagauggccaugacggacaccacccccuucgggcagcagcgcguguucaaggagaaggucgacacccgcacgcaggagcccaaggagggcaccaagaagcugaugaagaucaccgccgaguggcucuggaaggagcugggcaagaagaagaccccgcggaugugcacgcgcgaggaguucacccggaaggugcgcuccaacgccgcccugggggcgaucuucaccgacgagaacaaguggaaguccgcccgggaggccguggaggacucccgcuucugggagcucgucgacaaggagcggaaccugcaccuggagggcaagugcgagaccugcguguacaacaugauggggaagcgcgagaagaagcucggcgaguucgggaaggccaagggcagccgggccaucugguacauguggcugggcgcgcgcuuccuggaguucgaggcccucggguuccugaacgaggaccacugguucucccgggagaacagccuguccggcgucgagggggagggccuccacaagcugggguacauccugcgcgacgugagcaagaaggagggcggcgccauguacgccgacgacacggcggggugggacacccggaucacccucgaggaccugaagaacgaggagaucgugaccaaccacauggagggcgagcacaagaagcuggccgaggccaucuucaagcucacguaccagaacaaggucgugcgcgugcagcggcccacgccccgggggaccgucauggacaucaucagccggcgcgaccagcggggcuccggccagguggggaccuacggccugaacacguucaccaacauggaggcccagcugauccgccagauggagggggagggcguguucaagaacauccagcaccucaccgucaccgaggaggccgcggugcagaacuggcuggcccggguggggcgcgagcgccugagccggauggccaucuccggcgacgacugcgucgugaagccccucgacgaccgcuucgccaacgcccugacggcgcugaacgacaugggcaagauccggaaggacauccagcagugggagccgagcaagggguggaacgacuggacccaggugcccuucugcucccaccacuuccacgagcucaucaugaaggacggccgcguccugguggugcccugccggaaccaggacgagcugaucgggcgcgcccggaucagccagggcgccggguggucccuccgcgagaccgccugccugggcaagagcuacgcccagauguggucccugauguacuuccaccggcgcgaccuccggcuggcggccaacgccaucugcagcgccguccccucccacugggugccgaccagccgcacgaccugguccauccacgccaagcacgaguggaugaccaccgaggacaugcugaccguguggaaccgggucuggauccgcgagaaccccuggauggaggacaagacgcccguggagagcugggaggagauccccuaccucggcaagcgggaggaccaguggugcgggucccugaucggccugaccagccgcgcgaccugggccaagaacauccaggccgccaucaaccaggugcggucccucaucgggaacgaggaguacaccgacuacaugccgagcaugaagcgcuuccggcgcgaggaggaggaggcgggcguccugugguga

SEQ ID NO: 9149 - RNA, 9876 nt, Artificial Sequence
  derived and/or modified CDS sequence (opt1) from DENV-2__GQ868638__SS-prME
uccgccgggaugaucaucaugcugauccccaccgugauggccuuccaccucaccacccggaacggggagccgcacaugaucgucggcauccaggagaaggggaagucccugcuguucaagaccgaggacggcgugaacaugugcacccucauggcgauggaccugggggagcugugcgaggacaccaucaccuacaagugcccccuccugcggcagaacgagcccgaggacaucgacugcuggugcaacagcaccuccaccugggugaccuacgggaccugcaccaccaccggcgagcaccgccgggagaagcgcagcgucgcccuggugccccacgugggcaugggccucgagacgcggaccgagaccuggauguccagcgagggggccuggaagcacgcccagcgcaucgagaccuggauccugcggcaccccggcuucacgaucauggccgcgauccuggccuacaccaucgggaccacccacuuccagcgcgcccucaucuucauccugcugacggccgucgcgcccuccaugaccaugcggugcaucggcaucagcaaccgcgacuucguggagggcguguccgggggcagcugggucgacaucgugcucgagcacggguccugcgugaccaccauggccaagaacaagcccacgcuggacuucgagcugaucaagaccgaggccaagcagcccgccacccuccggaaguacugcaucgaggccaagcugaccaacacgaccaccgagagccgcugcccgacccagggcgagcccucccugaaggaggagcaggacaagcgguucgucugcaagcacagcaugguggaccgcggcugggggaacggcugcggccuguucggcaagggcgggaucgugacgugcgcgauguucacgugcaagaagaacauggagggcaagaucguccagcccgagaaccuggaguacaccaucguggugacgccccacuccggggaggagcacgccgucggcaacgacacggggaagcacggcaaggagaucaaggugaccccgcagagcuccaucaccgaggccgagcugaccggguacggcaccgugacgauggagugcagcccccggaccggccucgacuucaacgagaugguccugcugcagauggagaacaaggccuggcucgugcaccgccagugguuccuggaccugccccuccccuggcugccgggggccgacaagcagggcuccaacuggauccagaaggagacccuggugaccuucaagaacccccacgcgaagaagcaggacgucgugguccucgggagccaggagggcgccaugcacacggcccugaccggggccaccgagauccagaugagcuccggcaaccuccucuucaccggccaccugaagugccggcugcgcauggacaagcuccagcugaaggggaugagcuacuccaugugcacgggcaaguucaagguggugaaggagaucgccgagacccagcacgggaccaucgucauccggcugcaguacgagggcgacggcagccccugcaagauccccuucgagaucauggaccucgagaagcgcuacgugcuggggcggcugaucaccgugaacccgaucgucacggagaaggacucccccgugaacaucgaggcggagccgcccuucggcgacagcuacaucaucaucgggguggagccgggccagcucaagcugaacugguucaagaagggguccagcaucggccagauguucgagaccaccaugcgcggcgccaagcgcauggccauccugggggacaccgccugggacuucggcucccucgggggcgucuucacgagcguggggaaggcccugcaccagaucuucggcgcgaucuacggcgccgccuucuccggggugagcuggaccaugaagauccugaucggcgucaucaucaccuggaucgggaugaacucccggagcaccucccugagcgugucccucgugcuggucggcaucgugacgcuguaccucggggugaugguccaggccgacagcggcugcgugguguccuggaagaacaaggagcugaagugcggcagcgggaucuucaucaccgacaacguccacaccuggaccgagcaguacaaguuccagcccgagagccccuccaagcuggcgagcgccauccagaaggcccaggaggagggcaucugcgggauccgcuccgugacgcggcucgagaaccugauguggaagcagaucacccccgagcugaaccacauccucgccgagaacgaggugaagcugaccaucaugaccggcgacaucaaggggaucaugcaggccggcaagcgcagccugcggccgcagcccacggagcucaaguacuccuggaagaccuggggcaaggcgaagaugcugagcaccgagucccacaaccagaccuuccugaucgacgggcccgagacggccgagugcccgaacaccaaccgcgccuggaacagccucgaggucgaggacuacggcuucgggguguucaccaccaacaucuggcugaagcugaaggagaagcaggacgccuucugcgacuccaagcucaugagcgccgcgaucaaggacaaccgggccgugcacgccgacaugggcuacuggaucgaguccgcccugaacgacacguggaagaucgagaaggccagcuucaucgaggucaagaacugccacuggcccaagucccacacccuguggagcaacggcgugcucgaguccgagaugaucauccccaagaaccuggcggggcccgugagccagcacaacuaccgcccgggcuaccacacccagaccgccgggcccuggcaccugggcaagcucgagauggacuucgacuucugcgacgggaccacggucaucgugaccgaggacugcggcaaccggggccccucccugcgcaccaccacggccagcgggaagcugaucaccgaguggugcugccggagcugcacccucccgccccugcgcuaccggggcgaggacgggugcugguacggcauggagauccgcccccugaaggagaaggaggagaaccucgugaacucccuggucaccgccgggcacggccagguggacaacuucagccugggcgugcucgggauggcgcuguuccuggaggagaugcuccggacgcgcgucggcaccaagcacgccauccugcugguggccguguccuucgucacccucaucaccgggaacaugagcuucaaggaccugggccgggugguggucauggugggggccacgaugaccgacgacaucggcaugggcgugaccuaccuggcccuccuggcggccuucaagguccgccccaccuucgccgccgggcugcuccugcggaagcugacguccaaggagcucaugaugaccaccaucggcaucgugcugcugagccaguccaccauccccgagacgauccucgagcugaccgacgcccuggcgcucgggaugauggugcugaagaucguccgcgacauggagaaguaccagcuggccgugaccaucauggccauccucugcgugcccaacgccgucauccugcagaacgccuggaaggugagcugcaccauccuggcggucguguccgugagcccccuccugcugacguccagccagcagaagaccgacuggaucccccucgcccugaccaucaagggccugaaccccaccgccaucuuccucacgacccugucccgcaccaacaagaagcggagcuggccgcugaacgaggccaucauggcggucggcaugguguccauccucgccagcucccugcugaagaacgacauccccaugaccgggccccucguggccggcgggcugcugacggucugcuacgugcucaccggccgcagcgccgaccuggagcuggagcgggccaccgacgugaagugggaggaccaggcggagaucuccgggagcagccccauccucuccaucaccaucagcgaggacggcuccaugagcaucaagaacgaggaggaggagcagacgcugaccauccugauccgcaccggccuccuggucaucuccgggcuguucccggugagcauccccaucaccgccgccgccugguaccucugggaggugaagaagcagcgggccggcguccugugggacgugcccagcccgccgcccauggggaaggcggagcuggaggacggcgccuaccgcaucaagcagaaggggauccucggcuacagccagaucggcgccgggguguacaaggagggcaccuuccacacgauguggcacgucacccgcggggccgugcugaugcacaagggcaagcgcaucgagcccuccugggccgacgugaagaaggaccugaucagcuacgggggcggcuggaagcucgagggggaguggaaggagggcgaggagguccaggugcuggcgcuggagcccgggaagaacccccgggccgugcagaccaagcccggccucuucaagaccaacacggggaccaucggcgccgucucccuggacuucagccccggcaccuccgggagccccaucaucgacaagaagggcaaggugguggggcuguacggcaacggcgucgugacccgcuccggggccuacgugagcgccaucgcgcagacggagaaguccaucgaggacaaccccgagaucgaggacgacaucuuccggaagcgccggcugaccaucauggaccuccaccccggcgccgggaagaccaagcgcuaccugcccgccaucguccgggaggccaucaagcgcggccugcggacccucauccuggcgccgacgcgcgugguggccgccgagauggaggaggcccugcgggggcuccccauccgcuaccagacccccgccauccgggcggagcacaccggccgcgagaucgucgaccugaugugccacgccaccuucacgaugcgccugcucagccccgugcgggugccgaacuacaaccugaucaucauggacgaggcccacuucaccgaccccgccuccaucgccgcgcgcggcuacaucagcacccgggucgagaugggggaggccgccggcaucuucaugaccgccacgccgcccgggagccgcgacccguucccccaguccaacgcccccaucaucgacgaggagcgggagauccccgagcgcagcuggaacuccggccacgagugggugaccgacuucaaggggaagaccgugugguucgucccgagcaucaaggcgggcaacgacaucgccgccugccugcggaagaacggcaagaaggugauccagcucucccgcaagaccuucgacagcgaguacgugaagacgcggaccaacgacugggacuucgucgugaccaccgacaucuccgagaugggggccaacuucaaggcggaccgcgugaucgacccccggcgcugcaugaagcccgucauccugacggacggcgaggagcgggugauccuggccgggcccaugccggugacccacagcuccgccgcccagcgccggggccgcaucgggcggaaccccaagaacgagaacgaccaguacaucuacaugggcgagccccucgagaacgacgaggacugcgcccacuggaaggaggcgaagaugcugcuggacaacaucaacacccccgagggcaucaucccgagcauguucgagcccgagcgcgagaaggucgacgccaucgacggggaguaccggcuccgcggcgaggcccgcaagaccuucguggaccugaugcggcgcggggaccugcccguguggcucgccuacaaggucgccgcggagggcaucaacuacgccgaccggcgcuggugcuucgacgggaucaagaacaaccagauccuggaggagaacguggagguggagaucuggacgaaggagggcgagcggaagaagcugaagccgcgcuggcucgacgcccggaucuacuccgacccccuggcccugaaggaguucaaggaguucgccgcgggccgcaagagccucacccugaaccugaucaccgagauggggcggcuccccaccuucaugacgcagaagacccgcgacgcccuggacaaccuggccguccuccacaccgccgaggcgggcgggcgggccuacaaccacgcccuguccgagcugcccgagacccucgagacgcugcugcuccugacccugcucgccaccgugaccggcggcaucuuccuguuccugaugagcgggcgcggcaucgggaagaugacccucggcaugugcugcaucaucacggccuccauccugcugugguacgcgcagauccagccgcacuggaucgccgccagcaucauccucgaguucuuccugaucguccugcucauccccgagcccgagaagcagcggacgccccaggacaaccagcugaccuacguggugaucgccauccugaccgucguggccgcgacgauggccaacgagaugggguuccucgagaagaccaagaaggaccugggccugggcuccaucgccacccagcagccggagagcaacauccucgacaucgaccugcgccccgccuccgccuggacccuguacgcgguggccacgaccuucgucacccccaugcuccggcacagcaucgagaacagcuccgugaacgugagccugaccgccaucgccaaccaggccacgguccugauggggcucggcaagggguggccccuguccaagauggacaucggcgugccgcugcucgcgaucgggugcuacagccaggugaaccccaucacccugaccgccgcccugcuccugcuggucgcccacuacgcgaucaucggccccggccuccaggccaaggccacccgcgaggcccagaagcgggccgcggccgggaucaugaagaaccccacgguggacggcaucaccgugaucgaccuggacccgauccccuacgaccccaaguucgagaagcagcuggggcaggucaugcuccugauccugugcgugacccaggugcucaugaugcgcaccacgugggcccugugcgaggcccugacccucgccaccggccccaucuccacccugugggaggggaacccgggccgguucuggaacacgaccaucgcggucagcauggccaacaucuuccgcggcuccuaccuggccggggccggccuccuguucagcaucaugaagaacaccaccaacacgcggcgcgggaccggcaacaucggcgagacccugggggagaaguggaagucccgccucaacgcccugggcaagagcgaguuccagaccuacaagaaguccgggauccaggagguggaccggacgcuggcgaaggagggcaucaagcgcggggagaccgaccaccacgccgugagccggggcuccgccaagcuccgcugguucgucgagcggaacauggugacccccgagggcaagguggucgaccuggggugcggccgcgggggcuggagcuacuacugcgggggccugaagaacgugcgggaggugaagggccucaccaagggcgggcccgggcacgaggagcccaucccgauguccacguacggcuggaaccugguccgccugcagagcgggguggacguguucuucaucccgcccgagaagugcgacacccuccugugcgacaucggcgaguccagccccaacccgaccgucgaggccggccggacccugcgcgugcucaaccugguggagaacuggcugaacaacaacacccaguucugcaucaagguccugaaccccuacaugcccuccgugaucgagaagauggaggcgcuccagcggaaguacgggggcgcccuggugcgcaacccgcugagccggaacagcacgcacgagauguacugggucuccaacgccagcgggaacaucguguccagcgugaacaugaucucccgcaugcucaucaaccgguucaccaugcgccacaagaaggccaccuacgagcccgacgucgaccugggcagcgggacccggaacaucggcaucgaguccgagauccccaaccuggacaucaucggcaagcgcaucgagaagaucaagcaggagcacgagacgagcuggcacuacgaccaggaccaccccuacaagaccugggccuaccacggguccuacgagaccaagcagaccggcagcgcguccagcauggugaacggggugguccggcuccugacgaagccgugggacgugcugcccaccgugacccagauggccaugaccgacacgacccccuucggccagcagcgcgucuucaaggagaagguggacacccgcgcccaggagcccaaggagggcaccaagaagcucaugaagaucacggccgaguggcuguggaaggagcuggggaagaagaagaccccgcggaugugcacccgcgaggaguucacccggaaggugcgcuccaacgccgcgcucggcgccaucuucacggacgagaacaaguggaaguccgcccgggaggccgucgaggacagccgcuucugggagcugguggacaaggagcggaaccugcaccucgaggggaagugcgagaccugcguguacaacaugaugggcaagcgcgagaagaagcugggggaguucggcaaggccaagggcagccgggcgaucugguacauguggcugggggcccgcuuccucgaguucgaggcccugggcuuccugaacgaggaccacugguucucccgggagaacagccucuccggggucgagggcgaggggcugcacaagcugggcuacauccuccgcgacgugagcaagaaggagggcggggccauguacgcggacgacaccgccggcugggacacccggaucacgcuggaggaccugaagaacgaggagauggucaccaaccacauggagggggagcacaagaagcucgccgaggccaucuucaagcugaccuaccagaacaagguggugcgcguccagcggcccacgccccgcggcaccgugauggacaucaucagccggcgcgaccagcggggguccggccaggugggcaccuacgggcugaacaccuucaccaacauggaggcccagcucauccgccagauggagggcgagggggucuuccggaacauccagcaccugacggcgaccgaggagguggccgugcagaacuggcuggcccgcgucggccgcgagcggcucagccgcauggccaucuccggcgacgacugcguggugaagccccuggacgaccgguucgccaacgcgcugaccgcccucaacgacauggggaagauccgcaaggacauccagcagugggagccgagcaagggcuggaacgacuggacccagguccccuucugcucccaccacuuccacgagcugaucaugaaggacgggcgggugcuggugguccccugccgcaaccaggacgagcucaucggccgggcccgcaucagccagggggccggcuggucccugcgggagacggccugccugggcaagagcuacgcgcagauguggucccucauguacuuccaccgccgggaccugcgccuggccgccaacgccaucugcagcgccgugcccucccacugggugccgaccagccggaccaccugguccauccacgcgaagcacgaguggaugaccacggaggacaugcucaccgucuggaaccgcguguggauccgggagaaccccuggauggaggacaagacccccguggagagcugggaggagauccccuaccuggggaagcgcgaggaccaguggugcggcucccugaucgggcucaccagccgggccacgugggccaagaacauccaggccgcgaucaaccagguccgcucccugaucggcaacgaggaguacaccgacuacaugccgagcaugaagcgguuccgccgcgaggaggaggaggccggggugcugugguga

SEQ ID NO: 9150 - RNA, 9876 nt, Artificial Sequence
  derived and/or modified CDS sequence (opt1) from DENV-2__GU131927__SS-prME
agcgcggggaugaucaucaugcugauccccaccgugauggccuuccaccucaccacccggaacggggagccccacaugaucgugggcauccaggagaagggcaagagccugcuguucaagaccgaggacggggugaacaugugcacccucauggcgauggaccugggggagcugugcgaggacaccaucaccuacaagugcccccuccugcggcagaacgagcccgaggacaucgacugcuggugcaacagcaccagcaccugggugaccuacggcacgugcaccaccaccggcgagcaccggcgggagaagcgcagcgucgcccuggugccccacguggggaugggccucgagacgcggaccgagaccuggaugagcagcgagggggccuggaagcacgcccagcgcaucgagaccuggauccugcggcacccgggcuucacgaucauggccgcgauccuggccuacaccaucgggaccacccacuuccagcgcgcccucaucuucauccugcugacggccgucgcgcccuccaugaccaugcggugcaucggcaucagcaaccgcgacuucguggagggcguguccgggggcagcugggucgacaucgugcucgagcacggguccugcgugaccaccauggcccggaacaagcccacgcuggacuucgagcugaucaagaccgaggccaagcagcccgccacccuccgcaaguacugcaucgaggccaagcugaccaacacgaccaccgagagccggugccccacccagggcgagcccucccugaaggaggagcaggacaagcgcuucgucugcaagcacagcaugguggaccggggcugggggaacggcugcggccuguucggcaagggcgggaucgugacgugcgcgauguucacgugcaagaagaacauggagggcaagaucguccagcccgagaaccuggaguacaccaucguggugacgccccacuccggggaggagcacgccgucggcaacgacacggggaagcacggcaaggagaucaaggugaccccgcagagcuccaucaccgaggccgagcugaccggguacggcaccgugacgauggagugcagcccccgcaccggccucgacuucaacgagaugguccugcugcagauggagaacaaggccuggcucgugcaccggcagugguuccuggaccugccccuccccuggcugccgggggccgacaagcaggaguccaacuggauccagaaggagacccuggugaccuucaagaacccccacgcgaagaagcaggacgucgugguccucggcagccaggagggggccaugcacacggcccugaccggcgccaccgagauccagaugagcuccgggaaccuccuguucaccggccaccugaagugccgccugcggauggacaagcuccagcugaagggcaugagcuacuccaugugcacggggaaguucaagguggugaaggagaucgccgagacccagcacggcaccaucgucauccgcgugcaguacgagggggacggcagccccugcaagauccccuucgagaucauggaccuggagaagcgguacgugcucggccgccugaucaccgucaacccgaucgugacggagaaggacucccccgugaacaucgaggcggagccgcccuucggggacagcuacaucaucaucggcgucgagccggggcagcugaagcucaacugguucaagaagggcuccagcaucgggcagauguucgagaccaccaugcgcggcgccaagcggauggccauccugggcgacaccgccugggacuucgggucccugggcgggguguucacgagcgugggcaaggcccuccaccaggucuucggggcgaucuacggcgccgccuucuccggcgugagcuggaccaugaagauccugaucggggugaucaucaccuggaucggcaugaacucccgcagcaccucccugagcgucucccuggugcucguggggaucgucacgcuguaccugggcgugauggugcaggccgacagcgggugcgucguguccuggaagaacaaggagcucaagugcggcagcggcaucuucaucaccgacaacgugcacaccuggaccgagcaguacaaguuccagcccgagagccccuccaagcuggcgagcgccauccagaaggcccaggaggaggggaucugcggcauccgguccgucacgcgccuggagaaccucauguggaagcagaucacccccgagcugaaccacauccuggccgagaacgaggugaagcucaccaucaugaccggggacaucaagggcaucaugcaggccgggcggcgcagccugcggccgcagcccacggagcugaaguacuccuggaagaccuggggcaaggcgaagaugcucagcaccgaguccuacaaccagaccuuccugaucgacggccccgagacgaccgagugcccgaacgccaaccgcgccuggaacagccuggagguggaggacuacggguucggcgucuucaccaccaacaucuggcucaagcugaaggagaagcaggacgccuucugcgacuccaagcugaugagcgccgcgaucaaggacaaccgggccgugcacgccgacaugggguacuggaucgaguccgcccucaacgacacguggaagaucgagaaggccagcuucaucgaggugaagaacugccacuggcccaagucccacacccuguggagcaacggcguccuggaguccgagaugaucauccccaagagccucgcgggccccgugucccagcacaacuaccgcccgggguaccacacccagaucgccggccccuggcaccuggggaagcuggagauggacuucgacuucugcgacggcaccaccgugaucgucacggaggacugcgggaaccggggccccagccuccgcaccaccaccgccagcggcaagcugaucacggaguggugcugccgguccugcacccugcccccgcuccgcuaccgcggggaggacggcugcugguacgggauggagauccgcccccugaaggagaaggaggagaaccuggugaacagccucgugaccgccggccacgggcaggucgacaacuucucccugggcgugcugggcauggcccucuuccuggaggagaugcugcggacccgcguggggacgaagcacgccauccuccuggucgccgugagcuucgugacccugaucaccggcaacauguccuucaaggaccucgggcgggucguggugauggucggcgccaccauggccgacgacaucgggaugggcgugacguaccuggcgcugcucgccgccuucaaggugcgccccaccuucgccgccggccugcugcuccgcaagcugaccagcaaggagcugaugaugaccacgaucgggaucguccuccugucccagagcaccauccccgagaccauccuggagcucaccgacgcgcuggcccugggcaugauggugcucaagaucgugcggaacauggagaaguaccagcuggccgucacgaucauggccauccugugcgugccgaacgccgucauccuccagaacgcguggaagguguccugcaccauccuggccguggucagcgugagcccccugcuccugaccagcucccagcagaagaccgacuggaucccccuggcccucacgaucaaggggcugaaccccaccgccaucuuccugaccacccucagccgcacgaacaagaagcgguccuggccgcugaacgaggcgaucauggccgugggcauggucagcauccuggccuccagccuccugaagaacgacauccccaugaccggcccccugguggccgggggccuccugaccgugugcuacguccugaccgggcgcuccgccgaccucgagcuggagcgggcgacggacgugaagugggaggagcaggccgagaucagcggcagcucccccauccugagcaucaccaucuccgaggacgggagcauguccaucaagaacgaggaggaggagcagacccucaccauccugauccgcacgggccugcucgugaucagcggccuguucccgaucuccauccccaucaccgccgccgccugguaccugugggaggucaagaagcagcgggcgggggugcucugggacgugcccuccccgccgcccaugggcaaggccgagcuggaggacggggccuaccgcaucaagcagaagggcauccugggguacucccagaucggcgccggcgucuacaaggaggggaccuuccacaccauguggcacgugacccggggcgccgugcucaugcacaaggggaagcgcaucgagcccagcugggcggacgucaagaaggaccugaucuccuacggcgggggcuggaagcuggagggcgaguggaaggagggggaggagguccaggugcucgcccuggagcccggcaagaacccccgggccguccagacgaagcccgggcuguucaagaccaacaccggcaccaucggggccgugagccucgacuucucccccggcacgagcggcucccccaucaucgacaagaaggggaagguggucggccuguacgggaacggcguggugacccgcagcggcgccuacgucuccgcgaucgcccagaccgagaaguccaccgaggacaaccccgagaucgaggacgacaucuuccggaagcgccggcugacgaucauggaccugcaccccggggccggcaagaccaagcgcuaccuccccgccaucgugcgggaggcgaucaagcgcgggcugcggacccugauccucgccccgacccgcguggucgccgccgagauggaggaggcccugcggggccugcccauccgcuaccagacgcccgcgauccgcgccgagcacaccgggcgggagaucguggaccucaugugccacgccaccuucaccaugcgccugcugucccccgugcgggucccgaacuacaaccucaucaucauggacgaggcccacuucacggaccccgccagcaucgcggcccgcggcuacaucagcacccggguggagaugggcgaggccgccgggaucuucaugaccgccacgccgcccggcucccgcgacccguucccccagagcaacgcgcccaucaucgacgaggagcgggagauccccgagcgcuccuggaacagcgggcacgagugggugacggacuucaagggcaagaccgucugguucgugccguccaucaaggccgggaacgacaucgccgccugccugcggaagaacggcaagaaggugauccagcugagccgcaagaccuucgacuccgaguacgucaagacccggacgaacgacugggacuucguggugaccaccgacaucagcgagaugggcgcgaacuucaaggccgagcgcgucaucgacccccggcgcugcaugaagcccgugauccucaccgacggggaggagcgggugauccuggccggccccaugccggucacgcacuccagcgccgcccagcgccgggggcgcaucggccggaaccccaagaacgagaacgaccaguacaucuacaugggggagccccuggagaacgacgaggacugcgcgcacuggaaggaggccaagaugcuccuggacaacaucaacacccccgagggcaucaucccguccauguucgagcccgagcgcgagaagguggacgccaucgacggcgaguaccgccugcgcggggaggcccgcaagaccuucguggaccucaugcggcgcggcgaccugcccgucuggcuggccuacaagguggcggccgaggggaucaacuacgccgaccggcgcuggugcuucgacggcaucaagaacaaccagauccucgaggagaacguggaggucgagaucuggaccaaggagggggagcggaagaagcugaagccgcgcuggcuggacgcccggaucuacagcgacccccucgcccugaaggaguucaaggaguucgcggccggccgcaagucccugacgcucaaccugaucaccgagaugggccggcugcccaccuucaugacccagaagacgcgcgacgcccucgacaaccuggccgugcugcacaccgcggaggccgggggccgggccuacaaccacgcccucagcgagcugcccgagacccuggagacccuccugcugcucacgcugcuggccaccgucaccgggggcaucuuccucuuccugauguccggccgcgggaucggcaagaugacccuggggaugugcugcaucaucaccgcgagcauccuccugugguacgcccagauccagccgcacuggaucgccgccuccaucauccuggaguucuuccucaucgugcugcugauccccgagcccgagaagcagcggacgccccaggacaaccagcucaccuacguggucaucgccauccugaccgugguggcggccaccauggccaacgagaugggcuuccuggagaagacgaagaaggaccucgggcugggcagcaucgccacccagcagccggaguccaacauccuggacaucgaccuccgccccgccagcgcguggacccuguacgccgucgccaccacguucaucacccccaugcugcggcacagcaucgagaacuccagcgugaacaccucccucaccgccaucgccaaccaggcgacggugcugaugggccuggggaagggcuggccccucagcaagauggacaucggggucccgcugcuggccaucggcugcuacucccaggugaaccccaucacccucaccgccgcccugcugcuccugguggcgcacuacgccaucaucgggcccggccugcaggccaaggccacccgcgaggcccagaagcgggcggccgccggcaucaugaagaaccccacggucgacgggaucaccgugaucgaccucgacccgauccccuacgaccccaaguucgagaagcagcugggccaggugaugcugcucauccugugcgucacccaggugcugaugaugcgcaccacgugggcccucugcgaggcccugacccuggcgaccgggcccaucagcacccucugggagggcaacccggggcgguucuggaacacgaccaucgccguguccauggccaacaucuuccgcggcagcuaccuggccggcgccgggcuccucuucuccaucaugaagaacaccaccaacacgcgccggggcaccgggaacaucggcgagacccugggcgagaaguggaagucccgccugaacgcgcucgggaaguccgaguuccagaucuacaagaaguccggcauccaggaggucgaccggacccuggccaaggaggggaucaagcgcggcgagacggaccaccacgccgugucccgggggagcgccaagcugcgcugguucguggagcggaacauggucacccccgagggcaaggugguggaccucggcugcgggcgcggcgggugguccuacuacugcggcgggcugaagaacgucaaggaggugaagggccugaccaagggcgggcccggccacgaggagcccaucccgaugagcaccuacggguggaaccucgugcggcugcaguccggcgucgacguguucuucaucccgcccgagaagugcgacacgcugcucugcgacaucggggagagcucccccaacccgaccguggaggcgggccgcacccugcggguccugaaccucguggagaacuggcugaacaacaacacccaguucugcaucaaggugcugaaccccuacaugcccagcgucaucgagaagauggaggcccugcagcgcaaguacggcggggcccucgugcggaacccgcugagccgcaacuccacccacgagauguacugggugagcaacgccuccggcaacaucgucagcuccgugaacaugaucagccggaugcugaucaaccgcuucacgaugcggcacaagaaggccaccuacgagcccgacguggaccucggguccggcacccgcaacaucgggaucgagagcgagguccccaaccuggacaucaucggcaagcggaucgagaagaucaagcaggagcacgagaccuccuggcacuacgaccaggaccaccccuacaagacgugggcguaccacggcagcuacgagaccacccagaccggguccgccagcuccauggugaacggcgugguccgccugcucacgaagccgugggacgugcugcccaccgugacccagauggccaugaccgacacgacccccuucgggcagcagcgcgucuucaaggagaagguggacacccggacccaggagcccaaggagggcacgaagaagcugaugaagaucaccgccgaguggcucuggaaggagcugggcaagaagaagaccccgcgcaugugcacccgggaggaguucacgcgcaaggugcggagcaacgccgcgcugggggccaucuucaccgacgagaacaaguggaaguccgcccgcgaggccgucgaggacagccgguucugggagcucguggacaaggagcgcaaccugcaccuggagggcaagugcgagaccugcguguacaacaugauggggaagcgggagaagaagcucggcgaguucgggaaggccaagggcucccgcgcgaucugguacauguggcugggcgcccgguuccuggaguucgaggcccucggguuccugaacgaggaccacugguucagccgcgagaacucccugagcggcgucgagggggagggccuccacaagcugggguacauccugcgggacgugagcaagaaggagggcggcgccauguacgcggacgacaccgccgggugggacacgcgcaucacccucgaggaccugaagaacgaggagauggucaccaaccacaugaagggcgagcacaagaagcuggccgaggccaucuucaagcucaccuaccagaacaagguggugcggguccagcgccccacgccccgggggaccgugauggacaucaucucccgccgggaccagcgcggcagcggccagguggggaccuacggccugaacaccuucacgaacauggaggcccagcugauccggcagauggagggggagggcgucuucaagaacauccagcaccucaccgugaccgaggagguggcgguccagaacuggcuggcccgcguggggcgcgagcggcugucccgcauggccaucagcggcgacgacugcguggucaagccccucgacgaccgguucgccaacgcccugaccgcgcugaacgacaugggcaagauccgcaaggacauccagcagugggagccguccaagggguggaacgacuggacccaggugcccuucugcagccaccacuuccacgagcucaucaugaaggacggccgggugcuggucgugcccugccgcaaccaggacgagcugaucgggcgggcccgcaucucccagggcgccggguggagccuccgggagaccgccugccugggcaaguccuacgcccagauguggagccugauguacuuccaccgccgggaccuccgccuggcggccaacgccaucugcuccgccgugcccagccacugggucccgaccucccggaccaccuggagcauccacgccaagcacgaguggaugacgaccgaggacaugcugaccguguggaaccgcguguggauccgggagaaccccuggauggaggacaagacccccgucgaguccugggaggagauccccuaccucggcaagcgcgaggaccaguggugcgggagccugaucggccugacgucccgggcgaccugggccaagaacauccaggccgccaucaaccaggugcgcagccucaucgggaacgaggaguacaccgacuacaugccgagcaugaagcgguuccgccgcgaggaggaggaggcgggcgugcugugguga

SEQ ID NO: 9151 - RNA, 9876 nt, Artificial Sequence
  derived and/or modified CDS sequence (opt1) from DENV-2__GU131928__SS-prME
agcgccgggaugaucaucaugcugauccccaccgugauggccuuccaccucaccacccgcaacggggagccccacaugaucgucgggauccaggagaagggcaagagccugcuguucaagaccgaggacggcgugaacaugugcacccucauggcgauggaccugggggagcugugcgaggacaccaucaccuacaagugcccccuccugcggcagaacgagcccgaggacaucgacugcuggugcaacagcaccuccaccugggugaccuacgggaccugcaccaccaccggcgagcaccgccgggagaagcgcagcgucgcccuggugccccacguggggaugggccucgagacccggaccgagaccuggauguccagcgagggggccuggaagcacgcccagcgcaucgagaccuggauccugcggcacccgggcuucacgaucauggccgcgauccuggccuacaccaucgggaccacccacuuccagcgcguccucaucuucauccugcugacggccguggcccccuccaugaccaugcggugcaucggcaucagcaaccgcgacuucguggagggcgucuccgggggcagcuggguggacaucgugcucgagcacggguccugcgucaccaccauggcgaagaacaagcccacgcuggacuucgagcugaucaagaccgaggccaagcagcccgccacccuccggaaguacugcaucgaggccaagcugaccaacacgaccaccgagagccgcugccccacccagggcgagcccucccugaaggaggagcaggacaagcgguucgugugcaagcacagcaugguggaccgcggcugggggaacggcugcggccuguucggcaagggcgggaucgucacgugcgccauguucacgugcaagaagaacauggagggcaagaucgugcagcccgagaaccuggaguacaccaucguggucacgccccacuccggggaggagcacgcggugggcaacgacacggggaagcacggcauggagaucaaggugaccccgcagagcuccaucaccgaggccgagcugaccggguacggcaccgucacgauggagugcagcccccggaccggccucgacuucaacgagauggugcugcugcagauggagaacaaggccuggcucgugcaccgccagugguuccuggaccugccccuccccuggcugccgggggccgacaagcaggaguccaacuggauccagaaggagacccuggucaccuucaagaacccccacgccaagaagcaggacguggucgugcucggcagccaggagggggcgaugcacacggcccugaccggcgccaccgagauccagaugagcuccgggaaccuccuguucaccggccaccugaagugccggcugcgcauggacaagcuccagcugaagggcaugagcuacuccaugugcacggggaaguucaagguggucaaggagaucgccgagacccagcacggcaccaucgugauccgggugcaguacgagggggacggcagccccugcaagauccccuucgagaucauggaccuggagaagcgcuacguccucggccggcugaucaccgugaacccgaucgugacggagaaggacucccccgucaacaucgaggccgagccgcccuucggggacagcuacaucaucaucggcguggagccggggcagcugaagcucaacugguucaagaagggcuccagcaucgggcagauguucgagaccaccaugcgcggcgcgaagcgcauggccauccugggcgacaccgccugggacuucgggucccugggcgggguguucacgagcaucggcaaggcccuccaccaggucuucggggccaucuacggcguggcguucuccggcgugagcuggaccaugaagauccugaucggggucaucaucaccuggaucggcaugaacucccggagcaccucccugagcgugucccuggugcucgucgggaucgugacgcuguaccugggcgugaugguccaggccgacagcgggugcgugguguccuggaagaacaaggagcucaagugcggcagcggcaucuucaucaccgacaacguccacaccuggaccgagcaguacaaguuccagcccgagagccccuccaagcuggccagcgccauccagaaggcgcaggaggaggggaucugcggcauccgcuccgugacgcggcuggagaaccucauguggaagcagaucacccccgagcugaaccacauccuggccgagaacgaggugaagcucaccaucaugaccggggacaucaagggcaucaugcaggccgggaagcgcagccugcggccgcagcccacggagcugaaguacuccuggaagaccuggggcaaggccaagaugcucagcaccgaguccuacaaccagaccuuccugaucgacggccccgagacggccgagugcccgaacaccaaccgcgcguggaacagccuggaggucgaggacuacggguucggcguguucaccaccaacaucuggcucaagcugaaggagaagcaggacgccuucugcgacuccaagcugaugagcgccgccaucaaggacaaccgggccgugcacgcggacaugggguacuggaucgaguccgcccucaacgacacguggaagaucgagaaggccagcuucaucgaggucaagaacugccacuggcccaagucccacacccuguggagcaacggcgugcuggaguccgagaugaucauccccaagaaccucgccggccccgugagccagcacaacuaccgcccgggguaccacacccagaucgccggccccuggcaccuggggaagcuggagauggacuucgacuucugcgacggcaccaccgucaucgugacggaggacugcgggaaccggggccccucccuccgcaccaccaccgcgagcggcaagcugaucacggaguggugcugccggagcugcacccugcccccgcuccgcuaccgcggggaggacggcugcugguacgggauggagauccgcccccugaaggagaaggaggagaaccuggugaacucccucgucaccgccggccacggccagguggacaacuucagccugggcgugcugggcauggcccucuuccuggaggagaugcugcggacccgcgucgggacgaagcacgccauccuccugguggcgguguccuucgucacccugaucaccggcaacaugagcuucaaggaccucgggcgggugguggucauggugggcgccaccauggccgacgacaucgggaugggcgugacguaccuggcccugcucgccgcguucaagguccgccccaccuucgccgccggccugcugcuccggaagcugaccuccaaggagcugaugaugaccacgaucgggaucgugcuccugagccaguccaccauccccgagaccgugcuggagcucaccgacgcccuggcccugggcaugaugguccucaagaucgugcgcaacauggagaaguaccagcuggcggucacgaucauggccauccugugcgugccgaacgccgugauccuccagaacgccuggaaggucagcugcaccauccuggccgugguguccgucagcccccugcuccugaccuccagccagcagaagaccgacuggaucccccuggcgcucacgaucaaggggcugaaccccaccgccaucuuccugaccacccucucccgcacgaacaagaagcggagcuggccgcugaacgaggccaucauggccgugggcaugguguccauccuggcgagcucccuccugaagaacgacauccccaugaccggcccccuggucgccgggggccuccugaccgugugcuacgugcugaccgggcgcagcgccgaccucgagcuggagcgggccacggacgucaagugggaggaccaggccgagaucuccggcagcagccccauccuguccaucaccaucagcgaggacggguccaugagcaucaagaacgaggaggaggagcagacccucaccauccugauccgcacgggccugcucgugaucuccggccuguucccgaucagcauccccaucaccgcggccgccugguaccugugggaggugaagaagcagcgggccgggguccucugggacgugcccagcccgccgcccaugggcaaggccgagcuggaggacggggcguaccgcaucaagcagaagggcauccugggguacagccagaucggcgccggcguguacaaggaggggaccuuccacaccauguggcacgucacccggggcgccgugcucaugcacaaggggaagcgcaucgagcccuccugggccgacgugaagaaggaccugaucagcuacggcgggggcuggaagcuggagggcgaguggaaggagggggaggagguccaggugcucgcccuggagcccggcaagaacccccgggcggugcagacgaagcccgggcuguucaagaccaacaccggcaccaucggggccgucucccucgacuucagccccggcacguccggcagccccaucaucgacaagaaggggaagguggugggccuguacgggaacggcgucgugacccgcuccggcgccuacgugagcgccaucgcccagaccgagaaguccaucgaggacaaccccgagaucgaggacgacaucuuccggaagcgccggcugaccaucauggaccugcaccccggggcgggcaagacgaagcgcuaccuccccgccaucguccgggaggccaucaagcgcgggcugcggacccugauccucgccccgacccgcgugguggcggccgagauggaggaggcccugcggggccugcccauccgcuaccagacccccgccauccgggccgagcacacggggcgcgagaucgucgaccucaugugccacgcgaccuucaccaugcgccugcugagccccgugcgggugccgaacuacaaccucaucaucauggacgaggcccacuucaccgaccccgccuccaucgccgcccgcggcuacaucagcacgcgggucgagaugggcgaggcggccgggaucuucaugaccgccacgccgcccggcagccgcgacccguucccccaguccaacgcccccaucaucgacgaggagcgggagauccccgagcgcagcuggaacuccgggcacgagugggugaccgacuucaagggcaagacggugugguucgucccgagcaucaaggccgggaacgacaucgcggccugccugcggaagaacggcaagaaggugauccagcugucccgcaagaccuucgacagcgaguacgugaagacccggaccaacgacugggacuucgucgugacgaccgacaucuccgagaugggcgccaacuucaaggccgagcgcgugaucgacccccggcgcugcaugaagcccgucauccucaccgacggggaggagcgggugauccuggcgggccccaugccggugacccacagcuccgccgcccagcgccgggggcgcaucggccggaaccccaagaacgagaacgaccaguacaucuacaugggggagccccuggagaacgacgaggacugcgcccacuggaaggaggccaagaugcuccuggacaacaucaacacgcccgagggcaucaucccgagcauguucgagcccgagcgcgagaaggucgacgcgaucgacggcgaguaccggcugcgcggggaggcccgcaagaccuucguggaccucaugcggcgcggcgaccugcccguguggcuggccuacaaggucgccgccgaggggaucaacuacgcggaccggcgcuggugcuucgacggcaucaagaacaaccagauccucgaggagaacguggaggucgagaucuggaccaaggagggggagcggaagaagcugaagccgcgcuggcuggacgcccggaucuacuccgacccccucgcccugaaggaguucaaggaguucgccgccggccgcaagagccugacccucaaccugaucacggagaugggccggcugcccaccuucaugacccagaagacccgcgacgcgcucgacaaccuggccgugcugcacacggccgaggccgggggccgggcguacaaccacgcccucuccgagcugcccgagacccuggagacccuccugcugcucacccugcuggccacggugaccgggggcaucuuccucuuccugaugagcggccgcgggaucggcaagaugacccuggggaugugcugcaucaucaccgccuccauccuccugugguacgcccagauccagccgcacuggaucgcggccagcaucauccuggaguucuuccucaucguccugcugauccccgagcccgagaagcagcggacgccccaggacaaccagcucacguacguggugaucgccauccugaccgucguggccgccaccauggcgaacgagaugggcuuccuggagaagaccaagaaggaccucgggcugggcuccaucgccacgcagcagccggagagcaacauccuggacaucgaccuccgccccgccuccgccuggacccuguacgccguggcgaccaccuucgucacgcccaugcugcggcacagcaucgagaacagcuccgugaacgugagccucaccgccaucgccaaccaggccaccguccugaugggccuggggaagggcuggccccucuccaagauggacaucggggugccgcugcuggccaucggcugcuacagccaggugaaccccaucacccucacggcggcccugcugcuccuggucgcccacuacgccaucaucgggcccggccugcaggcgaaggccacccgcgaggcccagaagcgggccgccgcgggcaucaugaagaaccccaccguggacgggaucaccgugaucgaccucgacccgauccccuacgaccccaaguucgagaagcagcugggccaggucaugcugcucauccugugcgugacccaggugcugaugaugcgcaccaccugggcccucugcgaggcccugacccuggccacggggcccaucuccacccucugggagggcaacccggggcgguucuggaacaccaccaucgccgucagcauggcgaacaucuuccgcggcuccuaccuggccggcgccgggcuccucuucagcaucaugaagaacacgaccaacacccggcgcggcaccgggaacaucggcgagacgcugggcgagaaguggaagucccgccugaacgcccucgggaaguccgaguuccagaucuacaagaaguccggcauccaggagguggaccggacccuggccaaggaggggaucaagcgcggcgagaccgaccaccacgcggugagccggggguccgccaagcugcgcugguucgucgagcggaacauggugacccccgagggcaagguggucgaccucggcugcgggcgcggcggguggagcuacuacugcggcgggcugaagaacgugcgggaggugaagggccugacgaagggcgggcccggccacgaggagcccaucccgauguccaccuacggguggaaccucguccgccugcagagcggcguggacguguucuucaucccgcccgagaagugcgacacccugcucugcgacaucggggaguccagccccaacccgaccgucgaggccggccggacgcugcgcgugcugaaccucguggagaacuggcugaacaacaacacccaguucugcaucaagguccugaaccccuacaugcccuccgugaucgagaagauggaggcccugcagcggaaguacggcggggcgcucgugcgcaacccgcugagccggaacagcacccacgagauguacugggucuccaacgccagcggcaacaucguguccagcgugaacaugaucucccgcaugcugaucaaccgguucaccaugcgccacaagaaggccaccuacgagcccgacgucgaccucgggagcggcacgcggaacaucgggaucgaguccgagacccccaaccuggacaucaucggcaagcgcaucgagaagaucaaggaggagcacgagaccagcuggcacuacgaccaggaccaccccuacaagaccugggccuaccacggcuccuacgagacgaagcagaccgggagcgccuccagcauggugaacggcgugguccggcugcucaccaagccgugggacgugcugcccaccgugacgcagauggcgaugaccgacaccacccccuucgggcagcagcgcgucuucaaggagaagguggacacgcgcacccaggagcccaaggagggcaccaagaagcugaugaagaucaccgccgaguggcucuggaaggagcugggcaagaagaagacgccgcggaugugcacccgcgaggaguucacccggaaggugcgcuccaacgccgcccugggggccaucuucaccgacgagaacaaguggaaguccgcgcgggaggccgucgaggacucccgcuucugggagcucguggacaaggagcggaaccugcaccuggagggcaagugcgagacgugcgucuacaacaugauggggaagcgcgagaagaagcucggcgaguucgggaaggccaagggcagccgggccaucugguacauguggcugggcgcccgcuuccuggaguucgaggcgcucggguuccugaacgaggaccacugguucucccgggagaacagccuguccggcguggagggggagggccuccacaagcugggguacauccugcgcgacgugagcaagaaggagggcggcgccauguacgccgacgacaccgccgggugggacacccggaucacccucgaggaccugaagaacgaggagauggucacgaaccacauggagggcgagcacaagaagcuggcggaggccaucuucaagcucaccuaccagaacaagguggugcgcguccagcggcccacgccccgggggaccgugauggacaucaucagccggcgcgaccagcggggcuccggccagguggggacguacggccugaacaccuucaccaacauggaggcccagcugauccgccagauggagggggagggcgucuucaagaacauccagcaccucaccgugacggaggaggccgccgugcagaacuggcuggcgcgggucgggcgcgagcgccugagccggauggccaucuccggcgacgacugcguggugaagccccucgacgaccgcuucgccaacgcccugaccgcccugaacgacaugggcaagauccggaaggacauccagcagugggagccgagcaagggguggaacgacuggacccagguccccuucugcucccaccacuuccacgagcucaucaugaaggacggccgcgugcuggugguccccugccggaaccaggacgagcugaucgggcgcgcgcggaucagccagggcgccggguggucccuccgcgagaccgccugccugggcaagagcuacgcccagauguggucccugauguacuuccaccggcgcgaccuccggcuggccgcgaacgccaucugcagcgccgugcccucccacugggugccgacgagccgcaccaccugguccauccacgccaagcacgaguggaugaccaccgaggacaugcugacggucuggaaccggguguggauccgcgagaaccccuggauggaggacaagacccccguggagagcugggaggagauccccuaccucggcaagcgggaggaccaguggugcgggucccugaucggccugaccagccgcgccaccugggcgaagaacauccaggccgccaucaaccagguccggucccucaucgggaacgaggaguacacggacuacaugccgagcaugaagcgcuuccggcgcgaggaggaggaggccggcgugcugugguga

SEQ ID NO: 9152 - RNA, 9876 nt, Artificial Sequence
  derived and/or modified CDS sequence (opt1) from DENV-2__GU131929__SS-prME
agcgccgggaugaucaucaugcugauccccaccgugauggccuuccaccucaccacccgcaacggggagccccacaugaucgucgggauccaggagaagggcaagagccugcuguucaagaccgaggacggcgugaacaugugcacccucauggcgauggaccugggggagcugugcgaggacaccaucaccuacaagugcccccuccugcggcagaacgagcccgaggacaucgacugcuggugcaacagcaccagcaccugggugaccuacgggaccugcaccaccaccggcgagcaccgccgggagaagcgcagcgucgcccuggugccccacguggggaugggccucgagacccggaccgagaccuggaugagcagcgagggggccuggaagcacgcccagcgcaucgagaccuggauccugcggcacccgggcuucacgaucauggccgcgauccuggccuacaccaucgggaccacccacuuccagcgcguccucaucuucauccugcugacggccguggcccccuccaugaccauccggugcaucggcaucagcaaccgcgacuucguggagggcgucuccgggggcagcuggguggacaucgugcucgagcacggguccugcgucaccaccauggcgaagaacaagcccacgcuggacuucgagcugaucaagaccgaggccaagcagcccgccacccuccggaaguacugcaucgaggccaagcugaccaacacgaccaccgagagccgcugccccacccagggcgagcccucccugaaggaggagcaggacaagcgguucgugugcaagcacagcaugguggaccgcggcugggggaacggcugcggccuguucggcaagggcgggaucgucacgugcgccauguucacgugcaagaagaacauggagggcaagaucgugcagcccgagaaccuggaguacaccaucguggucacgccccacuccggggaggagcacgcggugggcaacgacacggggaagcacggcauggagaucaaggugaccccgcagagcuccaucaccgaggccgagcugaccggguacggcaccgucacgauggagugcagcccccggaccggccucgacuucaacgagauggugcugcugcagauggagaacaaggccuggcucgugcaccgccagugguuccuggaccugccccuccccuggcugccgggggccgacaagcaggaguccaacuggauccagaaggagacccuggucaccuucaagaacccccacgccaagaagcaggacguggucgugcucggcagccaggagggggcgaugcacacggcccugaccggcgccaccgagauccagaugagcuccgggaaccuccuguucaccggccaccugaagugccggcugcgcauggacaagcuccagcugaagggcaugagcuacuccaugugcacggggaaguucaagguggucaaggagaucgccgagacccagcacggcaccaucgugauccgggugcaguacgagggggacggcagccccugcaagauccccuucgagaucauggaccuggagaagcgcuacguccucggccggcugaucaccgugaacccgaucgugacggagaaggacucccccgucaacaucgaggccgagccgcccuucggggacagcuacaucaucaucggcguggagccggggcagcugaagcucaacugguucaagaagggcuccagcaucgggcagauguucgagaccaccaugcgcggcgcgaagcgcauggccauccugggcgacaccgccugggacuucgggucccugggcgggguguucacgagcaucggcaaggcccuccaccaggucuucggggccaucuacggcguggcguucuccggcgugagcuggaccaugaagauccugaucggggucaucaucaccuggaucggcaugaacucccggagcaccucccugagcgugucccuggugcucgucgggaucgugacgcuguaccugggcgugaugguccaggccgacagcgggugcgugguguccuggaagaacaaggagcucaagugcggcagcggcaucuucaucaccgacaacguccacaccuggaccgagcaguacaaguuccagcccgagagccccuccaagcuggccagcgccauccagaaggcgcaggaggaggggaucugcggcauccgcuccgugacgcggcuggagaaccucauguggaagcagaucacccccgagcugaaccacauccuggccgagaacgaggugaagcucaccaucaugaccggggacaucaagggcaucaugcaggccgggaagcgcagccugcggccgcagcccacggagcugaaguacuccuggaagaccuggggcaaggccaagaugcuguucaccgagagcuacaaccagaccuuccugaucgacggccccgagacggccgagugcccgaacaccaaccgcgcguggaacucccuggaggucgaggacuacggguucggcguguucaccaccaacaucuggcucaagcugaaggagaagcaggacgccuucugcgacagcaagcugauguccgccgccaucaaggacaaccgggccgugcacgcggacaugggguacuggaucgagagcgcccucaacgacacguggaagaucgagaaggccuccuucaucgaggucaagaacugccacuggcccaagagccacacccugugguccaacggcgugcuggagagcgagaugaucauccccaagaaccucgccggccccgugucccagcacaacuaccgcccgggguaccacacccagaucgccggccccuggcaccuggggaagcuggagauggacuucgacuucugcgacggcaccaccgucaucgugacggaggacugcgggaaccggggccccagccuccgcaccaccaccgcguccggcaagcugaucacggaguggugcugccggagcugcacccugcccccgcuccgcuaccgcggggaggacggcugcugguacgggauggagauccgcccccugaaggagaaggaggagaaccuggugaacagccucgucaccgccggccacggccagguggacaacuucucccugggcgugcugggcauggcccucuuccuggaggagaugcugcggacccgcgucgggacgaagcacgccauccuccugguggcggugagcuucgucacccugaucaccggcaacauguccuucaaggaccucgggcgggugguggucauggugggcgccaccauggccgacgacaucgggaugggcgugacguaccuggcccugcucgccgcguucaagguccgccccaccuucgccgccggccugcugcuccggaagcugaccagcaaggagcugaugaugaccacgaucgggaucgugcuccugucccagagcaccauccccgagaccgugcuggagcucaccgacgcccuggcccugggcaugaugguccucaagaucgugcgcaacauggagaaguaccagcuggcggucacgaucauggccauccugugcgugccgaacgccgugauccuccagaacgccuggaaggucuccugcaccauccuggccguggugagcgucagcccccuccuccugaccagcucccagcagaagaccgacuggaucccccuggcgcucacgaucaaggggcugaaccccaccgccaucuuccugaccacccucagccgcacgaacaagaagcgguccuggccgcugaacgaggccaucauggccgugggcauggugagcauccuggcguccagccuccugaagaacgacauccccaugaccggcccccuggucgccgggggccuccugaccgugugcuacgugcugaccgggcgcuccgccgaccucgagcuggagcgggccacggacgucaagugggaggaccaggccgagaucagcggcuccagccccauccugagcaucaccaucuccgaggacgggagcauguccaucaagaacgaggaggaggagcagacccucaccauccugauccgcacgggccugcucgugaucagcggccuguucccgaucuccauccccaucaccgcggccgccugguaccugugggaggugaagaagcagcgggccgggguccucugggacgugcccuccccgccgcccaugggcaaggccgagcuggaggacggggcguaccgcaucaagcagaagggcauccugggguacucccagaucggcgccggcguguacaaggaggggaccuuccacaccauguggcacgucacccggggcgccgugcucaugcacaaggggaagcgcaucgagcccagcugggccgacgugaagaaggaccugaucuccuacggcgggggcuggaagcuggagggcgaguggaaggagggggaggagguccaggugcucgcccuggagcccggcaagaacccccgggcggugcagacgaagcccgggcuguucaagaccaacaccggcaccaucggggccgucagccucgacuucucccccggcacgagcggcucccccaucaucgacaagaaggggaagguggugggccuguacgggaacggcgucgugacccgcagcggcgccuacguguccgccaucgcccagaccgagaaguccaucgaggacaaccccgagaucgaggacgacaucuuccggaagcgccggcugaccaucauggaccugcaccccggggcgggcaagacgaagcgcuaccuccccgccaucguccgggaggccaucaagcgcgggcugcggacccugauccucgccccgacccgcgugguggcggccgagauggaggaggcccugcggggccugcccauccgcuaccagacccccgccauccgggccgagcacacggggcgcgagaucgucgaccucaugugccacgcgaccuucaccaugcgccugcugucccccgugcgggugccgaacuacaaccucaucaucauggacgaggcccacuucaccgaccccgccagcaucgccgcccgcggcuacaucuccacgcgggucgagaugggcgaggcggccgggaucuucaugaccgccacgccgcccggcagccgcgacccguucccccagagcaacgcccccaucaucgacgaggagcgggagauccccgagcgcuccuggaacagcgggcacgagugggugaccgacuucaagggcaagacggugugguucgucccguccaucaaggccgggaacgacaucgcggccugccugcggaagaacggcaagaaggugauccagcugagccgcaagaccuucgacuccgaguacgugaagacccggaccaacgacugggacuucgucgugacgaccgacaucagcgagaugggcgccaacuucaaggccgagcgcgugaucgacccccggcgcugcaugaagcccgucauccucaccgacggggaggagcgggugauccuggcgggccccaugccggugacccacuccagcgccgcccagcgccgggggcgcaucggccggaaccccaagaacgagaacgaccaguacaucuacaugggggagccccuggagaacgacgaggacugcgcccacuggaaggaggccaagaugcuccuggacaacaucaacacgcccgagggcaucaucccguccauguucgagcccgagcgcgagaaggucgacgcgaucgacggcgaguaccggcugcgcggggaggcccgcaagaccuucguggaccucaugcggcgcggcgaccugcccguguggcuggccuacaaggucgccgccgaggggaucaacuacgcggaccggcgcuggugcuucgacggcaucaagaacaaccagauccucgaggagaacguggaggucgagaucuggaccaaggagggggagcggaagaagcugaagccgcgcuggcuggacgcccggaucuacagcgacccccucgcccugaaggaguucaaggaguucgccgccggccgcaagucccugacccucaaccugaucacggagaugggccggcugcccaccuucaugacccagaagacccgcgacgcgcucgacaaccuggccgugcugcacacggccgaggccgggggccgggcguacaaccacgcccucagcgagcugcccgagacccuggagacccuccugcugcucacccugcuggccacggugaccgggggcaucuuccucuuccugauguccggccgcgggaucggcaagaugacccuggggaugugcugcaucaucaccgccagcauccuccugugguacgcccagauccagccgcacuggaucgcggccuccaucauccuggaguucuuccucaucguccugcugauccccgagcccgagaagcagcggacgccccaggacaaccagcucacguacguggugaucgccauccugaccgucguggccgccaccauggcgaacgagaugggcuuccuggagaagaccaagaaggaccucgggcugggcagcaucgccacgcagcagccggaguccaacauccuggacaucgaccuccgccccgccagcgccuggacccuguacgccguggcgaccaccuucgucacgcccaugcugcggcacuccaucgagaacagcagcgugaacgugucccucaccgccaucgccaaccaggccaccguccugaugggccuggggaagggcuggccccucagcaagauggacaucggggugccgcugcuggccaucggcugcuacucccaggugaaccccaucacccucacggcggcccugcugcuccuggucgcccacuacgccaucaucgggcccggccugcaggcgaaggccacccgcgaggcccagaagcgggccgccgcgggcaucaugaagaaccccaccguggacgggaucaccgugaucgaccucgacccgauccccuacgaccccaaguucgagaagcagcugggccaggucaugcugcucauccugugcgugacccaggugcugaugaugcgcaccaccugggcccucugcgaggcccugacccuggccacggggcccaucagcacccucugggagggcaacccggggcgguucuggaacaccaccaucgccgucuccauggcgaacaucuuccgcggcagcuaccuggccggcgccgggcuccucuucuccaucaugaagaacacgaccaacacccggcgcggcaccgggaacaucggcgagacgcugggcgagaaguggaagucccgccugaacgcccucgggaaguccgaguuccagaucuacaagaaguccggcauccaggagguggaccggacccuggccaaggaggggaucaagcgcggcgagaccgaccaccacgcggugucccgggggagcgccaagcugcgcugguucgucgagcggaacauggugacccccgagggcaagguggucgaccucggcugcgggcgcggcgggugguccuacuacugcggcgggcugaagaacgugcgggaggugaagggccugacgaagggcgggcccggccacgaggagcccaucccgaugagcaccuacggguggaaccucguccgccugcaguccggcguggacguguucuucaucccgcccgagaagugcgacacccugcucugcgacaucggggagagcucccccaacccgaccgucgaggccggccggacgcugcgcgugcugaaccucguggagaacuggcugaacaacaacacccaguucugcaucaagguccugaaccccuacaugcccagcgugaucgagaagauggaggcccugcagcggaaguacggcggggcgcucgugcgcaacccgcugucccggaacagcacccacgagauguacugggucagcaacgccuccggcaacaucgugagcuccgugaacaugaucagccgcaugcugaucaaccgguucaccaugcgccacaagaaggccaccuacgagcccgacgucgaccucggguccggcacgcggaacaucgggaucgagagcgagacccccaaccuggacaucaucggcaagcgcaucgagaagaucaaggaggagcacgagaccuccuggcacuacgaccaggaccaccccuacaagaccugggccuaccacggcagcuacgagacgaagcagaccggguccgccagcuccauggugaacggcgugguccggcugcucaccaagccgugggacgugcugcccaccgugacgcagauggcgaugaccgacaccacccccuucgggcagcagcgcgucuucaaggagaagguggacacgcgcacccaggagcccaaggagggcaccaagaagcugaugaagaucaccgccgaguggcucuggaaggagcugggcaagaagaagacgccgcggaugugcacccgcgaggaguucacccggaaggugcgcagcaacgccgcccugggggccaucuucaccgacgagaacaaguggaaguccgcgcgggaggccgucgaggacagccgcuucugggagcucguggacaaggagcggaaccugcaccuggagggcaagugcgagacgugcgucuacaacaugauggggaagcgcgagaagaagcucggcgaguucgggaaggccaagggcucccgggccaucugguacauguggcugggcgcccgcuuccuggaguucgaggcgcucggguuccugaacgaggaccacugguucagccgggagaacucccugagcggcguggagggggagggccuccacaagcugggguacauccugcgcgacguguccaagaaggagggcggcgccauguacgccgacgacaccgccgggugggacacccggaucacccucgaggaccugaagaacgaggagauggucacgaaccacauggagggcgagcacaagaagcuggcggaggccaucuucaagcucaccuaccagaacaagguggugcgcguccagcggcccacgccccgggggaccgugauggacaucaucagccggcgcgaccagcggggcagcggccagguggggacguacggccugaacaccuucaccaacauggaggcccagcugauccgccagauggagggggagggcgucuucaagaacauccagcaccucaccgugacggaggaggccgccgugcagaacuggcuggcgcgggucgggcgcgagcgccugucccggauggccaucagcggcgacgacugcguggugaagccccucgacgaccgcuucgccaacgcccugaccgcccugaacgacaugggcaagauccggaaggacauccagcagugggagccguccaagggguggaacgacuggacccagguccccuucugcagccaccacuuccacgagcucaucaugaaggacggccgcgugcuggugguccccugccggaaccaggacgagcugaucgggcgcgcgcggaucucccagggcgccggguggagccuccgcgagaccgccugccugggcaaguccuacgcccagauguggagccugauguacuuccaccggcgcgaccuccggcuggccgcgaacgccaucugcuccgccgugcccagccacugggugccgacgucccgcaccaccuggagcauccacgccaagcacgaguggaugaccaccgaggacaugcugacggucuggaaccggguguggauccgcgagaaccccuggauggaggacaagacccccguggaguccugggaggagauccccuaccucggcaagcgggaggaccaguggugcgggagccugaucggccugaccucccgcgccaccugggcgaagaacauccaggccgccaucaaccagguccggagccucaucgggaacgaggaguacacggacuacaugccguccaugaagcgcuuccggcgcgaggaggaggaggccggcgugcugugguga

SEQ ID NO: 9153 - RNA, 9876 nt, Artificial Sequence
  derived and/or modified CDS sequence (opt1) from DENV-2__GU131930__SS-prME
agcgccggcaugaucaucaugcugauccccaccgugauggccuuccaccucaccacccgcaacggggagccccacaugaucgugggcauccaggagaagggcaagagccugcuguucaagaccgaggacggcgugaacaugugcacccucauggcgauggaccugggggagcugugcgaggacaccaucaccuacaagugcccccuccugcggcagaacgagcccgaggacaucgacugcuggugcaacagcaccagcaccugggugaccuacgggaccugcaccaccaccggcgagcaccgccgggagaagcgcagcgucgcccuggugccccacguggggaugggccucgagacccggaccgagaccuggauguccagcgagggggccuggaagcacgcccagcgcaucgagaccuggauccugcggcacccgggcuucaccaucauggccgcgauccuggccuacaccaucgggaccacccacuuccagcgcgcccucaucuucauccugcugacggccgucgcgcccuccaugaccaugcggugcaucggcaucagcaaccgcgacuucguggagggcguguccgggggcagcugggucgacaucgugcucgagcacggguccugcgugaccaccauggccaagaacaagcccacgcuggacuucgagcugaucaagaccgaggccaagcagcccgccacccuccggaaguacugcaucgaggccaagcugaccaacacgaccaccgagagccgcugccccacccagggcgagcccucccugaaggaggagcaggacaagcgguucgucugcaagcacagcaugguggaccgcggcugggggaacggcugcgggcuguucggcaagggcgggaucgugacgugcgcgauguucacgugcaagaagaacauggagggcaagaucguccagcccgagaaccuggaguacaccaucguggugacgccccacuccggggaggagcacgccgucggcaacgacacggggaagcacggcaaggagaucaaggugaccccgcagagcuccaucaccgaggccgagcugaccggguacggcaccgugacgauggagugcagcccccggaccggccucgacuucaacgagaugguccugcugcagauggaguccaaggccuggcucgugcaccgccagugguuccuggaccugccccuccccuggcugccgggggccgacaagcagggcagcaacuggauccagaaggagacccuggugaccuucaagaacccccacgcgaagaagcaggacgucgugguccucgggagccaggagggcgccaugcacacggcccugaccggggccaccgagauccagauguccagcggcaaccuccuguucaccggccaccugaagugccggcugcgcauggacaagcuccagcugaaggggauguccuacagcaugugcacgggcaaguucaagguggugaaggagaucgccgagacccagcacgggaccaucgucauccgggugcaguacgagggcgacggcucccccugcaagauccccuucgagaucauggaccuggagaagcgcuacgugcucgggcggcugaucaccgucaacccgaucgugacggagaaggacagccccgugaacaucgaggcggagccgcccuucggcgacuccuacaucaucaucggggucgagccgggccagcugaagcucaacugguucaagaaggggagcuccaucggccagauguucgagaccaccaugcgcggcgccaagcgcauggccauccugggggacaccgccugggacuucggcagccucggcgggguguucacguccaucgggaaggcccuccaccagguguucggggcgaucuacggcgccgccuucagcggggucuccuggaccaugaagauccugaucggcgugaucaucaccuggaucgggaugaacagccgguccaccagccuguccgugagccugguccucgugggcaucgugacgcuguaccugggggucauggugcaggccgacuccggcugcguggucagcuggaagaacaaggagcucaagugcggcagcgggaucuucaucaccgacaacgugcacaccuggaccgagcaguacaaguuccagcccgagucccccagcaagcuggcguccgccauccagaaggcccaggaggagggcaucugcgggauccgcagcgugacgcggcuggagaaccucauguggaagcagaucacccccgagcugaaccacauccuggccgagaacgaggucaagcucaccaucaugaccggcgacaucaaggggaucaugcaggccggcaagcgcucccugcggccgcagcccacggagcugaaguacagcuggaagaccuggggcaaggcgaagaugcucuccaccgagagccacaaccagaccuuccugaucgacgggcccgagacggccgagugcccgaacaccaaccgcgccuggaacucccuggagguggaggacuacggcuucgggguguucaccaccaacaucuggcucaagcugaaggagaagcaggacgccuucugcgacagcaagcugauguccgccgcgaucaaggacaaccgggccguccacgccgacaugggcuacuggaucgagagcgcccucaacgacacguggaagaucgagaaggccuccuucaucgaggugaagaacugccacuggcccaagagccacacccugugguccaacggcgugcuggagagcgagaugaucauccccaagaaccucgcggggcccgucucccagcacaacuaccgcccgggcuaccacacccagaccgccgggcccuggcaccugggcaagcuggagauggacuucgacuucugcgacgggaccacggugaucgugaccgaggacugcggcaaccggggccccagccuccgcaccaccacggccagcgggaagcugaucaccgaguggugcugccgguccugcacccugcccccgcuccgcuaccggggcgaggacgggugcugguacggcauggagauccgcccccugaaggagaaggaggagaaccuggucaacagccucgugaccgccgggcacggccagguggacaacuucucccugggcguccuggggauggcccuguuccuggaggagaugcugcggacgcgcgugggcaccaagcacgccauccuccugguggccgucagcuucgugacccugaucaccgggaacauguccuucaaggaccucggccggguggucgugaugguggggacgaccaugaccgacgacaucggcaugggcgucaccuaccuggcccugcucgccgcguucaaggugcgccccacguucgccgccgggcugcugcuccggaagcugaccagcaaggagcugaugaugaccaccaucggcaucgugcuccugucccagagcacgauccccgagaccauccuggagcucaccgacgcccuggcccuggggaugaugguccucaagaucgugcgcgacauggagaaguaccagcuggcggugaccaucauggccauccugugcgucccgaacgccgugauccuccagaacgccuggaaggucuccugcacgauccuggccguggugagcgucagcccccugcuccugaccagcucccagcagaagaccgacuggaucccccuggcgcucaccaucaagggccugaaccccacggccaucuuccugaccacccucagccgcaccaacaagaagcgguccuggccgcugaacgaggccaucauggccgugggcauggugagcauccuggcguccagccuccugaagaacgacauccccaugacggggccccuggucgccggcgggcuccugaccgugugcuacgugcugaccggccgcuccgccgaccucgagcuggagcgggccaccgacgucaagugggaggaccaggccgagaucagcgggagcucccccauccugagcaucacgaucuccgaggacggcagcauguccaucaagaacgaggaggaggagcagacccucaccauccugauccgcaccggccugcucgugaucagcgggcuguucccgguguccauccccaucaccgcggccgccugguaccugugggaggucaagaagcagcgggccggcgugcucugggacgugcccuccccgccgcccauggggaaggccgagcuggaggacggcgcguaccgcaucaagcagaaggggauccugggcuacucccagaucggcgccggggucuacaaggagggcacguuccacaccauguggcacgugacccgcggggcggugcucaugcacaagggcaagcgcaucgagcccagcugggccgacgucaagaaggaccugaucuccuacgggggcggcuggaagcuggagggggaguggaaggagggcgaggagguccaggugcucgcccuggagcccgggaagaacccccgggcgguccagaccaagcccggccuguucaagacgaacaccgggaccaucggcgccgugagccucgacuucucccccggcaccagcgggucccccaucaucgacaagaagggcaagguggucgggcuguacggcaacggcguggugacgcgcagcggggccuacgucuccgccaucgcccagaccgagaaguccaucgaggacaaccccgagaucgaggacgacaucuuccggaagcgccggcugaccaucauggaccugcaccccggcgcggggaagaccaagcgcuaccuccccgccaucgugcgggaggccaucaagcgcggccugcggacgcugauccucgccccgacccgcguggucgcggccgagauggaggaggcccugcgggggcugcccauccgcuaccagacccccgccauccgggccgagcacaccggccgcgagaucguggaccucaugugccacgcgacguucaccaugcgccugcugucccccgugcgggucccgaacuacaaccucaucaucauggacgaggcccacuucaccgaccccgccagcaucgccgcccgcggcuacaucagcacccggguggagaugggggaggcggccggcaucuucaugacggccacgccgcccgggucccgcgacccguucccccagagcaacgcccccaucaucgacgaggagcgggagauccccgagcgcuccuggaacaccggccacgagugggugaccgacuucaaggggaagacggucugguucgugccgagcaucaaggccggcaacgacaucgcggccugccugcggaagaacggcaagaaggugauccagcugucccgcaagaccuucgacagcgaguacgucaagacccggaccaacgacugggacuucguggugacgaccgacaucuccgagaugggggccaacuucaaggccgagcgcgucaucgacccccggcgcugcaugaagcccgugauccucaccgacggcgaggagcgggugauccuggcggggcccaugccggucacccacagcuccgccgcccagcgccggggccgcaucgggcggaaccccaagaacgagaacgaccaguacaucuacaugggcgagccccuggagaacgacgaggacugcgcccacuggaaggaggccaagaugcuccuggacaacaucaacacgcccgagggcaucaucccgagcauguucgagcccgagcgcgagaagguggacgcgaucgacggggaguaccggcugcgcggcgaggcccgcaagaccuucguggaccucaugcggcgcggggaccugcccgucuggcuggccuacaagguggccgccgagggcaucaacuacgcggaccggcgcuggugcuucgacgggaucaagaacaaccagauccucgaggagaacguggaggucgagaucuggaccaaggagggcgagcggaagaagcugaagccgcgcuggcuggacgcccggaucuacuccgacccccucgcccugaaggaguucaaggaguucgccgccggccgcaagagccugacccucaaccugaucacggagauggggcggcugcccaccuucaugacccagaagacccgcgacgcgcucgacaaccuggccgugcugcacacggccgaggccggcgggcgggcguacaaccacgcccucuccgagcugcccgagacccuggagacccuccugcugcucacccugcuggccaccgucacgggcggcaucuuccucuuccugaugagcgggcgcggcaucgggaagaugacccugggcaugugcugcaucaucaccgccuccauccuccugugguacgcccagauccagccgcacuggaucgcggccagcaucauccuggaguucuuccucaucgugcugcugauccccgagcccgagaagcagcggacgccccaggacaaccagcucacguacguggucaucgccauccugaccgugguggccgccaccauggcgaacgagaugggguuccuggagaagaccaagaaggaccucggccugggcuccaucgccacgcagcagccggagagcaacauccuggacaucgaccuccgccccgccuccgccuggacccuguacgccgucgcgaccaccuucgugacgcccaugcugcggcacagcaucgagaacagcuccgugaacgucagccucaccgccaucgccaaccaggccaccgugcugauggggcugggcaagggguggccccucuccaagauggacaucggcgugccgcugcuggccaucgggugcuacagccaggucaaccccaucacccucacggcggcccugcugcuccugguggcccacuacgccaucaucggccccggccugcaggcgaaggccacccgcgaggcccagaagcgggccgccgcggggaucaugaagaaccccaccguggacggcaucaccgucaucgaccucgacccgauccccuacgaccccaaguucgagaagcagcugggccaggugaugcugcucauccugugcgugacgcagguccugaugaugcgcaccaccugggcccucugcgaggcccugacccuggccacgggccccaucuccacccucugggaggggaacccgggccgguucuggaacaccaccaucgccgugagcauggcgaacaucuuccgcggcuccuaccuggccggggccggccuccucuucagcaucaugaagaacacgaccaacacccggcgcgggaccggcaacaucggcgagacgcugggggagaaguggaagucccgccugaacgcccucggcaagagcgaguuccagaccuacaagaaguccgggauccaggagguggaccggacccuggccaaggagggcaucaagcgcggggagaccgaccaccacgcggucagccggggcuccgccaagcugcgcugguucguggagcggaacauggugacgcccgagggcaaggucguggaccucgggugcggccgcgggggcuggagcuacuacugcgggggccugaagaacgugcgggaggucaagggccugaccaagggcgggcccgggcacgaggagcccaucccgauguccaccuacggcuggaaccucgugcgccugcagagcgggguggacgucuucuucaucccgcccgagaagugcgacacccugcucugcgacaucggcgaguccagccccaacccgaccguggaggccggccggacgcugcgcgugcugaaccucgucgagaacuggcugaacaacaacacccaguucugcaucaaggugcugaaccccuacaugcccuccgugaucgagaagauggaggcccugcagcggaaguacgggggcgcgcucguccgcaacccgcugagccggaacagcacccacgagauguacuggguguccaacgccagcgggaacaucguguccagcgucaacaugaucucccgcaugcugaucaaccgguucaccaugcgccacaagaaggccacguacgagcccgacguggaccucggcagcgggacccggaacaucggcaucgaguccgagauccccaaccuggacaucaucggcaagcgcaucgagaagaucaagcaggagcacgagaccagcuggcacuacgaccaggaccaccccuacaagaccugggccuaccacggguccuacgagacgaagcagaccggcagcgccuccagcauggugaacggggucgugcggcugcucaccaagccgugggacgugcugcccaccgucacgcagauggcgaugaccgacaccacccccuucggccagcagcgcguguucaaggagaagguggacacgcgcacccaggagcccaaggagggcaccaagaagcugaugaagaucaccgccgaguggcucuggaaggagcuggggaagaagaagacgccgcggaugugcacccgcgaggaguucacccggaagguccgcuccaacgccgcccugggcgccaucuucaccgacgagaacaaguggaaguccgcgcgggaggccguggaggacucccgcuucugggagcucguggacaaggagcggaaccugcaccuggaggggaagugcgagacgugcgucuacaacaugaugggcaagcgcgagaagaagcucggggaguucggcaaggccaagggcagccgggccaucugguacauguggcugggggcccgcuuccuggaguucgaggcgcucggcuuccugaacgaggaccacugguucucccgggagaacagccuguccgggguggagggcgaggggcuccacaagcugggcuacauccugcgcgacgucagcaagaaggagggcggggccauguacgccgacgacaccgccggcugggacacccggaucacccucgaggaccugaagaacgaggagauggugacgaaccacauggagggggagcacaagaagcuggcggaggccaucuucaagcucaccuaccagaacaaggugguccgcgugcagcggcccacgccccggggcaccgugauggacaucaucagccggcgcgaccagcggggguccggccaggucggcacguacgggcugaacaccuucaccaacauggaggcccagcugauccgccagauggagggcgaggggguguucaagaacauccagcaccucaccgccacggaggagguggccgucaagaacuggcuggcgcgggugggccgcgagcgccugagccggauggccaucuccggcgacgacugcguggucaagccccucgacgaccgcuucgccaacgcccugaccgcccugaacgacauggggaagauccggaaggacauccagcagugggagccgagcaagggcuggaacgacuggacccaggugcccuucugcucccaccacuuccacgagcucaucaugaaggacgggcgcgugcuggucgugcccugccggaaccaggacgagcugaucggccgcgcgcggaucagccagggggccggcuggucccuccgcgagaccgccugccugggcaagagcuacgcccagauguggucccugauguacuuccaccggcgcgaccuccggcuggccgcgaacgccaucugcagcgccgugcccucccacugggucccgaccagccgcacgaccugguccauccacgccaagcacgaguggaugaccaccgaggacaugcugacgguguggaaccggguguggauccgcgagaaccccuggauggaggacaagacccccgucgagagcugggaggagauccccuaccucgggaagcgggaggaccaguggugcggcucccugaucgggcugaccagccgcgccaccugggcgaagaacauccaggccgccaucaaccaggugcggucccucaucggcaacgaggaguacacggacuacaugccgagcaugaagcgcuuccggcgcgaggaggaggaggccggggugcugugguga

SEQ ID NO: 9154 - RNA, 9876 nt, Artificial Sequence
  derived and/or modified CDS sequence (opt1) from DENV-2__GU131931__SS-prME
agcgcggggaugaucaucaugcugauccccaccgugauggccuuccaccucaccacccgcaacggggagccccacaugaucgugggcauccaggagaaggggaagucccugcuguucaagaccgaggacggcgugaacaugugcacccucauggcgauggaccugggggagcugugcgaggacaccaucaccuacaagugcccccuccugcggcagaacgagcccgaggacaucgacugcuggugcaacagcaccagcaccugggugaccuacgggaccugcaccaccaccggcgagcaccgccgggagaagcgcagcgucgcccuggugccccacguggggaugggccucgagacccggaccgagaccuggauguccagcgagggggccuggaagcacgcccagcgcaucgagaccuggauccugcggcacccgggcuucaccaucauggccgcgauccuggcccacaccaucgggaccacccacuuccagcgcguccucaucuucauccugcugacggccguggcccccuccaugaccaugcggugcaucggcaucagcaaccgcgacuucguggagggcgucuccgggggcagcuggguggacaucgugcucgagcacggguccugcgucaccaccauggcgaagaacaagcccacgcuggacuucgagcugaucaagaccgaggccaagcagcccgccacccuccggaaguacugcaucgaggccaagcugaccaacacgaccaccgagagccgcugccccacccagggcgagcccucccugaaggaggagcaggacaagcgguucgugugcaagcacagcaugguggaccgcggcugggggaacggcugcggccuguucggcaagggcgggaucgucacgugcgccauguucacgugcaagaagaacauggagggcaagaucgugcagcccgagaaccuggaguacaccaucguggucacgccccacuccggggaggagcacgcggugggcaacgacacggggaagcacggcauggagaucaaggugaccccgcagagcuccaucaccgaggccgagcugaccggguacggcaccgucacgauggagugcagcccccggaccggccucgacuucaacgagauggugcugcugcagauggagaacaaggccuggcucgugcaccgccagugguuccuggaccugccccuccccuggcugccgggggccgacaagcaggaguccaacuggauccagaaggagacccuggucaccuucaagaacccccacgccaagaagcaggacguggucgugcucggcagccaggagggggcgaugcacacggcccugaccggcgccaccgagauccagaugagcuccgggaaccuccuguucaccggccaccugaagugccggcugcgcauggacaagcuccagcugaagggcaugagcuacuccaugugcacggggaaguucaagguggucaaggagaucgccgagacccagcacggcaccaucgugauccgggugcaguacgagggggacggcagccccugcaagauccccuucgagaucauggaccuggagaagcgcuacguccucggccggcugaucaccgugaacccgaucgugacggagaaggacucccccgucaacaucgaggccgagccgcccuucggggacagcuacaucaucaucggcguggagccggggcagcugaagcucaacugguucaagaagggcuccagcaucgggcagauguucgagaccaccaugcgcggcgcgaagcgcauggccauccugggcgacaccgccugggacuucgggucccugggcgggguguucacgagcaucggcaaggcccuccaccagaucuucggggccaucuacggcgcggccuucuccggcgucagcuggaccaugaagauccugaucggggugaucaucaccuggaucggcaugaacucccggagcaccucccugagcgugucccugguccucguggggaucgugacgcuguaccugggcgucauggugcaggccgacagcgggugcguggucuccuggaagaacaaggagcucaagugcggcagcggcaucuucaucaccgacaacgugcacaccuggaccgagcaguacaaguuccagcccgagagccccuccaagcuggccagcgcgauccagaaggcccaggaggaggggaucugcggcauccgcuccgugacgcggcuggagaaccucauguggaagcagaucacccccgagcugaaccacauccuggccgagaacgaggucaagcucaccaucaugaccggggacaucaagggcaucaugcaggccgggaagcgcagccugcggccgcagcccacggagcugaaguacuccuggaagaccuggggcaaggccaagaugcucagcaccgagucccacaaccagaccuuccugaucgacggccccgagacggcggagugcccgaacaccaaccgcgccuggaacagccuggagguggaggacuacggguucggcguguucaccaccaacaucuggcucaagcugaaggagaagcaggacgccuucugcgacuccaagcugaugagcgccgccaucaaggacaaccgggcgguccacgccgacaugggguacuggaucgaguccgcccucaacgacacguggaagaucgagaaggccagcuucaucgaggugaagaacugccacuggcccaagucccacacccuguggagcaacggcgugcuggaguccgagaugaucauccccaagaaccucgccggccccgucagccagcacaacuaccgcccgggguaccacacccagaucgcgggccccuggcaccuggggaagcuggagauggacuucgacuucugcgacggcaccaccgugaucgugacggaggacugcgggaaccggggccccucccuccgcaccaccaccgccagcggcaagcugaucacggaguggugcugccggagcugcacccugcccccgcuccgcuaccgcggggaggacggcugcugguacgggauggagauccgcccccugaaggagaaggaggagaaccuggucaacucccucgugaccgccggccacggccagguggacaacuucagccugggcguccugggcauggcccucuuccuggaggagaugcugcggacccgcguggggacgaagcacgcgauccuccugguggccgucuccuucgugacccugaucaccggcaacaugagcuucaaggaccucgggcggguggucgugauggugggcgccaccauggccgacgacaucgggaugggcgucacguaccuggcccugcucgcggccuucaaggugcgccccaccuucgccgccggccugcugcuccggaagcugaccuccaaggagcugaugaugaccacgaucgggaucgugcuccugagccaguccaccauccccgagaccguccuggagcucaccgacgcccuggcgcugggcaugauggugcucaagaucgugcgcaacauggagaaguaccagcuggccgucacgaucauggccauccugugcgugccgaacgccgucauccuccagaacgccuggaaggugagcugcaccauccuggcgguggucuccgugagcccccugcuccugaccuccagccagcagaagaccgacuggaucccccuggcccucacgaucaaggggcugaaccccaccgccaucuuccugaccacccucucccgcacgaacaagaagcggagcuggccgcugaacgaggccaucauggcggugggcauggucuccauccuggccagcucccuccugaagaacgacauccccaugaccggcccccugguggccgggggccuccugaccgugugcuacguccugaccgggcgcagcgccgaccucgagcuggagcgggccacggacgugaagugggaggaccaggcggagaucuccggcagcagccccauccuguccaucaccaucagcgaggacggguccaugagcaucaagaacgaggaggaggagcagacccucaccauccugauccgcacgggccugcucgugaucuccggccuguucccgaucagcauccccaucaccgccgccgccugguaccugugggaggucaagaagcagcgggccggggugcucugggacgugcccagcccgccgcccaugggcaaggcggagcuggaggacggggccuaccgcaucaagcagaagggcauccugggguacagccagaucggcgccggcgucuacaaggaggggaccuuccacaccauguggcacgugacccggggcgccgugcucaugcacaaggggaagcgcaucgagcccuccugggccgacgucaagaaggaccugaucagcuacggcgggggcuggaagcuggagggcgaguggaaggagggggaggagguccaggugcucgcgcuggagcccggcaagaacccccgggccguccagacgaagcccgggcuguucaagaccaacaccggcaccaucggggccgugucccucgacuucagccccggcacguccggcagccccaucaucgacaagaaggggaagguggucggccuguacgggaacggcguggugacccgcuccggcgccuacgucagcgccaucgcgcagaccgagaaguccaucgaggacaaccccgagaucgaggacgacaucuuccggaagcgccggcugaccaucauggaccugcaccccggggccggcaagacgaagcgcuaccuccccgccaucgugcgggaggccaucaagcgcgggcugcggacccugauccucgcgccgacccgcguggucgccgccgagauggaggaggcccugcggggccugcccauccgcuaccagacccccgccauccgggcggagcacacggggcgcgagaucguggaccucaugugccacgccaccuucaccaugcgccugcugagccccgugcgggucccgaacuacaaccucaucaucauggacgaggcccacuucaccgaccccgccuccaucgccgcgcgcggcuacaucagcacgcggguggagaugggcgaggccgccgggaucuucaugaccgccacgccgcccggcagccgcgacccguucccccaguccaacgcccccaucaucgacgaggagcgggagauccccgagcgcagcuggaacuccgggcacgagugggugaccgacuucaagggcaagacggucugguucgugccgagcaucaaggcggggaacgacaucgccgccugccugcggaagaacggcaagaaggugauccagcugucccgcaagaccuucgacagcgaguacgucaagacccggaccaacgacugggacuucguggugacgaccgacaucuccgagaugggcgccaacuucaaggcggagcgcgucaucgacccccggcgcugcaugaagcccgugauccucaccgacggggaggagcgggugauccuggccggccccaugccggucacccacagcuccgccgcccagcgccgggggcgcaucggccggaaccccaagaacgagaacgaccaguacaucuacaugggggagccccuggagaacgacgaggacugcgcccacuggaaggaggcgaagaugcuccuggacaacaucaacacgcccgagggcaucaucccgagcauguucgagcccgagcgcgagaagguggacgccaucgacggcgaguaccggcugcgcggggaggcccgcaagaccuucguggaccucaugcggcgcggcgaccugcccgucuggcuggccuacaagguggccgcggaggggaucaacuacgccgaccggcgcuggugcuucgacggcaucaagaacaaccagauccucgaggagaacguggaggucgagaucuggaccaaggagggggagcggaagaagcugaagccgcgcuggcuggacgcccggaucuacuccgacccccucgcccugaaggaguucaaggaguucgccgcgggccgcaagagccugacccucaaccugaucacggagaugggccggcugcccaccuucaugacccagaagacccgcgacgcccucgacaaccuggccgugcugcacacggccgaggccggcgggcgggccuacaaccacgcccucuccgagcugcccgagacccuggagacccuccugcugcucacccugcuggccacggucaccgggggcaucuuccucuuccugaugagcggccgcgggaucggcaagaugacccuggggaugugcugcaucaucaccgccuccauccuccugugguacgcgcagauccagccgcacuggaucgccgccagcaucauccuggaguucuuccucaucgugcugcugauccccgagcccgagaagcagcggacgccccaggacaaccagcucacguacguggucaucgccauccugaccgugguggccgcgaccauggccaacgagaugggcuuccuggagaagaccaagaaggaccucgggcugggcuccaucgccacgcagcagccggagagcaacauccuggacaucgaccuccgccccgccuccgccuggacccuguacgcggucgccaccaccuucgugacgcccaugcugcggcacagcaucgagaacagcuccgugaacgucagccucaccgccaucgccaaccaggccaccgugcugaugggccuggggaagggcuggccccucuccaagauggacaucggggugccgcugcuggcgaucggcugcuacagccaggucaaccccaucacccucacggccgcccugcugcuccugguggcccacuacgcgaucaucgggcccggccugcaggccaaggccacccgcgaggcccagaagcgggccgcggccggcaucaugaagaaccccaccguggacgggaucaccgucaucgaccucgacccgauccccuacgaccccaaguucgagaagcagcugggccaggugaugcugcucauccugugcgugacgcagguccugaugaugcgcaccaccugggcccucugcgaggcccugacccuggccacggggcccaucuccacccucugggagggcaacccggggcgguucuggaacaccaccaucgcggugagcauggccaacaucuuccgcggcuccuaccuggccggcgccgggcuccucuucagcaucaugaagaacacgaccaacacccggcgcggcaccgggaacaucggcgagacgcugggcgagaaguggaagucccgccugaacgcccucgggaaguccgaguuccagaucuacaagaaguccggcauccaggagguggaccggacccuggcgaaggaggggaucaagcgcggcgagaccgaccaccacgccgucagccggggguccgccaagcugcgcugguucguggagcggaacauggugacccccgagggcaaggucguggaccucggcugcgggcgcggcggguggagcuacuacugcggcgggcugaagaacgugcgggaggucaagggccugacgaagggcgggcccggccacgaggagcccaucccgauguccaccuacggguggaaccucgugcgccugcagagcggcguggacgucuucuucaucccgcccgagaagugcgacacccugcucugcgacaucggggaguccagccccaacccgaccguggaggccggccggacgcugcgcgugcugaaccucgucgagaacuggcugaacaacaacacccaguucugcaucaaggugcugaaccccuacaugcccuccgugaucgagaagauggaggcgcugcagcggaaguacggcggggcccucguccgcaacccgcugagccggaacagcacccacgagauguacuggguguccaacgccagcggcaacaucguguccagcgucaacaugaucucccgcaugcugaucaaccgguucaccaugcgccacaagaaggccaccuacgagcccgacguggaccucgggagcggcacgcggaacaucgggaucgaguccgagauccccaaccuggacaucaucggcaagcgcaucgagaagaucaaggaggagcacgagaccagcuggcacuacgaccaggaccaccccuacaagaccugggccuaccacggcuccuacgagaccaagcagacggggagcgcguccagcauggugaacggcgucgugcggcugcucaccaagccgugggacgugcugcccaccgucacccagauggccaugacggacaccacccccuucgggcagcagcgcguguucaaggagaagguggacacccgcacgcaggagcccaaggagggcaccaagaagcugaugaagaucaccgccgaguggcucuggaaggagcugggcaagaagaagaccccgcggaugugcacgcgcgaggaguucacccggaagguccgcuccaacgccgcccugggggcgaucuucaccgacgagaacaaguggaaguccgcccgggaggccguggaggacucccgcuucugggagcucguggacaaggagcggaaccugcaccuggagggcaagugcgagaccugcgucuacaacaugauggggaagcgcgagaagaagcucggcgaguucgggaaggccaagggcagccgggccaucugguacauguggcugggcgcgcgcuuccuggaguucgaggcccucggguuccugaacgaggaccacugguucucccgggagaacagccuguccggcguggagggggagggccuccacaagcugggguacauccugcgcgacgucagcaagaaggagggcggcgccauguacgccgacgacacggcggggugggacacccggaucacccucgaggaccugaagaacgaggagauggugaccaaccacauggagggcgagcacaagaagcuggccgaggccaucuucaagcucacguaccagaacaaggugguccgcgugcagcggcccacgccccgggggaccgugauggacaucaucagccggcgcgaccagcggggcuccgggcaggucggcaccuacggccugaacacguucaccaacauggaggcccagcugauccgccagauggagggggagggcguguucaagaacauccagcaccucaccgugaccgaggaggccgcgguccagaacuggcuggcccggguggggcgcgagcgccugagccggauggccaucuccggcgacgacugcguggucaagccccucgacgaccgcuucgccaacgcccugacggcgcugaacgacaugggcaagauccggaaggacauccagcagugggagccgagcaagggguggaacgacuggacccaggugcccuucugcucccaccacuuccacgagcucaucaugaaggacggccgcgugcuggucgugcccugccggaaccaggacgagcugaucgggcgcgcccggaucagccagggcgccggguggucccuccgcgagaccgccugccugggcaagagcuacgcccagauguggucccugauguacuuccaccggcgcgaccuccggcuggcggccaacgccaucugcagcgccgugcccucccacugggucccgaccagccgcacgaccugguccauccacgccaagcacgaguggaugaccaccgaggacaugcugaccguguggaaccggguguggauccgcgagaaccccuggauggaggacaagacgcccgucgagagcugggaggagauccccuaccucggcaagcgggaggaccaguggugcgggucccugaucggccugaccagccgcgcgaccugggccaagaacauccaggccgccaucaaccaggugcggucccucaucgggaacgaggaguacaccgacuacaugccgagcaugaagcgcuuccggcgcgaggaggaggaggcgggcgugcugugguga

SEQ ID NO: 9155 - RNA, 9876 nt, Artificial Sequence
  derived and/or modified CDS sequence (opt1) from DENV-2__GU131932__SS-prME
agcgcgggcaugaucaucaugcugauccccaccgugauggccuuccaccucaccacccgcaacggggagccccacaugaucgucggcauccaggagaaggggaagucccugcuguucaagaccgaggacggcgugaacaugugcacccucauggcgauggaccugggggagcugugcgaggacaccaucaccuacaagugcccccuccugcggcagaacgagcccgaggacaucgacugcuggugcaacagcaccuccaccugggugaccuacgggaccugcaccaccaccggcgagcaccgccgggagaagcgcagcgucgcccuggugccccacguggggaugggccucgagacccggaccgagaccuggauguccagcgagggggccuggaagcacgcccagcgcaucgagaccuggauccugcggcacccgggcuucacgaucauggccgcgauccuggccuacaccaucgggaccacccacuuccagcgcguccucaucuucauccugcugacggccguggcccccuccaugaccaugcggugcaucggcaucagcaaccgcgacuucguggagggcgucuccgggggcagcuggguggacaucgugcucgagcacggguccugcgucaccaccauggcgaagaacaagcccacgcuggacuucgagcugaucaagaccgaggccaagcagcccgccacccuccggaaguacugcaucgaggccaagcugaccaacacgaccaccgagagccgcugccccacccagggcgagcccucccugaaggaggagcaggacaagcgguucgugugcaagcacagcaugguggaccgcggcugggggaacggcugcggccuguucggcaagggcgggaucgucacgugcgccauguucacgugcaagaagaacauggagggcaagaucgugcagcccgagaaccuggaguacaccaucguggucacgccccacuccggggaggagcacgcggugggcaacgacacggggaagcacggcauggagaucaaggugaccccgcagagcuccaucaccgaggccgagcugaccggguacggcaccgucacgauggagugcagcccccggaccggccucgacuucaacgagauggugcugcugcagauggagaacaaggccuggcucgugcaccgccagugguuccuggaccugccccuccccuggcugccgggggccgacaagcaggaguccaacuggauccagaaggagacccuggucaccuucaagaacccccacgccaagaagcaggacguggucgugcucggcagccaggagggggcgaugcacacggcccugaccggcgccaccgagauccagaugagcuccgggaaccuccuguucaccggccaccugaagugccggcugcgcauggacaagcuccagcugaagggcaugagcuacuccaugugcacggggaaguucaagguggucaaggagaucgccgagacccagcacggcaccaucgugauccgggugcaguacgagggggacggcagccccugcaagauccccuucgagaucauggaccuggagaagcgcuacguccucggccggcugaucaccgugaacccgaucgugacggagaaggacucccccgucaacaucgaggccgagccgcccuucggggacagcuacaucaucaucggcguggagccggggcagcugaagcucaacugguucaagaagggcuccagcaucgggcagauguucgagaccaccaugcgcggcgcgaagcgcauggccauccugggcgacaccgccugggacuucgggucccugggcgggguguucacgagcaucggcaaggcccuccaccaggucuucggggccaucuacggcgcggccuucuccggcgugagcuggaccaugaagauccugaucggggugaucaucaccuggaucggcaugaacucccggagcaccucccugagcgucucccuggugcucguggggaucgucacgcuguaccugggcgugauggugcaggccgacagcgggugcgucguguccuggaagaacaaggagcucaagugcggcagcggcaucuucaucaccgacaacgugcacaccuggaccgagcaguacaaguuccagcccgagagccccuccaagcuggccagcgcgauccagaaggcccaggaggaggggaucugcggcauccgcuccgucacgcggcuggagaaccucauguggaagcagaucacccccgagcugaaccacauccuggccgagaacgaggugaagcucaccaucaugaccggggacaucaagggcaucaugcaggccgggaagcgcagccugcggccgcagcccacggagcugaaguacuccuggaagaccuggggcaaggccaagaugcucagcaccgaguccuacaaccagaccuuccugaucgacggccccgagacggcggagugcccgaacaccaaccgcgccuggaacagccuggagguggaggacuacggguucggcgucuucaccaccaacaucuggcucaagcugaaggagaagcaggacgccuucugcgacuccaagcugaugagcgccgccaucaaggacaaccgggcggugcacgccgacaugggguacuggaucgaguccgcccucaacgacacguggaagaucgagaaggccagcuucaucgaggugaagaacugccacuggcccaagucccacacccuguggagcaacggcguccuggaguccgagaugaucauccccaagaaccucgccggccccgugagccagcacaacuaccgcccgggguaccacacccagaucgcgggccccuggcaccuggggaagcuggagauggacuucgacuucugcgacggcaccaccgugaucgucacggaggacugcgggaaccggggccccucccuccgcaccaccaccgccagcggcaagcugaucacggaguggugcugccggagcugcacccugcccccgcuccgcuaccgcggggaggacggcugcugguacgggauggagauccgcccccugaaggagaaggaggagaaccuggugaacucccucgugaccgccggccacgggcaggucgacaacuucagccugggcgugcugggcauggcccucuuccuggaggagaugcugcggacccgcguggggacgaagcacgcgauccuccuggucgccguguccuucgugacccugaucaccggcaacaugagcuucaaggaccucgggcgggucguggugauggucggcgccaccauggccgacgacaucgggaugggcgugacguaccuggcccugcucgcggccuucaaggugcgccccaccuucgccgccggccugcugcuccggaagcugaccuccaaggagcugaugaugaccacgaucgggaucguccuccugagccaguccaccauccccgagaccgugcuggagcucaccgacgcccuggcgcugggcaugauggugcucaagaucguccgcaacauggagaaguaccagcuggccgugacgaucauggccauccugugcgucccgaacgccgugauccuccagaacgccuggaaggugagcugcaccauccuggcggucguguccgugagcccccugcuccugaccuccagccagcagaagaccgacuggaucccccuggcccucacgaucaaggggcugaaccccaccgccaucuuccugaccacccucucccgcacgaacaagaagcggagcuggccgcugaacgaggccaucauggcggucggcaugguguccauccuggccagcucccuccugaagaacgacauccccaugaccggcccccugguggccgggggccuccugaccgucugcuacgugcugaccgggcgcagcgccgaccucgagcuggagcgggccacggacgugaagugggaggaccaggcggagaucuccggcagcagccccauccuguccaucaccaucagcgaggacggguccaugagcaucaagaacgaggaggaggagcagacccucaccauccugauccgcacgggccugcucgucaucuccggccuguucccgaucagcauccccaucaccgccgccgccugguaccugugggaggugaagaagcagcgggccggggugcucugggacguccccagcccgccgcccaugggcaaggcggagcuggaggacggggccuaccgcaucaagcagaagggcauccugggguacagccagaucggcgccggcguguacaaggaggggaccuuccacaccauguggcacgugacccggggcgccguccucaugcacaaggggaagcgcaucgagcccuccugggccgacgugaagaaggaccugaucagcuacggcgggggcuggaagcuggagggcgaguggaaggagggggaggaggugcagguccucgcgcuggagcccggcaagaacccccgggccgugcagacgaagcccgggcuguucaagaccaacaccggcaccaucggggccgugucccucgacuucagccccggcacguccggcagccccaucaucgacaagaaggggaaggucgugggccuguacgggaacggcguggucacccgcuccggcgccuacgugagcgccaucgcgcagaccgagaaguccaucgaggacaaccccgagaucgaggacgacaucuuccggaagcgccggcugaccaucauggaccugcaccccggggccggcaagacgaagcgcuaccuccccgccaucgugcgggaggccaucaagcgcgggcugcggacccugauccucgcgccgacccgcgucguggccgccgagauggaggaggcccugcggggccugcccauccgcuaccagacccccgccauccgggcggagcacacggggcgcgagaucguggaccucaugugccacgccaccuucaccaugcgccugcugagccccguccgggugccgaacuacaaccucaucaucauggacgaggcccacuucaccgaccccgccuccaucgccgcgcgcggcuacaucagcacgcggguggagaugggcgaggccgccgggaucuucaugaccgccacgccgcccggcagccgcgacccguucccccaguccaacgcccccaucaucgacgaggagcgggagauccccgagcgcagcuggaacuccgggcacgagugggucaccgacuucaagggcaagacggugugguucgugccgagcaucaaggcggggaacgacaucgccgccugccugcggaagaacggcaagaaggucauccagcugucccgcaagaccuucgacagcgaguacgugaagacccggaccaacgacugggacuucguggucacgaccgacaucuccgagaugggcgccaacuucaaggcggagcgcgugaucgacccccggcgcugcaugaagcccgugauccucaccgacggggaggagcgggucauccuggccggccccaugccggugacccacagcuccgccgcccagcgccgggggcgcaucggccggaaccccaagaacgagaacgaccaguacaucuacaugggggagccccuggagaacgacgaggacugcgcccacuggaaggaggcgaagaugcuccuggacaacaucaacacgcccgagggcaucaucccgagcauguucgagcccgagcgcgagaagguggacgccaucgacggcgaguaccggcugcgcggggaggcccgcaagaccuucgucgaccucaugcggcgcggcgaccugcccguguggcuggccuacaagguggccgcggaggggaucaacuacgccgaccggcgcuggugcuucgacggcaucaagaacaaccagauccucgaggagaacgucgagguggagaucuggaccaaggagggggagcggaagaagcugaagccgcgcuggcuggacgcccggaucuacuccgacccccucgcccugaaggaguucaaggaguucgccgcgggccgcaagagccugacccucaaccugaucacggagaugggccggcugcccaccuucaugacccagaagacccgcgacgcccucgacaaccuggccguccugcacacggccgaggccggcgggcgggccuacaaccacgcccucuccgagcugcccgagacccuggagacccuccugcugcucacccugcuggccacggugaccgggggcaucuuccucuuccugaugagcggccgcgggaucggcaagaugacccuggggaugugcugcaucaucaccgccuccauccuccugugguacgcgcagauccagccgcacuggaucgccgccagcaucauccuggaguucuuccucaucgugcugcugauccccgagcccgagaagcagcggacgccccaggacaaccagcucacguacgucgugaucgccauccugaccguggucgccgcgaccauggccaacgagaugggcuuccuggagaagaccaagaaggaccucgggcugggcuccaucgccacgcagcagccggagagcaacauccuggacaucgaccuccgccccgccuccgccuggacccuguacgcgguggccaccaccuucgugacgcccaugcugcggcacagcaucgagaacagcuccgucaacgugagccucaccgccaucgccaaccaggccaccgugcugaugggccuggggaagggcuggccccucuccaagauggacaucggggucccgcugcuggcgaucggcugcuacagccaggugaaccccaucacccucacggccgcccugcugcuccugguggcccacuacgcgaucaucgggcccggccugcaggccaaggccacccgcgaggcccagaagcgggccgcggccggcaucaugaagaaccccaccgucgacgggaucaccgugaucgaccucgacccgauccccuacgaccccaaguucgagaagcagcugggccaggugaugcugcucauccugugcgucacccaggugcugaugaugcgcaccaccugggcccucugcgaggcccugacccuggccacggggcccaucuccacccucugggagggcaacccggggcgguucuggaacaccaccaucgcggugagcauggccaacaucuuccgcggcuccuaccuggccggcgccgggcuccucuucagcaucaugaagaacacgaccaacacccggcgcggcaccgggaacaucggcgagacgcugggcgagaaguggaagaaccgccugaacgcccucgggaaguccgaguuccagaucuacaagaaguccggcauccaggaggucgaccggacccuggcgaaggaggggaucaagcgcggcgagaccgaccaccacgccgugucccgggggagcgccaagcugcgcugguucguggagcggaacauggucacccccgagggcaaggugguggaccucggcugcgggcgcggcgggugguccuacuacugcggcgggcugaagaacguccgggaggugaagggccugacgaagggcgggcccggccacgaggagcccaucccgaugagcaccuacggguggaaccucgugcgccugcaguccggcgucgacguguucuucaucccgcccgagaagugcgacacccugcucugcgacaucggggagagcucccccaacccgaccguggaggccggccggacgcugcgcguccugaaccucguggagaacuggcugaacaacaacacccaguucugcaucaaggugcugaaccccuacaugcccagcgucaucgagaagauggaggcgcugcagcggaaguacggcggggcccucgugcgcaacccgcugucccggaacagcacccacgagauguacugggugagcaacgccuccggcaacaucgucagcuccgugaacaugaucagccgcaugcugaucaaccgguucaccaugcgccacaagaaggccaccuacgagcccgacguggaccucggguccggcacgcggaacaucgggaucgagagcgagauccccaaccuggacaucaucggcaagcgcaucgagaagaucaaggaggagcacgagaccuccuggcacuacgaccaggaccaccccuacaagaccugggccuaccacggcagcuacgagaccaagcagacgggguccgcgagcuccauggucaacggcguggugcggcugcucaccaagccgugggacguccugcccaccgugacccagauggccaugacggacaccacccccuucgggcagcagcgcguguucaaggagaaggucgacacccgcacgcaggagcccaaggagggcaccaagaagcugaugaagaucaccgccgaguggcucuggaaggagcugggcaagaagaagaccccgcggaugugcacgcgcgaggaguucacccggaaggugcgcagcaacgccgcccugggggcgaucuucaccgacgagaacaaguggaaguccgcccgggaggccguggaggacagccgcuucugggagcucgucgacaaggagcggaaccugcaccuggagggcaagugcgagaccugcguguacaacaugauggggaagcgcgagaagaagcucggcgaguucgggaaggccaagggcucccgggccaucugguacauguggcugggcgcgcgcuuccuggaguucgaggcccucggguuccugaacgaggaccacugguucagccgggagaacucccugagcggcgucgagggggagggccuccacaagcugggguacauccugcgcgacguguccaagaaggagggcggcgccauguacgccgacgacacggcggggugggacacccggaucacccucgaggaccugaagaacgaggagauggugaccaaccacauggagggcgagcacaagaagcuggccgaggccaucuucaagcucacguaccagaacaaggucgugcgcgugcagcggcccacgccccgggggaccgucauggacaucaucagccggcgcgaccagcggggcagcggccagguggggaccuacggccugaacacguucaccaacauggaggcccagcugauccgccagauggagggggagggcguguucaagaacauccagcaccucaccgucaccgaggaggccgcggugcagaacuggcuggcccggguggggcgcgagcgccugucccggauggccaucagcggcgacgacugcgucgugaagccccucgacgaccgcuucgccaacgcccugacggcgcugaacgacaugggcaagauccggaaggacauccagcagugggagccguccaagggguggaacgacuggacccaggugcccuucugcagccaccacuuccacgagcucaucaugaaggacggccgcguccugguggugcccugccggaaccaggacgagcugaucgggcgcgcccggaucucccagggcgccggguggagccuccgcgagaccgccugccugggcaaguccuacgcccagauguggagccugauguacuuccaccggcgcgaccuccggcuggcggccaacgccaucugcuccgccguccccagccacugggugccgaccucccgcacgaccuggagcauccacgccaagcacgaguggaugaccaccgaggacaugcugaccguguggaaccgggucuggauccgcgagaaccccuggauggaggacaagacgcccguggaguccugggaggagauccccuaccucggcaagcgggaggaccaguggugcgggagccugaucggccugaccucccgcgcgaccugggccaagaacauccaggccgccaucaaccaggugcggagccucaucgggaacgaggaguacaccgacuacaugccguccaugaagcgcuuccggcgcgaggaggaggaggcgggcguccugugguga

SEQ ID NO: 9156 - RNA, 9876 nt, Artificial Sequence
  derived and/or modified CDS sequence (opt1) from DENV-2__GQ199892__SS-prME
accgccggcgugaucgucaugcugauccccaccgccauggcguuccaccucaccacccggaacggggagccccacaugaucgugggccggcaggagaaggggaagucccugcuguucaagaccgaggacggcgugaacaugugcacccucauggccaucgaccugggggagcugugcgaggacaccaucaccuacaagugcccccuccugcgccagaacgagcccgaggacaucgacugcuggugcaacagcaccagcaccugggucaccuacgggaccugcaccaccacgggcgagcaccggcgcgagaagcgguccguggcccuggugccccacgucgggaugggccucgagacccggaccgagaccuggaugagcuccgagggggccuggaagcacgugcagcggaucgagacguggauccugcgccacccgggcuucaccaucauggccgcgauccuggccuacaccaucgggaccacgcacuuccagcgggcccucaucuucauccugcugaccgccguggcgcccagcaugaccaugcgcugcaucggcaucuccaaccgggacuucgucgagggcgugagcgggggcuccuggguggacaucguccucgagcacgggagcugcgugaccacgauggccaagaacaagcccacccuggacuucgagcugaucaagaccgaggccaagcagcccgccacccuccgcaaguacugcaucgaggccaagcugacgaacaccaccaccgagucccggugcccgacgcagggcgagcccagccugaacgaggagcaggacaagcgcuucaucugcaagcacuccaugguggaccggggcugggggaacggcugcgggcuguucggcaagggcgggaucgugaccugcgcgauguucacgugcaagaagaacauggagggcaagaucgugcagcccgagaaccuggaguacaccaucgugaucacgccccacagcggggaggagcacgccgucggcaacgacaccgggaagcacggcaaggagaucaagaucaccccgcaguccagcaccaccgaggccgagcugacgggguacggcaccgugaccauggagugcagcccccggaccggccucgacuucaacgagauggugcugcugcagauggaggacaaggccuggcucguccaccggcagugguuccuggaccugccccuccccuggcugccgggggccgacacgcagggcagcaacuggauccagaaggagacccuggugaccuucaagaacccccacgcgaagaagcaggacguggucgugcucgggucccaggagggcgccaugcacaccgcccugacgggggccaccgagauccagaugagcagcggcaaccuccuguucaccggccaccugaagugccgccugcggauggacaagcuccagcugaaggggauguccuacagcaugugcaccggcaaguucaagaucgucaaggagaucgccgagacgcagcacgggaccaucgugauccgcgugcaguacgagggcgacggcgcgcccugcaagauccccuucgagaucaccgaccuggagaagcggcacguccucgggcgccugaucaccgugaacccgaucgugacggagaaggacucccccgucaacaucgaggccgagccgcccuucggcgacagcuacaucaucguggggguggagccgggccagcugaagcucaacugguucaagaagggguccagcaucggccagauguucgagaccaccaugcgcggcgccaagcggauggccauccugggggacaccgccugggacuucggcucccucggcggggucuucacgagcaucgggaaggcgcuccaccagguguucggggccaucuacggcgccgccuucuccggggugagcuggaccaugaagauccugaucggcgucaucaucaccuggaucgggaugaacucccgcagcaccucccugagcgugucccuggugcucgucggcguggugacgcuguaccugggggcgaugguccaggccgacagcggcugcaucguguccuggaagaacaaggagcucaagugcggcagcgggaucuucaucaccgacaacgugcacaccuggaccgagcaguacaaguuccagcccgagucccccagcaagcuggccagcgccauccagaaggcccacgaggagggcaucugcgggauccgguccgucacgcgccuggagaaccucauguggaagcagaucacccccgagcugaaccacauccugagcgagaacgaggugaagcucaccaucaugaccggcgacaucaaggggaucaugcaggcgggcaagcggucccugcgcccgcagcccacggagcugaaguacagcuggaagaccuggggcaaggccaagaugcucuccaccgagagccacaaccagaccuuccugaucgacgggcccgagacggccgagugcccgaacaccaaccgggccuggaacucccuggagguggaggacuacggcuucggggucuucagcaccaacaucuggcucaagcugcgcgagaagcaggacguguucugcgacuccaagcugaugagcgccgcgaucaaggacaaccgggccgugcacgccgacaugggcuacuggaucgaguccgcccucaacgacaccuggaagauggagaaggccagcuucaucgaggucaaguccugccacuggcccaagagccacacccugugguccaacggcgugcuggagagcgagaugaucauccccaagaacuucgcggggcccgugucccagcacaacuaccgcccgggcuaccacacgcagaccgccgggcccuggcaccucggcaagcuggagauggacuucgacuucugcgaggggaccaccgucguggugacggaggacugcggcaaccggggccccagccugcgcaccaccaccgccagcgggaagcucaucacggaguggugcugccgguccugcacccugcccccgcugcgcuaccggggcgaggacgggugcugguacggcauggagauccgcccccucaaggagaaggaggagaaccuggucaacagccuggugaccgccgggcacggccagaucgacaacuucucccucggcauccuggggauggcgcuguuccucgaggagaugcugcggacccgcgugggcacgaagcacgccauccugcucgucgcccugagcuucgugacccugaucaccgggaacauguccuuccgggaccucggccgcgugauggucauggugggggccaccaugacggacgacaucggcaugggcgugaccuaccuggcccugcucgcggccuucaagguccgccccaccuucgccgccgggcugcugcuccggaagcugaccagcaaggagcugaugauggccacgaucggcaucgcgcuccugucccagagcacccugcccgagaccauccucgagcugaccgacgcccuggcccucgggaugauggcccugaagaucgugcgcaacauggagaaguaccagcuggccgugacgaucauggcgaucuccugcgucccgaacgccgugauccuccagaacgccuggaaggugagcugcaccauccuggccgcggucuccgugagcccccugcuccugaccuccagccagcagaaggccgacuggaucccccuggcccucaccaucaagggccugaaccccacggccaucuuccugaccacccucucccggaccagcaagaagcgcuccuggccgcugaacgaggccaucauggcggugggcauggucagcauccuggccuccagccuccugaagaacgacauccccaugacggggccccugguggccggcgggcuccugaccgucugcuacgugcugaccggccggagcgccgaccucgagcuggagcgcgccgcggacgugaagugggaggaccaggccgagaucuccgggagcucccccauccugagcaucaccaucuccgaggacggcagcauguccaucaagaacgaggaggaggagcagacgcucaccauccugauccggaccggccugcucgucaucagcgggguguucccgguguccauccccaucaccgccgccgccugguaccugugggaggucaagaagcagcgcgcgggcgugcugugggacgugcccagcccgccgcccgucgggaaggccgagcucgaggacggcgccuaccggaucaagcagcgcgggauccugggcuacucccagaucggcgccgggguguacaaggagggcaccuuccacacgauguggcacgugacccgcggggccguccugaugcaccgcggcaagcggaucgagcccagcugggcggacgugaagaaggaccucaucuccuacgggggcggcuggaagcuggagggggaguggaaggagggcgaggaggugcagguccuggcccucgagcccgggaagaacccccgcgccgugcagaccaagcccggcaucuucaagaccaacacggggaccaucggcgccgugagccuggacuucucccccggcaccagcgggucccccaucgucgaccggaagggcaaggugguggggcuguacggcaacggcgucgugacccgcagcggggcguacguguccgccaucgcccagacggagaaguccaucgaggacaaccccgagaucgaggacgacaucuuccggaagaagcgccucaccaucauggaccugcaccccggcgccgggaagaccaagcgguaccugcccgccaucguccgcgaggcgaucaagcggggccugcgcacccucauccuggccccgacgcgcgugguggccgccgagauggaggaggcccugcgggggcuccccauccgcuaccagacccccgcgauccgggccgagcacaccggccgcgagaucgucgaccugaugugccacgccaccuucacgaugcggcugcucagccccgugcgcgugccgaacuacaaccugaucaucauggacgaggcccacuucaccgaccccgccuccaucgcggcccggggcuacaucagcacccgcgucgagaugggggaggccgccggcaucuucaugaccgcgacgccgcccgggucccgggacccguucccccagagcaacgcccccaucauggacgaggagcgcgagauccccgagcgguccuggaacagcggccacgagugggugaccgacuucaaggggaagaccgugugguucgucccguccaucaaggccggcaacgacaucgccgccugccugcgcaagaacggcaagaaggugauccagcucagccggaagaccuucgacuccgaguacgugaagacgcgcgcgaacgacugggacuucgucgugaccaccgacaucagcgagaugggggccaacuucaaggccgagcgggugaucgacccccgccggugcaugaagcccgucauccugaccgacggcgaggagcgcgugauccuggccgggcccaugccggugacgcacuccagcgccgcgcagcggcgcggccgcaucgggcggaaccccaagaacgagaacgaccaguacaucuacaugggcgagccccucgagaacgacgaggacugcgcccacuggaaggaggccaagaugcugcuggacaacaucaacacccccgagggcaucaucccguccauguucgagcccgagcgcgagaaggucgacgccaucgacggggaguaccggcuccgcggcgaggcccggaagaccuucguggaccugaugcgccgcggggaccugcccguguggcucgcguacaaggucgccgccgagggcaucaacuacgccgaccgcaaguggugcuucgacgggaucaagaacaaccagauccuggaggagaacguggagguggagaucuggaccaaggagggcgagcggaagaagcugaagccgcgcuggcucgacgcgcggaucuacagcgacccccuggcccugaaggaguucaaggaguucgccgccggccgcaagucccucacgcugaaccugaucaccgagauggggcggcuccccaccuucaugacccagaaggcccgcaacgcgcuggacaaccuggccguccuccacacggccgaggugggcgggcgggccuacacccacgcccugagcgagcugcccgagacccucgagacccugcugcuccugacgcugcucgcgaccgugaccggcggcaucuuccuguuccugauguccgggaagggcaucgggaagaugacccucggcaugugcugcaucaucaccgccagcauccugcugugguacgcccagauccagccgcacuggaucgccgccuccaucauccucgaguucuuccugaucguccugcucauccccgagcccgagaagcagcgcacgccccaggacaaccagcugaccuacguggucaucgcgauccugaccgugguggccgccaccauggccaacgagaugggguuccucgagaagacgaagaaggaccugggcuucggcagcaucaccacccaggagagcgaguccaacauccuggacaucgaccuccggccggccagcgcguggacccuguacgccgucgccacgaccuucgugacccccaugcugcgccacuccaucgagaacagcuccgugaacgucagccucaccgccaucgcgaaccaggccacggugcugauggggcugggcaagggguggccccucuccaagauggacaucggcgugccccugcuggccaucgggugcuacagccaggucaacccgaucacccucaccgccgcccugcugcuccugguggcgcacuacgccaucaucggccccggccugcaggccaaggccacccgggaggcccagaagcgcgcggccgccgggaucaugaagaaccccacgguggacggcaucaccgucaucgaccucgagcccaucccguacgaccccaaguucgagaagcagcuggggcaggucaugcugcucauccugugcgugacccagguccugaugaugcggaccacgugggcccucugcgaggcccugacccuggcgaccggccccaucuccacccucugggaggggaaccccggccgcuucuggaacacgaccaucgccgugagcauggccaacaucuuccgcggcuccuaccuggccggggcgggccuccuguucagcaucaugaagaacaccaccaacacgcggcgcgggaccggcaacgugggcgagacccugggggagaaguggaagucccggcugaacgcccucggcaagagcgaguuccagaucuacaagaaguccgggauccaggaggucgaccgcacccuggccaaggagggcaucaagcgcggggagacggaccaccacgccgugagccgcggcuccgccaagcugcggugguucguggagcgcaacauggucaccccggagggcaaggugguggaccucgggugcggccgcgggggcuggagcuacuacugcgggggccugaagaacguccgcgaggugaagggccugaccaagggcggccccgggcacgaggagcccauccccauguccaccuacggcuggaaccucgugcggcugcagagcggggucgacguguucuucacgccgcccgagaagugcgacacccugcucugcgacaucggcgagagcucccccaaccccaccaucgaggcgggccgcacccugcgggugcugaaccucgucgagaacuggcugaacaacaacacccaguucugcaucaaggugcugaacccguacaugcccagcgugaucgagaagauggagacgcuccagcgcaaguacgggggcgcccugguccggaacccccugucccgcaacagcacccacgagauguacuggguguccaacgccaccgggaacaucgugagcuccgucaacaugaucagccggaugcugaucaaccgcuucaccaugaagcacaagaaggccacguacgagccggacguggaccucggcuccgggacccggaacaucggcaucgagagcgagauccccaaccuggacaucaucggcaagcgcaucgagaagaucaagcaggagcacgagaccuccuggcacuacgaccaggaccaccccuacaagaccugggccuaccacgggagcuacgagacgaagcagaccggcuccgcgagcuccauggugaacggggucgugcgccugcucaccaagcccugggacguggucccgauggugacccagauggccaugacggacaccacccccuucggccagcagcggguguucaaggagaaggucgacacccgcacgcaggagcccaaggagggcaccaagaagcugaugaagaucaccgccgaguggcuguggaaggagcucgggaaggagaagacgccccggaugugcacgcgcgaggaguucacccggaaggugcgcagcaacgccgcccugggcgcgaucuucaccgacgagaacaaguggaaguccgcccgggaggccguggaggacgggcgcuucugggagcuggucgaccgggagcgcaaccuccaccuggagggcaagugcgagaccugcguguacaacaugauggggaagcgggagaagaagcugggcgaguucggcaaggccaaggggagccgcgcgaucugguacauguggcucggcgcccgguuccuggaguucgaggcccugggguuccucaacgaggaccacugguucucccgcggcaacagccugagcgggguggagggcgagggccugcaccggcucggguacauccugcgcgaggucggcaagaaggagggcggcgccauguacgccgacgacacggcggggugggacacccggaucacccuggaggaccucaagaacgaggagauggugaccaaccacaugaagggcgagcacaagaagcuggccgaggccaucuucaagcugacguaccagaacaaggucgugcgcgugcagcggccgacgccccggggcaccgucauggacaucaucucccggaaggaccagcgcgggagcggccagguggggaccuacggccucaacacguucaccaacauggaggcccagcugauccgccagauggagggcgaggggaucuucaaguccauccagcaccugaccgccaccgaggagaucgcggugcagaacuggcucgcccgggucggccgcgagcggcugagccgcauggccaucuccggggacgacugcguggugaagcccaucgacgaccgguucgccagcgcccugacggcgcucaacgacaugggcaagguccgcaaggacauccagcagugggagcccucccggggguggaacgacuggacccaggugccguucugcagccaccacuuccacgagcuggugaugaaggacggccgcguccugguggugcccugccggaaccaggacgagcucaucggccgcgcccggaucucccagggggccggcuggagccugaaggagaccgccugccuggggaaguccuacgcccagauguggacccucauguacuuccaccgccgggaccugcgccuggcggccaacgccaucugcagcgccguccccucccacugggugcccaccagccggacgaccugguccauccacgcgaagcacgaguggaugaccaccgaggacaugcucgccguguggaaccgcgucuggauccaggagaacccguggauggaggacaagacgcccguggagagcugggaggaggugcccuaccugggcaagcgggaggaccaguggugcgggucccugaucggccucaccagccgcgccaccugggccaagaacauccagaccgccaucaaccagguccggagccugaucggcaacgagggguacacggacuacaugcccuccaugaagcgcuuccgccgggaggaggaggaggcgggcgugcugugguga

SEQ ID NO: 9157 - RNA, 9876 nt, Artificial Sequence
  derived and/or modified CDS sequence (opt1) from DENV-2__JF730044__SS-prME
accgccggcgugaucaucaugcugauccccaccgccauggcguuccaccucaccacccgcaacggggagccccacaugaucgucggccggcaggagaagggcaagagccugcuguucaagaccgaggacggcgugaacaugugcacccucauggccaucgaccugggggagcugugcgaggacaccaucaccuacaagugcccccuccugcgccagaacgagcccgaggacaucgacugcuggugcaacagcaccagcaccugggugacguacgggaccugcaccaccacgggcgagcaccggcgcgagaagcgguccgucgcccuggugccccacguggggaugggccucgagacccgcaccgagaccuggaugagcagcgagggggccuggaagcacguccagcggaucgagacguggauccugcgccaccccggcuucaccaucauggccgcgauccuggccuacaccaucgggaccacgcacuuccagcgggcccucaucuucauccugcugaccgccguggcgcccagcaugaccaugcgcugcaucggcaucuccaaccgggacuucguggagggcgucagcgggggcuccuggguggacaucgugcucgagcacgggagcugcgucaccacgauggccaagaacaagcccacccuggacuucgagcugaucaagaccgaggccaaggagcccgccacccuccgcaaguacugcaucgaggccaagcugacgaacaccaccaccgagucccggugcccgacgcagggcgagcccagccugaacgaggagcaggacaagcgcuucgugugcaagcacuccaugguggaccggggcugggggaacggcugcgggcuguucggcaagggcgggaucgugaccugcgcgauguucacgugcaagaagaacauggagggcaagaucgugcagcccgagaaccuggaguacaccaucgugaucacgccccacagcggggaggagcacgccgucggcaacgacaccgggaagcacggcaaggagaucaagaucaccccgcaguccagcuccaccgaggccgagcugaccggguacggcacggugaccauggagugcagcccccgcaccggccucgacuucaacgagauggugcugcugcagauggaggacaaggccuggcucguccaccggcagugguuccuggaccugccccuccccuggcugccgggggccgacacccagggcuccaacuggauccagaaggagacgcuggugaccuucaagaacccccacgcgaagaagcaggacguggucgugcucgggagccaggagggcgccaugcacaccgcccugaccggggccacggagauccagaugagcuccggcaaccuccuguucaccggccaccugaagugccgccugcggauggacaagcuccagcugaaggggaugagcuacuccaugugcaccggcaaguucaagaucgucaaggagaucgccgagacccagcacgggacgaucgugauccgcgugcaguacgagggcgacggcagccccugcaagauccccuucgagaucauggaccuggagaagcggcacguccucgggcgccugaucaccgugaacccgaucgugaccgagaaggacucccccgucaacaucgaggcggagccgcccuucggcgacagcuacaucaucaucgggguggagccgggccagcugaagcucaacugguucaagaagggguccagcaucggccagauguucgagaccacgaugcgcggcgccaagcggauggccauccugggggacaccgccugggacuucggcucccucggcgggguguucaccagcauggggaaggcccuccaccaggucuucggggcgaucuacggcgccgccuucuccggggugagcuggaccaugaagauccugaucggcgugaucaucacguggaucgggaugaacucccgcagcaccucccugagcgucucccuggugcucgugggcgucaucacccuguaccugggggccauggugcaggcggacagcggcugcguggucuccuggaagaacaaggagcucaagugcggcagcgggaucuucaucaccgacaacgugcacacguggaccgagcaguacaaguuccagcccgagagccccuccaagcuggccagcgccauccagaaggcccacgaggagggcaucugcgggauccgguccgugacccgccuggagaaccucauguggaagcagaucacccccgagcugaaccacauccugagcgagaacgaggucaagcucacgaucaugaccggcgacaucaaggggaucaugcaggccggcaagcggucccugcgcccgcagcccaccgagcugaaguacagcuggaagaccuggggcaaggcgaagaugcucuccacggagagccacaaccagaccuuccugaucgacgggcccgagaccgccgagugcccgaacaccaaccgggccuggaacucccuggagguggaggacuacggcuucgggguguucacgaccaacaucuggcucaagcugcgcgagaagcaggacgucuucugcgacagcaagcugauguccgccgccaucaaggacaaccgggcggugcacgccgacaugggcuacuggaucgagagcgcccucaacgacaccuggaagauggagaaggccuccuucaucgaggucaagagcugccacuggcccaagucccacacccuguggagcaacggcgugcuggaguccgagaugaucauccccaagagcuucgccgggcccgugagccagcacaacuaccgcccgggcuacuacacccagacggcggggcccuggcaccucggcaagcuggagauggacuucgacuucugcgaggggaccaccguggucgugaccgaggacugcggcaaccggggccccucccugcgcacgaccaccgccagcgggaagcucaucaccgaguggugcugccgguccugcacgcugcccccgcugcgcuaccggggcgaggacgggugcugguacggcauggagauccgcccccucaaggagaaggaggagaaccuggugaacagccuggucaccgccgggcacggccagaucgacaacuucucccucggcgugcuggggauggcccuguuccucgaggagaugcugcggacccgcgugggcaccaagcacgcgauccugcucgucgccgugagcuucgugacgcugaucaccgggaacauguccuuccgggaccugggccgcgucauggugauggugggggccaccaugaccgacgacaucggcaugggcgucacguaccucgcccugcuggccgcguucaaggugcgccccaccuucgccgccgggcuccugcugcggaagcucaccagcaaggagcugaugauggccaccaucggcaucgcccugcucucccagagcacgauccccgagaccauccuggagcugaccgacgcgcucgcccuggggaugauggugcugaagaucguccgcaacauggagaaguaccagcucgccgugaccaucauggccaucuccugcgugccgaacgccgucauccugcagaacgcguggaaggugagcugcacgauccuggccgccguguccgucagcccccuccugcugaccuccagccagcagaaggccgacuggaucccccucgcgcugaccaucaagggccugaaccccaccgccaucuuccucacgacccugucccggaccagcaagaagcgcuccuggccgcugaacgaggccaucauggccgugggcauggucagcauccucgccagcucccugcugaagaacgacauccccaugaccgggccccucguggcgggcgggcugcugacggugugcuacguccucaccggccggagcgccgaccuggagcuggagcgcgccaccgacgugaagugggaggaccaggccgagaucuccgggagcucccccauccucagcaucaccaucuccgaggacggcagcauguccaucaagaacgaggaggaggagcagacgcugaccauccugauccggaccggccuccuggugaucagcgggcuguucccggucuccauccccaucaccgccgcggccugguaccucugggaggugaagaagcagcgcgccggcgugcugugggacguccccagcccgccgcccguggggaaggccgagcuggaggacggcgccuaccggaucaagcagaaggggauccucggcuacucccagaucggcgcggggguguacaaggagggcaccuuccacacgauguggcacgucacccgcggggccgugcugaugcaccggggcaagcgcaucgagcccagcugggccgacgugaagaaggaccugaucuccuacgggggcggcuggaagcucgagggggaguggaaggagggcgaggagguccaggugcuggcccuggagcccgggaagaacccccgggccgugcagaccaagcccggccucuucaagaccaacacggggaccaucggcgcggucagccuggacuucucccccggcaccagcgggucccccaucguggaccgcaagggcaagguggucgggcuguacggcaacggcguggugacccggagcggggccuacgucagcgccaucgcccagacggagaaguccaucgaggacaaccccgagaucgaggacgacaucuuccgcaagaagcggcucaccaucauggaccugcaccccggcgcggggaagaccaagcgcuaccugcccgccaucgugcgggaggccaucaagcgcggccugcggacccucauccuggccccgacgcgcguggucgccgcggagauggaggaggcccugcgcgggcuccccauccgguaccagacccccgccauccgcgccgagcacaccggccgggagaucguggaccugaugugccacgccaccuucacgaugcgccugcucagccccgugcgggucccgaacuacaaccugaucaucauggacgaggcgcacuucaccgaccccgccuccaucgccgcccgcggcuacaucagcacccggguggagaugggggaggccgcgggcaucuucaugaccgccacgccgcccgggucccgcgacccguucccccagagcaacgcccccaucauggacgaggagcgggagauccccgagcgcuccuggaacagcggccacgagugggugaccgacuucaaggggaagaccgucugguucgugccguccaucaaggccggcaacgacaucgcggccugccugcggaagaacggcaagaaggugauccagcucagccgcaagaccuucgacuccgaguacgucaagacgcggaccaacgacugggacuucguggugaccaccgacaucagcgagaugggggccaacuucaaggccgagcgcgucaucgacccccggcgcugcaugaagcccgugauccugacggacggcgaggagcgggugauccuggccgggcccaugccggucacccacuccagcgcggcccagcgccggggccgcaucgggcgcaaccccaagaacgagaacgaccaguacaucuacaugggcgagccccucgagaacgacgaggacugcgcccacuggaaggaggccaagaugcugcuggacaacaucaacacccccgagggcaucaucccguccauguucgagcccgagcgggagaagguggacgccaucgacggggaguaccgccuccggggcgaggcgcgcaagaccuucguggaccugaugcggcgcggggaccugcccgucuggcucgccuaccggguggccgccgagggcaucaacuacgccgaccgccgguggugcuucgacggggugaagaacaaccagauccuggaggagaacgucgagguggagaucuggacgaaggagggcgagcgcaagaagcugaagccgcgguggcucgacgcgcgcaucuacagcgacccccuggcccugaaggaguucaaggaguucgccgccggccggaagucccucacccugaaccugaucaccgagauggggcgccuccccaccuucaugacgcagaaggcgcgggacgcccuggacaaccuggccgugcuccacaccgccgaggccggcgggcgcgcguacaaccacgcccugagcgagcugcccgagacccucgagacccugcugcuccugacgcugcucgccaccgucaccggcggcaucuuccuguuccugauguccgggaagggcguggggaagaugacccucggcaugugcugcaucaucaccgccagcauccugcugugguacgcccagauccagccgcacuggaucgcggccagcaucauccucgaguucuuccugaucguccugcucauccccgagcccgagaagcagcggacgccccaggacaaccagcugaccuacguggugaucgccauccugaccgucguggccgccaccauggcgaacgagaugggguuccucgagaagacgaagaaggaccugggccugggcuccaucgccacccaggagccggagagcaacauccucgacaucgaccugcgccccgccuccgccuggacccuguacgccguggcgaccacguucgucacccccaugcuccggcacagcaucgagaacuccagcgugaacgugucccugaccgccaucgccaaccaggccaccguccugauggggcucggcaagggguggccccugagcaagauggacaucggcgugccgcugcucgcgaucgggugcuacucccaggugaaccccgucacgcugaccgccgcccugcuccugcugguggcccacuacgccaucaucggccccggccuccaggcgaaggccacccgcgaggcccagaagcgggccgccgcggggaucaugaagaaccccaccguggacggcaucacggucaucgaccuggacccgauccccuacgaccccaaguucgagaagcagcuggggcaggucaugcuccugauccugugcgugacccagguccucaugaugcgcaccaccugggcccugugcgaggcccugacgcucgccaccggccccaucagcacccugugggaggggaacccgggccgcuucuggaacaccacgaucgccguguccauggcgaacaucuuccggggcagcuaccuggccggggccggccuccuguucuccaucaugaagaacaccaccaacacccgccgggggacgggcaacaucggcgagacccugggggagaaguggaagucccgccucaacgcccugggcaaguccgaguuccagaucuacaagaaguccgggauccaggagguggaccggacccuggcgaaggagggcaucaagcgcggggagaccgaccaccacgccgucucccggggcagcgccaagcuccgcugguucguggagcggaacauggugacgcccgagggcaaggucguggaccuggggugcggccgcgggggcugguccuacuacugcgggggccugaagaacgugaaggaggucaagggccucaccaagggcgggcccgggcacgaggagcccaucccgaugagcaccuacggcuggaaccuggugcggcugcagagcgggguggacgucuucuucacgccgcccgagaagugcgacacgcuccugugcgacaucggcgaguccagccccaacccgaccaucgaggccggccgcacccugcgggugcucucccugguggagaacuggcugaacaacgacacccaguucugcaucaagguccucaaccccuacaugcccagcgugaucgagaagauggagacccugcagcgcaaguacgggggcgcccuggugcggaacccgcugucccgcaacagcacgcacgagauguacugggucuccaacgcgaccgggaacaucgugagcuccgugaacaugaucagccggaugcucaucaaccgcuucaccaugaagcacaagaaggccaccuacgagcccgacgucgaccugggcuccgggacgcggaacaucggcaucgagagcgagauccccaaccuggacaucaucggcaagcgcaucgagaagaucaagcaggagcacgagaccuccuggcacuacgaccaggaccaccccuacaagaccugggccuaccacgggagcuacgagaccaagcagacgggcuccgccagcuccauggugaacggggugguccgccuccugaccaagccgugggacguggugcccauggucacccagauggccaugaccgacacgacccccuucggccagcagcggguguucaaggagaagguggacacccgcacccaggagcccaaggagggcacgaagaagcugaugaagaucaccgcggaguggcucuggaaggagcuggggaagaagaagaccccgcggaugugcacccgcgaggaguucacgcggaagguccgcagcaacgccgcccugggcgccaucuucaccgacgagaacaaguggaaguccgcccgggaggcgguggaggacagccgcuucugggagcucguggacaaggagcggaaccugcaccuggaggggaagugcgagaccugcgucuacaacaugaugggcaagcgcgagaagaagcucggggaguucggcaaggccaagggcagccgggccaucugguacauguggcugggggcccgcuuccuggaguucgaggcgcucggcuuccugaacgaggaccacugguucucccgggagaacagccuguccgggguggagggcgaggggcuccacaagcugggcuacauccugcgcgacgucggcaagaaggagggcggggccauguacgccgacgacaccgccgggugggacacgcggaucacccucgaggaccugaagaacgaggagauggugaccaaccacauggagggcgagcacaagaagcuggccgaggcgaucuucaagcucaccuaccagaacaaggugguccgcgugcagcggcccacgccccgcgggaccgugauggacaucaucagccggcgcgaccagcggggcuccggccaggucgggaccuacggccugaacaccuucacgaacauggaggcccagcugauccgccagauggagggggagggcaucuucaagagcauccagcaccucaccgccaccgaggagaucgccgugcagaacuggcuggcccgcgugggccgggagcgccugucccggauggcgaucagcggggacgacugcgucgugaagccccucgacgaccgcuucgccuccgcccugaccgcccugaacgacaugggcaaggugcggaaggacauccagcagugggagccgagccgcggguggaacgacuggacgcagguccccuucugcucccaccacuuccacgagcucaucaugaaggacggccgggugcuggugguccccugccgcaaccaggacgagcugaucgggcgggcccgcaucagccagggcgcgggcuggucccucaaggagaccgccugccugggcaagagcuacgcccagauguggucccugauguacuuccaccggcgcgaccuccggcuggccgccaacgcgaucugcagcgccgugcccucccacugggugccgaccagccgcaccaccuggagcauccacgccaagcacgaguggaugacgaccgaggacaugcugaccgucuggaaccggguguggauccaggagaaccccuggauggaggacaagacccccguggaguccugggaggagguccccuaccucggcaagcgcgaggaccaguggugcgggagccugaucggccugacgucccgggccaccugggcgaagaacauccagaccgccaucaaccaggugcgcagccucaucgggaacgaggaguacaccgacuacaugccguccaugaagcgguuccgccgcgaggaggaggaggccggcgugcugugguga

SEQ ID NO: 9158 - RNA, 9876 nt, Artificial Sequence
  derived and/or modified CDS sequence (opt1) from DENV-2__FJ639697__SS-prME
accgccggcgugaucaucaugcugauccccaccgccauggcguuccaccucaccacccgcaacggggagccccacaugaucgucggccggcaggagaagggcaagagccugcuguucaagaccgaggacggcgugaacaugugcacccucauggccaucgaccugggggagcugugcgaggacaccaucaccuacaagugcccccuccugcgccagaacgagcccgaggacaucgacugcuggugcaacagcaccagcaccugggugacguacgggaccugcaccaccacgggcgagcaccggcgcgagaagcgguccgucgcccuggugccccacguggggaugggccucgagacccgcaccgagaccuggaugagcagcgagggggccuggaagcacguccagcggaucgagacguggauccugcgccaccccggcuucaccaucauggccgcgauccuggccuacaccaucgggaccacgcacuuccagcgggcccucaucuucauccugcugaccgccguggcgcccagcaugaccaugcgcugcaucggcaucuccaaccgggacuucguggagggcgucagcgggggcuccuggguggacaucgugcucgagcacgggagcugcgucaccacgauggccaagaacaagcccacccuggacuucgagcugaucaagaccgaggccaaggagcccgccacccuccgcaaguacugcaucgaggccaagcugacgaacaccaccaccgagucccggugcccgacgcagggcgagcccagccugaacgaggagcaggacaagcgcuucgugugcaagcacuccaugguggaccggggcugggggaacggcugcgggcuguucggcaagggcgggaucgugaccugcgcgauguucacgugcaagaagaacauggagggcaagaucgugcagcccgagaaccuggaguacaccaucgugaucacgccccacagcggggaggagcacgccgucggcaacgacaccgggaagcacggcaaggagaucaagaucaccccgcaguccagcuccaccgaggccgagcugaccggguacggcacggugaccauggagugcagcccccgcaccggccucgacuucaacgagauggugcugcugcagauggaggacaaggccuggcucguccaccggcagugguuccuggaccugccccuccccuggcugccgggggccgacacccagggcuccaacuggauccagaaggagacgcuggugaccuucaagaacccccacgcgaagaagcaggacguggucgugcucgggagccaggagggcgccaugcacaccgcccugaccggggccacggagauccagaugagcuccggcaaccuccuguucaccggccaccugaagugccgccugcggauggacaagcuccagcugaaggggaugagcuacuccaugugcaccggcaaguucaagaucgucaaggagaucgccgagacccagcacgggacgaucgugauccgcgugcaguacgagggcgacggcagccccugcaagauccccuucgagaucauggaccuggagaagcggcacguccucgggcgccugaucaccgugaacccgaucgugaccgagaaggacucccccgucaacaucgaggcggagccgcccuucggcgacagcuacaucaucaucgggguggagccgggccagcugaagcucaacugguucaagaagggguccagcaucggccagauguucgagaccacgaugcgcggcgccaagcggauggccauccugggggacaccgccugggacuucggcucccucggcgggguguucaccagcauggggaaggcccuccaccaggucuucggggcgaucuacggcgccgccuucuccggggugagcuggaccaugaagauccugaucggcgugaucaucacguggaucgggaugaacucccgcagcaccucccugagcgucucccuggugcucgugggcgucaucacccuguaccugggggccauggugcaggcggacagcggcugcguggucuccuggaagaacaaggagcucaagugcggcagcgggaucuucaucaccgacaacgugcacacguggaccgagcaguacaaguuccagcccgagagccccuccaagcuggccagcgccauccagaaggcccacgaggagggcaucugcgggauccgguccgugacccgccuggagaaccucauguggaagcagaucacccccgagcugaaccacauccugagcgagaacgaggucaagcucacgaucaugaccggcgacaucaaggggaucaugcaggccggcaagcggucccugcgcccgcagcccaccgagcugaaguacagcuggaagaccuggggcaaggcgaagaugcucuccacggagagccacaaccagaccuuccugaucgacgggcccgagaccgccgagugcccgaacaccaaccgggccuggaacucccuggagguggaggacuacggcuucgggguguucacgaccaacaucuggcucaagcugcgcgagaagcaggacgucuucugcgacagcaagcugauguccgccgccaucaaggacaaccgggcggugcacgccgacaugggcuacuggaucgagagcgcccucaacgacaccuggaagauggagaaggccuccuucaucgaggucaagagcugccacuggcccaagucccacacccuguggagcaacggcgugcuggaguccgagaugaucauccccaagagcuucgccgggcccgugagccagcacaacuaccgcccgggcuacuacacccagacggcggggcccuggcaccucggcaagcuggagauggacuucgacuucugcgaggggaccaccguggucgugaccgaggacugcggcaaccggggccccucccugcgcacgaccaccgccagcgggaagcucaucaccgaguggugcugccgguccugcacgcugcccccgcugcgcuaccggggcgaggacgggugcugguacggcauggagauccgcccccucaaggagaaggaggagaaccuggugaacagccuggucaccgccgggcacggccagaucgacaacuucucccucggcgugcuggggauggcccuguuccucgaggagaugcugcggacccgcgugggcaccaagcacgcgauccugcucgucgccgugagcuucgugacgcugaucaccgggaacauguccuuccgggaccugggccgcgucauggugauggugggggccaccaugaccgacgacaucggcaugggcgucacguaccucgcccugcuggccgcguucaaggugcgccccaccuucgccgccgggcuccugcugcggaagcucaccagcaaggagcugaugauggccaccaucggcaucgcccugcucucccagagcacgauccccgagaccauccuggagcugaccgacgcgcucgcccuggggaugauggugcugaagaucguccgcaacauggagaaguaccagcucgccgugaccaucauggccaucuccugcgugccgaacgccgucauccugcagaacgcguggaaggugagcugcacgauccuggccgccguguccgucagcccccuccugcugaccuccagccagcagaaggccgacuggaucccccucgcgcugaccaucaagggccugaaccccaccgccaucuuccucacgacccugucccggaccagcaagaagcgcuccuggccgcugaacgaggccaucauggccgugggcauggucagcauccucgccagcucccugcugaagaacgacauccccaugaccgggccccucguggcgggcgggcugcugacggugugcuacguccucaccggccggagcgccgaccuggagcuggagcgcgccaccgacgugaagugggaggaccaggccgagaucuccgggagcucccccauccucagcaucaccaucuccgaggacggcagcauguccaucaagaacgaggaggaggagcagacgcugaccauccugauccggaccggccuccuggugaucagcgggcuguucccggucuccauccccaucaccgccgcggccugguaccucugggaggugaagaagcagcgcgccggcgugcugugggacguccccagcccgccgcccguggggaaggccgagcuggaggacggcgccuaccggaucaagcagaaggggauccucggcuacucccagaucggcgcggggguguacaaggagggcaccuuccacacgauguggcacgucacccgcggggccgugcugaugcaccggggcaagcgcaucgagcccagcugggccgacgugaagaaggaccugaucuccuacgggggcggcuggaagcucgagggggaguggaaggagggcgaggagguccaggugcuggcccuggagcccgggaagaacccccgggccgugcagaccaagcccggccucuucaagaccaacacggggaccaucggcgcggucagccuggacuucucccccggcaccagcgggucccccaucguggaccgcaagggcaagguggucgggcuguacggcaacggcguggugacccggagcggggccuacgucagcgccaucgcccagacggagaaguccaucgaggacaaccccgagaucgaggacgacaucuuccgcaagaagcggcucaccaucauggaccugcaccccggcgcggggaagaccaagcgcuaccugcccgccaucgugcgggaggccaucaagcgcggccugcggacccucauccuggccccgacgcgcguggucgccgcggagauggaggaggcccugcgcgggcuccccauccgguaccagacccccgccauccgcgccgagcacaccggccgggagaucguggaccugaugugccacgccaccuucacgaugcgccugcucagccccgugcgggucccgaacuacaaccugaucaucauggacgaggcgcacuucaccgaccccgccuccaucgccgcccgcggcuacaucagcacccggguggagaugggggaggccgcgggcaucuucaugaccgccacgccgcccgggucccgcgacccguucccccagagcaacgcccccaucauggacgaggagcgggagauccccgagcgcuccuggaacagcggccacgagugggugaccgacuucaaggggaagaccgucugguucgugccguccaucaaggccggcaacgacaucgcggccugccugcggaagaacggcaagaaggugauccagcucagccgcaagaccuucgacuccgaguacgucaagacgcggaccaacgacugggacuucguggugaccaccgacaucagcgagaugggggccaacuucaaggccgagcgcgucaucgacccccggcgcugcaugaagcccgugauccugacggacggcgaggagcgggugauccuggccgggcccaugccggucacccacuccagcgcggcccagcgccggggccgcaucgggcgcaaccccaagaacgagaacgaccaguacaucuacaugggcgagccccucgagaacgacgaggacugcgcccacuggaaggaggccaagaugcugcuggacaacaucaacacccccgagggcaucaucccguccauguucgagcccgagcgggagaagguggacgccaucgacggggaguaccgccuccggggcgaggcgcgcaagaccuucguggaccugaugcggcgcggggaccugcccgucuggcucgccuaccggguggccgccgagggcaucaacuacgccgaccgccgguggugcuucgacggggugaagaacaaccagauccuggaggagaacgucgagguggagaucuggacgaaggagggcgagcgcaagaagcugaagccgcgguggcucgacgcgcgcaucuacagcgacccccuggcccugaaggaguucaaggaguucgccgccggccggaagucccucacccugaaccugaucaccgagauggggcgccuccccaccuucaugacgcagaaggcgcgggacgcccuggacaaccuggccgugcuccacaccgccgaggccggcgggcgcgcguacaaccacgcccugagcgagcugcccgagacccucgagacccugcugcuccugacgcugcucgccaccgucaccggcggcaucuuccuguuccugauguccgggaagggcguggggaagaugacccucggcaugugcugcaucaucaccgccagcauccugcugugguacgcccagauccagccgcacuggaucgcggccagcaucauccucgaguucuuccugaucguccugcucauccccgagcccgagaagcagcggacgccccaggacaaccagcugaccuacguggugaucgccauccugaccgucguggccgccaccauggcgaacgagaugggguuccucgagaagacgaagaaggaccugggccugggcuccaucgccacccaggagccggagagcaacauccucgacaucgaccugcgccccgccuccgccuggacccuguacgccguggcgaccacguucgucacccccaugcuccggcacagcaucgagaacuccagcgugaacgugucccugaccgccaucgccaaccaggccaccguccugauggggcucggcaagggguggccccugagcaagauggacaucggcgugccgcugcucgcgaucgggugcuacucccaggugaaccccgucacgcugaccgccgcccugcuccugcugguggcccacuacgccaucaucggccccggccuccaggcgaaggccacccgcgaggcccagaagcgggccgccgcggggaucaugaagaaccccaccguggacggcaucacggucaucgaccuggacccgauccccuacgaccccaaguucgagaagcagcuggggcaggucaugcuccugauccugugcgugacccagguccucaugaugcgcaccaccugggcccugugcgaggcccugacgcucgccaccggccccaucagcacccugugggaggggaacccgggccgcuucuggaacaccacgaucgccguguccauggcgaacaucuuccggggcagcuaccuggccggggccggccuccuguucuccaucaugaagaacaccaccaacacccgccgggggacgggcaacaucggcgagacccugggggagaaguggaagucccgccucaacgcccugggcaaguccgaguuccagaucuacaagaaguccgggauccaggagguggaccggacccuggcgaaggagggcaucaagcgcggggagaccgaccaccacgccgucucccggggcagcgccaagcuccgcugguucguggagcggaacauggugacgcccgagggcaaggucguggaccuggggugcggccgcgggggcugguccuacuacugcgggggccugaagaacgugaaggaggucaagggccucaccaagggcgggcccgggcacgaggagcccaucccgaugagcaccuacggcuggaaccuggugcggcugcagagcgggguggacgucuucuucacgccgcccgagaagugcgacacgcuccugugcgacaucggcgaguccagccccaacccgaccaucgaggccggccgcacccugcgggugcucucccugguggagaacuggcugaacaacgacacccaguucugcaucaagguccucaaccccuacaugcccagcgugaucgagaagauggagacccugcagcgcaaguacgggggcgcccuggugcggaacccgcugucccgcaacagcacgcacgagauguacugggucuccaacgcgaccgggaacaucgugagcuccgugaacaugaucagccggaugcucaucaaccgcuucaccaugaagcacaagaaggccaccuacgagcuggacgucgaccugggcuccgggacgcggaacaucggcaucgagagcgagauccccaaccucgacaucaucggcaagcgcaucgagaagaucaagcaggagcacgagaccuccuggcacuacgaccaggaccaccccuacaagaccugggccuaccacgggagcuacgagaccaagcagacgggcuccgccagcuccauggugaacggggugguccgccugcugaccaagcccugggacguggugccgauggucacccagauggccaugaccgacacgacccccuucggccagcagcggguguucaaggagaagguggacacccgcacccaggagcccaaggagggcacgaagaagcucaugaagaucaccgcggaguggcuguggaaggagcuggggaagaagaagacgccccggaugugcacccgcgaggaguucacgcggaagguccgcagcaacgccgcccucggcgccaucuucaccgacgagaacaaguggaaguccgcccgggaggcgguggaggacagccgcuucugggagcugguggacaaggagcggaaccugcaccucgaggggaagugcgagaccugcgucuacaacaugaugggcaagcgcgagaagaagcugggggaguucggcaaggccaagggcagccgggccaucugguacauguggcugggggcccgcuuccucgaguucgaggcgcugggcuuccugaacgaggaccacugguucucccgggagaacagccucuccgggguggagggcgaggggcugcacaagcugggcuacauccuccgcgacgucggcaagaaggagggcggggccauguacgccgacgacaccgccgggugggacacgcggaucacccuggaggaccugaagaacgaggagauggugaccaaccacauggagggcgagcacaagaagcucgccgaggcgaucuucaagcugaccuaccagaacaaggugguccgcgugcagcggccgacgccccgcgggaccgugauggacaucaucagccggcgcgaccagcggggcuccggccaggucgggaccuacggccugaacaccuucacgaacauggaggcccagcucauccgccagauggagggggagggcaucuucaagagcauccagcaccugaccgugaccgaggagaucgccgugcagaacuggcuggcccgcgucggccgggagcgccucucccggauggccaucagcggggacgacugcguggugaagccccuggacgaccgcuucgcguccgcccugaccgcccucaacgacaugggcaagguccggaaggacauccagcagugggagcccagccgcggguggaacgacuggacccaggugccguucugcucccaccacuuccacgagcugaucaugaaggacggccgggugcuggucgugcccugccgcaaccaggacgagcucaucgggcgggcccgcaucagccagggcgccggcuggucccugaaggagaccgcgugccugggcaagagcuacgcccagauguggucccucauguacuuccaccggcgcgaccugcggcuggccgccaacgccaucugcagcgcggugcccucccacuggguccccaccagccgcaccaccuggagcauccacgccaagcacgaguggaugacgaccgaggacaugcucaccguguggaaccggguguggauccaggagaacccguggauggaggacaagacccccgucgaguccugggaggaggugcccuaccugggcaagcgcgaggaccaguggugcgggagccugaucggccucacgucccggaccaccugggccaagaacauccagaccgccaucaaccaggugcgcagccugaucgggaacgaggaguacacggacuacaugcccuccaugaagcgguuccgccgcgaggaggaggaggcgggcguccugugguga

SEQ ID NO: 9159 - RNA, 9876 nt, Artificial Sequence
  derived and/or modified CDS sequence (opt1) from DENV-2__FJ639698__SS-prME
accgcgggcgugaucaucaugcugauccccaccgccauggcguuccaccucaccacccgcaacggggagccccacaugaucgugggccggcaggagaaggggaagucccugcuguucaagaccgaggacggcgugaacaugugcacccucauggccaucgaccugggggagcugugcgaggacaccaucaccuacaagugcccccuccugcgccagaacgagcccgaggacaucgacugcuggugcaacagcaccagcaccugggugaccuacgggaccugcaccaccacgggcgagcaccggcgcgagaagcgguccgucgcccuggugccccacguggggaugggccucgagacccgcaccgagaccuggaugagcagcgagggggccuggaagcacgcccagcggaucgagaccuggauccugcgccaccccggcuucaccaucauggcggccauccuggccuacaccaucgggaccacgcacuuccagcgggcccucaucuucauccugcugaccgcgguggcccccagcaugaccaugcgcugcaucggcaucuccaaccgggacuucguggagggcgugagcgggggcuccugggucgacaucgugcucgagcacgggagcugcgugaccacgauggccaagaacaagcccacccuggacuucgagcugaucaagaccgaggccaaggagcccgccacccuccgcaaguacugcaucgaggcgaagcugacgaacaccaccaccgagucccggugcccgacgcagggcgagcccagccugaacgaggagcaggacaagcgcuucgucugcaagcacuccaugguggaccggggcugggggaacggcugcgggcuguucggcaagggcgggaucgugaccugcgccauguucagcugcaagaagaacauggagggcaagaucguccagcccgagaaccuggaguacaccaucgugaucacgccccacuccggggaggagcacgccgugggcaacgacacggggaagcacggcaaggagaucaagaucaccccgcagagcuccaucaccgaggccgagcugaccggguacggcaccgucacgauggagugcagcccccgcaccggccucgacuucaacgagauggugcugcugcagauggaggacaaggccuggcucgugcaccggcagugguuccuggaccugccccuccccuggcugccgggggcggacacccagggcuccaacuggauccagaaggagacccuggucacguucaagaacccccacgccaagaagcaggacguggugguccucgggagccaggagggcgccaugcacaccgcccugaccggggccaccgagauccagaugagcuccggcaaccuccuguucacgggccaccugaagugccgccugcggauggacaagcuccagcugaaggggaugagcuacuccaugugcaccggcaaguucaagaucgugaaggagaucgcggagacccagcacgggaccaucgucauccgcgugcaguacgagggcgacggcagccccugcaagauccccuucgagaucauggaccuggagaagcggcacgugcucgggcgccugaucacggucaacccgaucaucaccgagaaggacucccccgugaacaucgaggccgagccgcccuucggcgacagcuacaucaucaucgggguggagccgggccagcugaagcucaacugguucaagaagggguccagcaucggccagauguucgagaccaccaugcgcggcgccaagcggauggccauccugggggacacggccugggacuucggcucccucggcggggucuucaccagcaucgggaaggcgcuccaccagguguucggggccaucuacggcgccgccuucuccggggugagcuggaccaugaagauccugaucggcgucaucaucaccuggaucgggaugaacucccgcagcacgucccugagcgugucccuggugcucgucggcgugaucacccuguaccugggggcgauggugcaggccgacagcggcugcgucguguccuggaagaacaaggagcucaagugcggcagcgggaucuucaucaccgacaacgugcacaccuggacggagcaguacaaguuccagcccgagagccccuccaagcuggccagcgccauccagaaggcccacgaggagggcaucugcgggauccgguccgucacccgccuggagaaccucauguggaagcagaucacccccgagcugaaccacauccugagcgagaacgaggugaagcucaccaucaugacgggcgacaucaaggggaucaugcaggcgggcaagcggucccugcgcccgcagcccaccgagcugaaguacagcuggaagaccuggggcaaggccaagaugcucuccaccgagagccacaaccagacguuccugaucgacgggcccgagaccgccgagugcccgaacaccaaccgggccuggaacucccuggagguggaggacuacggcuucggggucuucaccacgaacaucuggcucaagcugaaggagaagcaggacguguucugcgaccccaagcugaugagcgccgcgaucaaggacaaccgcgccgugcacgccgacaugggcuacuggaucgaguccgcccucaacgacaccuggaagauggagaaggccagcuucaucgaggucaaguccugccacuggcccaagagccacacccugugguccaacggcgugcuggagagcgagaugaucauccccaagggguucgcgggcccggugucccagcacaacuaccggcccggguacuacacccagaccgccggccccuggcaccucgggaagcuggagauggacuucgacuucugcgagggcacgaccgucguggugaccgaggacugcggcaaccgcgggcccagccugcggaccacgaccgccagcggcaagcucaucaccgaguggugcugccgcuccugcacccugccgccccugcgguaccgcggggaggacggcugcugguacgggauggagauccggccccucaaggagaaggaggagaaccuggucaacagccuggugacggccggccacggccagaucgacaacuucucccucggggugcugggcauggcgcuguuccucgaggagaugcugcgcacccgggucgggaccaagcacgccauccugcucguggccgugagcuucgucacccugaucacgggcaacauguccuuccgcgaccuggggcgggugauggugauggucggcgccaccaugaccgacgacaucggcaugggggugaccuaccucgcccugcuggcggccuucaaggugcgccccacguucagcgccggccuccugcugcgcaagcucaccuccaaggagcugaugauggccaccaucgggaucgcccugcucagccaguccaccaucccggagacgauccuggagcugaccgacgcgcucgcccugggcaugaugguccugaagaucgugcggaacauggagaaguaccagcucgccgugaccaucauggccaucagcugcguccccaacgccgugauccugcagaacgcguggaagguguccugcaccauccuggccgccgucagcgugagcccccuccugcugacgagcucccagcagaaggccgacuggaucccccucgcgcugaccaucaagggccugaacccgaccgccaucuuccucaccacgcugagccgcaccuccaagaagcggagcuggccccugaacgaggccaucauggccguggggauggucuccauccucgccagcagccugcugaagaacgacauccccaugaccggcccccucguggccgggggccugcugaccgucugcuacgugcucacggggcgcuccgccgaccuggagcuggagcgggccaccgacgugaagugggaggaccaggccgagaucagcggcuccagcccgauccucuccaucaccaucagcgaggacggcuccaugagcaucaagaacgaggaggaggagcagacccugacgauccugauccgcaccgggcuccuggucaucuccggccuguuccccgugagcauccccaucaccgccgcggccugguaccucugggaggugaagaagcagcgggccgggguccugugggacgugcccuccccgccgcccgugggcaaggccgagcuggaggacggggccuaccgcaucaagcagaagggcauccucggcuacagccagaucggggcgggcgucuacaaggaggggaccuuccacaccauguggcacgugacgcggggcgccgugcugaugcaccgcgggaagcggaucgagccguccugggccgacgucaagaaggaccugaucagcuacggcggcggguggaagcucgagggcgaguggaaggagggggaggagguccaggugcuggcccuggagcccggcaagaacccccgcgccguccagaccaagcccggccucuucaagaccaacaccggcacgaucggcgcggugucccuggacuucagcccggggaccuccggcagccccaucguggaccggaaggggaaggucgugggccuguacggcaacgggguggucacccgcuccggcgccuacgugagcgccaucgcccagaccgagaaguccaucgaggacaaccccgagaucgaggacgacaucuuccggaagaagcgccucacgaucauggaccugcaccccggggcgggcaagaccaagcgguaccugccggccaucgugcgcgaggccaucaagcgggggcugcgcacccucauccuggcccccacccgggucguggccgcggagauggaggaggcccugcgcggccuccccauccgcuaccagacgcccgccauccgggccgagcacaccggccgcgagaucguggaccugaugugccacgccaccuucaccaugcggcugcucuccccgguccgcgugcccaacuacaaccugaucaucauggacgaggcgcacuucacggaccccgccagcaucgccgcccggggguacaucuccacccgcguggagaugggcgaggccgcggggaucuucaugaccgccacgccgcccggcagccgggaccccuucccccaguccaacgcccccaucauggacgaggagcgcgagauccccgagcggagcuggaacuccgggcacgagugggucacggacuucaagggcaagaccgugugguucgugcccagcaucaaggccggcaacgacaucgcggccugccugcgcaagaacgggaagaaggucauccagcucucccggaagaccuucgacagcgaguacgugaagacccgcacgaacgacugggacuucguggucaccaccgacaucuccgagaugggcgccaacuucaaggccgagcgggugaucgacccccgccggugcaugaagcccgugauccugaccgacggggaggagcgcgucauccuggccggcccgaugcccgugacgcacagcuccgcggcccagcggcgcgggcggaucggccgcaaccccaagaacgagaacgaccaguacaucuacaugggcgagccccucgagaacgacgaggacugcgcccacuggaaggaggccaagaugcugcuggacaacaucaacaccccggaggggaucauccccagcauguucgagcccgagcgcgagaagguggacgccaucgacggcgaguaccggcuccgcggggaggcgcggaagaccuucgucgaccugaugcgccggggcgaccugccgguguggcucgccuaccgcguggccgccgaggggaucaacuacgccgaccggcgcuggugcuucgacggcgucaagaacaaccagauccuggaggagaacguggagguggagaucuggaccaaggagggcgagcggaagaagcugaagccccgcuggcucgacgcgcggaucuacuccgacccccuggcccugaaggaguucaaggaguucgccgccgggcgcaagagccucacgcugaaccugaucaccgagaugggccggcuccccaccuucaugacccagaaggcgcgcgacgcccuggacaaccuggccguccuccacacggccgaggucgggggccgggccuacaaccacgcgcuguccgagcugccggagacccucgagacccugcugcuccugacccugcucgccacggugaccggcgggaucuuccuguuccugaugagcggcaagggggucggcaagaugacccucgggaugugcugcaucaucaccgccuccauccugcugugguacgcccagauccagccccacuggaucgccgcgagcaucauccucgaguucuuccugaucgugcugcucauccccgagcccgagaagcagcgcaccccgcaggacaaccagcugacguacgucgugaucgccauccugaccguggucgccgccaccauggccaacgagaugggcuuccucgagaagaccaagaaggaccugggccuggggagcaucgcgacgcaggagcccgaguccaacauccucgacaucgaccugcggcccgccagcgccuggacccuguacgccguggccaccaccuucgugacgcccaugcuccgccacuccaucgagaacagcuccgucaacgugagccugaccgcgaucgccaaccaggccaccgugcugaugggccucgggaagggcuggccgcuguccaagauggacaucggggucccccugcucgccaucggcugcuacagccaggugaaccccaucacccugacggcggcccugcuccugcugguggcccacuacgccaucaucggccccgggcuccaggccaaggcgacccgggaggcccagaagcgcgccgccgccggcaucaugaagaacccgaccgucgacgggaucaccgugaucgaccuggaccccauccccuacgaccccaaguucgagaagcagcugggccaggugaugcuccugauccugugcgucacccaggugcucaugaugcggaccaccugggcgcugugcgaggcccugacccucgccacggggccgaucuccacccugugggagggcaaccccggccgcuucuggaacaccaccaucgccgugagcauggccaacaucuuccgcggguccuaccuggcgggcgccgggcuccuguucagcaucaugaagaacacgaccaacacccggcgcggcaccggcaacaucggggagacgcugggcgagaaguggaagucccggcucaacgcccuggggaagaacgaguuccagaucuacaagaaguccggcauccaggaggucgaccgcacccuggccaaggaggggaucaagcggggcgagaccgaccaccacgcggugucccgcggcagcgccaagcuccggugguucguggagcgcaacauggucacccccgaggggaaggugguggaccugggcugcgggcggggcgggugguccuacuacugcggcggccugaagaacguccgcgaggugaaggggcucacgaagggcgggcccggccacgaggagccgauccccaugagcaccuacggguggaaccuggugcggcugcaguccggcgucgacguguucuucacgccgcccgagaagugcgacacccuccugugcgacaucggcgagagcagcccgaaccccacgaucgaggccgggcgcacccugcgggugcucucccuggucgagaacuggcugaacaacgacacccaguucugcaucaaggugcucaaccccuacaugccgagcgugaucgagaagauggagacccugcagcgcaaguacggcggggcccugguccggaacccccugucccgcaacagcacccacgagauguacuggguguccaacgccacgggcaacaucgugagcuccgucaacaugaucagccggaugcucaucaaccgcuucaccaugaagcacaagaaggcgaccuacgagcccgacguggaccugggguccggcacccggaacaucggcaucgagagcgagauccccaaccuggacaucaucgggaagcgcaucgagaagaucaagcaggagcacgagacguccuggcacuacgaccaggaccacccguacaagaccugggccuaccacggcagcuacgagaccaagcagaccggguccgccagcuccauggugaacggcgucgugcgccuccugacgaagcccugggacgugguccccauggugacccagauggccaugaccgacaccacgcccuucggccagcagcggguguucaaggagaaggucgacacccgcacccaggagccgaaggaggggaccaagaagcugaugaagaucacggccaaguggcucuggaaggagcugggcaagaagaagacgccccggaucugcacccgcgaggaguucaccaagaaggugcggagcaacgcggcccugggggccaucuucacggacgagaacaaguggaaguccgcccgcgaggccguggaggacagccgguucugggagcucgucgacaaggagcgcaaccugcaccuggagggcaagugcgagaccugcguguacaacaugauggggaagcgggagaagaagcucggcgaguucggcaaggcgaaggggucccgcgccaucugguacauguggcugggcgcccgguuccuggaguucgaggcccucggguuccugaacgaggaccacugguucagccgcgagaacagccuguccggcguggagggggagggccuccacaagcugggcuacauccugcgggacgucagcaagaaggagggcggcgcgauguacgccgacgacaccgccgggugggacacccgcaucacgcucgaggaccugaagaacgaggagauggugaccaaccacauggagggcgagcacaagaagcuggccgaggccaucuucaagcucaccuaccagaacaaggucgugcgggugcagcgccccacgccccgggggacggucauggacaucaucucccgccgggaccagcgcggcagcggccagguggggaccuacggccugaacaccuucaccaacauggaggcgcagcugauccggcagauggagggggagggcaucuucaaguccauccagcaccucacggugaccgaggaggucgccgugcagaacuggcuggcccgcgugggccgcgagcggcugagccgcauggccaucuccggggacgacugcgucgugaagccgcucgacgaccgguucgccagcgcgcugaccgcccugaacgacaugggcaaggugcgcaaggacauccagcagugggagcccucccggggguggaacgacuggacccagguccccuucugcagccaccacuuccacgagcucaucaugaaggacggccgcgugcuggugguccccugccggaaccaggacgagcugaucgggcgcgcccggaucucccagggcgccggcuggagccucaaggagacggccugccuggggaaguccuacgcgcagauguggagccugauguacuuccaccgccgggaccuccgccuggccgccaacgccaucugcuccgccgugccgagccacugggugcccaccucccggaccaccuggagcauccacgcgaagcacgaguggaugaccacggaggacaugcugaccgucuggaaccgcguguggauccaggagaaccccuggauggaggacaagacccccguggagagcugggaggaggucccguaccucggcaagcgggaggaccaguggugcgggucccugaucggccugaccagccgcgccacgugggccaagaacauccagaccgccaucaaccaggugcggucccucaucgggaacgaggaguacaccgacuacaugcccagcaugaagcgcuuccggcgcgaggaggaggaggcgggcgugcugugguga

SEQ ID NO: 9160 - RNA, 9876 nt, Artificial Sequence
  derived and/or modified CDS sequence (opt1) from DENV-2__FJ639699__SS-prME
accgccggcgugaucaucaugcugauccccaccgccauggcguuccaccucaccacccgcaacggggagccccacaugaucgucggccggcaggagaaggggaagucccugcuguucaagaccgaggacggcgugaacaugugcacccucauggccaucgaccugggggagcugugcgaggacaccaucaccuacaagugcccccuccugcgccagaacgagcccgaggacaucgacugcuggugcaacagcaccagcaccugggugaccuacgggaccugcaccaccacgggcgagcaccggcgcgagaagcgguccgucgcccuggugccccacguggggaugggccucgagacccgcaccgagaccuggaugagcuccgagggggccuggaagcacgcccagcggaucgagaccuggauccugcgccaccccggcuucaccaucauggcggccauccuggccuacaccaucgggaccacccacuuccagcgggcccucaucuucauccugcugaccgcggucgcccccagcaugaccaugcgcugcaucggcaucuccaaccgggacuucguggagggcgugagcgggggcuccugggucgacaucgugcucgagcacgggagcugcgugaccacgauggccaagaacaagcccacccuggacuucgagcugaucaagaccgaggccaaggagcccgccacccuccgcaaguacugcaucgaggcgaagcugacgaacaccaccaccgagucccggugcccgacgcagggcgagcccagccugaacgaggagcaggacaagcgcuucgucugcaagcacuccaugguggaccggggcugggggaacggcugcgggcuguucggcaagggcgggaucgugaccugcgccauguucagcugcaagaagaacauggagggcaagaucguccagcccgagaaccuggaguacaccaucgugaucacgccccacuccggggaggagcacgccgugggcaacgacacggggaagcacggcaaggagaucaagaucaccccgcagagcuccaucaccgaggccgagcugaccggguacggcaccgucacgauggagugcagcccccgcaccggccucgacuucaacgagauggugcugcugcagauggaggacaaggccuggcucgugcaccggcagugguuccuggaccugccccuccccuggcugccgggggcggacacccagggcuccaacuggauccagaaggagacccuggucacguucaagaacccccacgccaagaagcaggacguggugguccucgggagccaggagggcgccaugcacaccgcccugaccggggccaccgagauccagaugagcuccggcaaccuccuguucacgggccaccugaagugccgccugcggauggacaagcuccagcugaaggggaugagcuacuccaugugcaccggcaaguucaagaucgugaaggagaucgcggagacccagcacgggaccaucgucauccgcgugcaguacgagggcgacggcagccccugcaagauccccuucgagaucauggaccuggagaagcggcacgugcucgggcgccugaucacggucaacccgaucaucaccgagaaggacucccccgugaacaucgaggccgagccgcccuucggcgacagcuacaucaucaucgggguggagccgggccagcugaagcucaacugguucaagaagggguccagcaucggccagauguucgagaccaccaugcgcggcgccaagcggauggccauccugggggacacggccugggacuucggcucccucggcggggucuucaccagcaucgggaaggcgcuccaccagguguucggggccaucuacggcgccgccuucuccggggugagcuggaccaugaagauccugaucggcgucaucaucaccuggaucgggaugaacucccgcagcacgucccugagcgugucccuggugcucgucggcgugaucacccuguaccugggggcgauggugcaggccgacagcggcugcgucguguccuggaagaacaaggagcucaagugcggcagcgggaucuucaucaccgacaacgugcacaccuggacggagcaguacaaguuccagcccgagagccccuccaagcuggccagcgccauccagaaggcccacgaggagggcaucugcgggauccgguccgucacccgccuggagaaccucauguggaagcagaucacccccgagcugaaccacauccugagcgagaacgaggugaagcucaccaucaugacgggcgacaucaaggggaucaugcaggcgggcaagcggucccugcgcccgcagcccaccgagcugaaguacagcuggaagaccuggggcaaggccaagaugcucuccaccgagagccacaaccagacguuccugaucgacgggcccgagaccgccgagugcccgaacaccaaccgggccuggaacucccuggagguggaggacuacggcuucggggucuucaccacgaacaucuggcucaagcugaaggagaagcaggacguguucugcgacagcaagcugauguccgccgcgaucaaggacaaccgcgccgugcacgccgacaugggcuacuggaucgagagcgcccucaacgacaccuggaagauggagaaggccuccuucaucgaggucaagagcugccacuggcccaagucccacacccuguggagcaacggcgugcuggaguccgagaugaucauccccaagggguucgcgggccccgugagccagcacaacuaccggccgggguacuacacccagaccgccggccccuggcaccucgggaagcuggagauggacuucgacuucugcgagggcacgaccgucguggugaccgaggacugcggcaaccgcgggcccagccugcggaccacgaccgccuccggcaagcucaucaccgaguggugcugccgcagcugcacccugcccccgcugcgguaccgcggggaggacggcugcugguacgggauggagauccggccccucaaggagaaggaggagaaccuggucaacucccuggugacggccggccacggccagaucgacaacuucagccucggggugcugggcauggcgcuguuccucgaggagaugcugcgcacccgggucgggaccaagcacgccauccugcucguggccguguccuucgucacccugaucacgggcaacaugagcuuccgcgaccuggggcgggugauggugauggucggcgccaccaugaccgacgacaucggcaugggggugaccuaccucgcccugcuggcggccuucaaggugcgccccacguucgccgccggccuccugcugcgcaagcucaccuccaaggagcugaugauggccaccaucgggaucgcgcugcucagccaguccaccauccccgagacgauccuggagcugaccgacgcccucgcccugggcaugaugauccugaagaucguccggaacauggagaaguaccagcucgccgugaccaucauggccaucagcugcgugccgaacgcggucauccugcagaacgccuggaagguguccugcaccauccuggccgccgugagcgucagcccccuccugcugacgagcucccagcagaaggcggacuggaucccccucgcccugaccaucaagggccugaaccccaccgccaucuuccucaccacgcugagccgcaccuccaagaagcggagcuggccgcugaacgaggccaucauggccguggggaugguguccauccucgcgagcagccugcugaagaacgacauccccaugaccggcccccucgucgccgggggccugcugaccgugugcuacguccucacggggcgcuccgccgaccuggagcuggagcgggccaccgacgugaagugggaggaccaggccgagaucagcggcuccagccccauccucuccaucaccaucagcgaggacggcuccaugagcaucaagaacgaggaggaggagcagacccugacgauccugauccgcaccgggcuccuggugaucuccggccuguucccggucagcauccccaucaccgcggccgccugguaccucugggaggugaagaagcagcgggccggggugcugugggacguccccagcccgccgcccgugggcaaggccgagcuggaggacggggcguaccgcaucaagcagaagggcauccucggcuacagccagaucggggccggcguguacaaggaggggaccuuccacaccauguggcacgucacgcggggcgccgugcugaugcaccgcgggaagcggaucgagcccuccugggccgacgugaagaaggaccugaucagcuacggcggcggguggaagcucgagggcgaguggaaggagggggaggagguccaggugcuggcccuggagcccggcaagaacccccgcgcggugcagaccaagcccggccucuucaagaccaacaccggcacgaucggcgccgucucccuggacuucagccccgggaccuccggcagccccaucguggaccggaaggggaagguggucggccuguacggcaacgggguggugacccgcuccggcgccuacgucagcgccaucgcgcagaccgagaaguccaucgaggacaaccccgagaucgaggacgacaucuuccggaagaagcgccucacgaucauggaccugcaccccggggccggcaagaccaagcgguaccugcccgccaucgugcgcgaggccaucaagcgggggcugcgcacccucauccuggccccgacccggguggucgcggccgagauggaggaggcccugcgcggccuccccauccgcuaccagacgcccgccauccgggccgagcacaccggccgcgagaucguggaccugaugugccacgcgaccuucaccaugcggcugcucucccccgugcgcgucccgaacuacaaccugaucaucauggacgaggcccacuucacggaccccgccagcaucgccgcccggggguacaucuccacccgcguggagaugggcgaggcggccgggaucuucaugaccgccacgccgcccggcagccgggacccguucccccaguccaacgcccccaucauggacgaggagcgcgagauccccgagcggagcuggaacuccgggcacgagugggugacggacuucaagggcaagaccgucugguucgugccgagcaucaaggcgggcaacgacaucgccgccugccugcgcaagaacgggaagaaggugauccagcucucccggaagaccuucgacagcgaguacgucaagacccgcacgaacgacugggacuucguggugaccaccgacaucuccgagaugggcgccaacuucaaggccgagcgggucaucgacccccgccggugcaugaagcccgugauccugaccgacggggaggagcgcgugauccuggcgggccccaugccggucacgcacagcuccgccgcccagcggcgcgggcggaucggccgcaaccccaagaacgagaacgaccaguacaucuacaugggcgagccccucgagaacgacgaggacugcgcccacuggaaggaggccaagaugcugcuggacaacaucaacacccccgaggggaucaucccgagcauguucgagcccgagcgcgagaagguggacgcgaucgacggcgaguaccggcuccgcggggaggcccggaagaccuucguggaccugaugcgccggggcgaccugcccgucuggcucgccuaccgcguggccgccgaggggaucaacuacgcggaccggcgcuggugcuucgacggcgugaagaacaaccagauccuggaggagaacgucgagguggagaucuggaccaaggagggcgagcggaagaagcugaagccgcgcuggcucgacgcccggaucuacuccgacccccuggcccugaaggaguucaaggaguucgccgcggggcgcaagagccucacgcugaaccugaucaccgagaugggccggcuccccaccuucaugacccagaaggcccgcgacgcccuggacaaccuggccgugcuccacacggccgaggucgggggccgggcguacaaccacgcccuguccgagcugcccgagacccucgagacccugcugcuccugacccugcucgccacggugaccggcgggaucuuccuguuccugaugagcggcaagggggugggcaagaugacccucgggaugugcugcaucaucaccgccuccauccugcugugguacgcccagauccagccgcacuggaucgcggccagcaucauccucgaguucuuccugaucguccugcucauccccgagcccgagaagcagcgcacgccccaggacaaccagcugacguacguggucaucgccauccugaccgugguggccgccaccauggcgaacgagaugggcuuccucgagaagaccaagaaggaccugggccuggggagcaucgccacgcaggagccggaguccaacauccucgacaucgaccugcggcccgccagcgccuggacccuguacgccgucgcgaccaccuucgugacgcccaugcuccgccacuccaucgagaacagcuccgugaacgucagccugaccgccaucgccaaccaggccaccgugcugaugggccucgggaagggcuggccccuguccaagauggacaucggggugccgcugcucgcgaucggcugcuacagccaggucaaccccaucacccugacggccgcccugcuccugcugguggcccacuacgccaucaucggccccgggcuccaggcgaaggccacccgggaggcccagaagcgcgccgccgcgggcaucaugaagaaccccaccguggacgggaucaccgucaucgaccuggacccgauccccuacgaccccaaguucgagaagcagcugggccaggugaugcuccugauccugugcgugacgcagguccucaugaugcggaccaccugggcccugugcgaggcccugacccucgccacggggcccaucuccacccugugggagggcaacccgggccgcuucuggaacaccaccaucgccgugagcauggcgaacaucuuccgcggguccuaccuggccggcgccgggcuccuguucagcaucaugaagaacacgaccaacacccggcgcggcaccggcaacaucggggagacgcugggcgagaaguggaagucccggcucaacgcccuggggaagaacgaguuccagaucuacaagaaguccggcauccaggagguggaccgcacccuggcgaaggaggggaucaagcggggcgagaccgaccaccacgccgucucccgcggcagcgccaagcuccggugguucguggagcgcaacauggugacccccgaggggaaggucguggaccugggcugcgggcggggcgggugguccuacuacugcggcggccugaagaacgugcgcgaggucaaggggcucacgaagggcgggcccggccacgaggagcccaucccgaugagcaccuacggguggaaccuggugcggcugcaguccggcguggacgucuucuucacgccgcccgagaagugcgacacccuccugugcgacaucggcgagagcagccccaacccgacgaucgaggccgggcgcacccugcgggugcucucccugguggagaacuggcugaacaacgacacccaguucugcaucaagguccucaaccccuacaugcccagcgugaucgagaagauggagacccugcagcgcaaguacggcggggcccuggugcggaacccgcugucccgcaacagcacccacgagauguacugggucuccaacgcgacgggcaacaucgugagcuccgugaacaugaucagccggaugcucaucaaccgcuucaccaugaagcacaagaaggccaccuacgagcccgacgucgaccugggguccggcacccggaacaucggcaucgagagcgagauccccaaccuggacaucaucgggaagcgcaucgagaagaucaagcaggagcacgagacguccuggcacuacgaccaggaccaccccuacaagaccugggccuaccacggcagcuacgagaccaagcagaccggguccgccagcuccauggugaacggcgugguccgccuccugacgaagccgugggacguggugcccauggucacccagauggccaugaccgacaccacgcccuucggccagcagcggguguucaaggagaagguggacacccgcacccaggagcccaaggaggggaccaagaagcugaugaagaucacggcgaaguggcucuggaaggagcugggcaagaagaagaccccgcggaucugcacccgcgaggaguucaccaagaagguccggagcaacgccgcccugggggccaucuucacggacgagaacaaguggaaguccgcccgcgaggcgguggaggacagccgguucugggagcucguggacaaggagcgcaaccugcaccuggagggcaagugcgagaccugcgucuacaacaugauggggaagcgggagaagaagcucggcgaguucggcaaggccaaggggucccgcgccaucugguacauguggcugggcgcccgguuccuggaguucgaggcgcucggguuccugaacgaggaccacugguucagccgcgagaacagccuguccggcguggagggggagggccuccacaagcugggcuacauccugcgggacgugagcaagaaggagggcggcgccauguacgccgacgacaccgccgggugggacacccgcaucacgcucgaggaccugaagaacgaggagauggucaccaaccacauggagggcgagcacaagaagcuggccgaggcgaucuucaagcucaccuaccagaacaaggugguccgggugcagcgccccacgccccgggggacggugauggacaucaucucccgccgggaccagcgcggcagcggccaggucgggaccuacggccugaacaccuucaccaacauggaggcccagcugauccggcagauggagggggagggcaucuucaaguccauccaguaccucacggugaccgaggagguggccguccagaacuggcuggcccgcgugggccgcgagcggcugagccgcauggccaucuccggggacgacugcguggucaagccccucgacgaccgguucgcgagcgcccugaccgcccugaacgacaugggcaaggugcgcaaggacauccagcagugggagccgucccggggguggaacgacuggacccaggugcccuucugcagccaccacuuccacgagcucaucaugaaggacggccgcguccugguggugcccugccggaaccaggacgagcugaucgggcgcgcccggaucucccagggcgccggcuggagccucaaggagacggcgugccuggggaaguccuacgcccagauguggagccugauguacuuccaccgccgggaccuccgccuggccgccaacgccaucugcuccgcgguccccagccacugggugccgaccucccggaccaccuggagcauccacgccaagcacgaguggaugaccacggaggacaugcugaccguguggaaccgcgucuggauccaggagaaccccuggauggaggacaagacccccguggagagcugggaggaggugcccuaccucggcaagcgggaggaccaguggugcgggucccugaucggccugaccagccgcgccacgugggccaagaacauccagaccgcgaucaaccagguccggucccucaucgggaacgaggaguacaccgacuacaugccgagcaugaagcgcuuccggcgcgaggaggaggaggccggcgugcugugguga

SEQ ID NO: 9161 - RNA, 9876 nt, Artificial Sequence
  derived and/or modified CDS sequence (opt1) from DENV-2__FJ639700__SS-prME
accgccggcgugaucaucaugcugauccccaccgccauggcguuccaccucaccacccgcaacggggagccccacaugaucgugggccggcaggagaaggggaagucccugcuguucaagaccgaggacggcgugaacaugugcacccucauggccaucgaccugggggagcugugcgaggacaccaucaccuacaagugcccccuccugcgccagaacgagcccgaggacaucgacugcuggugcaacagcaccagcaccugggugaccuacgggaccugcaccaccacgggcgagcaccggcgcgagaagcgguccgucgcccuggugccccacguggggaugggccucgagacccgcaccgagaccuggaugagcagcgagggggccuggaagcacgcccagcggaucgagaccuggauccugcgccaccccggcuucaccaucauggcggccauccuggccuacaccaucgggaccacgcacuuccagcgggcccucaucuucauccugcugaccgcggucgcccccagcaugaccaugcgcugcaucggcaucuccaaccgggacuucguggagggcgugagcgggggcuccugggucgacaucgugcucgagcacgggagcugcgugaccacgauggccaagaacaagcccacccuggacuucgagcugaucaagaccgaggccaaggagcccgccacccuccgcaaguacugcaucgaggcgaagcugacgaacaccaccaccgagucccggugcccgacgcagggcgagcccagccugaacgaggagcaggacaagcgcuucgucugcaagcacuccaugguggaccggggcugggggaacggcugcgggcuguucggcaagggcgggaucgugaccugcgccauguucagcugcaagaagaacauggagggcaagaucguccagcccgagaaccuggaguacaccaucgugaucacgccccacuccggggaggagcacgccgugggcaacgacacggggaagcacggcaaggagaucaagaucaccccgcagagcuccaucaccgaggccgagcugaccggguacggcaccgucacgauggagugcagcccccgcaccggccucgacuucaacgagauggugcugcugcagauggaggacaaggccuggcucgugcaccggcagugguuccuggaccugccccuccccuggcugccgggggcggacacccagggcuccaacuggauccagaaggagacccuggucacguucaagaacccccacgccaagaagcaggacguggugguccucgggagccaggagggcgccaugcacaccgcccugaccggggccaccgagauccagaugagcuccggcaaccuccuguucacgggccaccugaagugccgccugcggauggacaagcuccagcugaaggggaugagcuacuccaugugcaccggcaaguucaagaucgugaaggagaucgcggagacccagcacgggaccaucgucauccgcgugcaguacgagggcgacggcagccccugcaagauccccuucgagaucauggaccuggagaagcggcacgugcucgggcgccugaucacggucaacccgaucaucaccgagaaggacucccccgugaacaucgaggccgagccgcccuucggcgacagcuacaucaucaucgggguggagccgggccagcugaagcucaacugguucaagaagggguccagcaucggccagauguucgagaccaccaugcgcggcgccaagcggauggccauccugggggacacggccugggacuucggcucccucggcggggucuucaccagcaucgggaaggcgcuccaccagguguucggggccaucuacggcgccgccuucuccggggugagcuggaccaugaagauccugaucggcgucaucaucaccuggaucgggaugaacucccgcagcacgucccugagcgugucccuggugcucgucggcgugaucacccuguaccugggggcgauggugcaggccgacagcggcugcgucguguccuggaagaacaaggagcucaagugcggcagcgggaucuucaucaccgacaacgugcacaccuggacggagcaguacaaguuccagcccgagagccccuccaagcuggccagcgccauccagaaggcccacgaggagggcaucugcgggauccgguccgucacccgccuggagaaccucauguggaagcagaucacccccgagcugaaccacauccugagcgagaacgaggcgaagcucaccaucaugacgggcgacaucaaggggaucaugcaggccggcaagcggucccugcgcccgcagcccaccgagcugaaguacagcuggaagaccuggggcaaggccaagaugcucuccaccgagagccacaaccagacguuccugaucgacgggcccgagaccgccgagugcccgaacaccaaccgggccuggaacucccuggagguggaggacuacggcuucgggguguucaccacgaacaucuggcucaagcugaaggagaagcaggacgucuucugcgacagcaagcugauguccgcggccaucaaggacaaccgcgccgugcacgccgacaugggcuacuggaucgagagcgcccucaacgacaccuggaagauggagaaggcguccuucaucgaggugaaguccugccacuggcccaagucccacacccuguggagcaacggcguccuggaguccgagaugaucauccccaagggguucgccggccccgugagccagcacaacuaccggccgggguaccacacccagaccgccggccccuggcaccucgggaagcuggagauggacuucgacuucugcgagggcacgaccguggucgugaccgaggacugcggcaaccgcgggcccagccugcggaccacgaccgccuccggcaagcucaucaccgaguggugcugccgcagcugcacccugcccccgcugcgguaccgcggggaggacggcugcugguacgggauggagauccggccccucaaggagaaggaggagaaccuggugaacucccuggucacggcgggccacggccagaucgacaacuucagccucggggugcugggcauggcccuguuccucgaggagaugcugcgcacccggguggggaccaagcacgccauccugcucgucgccguguccuucgugacccugaucacgggcaacaugagcuuccgcgaccuggggcgggucauggugauggugggcgccaccaugaccgacgacaucggcaugggggucaccuaccucgcgcugcuggccgccuucaaggugcgccccacguucgccgccggccuccugcugcgcaagcucaccuccaaggagcugaugauggcgaccaucgggaucgcccugcucagccaguccaccauccccgagacgauccuggagcugaccgacgcccucgcccugggcaugaugauccugaagaucgugcggaacauggagaaguaccagcucgccgucaccaucauggcgaucagcugcgugccgaacgccgugauccugcagaacgccuggaaggucuccugcaccauccuggccgcggugagcgugagcccccuccugcugacgagcucccagcagaaggccgacuggaucccccucgcccugaccaucaagggccugaaccccaccgccaucuuccucaccacgcugagccgcaccuccaagaagcggagcuggccgcugaacgaggccaucauggcggucgggaugguguccauccucgccagcagccugcugaagaacgacauccccaugaccggcccccucguggccgggggccugcugaccgucugcuacgugcucacggggcgcuccgccgaccuggagcuggagcgggccaccgacgucaagugggaggaccaggcggagaucagcggcuccagccccauccucuccaucaccaucagcgaggacggcuccaugagcaucaagaacgaggaggaggagcagacccugacgauccugauccgcaccgggcuccuggugaucuccggccuguucccggugagcauccccaucaccgccgccgccugguaccucugggaggucaagaagcagcgggccggggugcugugggacgugcccagcccgccgcccgucggcaaggcggagcuggaggacggggccuaccgcaucaagcagaagggcauccucggcuacagccagaucggggccggcguguacaaggaggggaccuuccacaccauguggcacgugacgcggggcgccguccugaugcaccgcgggaagcggaucgagcccuccugggccgacgugaagaaggaccugaucagcuacggcggcggguggaagcucgagggcgaguggaaggagggggaggaggugcagguccuggcgcuggagcccggcaagaacccccgcgccgugcagaccaagcccggccucuucaagaccaacaccggcacgaucggcgccgugucccuggacuucagccccgggaccuccggcagccccaucgucgaccggaaggggaagguggugggccuguacggcaacggggucgugacccgcuccggcgccuacgugagcgcgaucgcccagaccgagaaguccaucgaggacaaccccgagaucgaggacgacaucuuccggaagaagcgccucacgaucauggaccugcaccccggggccggcaagaccaagcgguaccugcccgccaucguccgcgaggccaucaagcgggggcugcgcacccucauccuggcgccgacccgggugguggccgccgagauggaggaggcccugcgcggccuccccauccgcuaccagacgcccgccauccgggcggagcacaccggccgcgagaucgucgaccugaugugccacgccaccuucaccaugcggcugcucucccccgugcgcgugccgaacuacaaccugaucaucauggacgaggcccacuucacggaccccgccagcaucgccgcgcggggguacaucuccacccgcgucgagaugggcgaggccgccgggaucuucaugaccgccacgccgcccggcagccgggacccguucccccaguccaacgcgcccaucauggacgaggagcgcgagauccccgagcggagcuggaacuccgggcacgagugggugacggacuucaagggcaagaccgugugguucgucccgagcaucaaggccggcaacgacaucgccgccugccugcgcaagaacgggaagaaggugauccagcucucccggaagaccuucgacagcgaguacgugaagacccgcacgaacgacugggacuucgucgugaccaccgacaucuccgagaugggcgccaacuucaaggcggagcgggugaucgacccccgccggugcaugaagcccgucauccugaccgacggggaggagcgcgugauccuggccggccccaugccggugacgcacagcuccgccgcccagcggcgcgggcggaucggccgcaaccccaagaacgagaacgaccaguacaucuacaugggcgagccccucgagaacgacgaggacugcgcccacuggaaggaggcgaagaugcugcuggacaacaucaacacccccgaggggaucaucccgagcauguucgagcccgagcgcgagaaggucgacgccaucgacggcgaguaccggcuccgcggggaggcccggaagaccuucguggaccugaugcgccggggcgaccugcccguguggcucgccuaccgcgucgccgcggaggggaucaacuacgccgaccggcgcuggugcuucgacggcgugaagaacaaccagauccuggaggagaacguggaggucgagaucuggaccaaggagggcgagcggaagaagcugaagccgcgcuggcucgacgcccggaucuacuccgacccccuggcccugaaggaguucaaggaguucgcggccgggcgcaagagccucacgcugaaccugaucaccgagaugggccggcuccccaccuucaugacccagaaggcccgcgacgcccuggacaaccuggccgugcuccacacggcggaggucgggggccgggccuacaaccacgcccuguccgagcugcccgagacccucgagacccugcugcuccugacccugcucgccacggucaccggcgggaucuuccuguuccugaugagcggcaagggggugggcaagaugacccucgggaugugcugcaucaucaccgccuccauccugcugugguacgcgcagauccagccgcacuggaucgccgccagcaucauccucgaguucuuccugaucgugcugcucauccccgagcccgagaagcagcgcacgccccaggacaaccagcugacguacgucgugaucgccauccugaccgucguggccgcgaccauggccaacgagaugggcuuccucgagaagaccaagaaggaccugggccuggggagcaucgccacgcaggagccggaguccaacauccucgacaucgaccugcggcccgccagcgccuggacccuguacgcgguggccaccaccuucgucacgcccaugcuccgccacuccaucgagaacagcuccgugaacgugagccugaccgccaucgccaaccaggcgaccguccugaugggccucgggaagggcuggccccuguccaagauggacaucggggugccgcugcucgccaucggcugcuacagccaggugaaccccaucacccugacggccgcccugcuccugcuggucgcccacuacgcgaucaucggccccgggcuccaggccaaggccacccgggaggcccagaagcgcgccgcggccggcaucaugaagaaccccaccguggacgggaucaccgugaucgaccuggacccgauccccuacgaccccaaguucgagaagcagcugggccaggucaugcuccugauccugugcgugacccaggugcucaugaugcggaccaccugggcccugugcgaggcccugacccucgccacggggcccaucuccacccugugggagggcaacccgggccgcuucuggaacaccaccaucgcggucagcauggccaacaucuuccgcggguccuaccuggccggcgccgggcuccuguucagcaucaugaagaacacgaccaacacccggcgcggcaccggcaacaucggggagacgcugggcgagaaguggaagucccggcucaacgcgcuggggaagaacgaguuccagaucuacaagaaguccggcauccaggagguggaccgcacccuggccaaggaggggaucaagcggggcgagaccgaccaccacgccgugucccgcggcagcgccaagcuccggugguucgucgagcgcaacauggugacccccgaggggaagguggucgaccugggcugcgggcggggcgggugguccuacuacugcggcggccugaagaacgugcgcgaggugaaggggcucacgaagggcgggcccggccacgaggagcccaucccgaugagcaccuacggguggaaccugguccggcugcaguccggcguggacguguucuucacgccgcccgagaagugcgacacccuccugugcgacaucggcgagagcagccccaacccgacgaucgaggccgggcgcacccugcggguccucucccugguggagaacuggcugaacaacgacacccaguucugcaucaaggugcucaaccccuacaugcccagcgucaucgagaagauggagacccugcagcgcaaguacggcggggcgcuggugcggaacccgcugucccgcaacagcacccacgagauguacuggguguccaacgccacgggcaacaucgucagcuccgugaacaugaucagccggaugcucaucaaccgcuucaccaugaagcacaagaaggccaccuacgagcccgacguggaccugggguccggcacccggaacaucggcaucgagagcgagauccccaaccuggacaucaucgggaagcgcaucgagaagaucaagcaggagcacgagacguccuggcacuacgaccaggaccaccccuacaagaccugggccuaccacggcagcuacgagaccaagcagaccggguccgccagcuccauggucaacggcguggugcgccuccugacgaagccgugggacgucgugcccauggugacccagauggcgaugaccgacaccacgcccuucggccagcagcgggucuucaaggagaagguggacacccgcacccaggagcccaaggaggggaccaagaagcugaugaagaucacggccaaguggcucuggaaggagcugggcaagaagaagaccccgcggaucugcacccgcgaggaguucaccaagaaggugcggagcaacgccgcccugggggccaucuucacggacgagaacaaguggaaguccgcgcgcgaggccgucgaggacagccgguucugggagcucguggacaaggagcgcaaccugcaccuggagggcaagugcgagaccugcguguacaacaugauggggaagcgggagaagaagcucggcgaguucggcaaggccaaggggucccgcgccaucugguacauguggcugggcgcgcgguuccuggaguucgaggcccucggguuccugaacgaggaccacugguucagccgcgagaacagccuguccggcgucgagggggagggccuccacaagcugggcuacauccugcgggacgugagcaagaaggagggcggcgccauguacgccgacgacaccgccgggugggacacccgcaucacgcucgaggaccugaagaacgaggagauggugaccaaccacauggagggcgagcacaagaagcuggcggaggccaucuucaagcucaccuaccagaacaaggucgugcggguccagcgccccacgccccgggggacggugauggacaucaucucccgcaaggaccagcggggcagcggccagguggggaccuacggccugaacaccuucaccaacauggaggcccagcugauccgccagauggagggggagggcaucuucaaguccauccaguaccucacggucaccgaggagguggccgugcagaacuggcuggcccgggucggccgcgagcgccugagccggauggcgaucuccggggacgacugcguggugaagccccucgacgaccgcuucgccagcgcccugaccgcccugaacgacaugggcaagguccggaaggacauccagcagugggagccgucccgcggguggaacgacuggacccaggugcccuucugcagccaccacuuccacgagcucaucaugaaggacggccgggugcuggucgugcccugccgcaaccaggacgagcugaucgggcgggcccgcaucucccagggcgcgggcuggagccucaaggagacggccugccuggggaaguccuacgcccagauguggagccugauguacuuccaccggcgcgaccuccggcuggccgccaacgcgaucugcuccgccgugcccagccacugggucccgaccucccgcaccaccuggagcauccacgccaagcacgaguggaugaccacggaggacaugcugaccguguggaaccggguguggauccaggagaaccccuggauggaggacaagacccccgucgagagcugggaggaggugcccuaccucggcaagcgcgaggaccaguggugcgggucccugaucggccugaccagccgggccacgugggcgaagaacauccagaccgccaucaaccaggugcgcucccucaucgggaacgaggaguacaccgacuacaugccgagcaugaagcgguuccgccgggaggaggaggaggccggcguccugugguga

SEQ ID NO: 9162 - RNA, 9876 nt, Artificial Sequence
  derived and/or modified CDS sequence (opt1) from DENV-2__GQ868620__SS-prME
agcgccggcaugaucaucaugcugauccccaccgugauggccuuccaccucaccacccgcaacggggagccccacaugaucgugggcauccaggagaaggggaagucccugcuguucaagaccgaggacggcgugaacaugugcacccucauggcgauggaccugggggagcugugcgaggacaccaucaccuacaagugcccccuccugcggcagaacgagcccgaggacaucgacugcuggugcaacagcaccuccaccugggugaccuacgggaccugcaccaccaccggcgagcaccgccgggagaagcgcagcgucgcccuggugccccacguggggaugggccucgagacccggaccgagaccuggauguccagcgagggggccuggaagcacgcccagcgcaucgagaccuggauccugcggcacccgggcuucacgaucauggccgcgauccuggccuacaccaucgggaccacccacuuccagcgcgcccucaucuucauccugcugacggccgucgcgcccuccaugaccaugcggugcaucggcaucagcaaccgcgacuucguggagggcguguccgggggcagcugggucgacaucgugcucgagcacggguccugcgugaccaccauggccaagaacaagcccacgcuggacuucgagcugaucaagaccgaggccaagcagcccgccacccuccggaaguacugcaucgaggccaagcugaccaacacgaccaccgagagccgcugccccacccagggcgagcccucccugaaggaggagcaggacaagcgguucgucugcaagcacagcaugguggaccgcggcugggggaacggcugcgggcuguucggcaagggcgggaucgugacgugcgcgauguucacgugcaagaagaacauggagggcaagaucguccagcccgagaaccuggaguacaccaucguggugacgccccacuccggggaggagcacgccgucggcaacgacacggggaagcacggcaaggagaucaaggugaccccgcagagcuccaucaccgaggccgagcugaccggguacggcaccgugacgauggagugcagcccccggaccggccucgacuucaacgagaugguccugcugcagauggagaacaaggccuggcucgugcaccgccagugguuccuggaccugccccuccccuggcugccgggggccgacaagcagggcuccaacuggauccagaaggagacccuggugaccuucaagaacccccacgcgaagaagcaggacgucgugguccucgggagccaggagggcgccaugcacacggcccugaccggggccaccgagauccagaugagcuccggcaaccuccuguucaccggccaccugaagugccggcugcgcauggacaagcuccagcugaaggggaugagcuacuccaugugcacgggcaaguucaagguggugaaggagaucgccgagacccagcacgggaccaucgucauccgggugcaguacgagggcgacggcagccccugcaagauccccuucgagaucauggaccuggagaagcgcuacgugcucgggcggcugaucaccgucaacccgaucgugacggagaaggacucccccgugaacaucgaggcggagccgcccuucggcgacagcuacaucaucaucggggucgagccgggccagcugaagcucaacugguucaagaagggguccagcaucggccagauguucgagaccaccaugcgcggcgccaagcgcauggccauccugggggacaccgccugggacuucggcucccucggcgggguguucacgagcaucgggaaggcccuccaccagguguucggcgcgaucuacggcgccgccuucuccggggucagcuggaccaugaagauccugaucggcgugaucaucaccuggaucgggaugaacucccggagcaccucccugagcgugucccugguccucgugggcaucgugacgcuguaccugggggucauggugcaggccgacagcggcugcguggucuccuggaagaacaaggagcucaagugcggcagcgggaucuucaucaccgacaacgugcacaccuggaccgagcaguacaaguuccagcccgagagccccuccaagcuggcgagcgccauccagaaggcccaggaggagggcaucugcgggauccgcuccgugacgcggcuggagaaccucauguggaagcagaucacccccgagcugaaccacauccuggccgagaacgaggucaagcucaccaucaugaccggcgacaucaaggggaucaugcaggccggcaagcgcagccugcggccgcagcccacggagcugaaguacuccuggaagaccuggggcaaggcgaagaugcucagcaccgagucccacaaccagaccuuccugaucgacgggcccgagacggccgagugcccgaacaccaaccgcgccuggaacagccuggagguggaggacuacggcuucgggguguucaccaccaacaucuggcucaagcugaaggagaagcaggacgccuucugcgacuccaagcugaugagcgccgcgaucaaggacaaccgggccguccacgccgacaugggcuacuggaucgaguccgcccucaacgacacguggaagaucgagaaggccagcuucaucgaggugaagaacugccacuggcccaagucccacacccuguggagcaacggcgugcuggaguccgagaugaucauccccaagaaccucgcggggcccgucagccagcacaacuaccgcccgggcuaccacacccagaucgccgggcccuggcaccugggcaagcuggagauggacuucgacuucugcgacgggaccaccgugaucgugacggaggacugcggcaaccggggccccucccuccgcaccaccaccgccagcgggaagcugaucacggaguggugcugccggagcugcacccugcccccgcuccgcuaccggggcgaggacgggugcugguacggcauggagauccgcccccugaaggagaaggaggagaaccuggucaacucccucgugaccgccgggcacggccagguggacaacuucagccugggcguccuggggauggcccuguuccuggaggagaugcugcggacccgcgugggcacgaagcacgccauccuccugguggccgucuccuucgugacccugaucaccgggaacaugagcuucaaggaccucggccggguggucgugauggugggggccaccaugacggacgacaucggcaugggcgucaccuaccuggcccugcucgcggccuucaaggugcgccccaccuucgccgccgggcugcugcuccggaagcugaccuccaaggagcugaugaugacgaccaucggcaucgugcuccugagccaguccaccauccccgagaccauccuggagcucacggacgcccuggcgcuggggaugaugguccucaagaucgugcgcaacauggagaaguaccagcuggccgugaccaucauggccauccugugcgucccgaacgccgugauccuccagaacgccuggaaggucagcugcaccauccuggcggugguguccgucagcccccugcuccugaccuccagccagcagaagacggacuggaucccccuggcccucaccaucaagggccugaaccccaccgccaucuuccugaccacgcucucccgcaccaacaagaagcggagcuggccgcugaacgaggccaucauggcggugggcaugguguccauccuggccagcucccuccugaagaacgacauccccaugaccgggccccuggucgccggcgggcuccugaccgugugcuacgugcugacgggccgcagcgccgaccucgagcuggagcgggccaccgacgucaagugggaggaccaggcggagaucuccgggagcagccccauccuguccaucaccaucagcgaggacggcuccaugagcaucaagaacgaggaggaggagcagacccucacgauccugauccgcaccggccugcucgugaucuccgggcuguucccggugagcauccccaucaccgccgccgccugguaccugugggaggucaagaagcagcgggccggcgugcucugggacgugcccagcccgccgcccauggggaaggcggagcuggaggacggcgccuaccgcaucaagcagaaggggauccugggcuacagccagaucggcgccggggucuacaaggagggcaccuuccacaccauguggcacgugacgcgcggggcggugcucaugcacaagggcaagcgcaucgagcccuccugggccgacgucaagaaggaccugaucagcuacgggggcggcuggaagcuggagggggaguggaaggagggcgaggagguccaggugcucgcgcuggagcccgggaagaacccccgggucgugcagaccaagcccggccuguucaagaccaacaccgggacgaucggcgccgugucccucgacuucagccccggcaccuccgggagccccaucaucgacaagaagggcaaggucguggggcuguacggcaacggcguggucacccgcuccggggccuacgugagcgccaucgcccagaccgagaaguccaucgaggacaaccccgagaucgaggacgacaucuuccggaagcgccggcugacgaucauggaccugcaccccggcgcggggaagaccaagcgcuaccuccccgccaucgugcgggaggccaucaagcgcggccugcggacccugauccucgccccgacccgcgucguggcggccgagauggaggaggcccugcgggggcugcccauccgcuaccagacgcccgccauccgggccgagcacaccggccgcgagaucguggaccucaugugccacgcgaccuucaccaugcgccugcugagccccguccgggugccgaacuacaaccucaucaucauggacgaggcccacuucacggaccccgccuccaucgccgcccgcggcuacaucagcacccggguggagaugggggaggcggccggcaucuucaugaccgccacgccgcccgggagccgcgacccguucccccaguccaacgcccccaucaucgacgaggagcgggagauccccgagcgcagcuggaacuccggccacgagugggucacggacuucaaggggaagaccgugugguucgugccgagcaucaaggccggcaacgacaucgcggccugccugcggaagaacggcaagaaggucauccagcugucccgcaagaccuucgacagcgaguacgugaagacccggacgaacgacugggacuucguggucaccaccgacaucuccgagaugggggccaacuucaaggccgagcgcgugaucgacccccggcgcugcaugaagcccgugauccucaccgacggcgaggagcgggucauccuggcggggcccaugccggugacgcacagcuccgccgcccagcgccggggccgcaucgggcggaaccccaagaacgagaacgaccaguacaucuacaugggcgagccccuggagaacgacgaggacugcgcccacuggaaggaggccaagaugcuccuggacaacaucaacacccccgagggcaucaucccgagcauguucgagcccgagcgcgagaagguggacgcgaucgacggggaguaccggcugcgcggcgaggcccgcaagaccuucgucgaccucaugcggcgcggggaccugcccguguggcuggccuacaagguggccgccgagggcaucaacuacgcggaccggcgcuggugcuucgacgggaucaagaacaaccagauccucgaggagaacgucgagguggagaucuggaccaaggagggcgagcggaagaagcugaagccgcgcuggcuggacgcccggaucuacuccgacccccucgcccugaaggaguucaaggaguucgccgccggccgcaagagccugacgcucaaccugaucaccgagauggggcggcugcccaccuucaugacccagaagacgcgcgacgcgcucgacaaccuggccguccugcacaccgccgaggccggcgggcgggcguacaaccacgcccucuccgagcugcccgagacccuggagacccuccugcugcucacgcugcuggccaccgugaccggcggcaucuuccucuuccugaugagcgggcgcggcaucgggaagaugacccugggcaugugcugcaucaucaccgccuccauccuccugugguacgcccagauccagccgcacuggaucgcggccagcaucauccuggaguucuuccucaucgugcugcugauccccgagcccgagaagcagcggacgccccaggacaaccagcucaccuacgucgugaucgccauccugaccguggucgccgccaccauggcgaacgagaugggguuccuggagaagacgaagaaggaccucggccugggcuccaucgccacccagcagccggagagcaacauccuggacaucgaccuccgccccgccuccgccuggacccuguacgccguggcgaccacguucgugacccccaugcugcggcacagcaucgagaacagcuccgucaacgugagccucaccgccaucgccaaccaggccaccgugcugauggggcugggcaagggguggccccucuccaagauggacaucggcgucccgcugcuggccaucgggugcuacagccaggugaaccccaucacgcucaccgcggcccugcugcuccugaucgcccacuacgccaucaucggccccggccugcaggcgaaggccacccgcgaggcccagaagcgggccgccgcggggaucaugaagaaccccaccguggacggcaucacggucaucgaccucgacccgauccccuacgaccccaaguucgagaagcagcugggccaggugaugcugcucauccugugcgugacccagguccugaugaugcgcaccaccugggcccucugcgaggcccugacgcuggccaccggccccaucuccacccucugggaggggaacccgggccgguucuggaacaccacgaucgccgugagcauggcgaacaucuuccgcggcuccuaccuggccggggccggccuccucuucagcaucaugaagaacgccaacaacacccggcgcgggaccggcaacaucggcgagacccugggggagaaguggaagucccgccugaacgcccucggcaagagcgaguuccagaucuacaagaaguccgggauccaggagguggaccggacgcuggcgaaggagggcaucaagcgcggggagaccgaccaccacgccgucagccggggcuccgccaagcugcgcugguucguggagcggaacauggugacccccgagggcaaggucguggaccucgggugcggccgcgggggcuggagcuacuacugcgggggccugaagaacgugcgggaggucaagggccugaccaagggcgggcccgggcacgaggagcccaucccgauguccacguacggcuggaaccucgugcgccugcagagcgggguggacgucuucuucaucccgcccgagaagugcgacacccugcucugcgacaucggcgaguccagccccaacccgaccguggaggccggccggacccugcgcgugcugaaccucgucgagaacuggcugaacaacgacacgcaguucugcaucaaggugcugaaccccuacaugcccuccgugaucgagaagauggaggcgcugcagcggaaguacgggggcgcccucguccgcaacccgcugagccggaacagcacccacgagauguacuggguguccaacgccagcgggaacaucguguccagcgucaacaugaucucccgcaugcugaucaaccgguucaccaugcgccacaagaaggccaccuacgagcccgacguggaccucggcagcgggacccggaacaucggcaucgaguccgagauccccaaccuggacaucaucggcaagcgcaucgagaagaucaagcaggagcacgagacgagcugguacuacgaccaggaccaccccuacaagaccugggccuaccacggguccuacgagaccaagcagaccggcagcgcguccagcauggugaacggggucgugcggcugcucacgaagccgugggacgugcugcccaccgucacccagauggccaugaccgacacgacccccuucggccagcagcgcguguucaaggagaagguggacacccgcacccaggagcccaaggagggcacgaagaagcugaugaagaucaccgccgaguggcucuggaaggagcuggggaagaagaagaccccgcggaugugcacccgcgaggaguucauccggaagguccgcuccaacgccgcccugggcgcgaucuucacggacgagaacaaguggaaguccgcccgggaggccguggaggacucccgcuucugggagcucguggacaaggagcggaaccugcaccuggaggggaagugcgagaccugcgucuacaacaugaugggcaagcgcgagaagaagcucggggaguucggcaaggccaagggcagccgggccaucugguacauguggcugggggcgcgcuuccuggaguucgaggcccucggcuuccugaacgaggaccacugguucucccgggagaacagccuguccgggguggagggcgaggggcuccacaagcugggcuacauccugcgcgacgucagcaagaaggagggcggggccauguacgccgacgacaccgcgggcugggacacccggaucacgcucgaggaccugaagaacgaggagauggugaccaaccacauggagggggagcacaagaagcuggccgaggccaucuucaagcucaccuaccagaacaaggugguccgcgugcagcggcccacgccccggggcacggugauggacaucaucagccggcgcgaccagcggggguccggccaggucggcaccuacgggcugaacaccuucaccaacauggaggcccagcugauccgccagauggagggcgaggggguguucgagaacauccagcaccucacggugaccgaggaggucgccgugcagaacuggcuggcgcgggugggccgcgagcgccugagccggauggccaucuccggcgacgacugcgucgugaagccccucgacgaccgcuucgccaacgcccugaccgcccugaacgacauggggaagauccggaaggacauccagcagugggagccgagcaagggcuggaacgacuggacccaggugcccuucugcucccaccacuuccacgagcucaucaugaaggacgggcgcguccugguggugcccugccggaaccaggacgagcugaucggccgcgcgcggaucagccagggggccggcuggucccuccgcgagacggccugccugggcaagagcuacgcccagauguggucccugauguacuuccaccggcgcgaccuccggcuggccgcgaacgccaucugcagcgccguccccucccacugggugccgaccagccgcaccaccugguccauccacgccaagcacgaguggaugacgaccgaggacaugcugaccguguggaaccgggucuggauccgcgagaaccccuggauggaggacaagacccccguggagagcugggaggagauccccuaccucgggaagcgggaggaccaguggugcggcucccugaucgggcugaccagccgcgccacgugggcgaagaacauccaggccgccaucaaccaggugcggucccucaucggcaacgaggaguacaccgacuacaugccgagcaugaagcgcuuccggcgcgaggaggaggaggccgggguccugugguga

SEQ ID NO: 9163 - RNA, 9876 nt, Artificial Sequence
  derived and/or modified CDS sequence (opt1) from DENV-2__FJ639702__SS-prME
accgccggcgugaucaucaugcugauccccaccgccauggcguuccaccucaccacccggaacggggagccccacaugaucgucggccggcaggagaagggcaagagccugcuguucaagaccgaggacggcgugaacaugugcacccucauggccaucgaccugggggagcugugcgaggacacgaucaccuacaagugcccccuccugcggcagaacgagcccgaggacaucgacugcuggugcaacagcaccagcaccugggugacguacgggaccugcaccaccacgggcgagcaccggcgcgagaagcgguccgucgcccuggugccccacguggggaugggccucgagacccgcaccgagaccuggaugagcagcgagggggccuggaagcacguccagcggaucgagacguggauccugcggcaccccggcuucaccaucauggccgcgauccuggccuacaccaucgggaccacgcacuuccagcgggcccucaucuucauccugcugaccgccguggcgcccagcaugaccaugcgcugcaucggcaucuccaaccgggacuucguggagggcgucagcgggggcuccuggguggacaucgugcucgagcacgggagcugcgucaccacgauggccaagaacaagcccacccuggacuucgagcugaucaagaccgaggccaaggagcccgccacccuccgcaaguacugcaucgaggccaagcugacgaacaccaccaccgagucccggugcccgacgcagggcgagcccagccugaacgaggagcaggacaagcgcuucgugugcaagcacuccaugguggaccggggcugggggaacggcugcgggcuguucggcaagggcgggaucgugaccugcgcgauguucacgugcaagaagaacauggagggcaagaucgugcagcccgagaaccuggaguacaccaucgugaucacgccccacagcggggaggagcacgccgucggcaacgacaccgggaagcacggcaaggagaucaagaucaccccgcaguccagcuccaccgaggccgagcugaccggguacggcacggugaccauggagugcagcccccgcaccggccucgacuucaacgagauggugcugcugcagauggaggacaaggccuggcucguccaccggcagugguuccuggaccugccccuccccuggcugccgggggccgacacccagggcuccaacuggauccagaaggagacgcuggugaccuucaagaacccccacgcgaagaagcaggacguggucgugcucgggagccaggagggcgccaugcacaccgcccugaccggggccacggagauccagaugagcuccggcaaccuccuguucaccggccaccugaagugccgccugcggauggacaagcuccagcugaaggggaugagcuacuccaugugcaccggcaaguucaagaucgucaaggagaucgccgagacccagcacgggacgaucgugauccgcgugcaguacgagggcgacggcagccccugcaagauccccuucgagaucauggaccuggagaagcggcacguccucgggcgccugaucaccgugaacccgaucgugaccgagaaggacucccccgucaacaucgaggcggagccgcccuucggcgacagcuacaucaucaucgggguggagccgggccagcugaagcucaacugguucaagaagggguccagcaucggccagauguucgagaccacgaugcgcggcgccaagcggauggccauccugggggacaccgccugggacuucggcucccucggcgggguguucaccagcauggggaaggcccuccaccaggucuucggggcgaucuacggcgccgccuucuccggggugagcuggaccaugaagauccugaucggcgugaucaucacguggaucgggaugaacucccgcagcaccucccugagcgucucccuggugcucgugggcgucaucacccuguaccugggggccauggugcaggcggacagcggcugcguggucuccuggaagaacaaggagcucaagugcggcagcgggaucuucaucaccgacaacgugcacacguggaccgagcaguacaaguuccagcccgagagccccuccaagcuggccagcgccauccagaaggcccacgaggagggcaucugcgggauccgguccgugacccgccuggagaaccucauguggaagcagaucacccccgagcugaaccacauccugagcgagaacgaggucaagcucacgaucaugaccggcgacaucaaggggaucaugcaggccggcaagcggucccugcgcccgcagcccaccgagcugaaguacagcuggaagaccuggggcaaggcgaagaugcucuccacggagagccacaaccagaccuuccugaucgacgggcccgagaccgccgagugcccgaacaccaaccgggccuggaacucccuggagguggaggacuacggcuucgggguguucacgaccaacaucuggcucaagcugcgcgagaagcaggacgucuucugcgacagcaagcugauguccgccgccaucaaggacaaccgggcggugcacgccgacaugggcuacuggaucgagagcgcccucaacgacaccuggaagauggagaaggccuccuucaucgaggucaagagcugccacuggcccaagucccacacccuguggagcaacggcgugcuggaguccgagaugaucauccccaagagcuucgccgggcccgugagccagcacaacuaccgcccgggcuacuacacccagacggcggggcccuggcaccucggcaagcuggagauggacuucgacuucugcgaggggaccaccguggucgugaccgaggacugcggcaaccggggccccucccugcgcacgaccaccgccagcgggaagcucaucaccgaguggugcugccgguccugcacgcugcccccgcugcgcuaccggggcgaggacgggugcugguacggcauggagauccgcccccucaaggagaaggaggagaaccuggugaacagccuggucaccgccgggcacggccagaucgacaacuucucccucggcgugcuggggauggcccuguuccucgaggagaugcugcggacccgcgugggcaccaagcacgcgauccugcucgucgccgugagccuggugacgcugaucaccgggaacauguccuuccgggaccucggccgcgucauggugauggugggggccaccaugaccgacgacaucggcaugggcgucacguaccuggcccugcucgccgcguucaaggugcgccccaccuucgccgccgggcugcugcuccggaagcugaccagcaaggagcugaugauggccaccaucggcaucgcccuccugucccagagcacgauccccgagaccauccuggagcucaccgacgcgcuggcccuggggaugauggugcucaagaucguccgcaacauggagaaguaccagcuggccgugaccaucauggccaucuccugcgugccgaacgccgucauccugcagaacgcguggaaggugagcugcacgauccucgccgccguguccgucagcccccugcugcucaccuccagccagcagaaggccgacuggaucccccuggcgcugaccaucaagggccucaaccccaccgccaucuuccugacgacccugucccggaccagcaagaagcgcuccuggccgcucaacgaggccaucauggccgugggcauggucagcauccuggccagcucccugcucaagaacgacauccccaugaccgggccccugguggcgggcgggcugcucacggugugcuacguccugaccggccggagcgccgaccuggagcucgagcgcgccaccgacgugaagugggaggaccaggccgagaucuccgggagcucccccauccugagcaucaccaucuccgaggacggcagcauguccaucaagaacgaggaggaggagcagacgcugaccauccucauccggaccggccugcuggugaucagcggccucuucccggucuccauccccaucaccgccgcggccugguaccugugggaggugaagaagcagcgcgccggcgugcugugggacguccccagcccgccgcccguggggaaggccgagcucgaggacggcgccuaccggaucaagcagaaggggauccugggcuacucccagaucggcgcggggguguacaaggagggcaccuuccacacgauguggcacgucacccgcggggccgugcugaugcaccggggcaagcgcaucgagcccagcugggccgacgugaagaaggaccucaucuccuacgggggcggcuggaagcuggagggggaguggaaggagggcgaggagguccaggugcuggcccucgagcccgggaagaacccccgggccgugcagaccaagcccggccuguucaagaccaacacggggaccaucggcgcggucagccuggacuucucccccggcaccagcgggucccccaucguggaccgcaagggcaagguggucgggcucuacggcaacggcguggugacccggagcggggccuacgucagcgccaucgcccagacggagaaguccaucgaggacaaccccgagaucgaggacgacaucuuccgcaagaagcggcugaccaucauggaccugcaccccggcgcggggaagaccaagcgcuaccugcccgccaucgugcgggaggccaucaagcgcggccuccggacccugauccuggccccgacgcgcguggucgccgcggagauggaggaggcccuccgcgggcugcccauccgguaccagacccccgccauccgcgccgagcacaccggccgggagaucguggaccugaugugccacgccaccuucacgaugcgccuccugagccccgugcgggucccgaacuacaaccugaucaucauggacgaggcgcacuucaccgaccccgccuccaucgccgcccgcggcuacaucagcacccggguggagaugggggaggccgcgggcaucuucaugaccgccacgccgcccggguccaaggacccguucccccagagcaacgcccccaucauggacgaggagcgcgagauccccgagcgguccuggaacagcggccacgagugggugaccgacuucaaggggaagaccgucugguucgugccguccaucaaggccggcaacgacaucgcggccugccuccgcaagaacggcaagaaggugauccagcugagccggaagaccuucgacuccgaguacgucaagacgcgcaccaacgacugggacuucguggugaccaccgacaucagcgagaugggggccaacuucaaggccgagcgggucaucgacccccgccggugcaugaagcccgugauccugacggacggcgaggagcgcgugauccucgccgggcccaugccggucacccacuccagcgcggcccagcggcgcggccggaucgggcgcaaccccaagaacgagaacgaccaguacaucuacaugggcgagccccuggagaacgacgaggacugcgcccacuggaaggaggccaagaugcugcucgacaacaucaacacccccgagggcaucaucccguccauguucgagcccgagcgcgagaagguggacgccaucgacggggaguaccggcugcgcggcgaggcgcggaagaccuucguggaccugaugcgccgcggggaccuccccgucuggcuggccuaccgcguggccgccgagggcaucaacuacgccgaccggcgcuggugcuucgacggggugaagaacaaccagauccuggaggagaacgucgagguggagaucuggacgaaggagggcgagcggaagaagcucaagccgcgcuggcuggacgcgcggaucuacagcgacccccuggcccucaaggaguucaaggaguucgccgccggccgcaagucccugacccugaaccucaucaccgagauggggcggcugcccaccuucaugacgcagaaggcgcgcgacgcccuggacaaccucgccgugcugcacaccgccgaggccggcgggcgggcguacaaccacgcccugagcgagcuccccgagacccuggagacccugcuccugcugacgcuccuggccaccgucaccggcggcguguuccuguuccucauguccgggaagggcgucgggaagaugacccugggcaugugcugcaucaucaccgccagcauccugcucugguacgcccagauccagccgcacuggaucgcggccagcaucauccuggaguucuuccugaucgugcuccugauccccgagcccgagaagcagcgcacgccccaggacaaccagcugaccuacguggucaucgccauccucaccgugguggccgccaccauggcgaacgagaugggguuccuggagaagacgaagaaggaccugggccucggcuccaucgccacccaggagccggagagcaacauccuggacaucgaccugcggcccgccuccgccuggacccucuacgccgucgcgaccacguucgugacccccaugcugcgccacagcaucgagaacuccagcgugaacgucucccugaccgccaucgccaaccaggccaccgugcucauggggcugggcaagggguggccccugagcaagauggacaucggcgugccgcuccuggcgaucgggugcuacucccaggucaaccccgugacgcugaccgccgcccuccugcugcucguggcccacuacgccaucaucggccccggccugcaggcgaaggccacccgggaggcccagaagcgcgccgccgcggggaucaugaagaaccccaccgucgacggcaucacggugaucgaccuggacccgauccccuacgaccccaaguucgagaagcagcucgggcaggucaugcugcugauccucugcgucacccaggugcugaugaugcggaccaccugggcccugugcgaggcccucacgcuggccaccggccccaucagcacccugugggaggggaacccgggccgcuucuggaacaccacgaucgccguguccauggcgaacaucuuccgcggcagcuaccucgccggggccggccugcuguucuccaucaugaagaacaccaccaacacccggcgcgggacgggcaacaucggcgagacccucggggagaaguggaagucccggcugaacgcccugggcaaguccgaguuccagaucuacaagaaguccgggauccaggaggucgaccgcacccucgcgaaggagggcaucaagcgcggggagaccgaccaccacgccgugucccgcggcagcgccaagcugcggugguucguggagcgcaacauggucacgcccgagggcaaggugguggaccuggggugcggccgcggcgggugguccuacuacugcggcgggcucaagaacgucaaggaggugaaggggcugaccaagggcgggcccgggcacgaggagcccaucccgaugagcaccuacggcuggaaccuggugcgccuccagagcggggucgacguguucuucacgccgcccgagaagugcgacacgcugcugugcgacaucggcgaguccagccccaacccgaccaucgaggccggccggacccuccgcgugcugucccuggucgagaacuggcucaacaacgacacccaguucugcaucaaggugcugaaccccuacaugcccagcgugaucgagaagauggagacccugcagcggaaguacgggggcgcccugguccgcaacccgcucucccggaacagcacgcacgagauguacuggguguccaacgcgaccgggaacaucgugagcuccgucaacaugaucagccgcaugcugaucaaccgguucaccaugaagcacaagaaggccaccuacgagcccgacguggaccugggcuccgggacgcgcaacaucggcaucgagagcgagauccccaaccucgacaucaucggcaagcggaucgagaagaucaagcaggagcacgagaccuccuggcacuacgaccaggaccaccccuacaagaccugggccuaccacgggagcuacgagaccaagcagacgggcuccgccagcuccauggugaacggggucgugcgccugcugaccaagccgugggacgugguccccauggugacccagauggccaugaccgacacgacccccuucggccagcagcgcguguucaaggagaaggucgacacccggacccaggagcccaaggagggcacgaagaagcucaugaagaucaccgcggaguggcuguggaaggagcuggggaagaagaagaccccgcgcaugugcacccgggaggaguucacgcgcaaggugcggagcaacgccgcccucggcgccaucuucaccgacgagaacaaguggaaguccgcccgcgaggcgguggaggacagccgguucugggagcuggucgacaaggagcgcaaccugcaccucgaggggaagugcgagaccugcguguacaacaugaugggcaagcgggagaagaagcugggggaguucggcaaggccaagggcagccgcgccaucugguacauguggcugggggcccgguuccucgaguucgaggcgcugggcuuccugaacgaggaccacugguucucccgcgagaacagccucuccggggucgagggcgaggggcugcacaagcugggcuacauccuccgggacgugggcaagaaggagggcggggccauguacgccgacgacaccgccgggugggacacgcgcaucacccuggaggaccugaagaacgaggagauggugaccaaccacauggagggcgagcacaagaagcucgccgaggcgaucuucaagcugaccuaccagaacaaggucgugcgggugcagcgccccacgccccgggggaccgucauggacaucaucagccgccgggaccagcgcggcuccggccagguggggaccuacggccugaacaccuucacgaacauggaggcccagcucauccggcagauggagggggagggcaucuucaagagcauccagcaccugaccgccaccgaggagaucgccgugcagaacuggcuggcccgcgucggccgcgagcggcucucccgcauggcgaucagcggggacgacugcguggugaagccccuggacgaccgguucgccuccgcccugaccgcccucaacgacaugggcaagguccgcaaggacauccagcagugggagccgagccggggguggaacgacuggacccaggugcccuucugcucccaccacuuccacgagcugaucaugaaggacggccgcgugcuggucgugcccugccggaaccaggacgagcucaucgggcgcgcccggaucagccagggcgcgggcuggucccugaaggagaccgccugccugggcaagagcuacgcccagauguggucccucauguacuuccaccgccgggaccugcgccuggccgccaacgcgaucugcagcgccgugcccucccacugggucccgaccagccggaccaccuggagcauccacgccaagcacgaguggaugacgaccgaggacaugcucaccguguggaaccgcguguggauccaggagaaccccuggauggaggacaagacccccgucgaguccugggaggaggugcccuaccugggcaagcgggaggaccaguggugcgggagccugaucggccucacgucccgcgccaccugggcgaagaacauccagaccgccaucaaccaggugcggagccugaucgggaacgaggaguacaccgacuacaugccguccaugaagcgcuuccggcgcgaggaggaggaggccggcguccugugguga

SEQ ID NO: 9164 - RNA, 9876 nt, Artificial Sequence
  derived and/or modified CDS sequence (opt1) from DENV-2__GQ868621__SS-prME
agcgcggggaugaucaucaugcugauccccaccgugauggccuuccaccucaccacccgcaacggggagccccacaugaucgucggcauccaggagaaggggaagucccugcuguucaagaccgaggacggcgugaacaugugcacccucauggcgauggaccugggggagcugugcgaggacaccaucaccuacaagugcccccuccugcggcagaacgagcccgaggacaucgacugcuggugcaacagcaccagcaccugggugaccuacgggaccugcaccaccaccggcgagcaccgccgggagaagcgcagcgucgcccuggugccccacguggggaugggccucgagacccggaccgagaccuggauguccagcgagggggccuggaagcacgcccagcgcaucgagaccuggauccugcggcacccgggcuucacgaucauggccgcgauccuggccuacaccaucgggaccacccacuuccagcgcguccucaucuucauccugcugacggccguggcccccuccaugaccaugcggugcaucggcaucagcaaccgcgacuucguggagggcgucuccgggggcagcuggguggacaucgugcucgagcacggguccugcgucaccaccauggcgaagaacaagcccacgcuggacuucgagcugaucaagaccgaggccaagcagcccgccacccuccggaaguacugcaucgaggccaagcugaccaacacgaccaccgagagccgcugccccacccagggcgagcccucccugaaggaggagcaggacaagcgguucgugugcaagcacagcaugguggaccgcggcugggggaacggcugcggccuguucggcaagggcgggaucgucacgugcgccauguucacgugcaagaagaacauggagggcaagaucgugcagcccgagaaccuggaguacaccaucguggucacgccccacuccggggaggagcacgcggugggcaacgacacggggaagcacggcaaggagaucaaggugaccccgcagagcuccaucaccgaggccgagcugaccggguacggcaccgucacgauggagugcagcccccggaccggccucgacuucaacgagauggugcugcugcagauggagaacaaggccuggcucgugcaccgccagugguuccuggaccugccccuccccuggcugccgggggccgacaagcaggaguccaacuggauccagaaggagacccuggucaccuucaagaacccccacgccaagaagcaggacguggucgugcucggcagccaggagggggcgaugcacacggcccugaccggcgccaccgagauccagaugagcuccgggaaccuccuguucaccggccaccugaagugccggcugcgcauggacaagcuccagcugaagggcaugagcuacuccaugugcacggggaaguucaagguggucaaggagaucgccgagacccagcacggcaccaucgugauccgggugcaguacgagggggacggcagccccugcaagauccccuucgagaucauggaccuggagaagcgcuacauccucggccggcugaucaccgucaacccgaucgugacggagaaggacucccccgugaacaucgaggccgagccgcccuucggggacagcuacaucaucaucggcgucgagccggggcagcugaagcucaacugguucaagaagggcuccagcaucgggcagauguucgagaccaccaugcgcggcgcgaagcgcauggccauccugggcgacaccgccugggacuucgggucccugggcgggguguucacgagcaucggcaaggcccuccaccagguguucggggccaucuacggcgcggccuucuccggcgucagcuggaccaugaagauccugaucggggugaucaucaccuggaucggcaugaacucccggagcaccucccugagcgugucccugguccucguggggaucgugacgcuguaccugggcgucauggugcaggccgacagcgggugcguggucuccuggaagaacaaggagcucaagugcggcagcggcaucuucaucaccgacaacgugcacaccuggaccgagcaguacaaguuccagcccgagagccccuccaagcuggccagcgcgauccagaaggcccaggaggaggggaucugcggcauccgcuccgugacgcggcuggagaaccucauguggaagcagaucacccccgagcugaaccacauccuggccgagaacgaggucaagcucaccaucaugaccggggacaucaagggcaucaugcaggccgggaagcgcagccugcggccgcagcccacggagcugaaguacuccuggaagaccuggggcaaggccaagaugcucagcaccgaguccuacaaccagaccuuccugaucgacggccccgagacggcggagugcccgaacaccaaccgcgccuggaacagccuggagguggaggacuacggguucggcguguucaccaccaacaucuggcucaagcugaaggagaagcaggacgccuucugcgacuccaagcugaugagcgccgccaucaaggacaaccgggcgguccacgccgacaugggguacuggaucgaguccgcccucaacgacacguggaagaucgagaaggccagcuucaucgaggugaagaacugccacuggcccaagucccacacccuguggagcaacggcgugcuggaguccgagaugaucauccccaagaaccucgccggccccgucagccagcacaacuaccgcccgggguaccacacccagaucgcgggccccuggcaccuggggaagcuggagauggacuucgacuucugcgacggcaccaccgugaucgugacggaggacugcgggaaccggggccccucccuccgcaccaccaccgccagcggcaagcugaucacggaguggugcugccggagcugcacccugcccccgcuccgcuaccgcggggaggacggcugcugguacgggauggagauccgcccccugaaggagaaggaggagaaccuggucaacucccucgugaccgccggccacggccagguggacaacuucagccugggcguccugggcauggcccucuuccuggaggagaugcugcggacccgcguggggacgaagcacgcgauccuccugguggccgucuccuucaugacccugaucaccggcaacaugagcuucaaggaccucgggcgggugguggucauggugggcgccaccauggccgacgacaucgggaugggcgugacguaccuggcccugcucgcggccuucaagguccgccccaccuucgccgccggccugcugcuccggaagcugaccuccaaggagcugaugaugaccacgaucgggaucgugcuccugagccaguccaccauccccgagaccgugcuggagcucaccgacgcccuggcgcugggcaugaugguccucaagaucgugcgcaacauggagaaguaccagcuggccgugacgaucauggccauccugugcgucccgaacgccgugauccuccagaacgccuggaaggucagcugcaccauccuggcggugguguccgucagcccccugcuccugaccuccagccagcagaagaccgacuggaucccccuggcccucacgaucaaggggcugaaccccaccgccaucuuccugaccacccucucccgcacgaacaagaagcggagcuggccgcugaacgaggccaucauggcggugggcaugguguccauccuggccagcucccuccugaagaacgacauccccaugaccggcccccuggucgccgggggccuccugaccgugugcuacgugcugaccgggcgcagcgccgaccucgagcuggagcgggccacggacgucaagugggaggaccaggcggagaucuccggcagcagccccauccuguccaucaccaucagcgaggacggguccaugagcaucaagaacgaggaggaggagcacacccucaccauccugauccgcacgggccugcucgugaucuccggccuguucccgaucagcauccccaucaccgccgccgccugguaccugugggaggugaagaagcagcgggccgggguccucugggacgugcccagcccgccgcccaugggcaaggcggagcuggaggacggggccuaccgcaucaagcagaagggcauccugggguacagccagaucggcgccggcguguacaaggaggggaccuuccacaccauguggcacgucacccggggcgccgugcucaugcacaaggggaagcgcaucgagcccuccugggccgacgugaagaaggaccugaucagcuacggcgggggcuggaagcuggagggcgaguggaaggagggggaggagguccaggugcucgcgcuggagcccggcaagaacccccgggccgugcagacgaagcccgggcuguucaagaccaacaccggcaccaucggggccgucucccucgacuucagccccggcacguccggcagccccaucaucgacaagaaggggaagguggugggccuguacgggaacggcgucgugacccgcuccggcgccuacgugagcgccaucgcgcagaccgagaaguccaucgaggacaaccccgagaucgaggacgacaucuuccggaagcgccggcugaccaucauggaccugcaccccggggccggcaagacgaagcgcuaccuccccgccaucguccgggaggccaucaagcgcgggcugcggacccugauccucgcgccgacccgcgugguggccgccgagauggaggaggcccugcggggccugcccauccgcuaccagacccccgccauccgggcggagcacacggggcgcgagaucgucgaccucaugugccacgccaccuucaccaugcgccugcugagccccgugcgggugccgaacuacaaccucaucaucauggacgaggcccacuucaccgaccccgccuccaucgccgcgcgcggcuacaucagcacgcgggucgagaugggcgaggccgccgggaucuucaugaccgccacgccgcccggcagccgcgacccguucccccaguccaacgcccccaucaucgacgaggagcgggagauccccgagcgcagcuggaacuccgggcacgagugggugaccgacuucaagggcaagacggugugguucgucccgagcaucaaggcggggaacgacaucgccgccugccugcggaagaacggcaagaaggugauccagcugucccgcaagaccuucgacagcgaguacgugaagacccggaccaacgacugggacuucgucgugacgaccgacaucuccgagaugggcgccaacuucaaggcggagcgcgugaucgacccccggcgcugcaugaagcccgucauccucaccgacggggaggagcgggugauccuggccggccccaugccggugacccacagcuccgccgcccagcgccgggggcgcaucggccggaaccccaagaacgagaacgaccaguacaucuacaugggggagccccuggagaacgacgaggacugcgcccacuggaaggaggcgaagaugcuccuggacaacaucaacacgcccgagggcaucaucccgagcauguucgagcccgagcgcgagaaggucgacgccaucgacggcgaguaccggcugcgcggggaggcccgcaagaccuucguggaccucaugcggcgcggcgaccugcccguguggcuggccuacaaggucgccgcggaggggaucaacuacgccgaccggcgcuggugcuucgacggcaucaagaacaaccagauccucgaggagaacguggagguggagaucuggaccaaggagggggagcggaagaagcugaagccgcgcuggcuggacgcccggaucuacuccgacccccucgcccugaaggaguucaaggaguucgccgcgggccgcaagagccugacccucaaccugaucacggagaugggccggcugcccaccuucaugacccagaagacccgcgacgcccucgacaaccuggccguccugcacacggccgaggccggcgggcgggccuacaaccacgcccucuccgagcugcccgagacccuggagacccuccugcugcucacccugcuggccacggugaccgggggcaucuuccucuuccugaugagcggccgcgggaucggcaagaugacccuggggaugugcugcaucaucaccgccuccauccuccugugguacgcgcagauccagccgcacuggaucgccgccagcaucauccuggaguucuuccucaucguccugcugauccccgagcccgagaagcagcggacgccccaggacaaccagcucacguacguggugaucgccauccugaccgucguggccgcgaccauggccaacgagaugggcuuccuggagaagaccaagaaggaccucgggcugggcuccaucgccacgcagcagccggagagcaacauccuggacaucgaccuccgccccgccuccgccuggacccuguacgcgguggccaccaccuucgucacgcccaugcugcggcacagcaucgagaacagcuccgugaacgugagccucaccgccaucgccaaccaggccaccguccugaugggccuggggaagggcuggccccucuccaagauggacaucggggugccgcugcuggcgaucggcugcuacagccaggugaaccccaucacccucacggccgcccugcugcuccuggucgcccacuacgcgaucaucgggcccggccugcaggccaaggccacccgcgaggcccagaagcgggccgcggccggcaucaugaagaaccccaccguggacgggaucaccgugaucgaccucgacccgauccccuacgaccccaaguucgagaagcagcugggccaggucaugcugcucauccugugcgugacccaggugcugaugaugcgcaccaccugggcccucugcgaggcccugacccuggccacggggcccaucuccacccucugggagggcaacccggggcgguucuggaacaccaccaucgcggucagcauggccaacaucuuccgcggcuccuaccuggccggcgccgggcuccucuucagcaucaugaagaacacgaccaacacccggcgcggcaccgggaacaucggcgagacgcugggcgagaaguggaagucccgccugaacgcccucgggaaguccgaguuccagaucuacaagaaguccggcauccaggagguggaccggacccuggcgaaggaggggaucaagcgcggcgagaccgaccaccacgccgugagccggggguccgccaagcugcgcugguucgucgagcggaacauggugacccccgagggcaagguggucgaccucggcugcgggcgcggcggguggagcuacuacugcggcgggcugaagaacgugcgggaggugaagggccugacgaagggcgggcccggccacgaggagcccaucccgauguccaccuacggguggaaccucguccgccugcagagcggcguggacguguucuucaucccgcccgagaagugcgacacccugcucugcgacaucggggaguccagccccaacccgaccgucgaggccggccggacgcugcgcgugcugaaccucguggagaacuggcugaacaacaacacccaguucugcaucaagguccugaaccccuacaugcccuccgugaucgagaagauggaggcgcugcagcggaaguacggcggggcccucgugcgcaacccgcugagccggaacagcacccacgagauguacugggucuccaacgccagcggcaacaucguguccagcgugaacaugaucucccgcaugcugaucaaccgguucaccaugcgccacaagaaggccaccuacgagcccgacgucgaccucgggagcggcacgcggaacaucgggaucgaguccgaggugcccaaccuggacaucaucggcaagcgcaucgagaagaucaagcaggagcacgagaccagcuggcacuacgaccaggaccaccccuacaagaccugggccuaccacggcuccuacgagaccaagcagacggggagcgcguccagcauggugaacggcgucgugcggcugcucaccaagccgugggacgugcugcccaccgucacccagauggccaugacggacaccacccccuucgggcagcagcgcguguucaaggagaagguggacacccgcacgcaggagcccaaggagggcaccaagaagcugaugaagaucaccgccgaguggcucuggaaggagcugggcaagaagaagaccccgcggaugugcacgcgcgaggaguucacccggaagguccgcuccaacgccgcccugggggcgaucuucaccgacgagaacaaguggaaguccgcccgggaggccguggaggacucccgcuucugggagcucguggacaaggagcggaaccugcaccuggagggcaagugcgagaccugcgucuacaacaugauggggaagcgcgagaagaagcucggcgaguucgggaaggccaagggcagccgggccaucugguacauguggcugggcgcgcgcuuccuggaguucgaggcccucggguuccugaacgaggaccacugguucucccgggagaacagccuguccggcguggagggggagggccuccacaagcugggguacauccugcgcgacgucagcaagaaggagggcggcgccauguacgccgacgacacggcggggugggacacccggaucacccucgaggaccugaagaacgaggagauggugaccaaccacauggagggcgagcacaagaagcuggccgaggccaucuucaagcucacguaccagaacaaggugguccgcgugcagcggcccacgccccgggggaccgugauggacaucaucagccggcgcgaccagcggggcuccgggcaggucggcaccuacggccugaacacguucaccaacauggaggcccagcugauccgccagauggagggggagggcguguucaagaacauccagcaccucaccgugaccgaggaggucgccgugcagaacuggcuggcgcggguggggcgcgagcgccugagccggauggccaucuccggcgacgacugcgucgugaagccccucgacgaccgcuucgccaacgcccugacggcccugaacgacaugggcaagauccggaaggacauccagcagugggagccgagcaagggguggaacgacuggacccaggugcccuucugcucccaccacuuccacgagcucaucaugaaggacggccgcguccugguggugcccugccggaaccaggacgagcugaucgggcgcgcgcggaucagccagggcgccggguggucccuccgcgagaccgccugccugggcaagagcuacgcccagauguggucccugauguacuuccaccggcgcgaccuccggcuggccgcgaacgccaucugcagcgccguccccucccacugggugccgaccagccgcacgaccugguccauccacgccaagcacgaguggaugaccaccgaggacaugcugaccguguggaaccgggucuggauccgcgagaaccccuggauggaggacaagacgcccguggagagcugggaggagauccccuaccucggcaagcgggaggaccaguggugcgggucccugaucggccugaccagccgcgccaccugggcgaagaacauccaggccgccaucaaccaggugcggucccucaucgggaacgaggaguacaccgacuacaugccgagcaugaagcgcuuccggcgcgaggaggaggaggccggcguccugugguga

SEQ ID NO: 9165 - RNA, 9876 nt, Artificial Sequence
  derived and/or modified CDS sequence (opt1) from DENV-2__FJ639704__SS-prME
agcgcgggcaugaucaucaugcugauccccaccgugguggccuuccaccucaccacccggaacggggagccccacaugaucgugggcauccaggagaaggggaagucccugcuguucaagaccgaggacggcgugaacaugugcacccucauggcgauggaccugggggagcugugcgaggacaccaucaccuacaagugcccccuccugcggcagaacgagcccgaggacaucgacugcuggugcaacagcaccagcaccugggucaccuacgggaccugcaccaccaccggcgagcaccgccgggagaagcgcagcguggcccuggugccccacgucgggaugggccucgagacccggaccgagaccuggauguccagcgagggggccuggaagcacgcccagcgcaucgagaccuggauccugcggcacccgggcuucacgaucauggccgcgauccuggccuacaccaucgggaccacccacuuccagcgcgcccucaucuucauccugcugacggccguggcgcccuccaugaccaugcggugcaucggcaucagcaaccgcgacuucguggagggcgucuccgggggcagcuggguggacaucgugcucgagcacggguccugcgucaccaccauggccaagaacaagcccacgcuggacuucgagcugaucaagaccgaggccaagcagcccgccacccuccggaaguacugcaucgaggccaagcugaccaacacgaccaccgagagccgcugccccacccagggcgagcccucccugaaggaggagcaggacaagcgguucgugugcaagcacagcaugguggaccgcggcugggggaacggcugcggccuguucggcaagggcgggaucgucacgugcgcgauguucacgugcaagaagaacauggagggcaagaucgugcagcccgagaaccuggaguacaccaucguggucacgccccacuccggggaggagcacgccgugggcaacgacacggggaagcacggcaaggagaucaaggugaccccgcagagcuccaucaccgaggccgagcugaccggguacggcaccgucacgauggagugcagcccccggaccggccucgacuucaacgagauggugcugcugcagauggagaacaaggccuggcucgugcaccgccagugguuccuggaccugccccuccccuggcugccgggggccgacaagcaggaguccaacuggauccagaaggagacccuggucaccuucaagaacccccacgcgaagaagcaggacguggucgugcucggcagccaggagggggccaugcacacggcccugaccggcgccaccgagauccagaugagcuccgggaaccuccuguucaccggccaccugaagugccggcugcgcauggacaagcuccagcugaagggcaugagcuacuccaugugcacggggaaguucaagguggucaaggagaucgccgagacccagcacggcaccaucgugauccgggugcaguacgagggggacggcagccccugcaagauccccuucgagaucauggaccuggagaagcgcuacguccucggccggcugaucaccgugaacccgaucgugacggagaaggacucccccgucaacaucgaggcggagccgcccuucggggacagcuacaucaucaucggcguggagccggggcagcugaagcucaacugguucaagaagggcuccagcaucgggcagauguucgagaccaccaugcgcggcgccaagcgcauggccauccugggcgacaccgccugggacuucgggucccugggcgggguguucacgagcaucggcaaggcccuccaccaggucuucggggcgaucuacggcgccgccuucuccggcgugagcuggaccaugaagauccugaucggggugaucaucaccuggaucggcaugaacucccggagcaccucccugagcgucucccuggugcucguggggaucgucacgcuguaccugggcgugauggugcaggccgacagcgggugcgucguguccuggaagaacaaggagcucaagugcggcagcggcaucuucaucaccgacaacgugcacaccuggaccgagcaguacaaguuccagcccgagagccccuccaagcuggcgagcgccauccagaaggcccaggaggaggggaucugcggcauccgcuccgucacgcggcuggagaaccucauguggaagcagaucacccccgagcugaaccacauccuggccgagaacgaggugaagcucaccaucaugaccggggacaucaagggcaucaugcaggccgggaagcgcagccugcggccgcagcccacggagcugaaguacuccuggaagaccuggggcaagaccaagaugcucagcaccgaguccuacaaccagacguuccugaucgacggccccgagaccaccgagugcccgaacaccaaccgcgcguggaacagccuggagguggaggacuacggguucggcgucuucacgaccaacaucuggcucaagcugaaggagaagcaggacgccuucugcgacuccaagcugaugagcgccgccaucaaggacaaccgggccgugcacgcggacaugggguacuggaucgaguccgcccucaacgacaccuggaagaucgagaaggccagcuucaucgaggugaagaacugccacuggcccaagucccacacccuguggagcaacggcguccuggaguccgagaugaucauccccaagaaccucgccggccccgugagccagcacaacuaccgcccgggguaccacacccagaucgccggccccuggcaccuggggaagcuggagauggacuucgacuucugcgacggcacgaccgugaucgucaccgaggacugcgggaaccggggccccucccuccgcaccacgaccgcgagcggcaagcugaucaccgaguggugcugccggagcugcacccugcccccgcuccgcuaccgcggggaggacggcugcugguacgggauggagauccgcccccugaaggagaaggaggagaaccuggugaacucccucgugacggccggccacgggcaggucgacaacuucagccugggcgugcugggcauggcccucuuccuggaggagaugcugcggacccgcguggggaccaagcacgccauccuccuggucgcgguguccuucgugacccugaucacgggcaacaugagcuucaaggaccucgggcgggucguggugauggucggcgccaccauggccgacgacaucgggaugggcgugaccuaccuggcccugcucgccgcguucaaggugcgccccaccuucgccgccggccugcugcuccggaagcugacguccaaggagcugaugaugaccaccaucgggaucguccuccugagccaguccaccauccccgagacgauccuggagcucaccgacgcccuggcccugggcaugauggugcucaagaucgugcgcaacauggagaaguaccagcuggcggucaccaucauggccauccugugcgugccgaacgccgucauccuccagaacgccuggaaggugagcugcaccauccuggccguggucuccgugagcccccugcuccugacguccagccagcagaaggcggacuggaucccccuggcccucaccaucaaggggcugaaccccaccgccaucuuccugaccacgcucucccgcaccaacaagaagcggagcuggccgcugaacgaggccaucauggcggugggcauggucuccauccuggccagcucccuccugaagaacgacauccccaugaccggcccccugguggccgggggccuccugaccgugugcuacguccugacggggcgcagcgccgaccucgagcuggagcgggccaccgacgugaagugggaggagcaggcggagaucuccggcagcagccccauccuguccaucaccaucagcgaggacggguccaugagcaucaagaacgaggaggaggagcagacccucacgauccugauccgcaccggccugcucgugaucuccggccuguucccgaucagcauccccaucaccgccgccgccugguaccugugggaggucaagaagcagcgggccggggugcucugggacgugcccagcccgccgcccaugggcaaggcggagcuggaggacggggccuaccgcaucaagcagaagggcauccugggguacagccagaucggcgccggcgucuacaaggaggggaccuuccacaccauguggcacgugacgcggggcgccgugcucaugcacaaggggaagcgcaucgagcccuccugggccgacgucaagaaggaccugaucagcuacggcgggggcuggaagcuggagggcgaguggaaggagggggaggagguccaggugcucgcgcuggagcccggcaagaacccccgggccguccagaccaagcccgggcuguucaagaccaacaccggcacgaucggggccgugucccucgacuucagccccggcaccuccggcagccccaucaucgacaagaaggggaagguggucggccuguacgggaacggcguggugacccgcuccggcgccuacgucagcgccaucgcgcagaccgagaaguccaucgaggacaaccccgagaucgaggacgacaucuuccggaagcgccggcugacgaucauggaccugcaccccggggccggcaagaccaagcgcuaccuccccgccaucgugcgggaggccaucaagcgcgggcugcggacccugauccucgcgccgacccgcguggucgccgccgagauggaggaggcccugcggggccugcccauccgcuaccagacgcccgccauccgggcggagcacaccgggcgcgagaucguggaccucaugugccacgccaccuucaccaugcgccugcugagccccgugcgggucccgaacuacaaccucaucaucauggacgaggcccacuucacggaccccgccuccaucgccgcgcgcggcuacaucagcacccggguggagaugggcgaggccgccgggaucuucaugaccgccacgccgcccggcagccgcgacccguucccccaguccaacgcccccaucaucgacgaggagcgggagauccccgagcgcagcuggaacuccgggcacgagugggugacggacuucaagggcaagaccgucugguucgugccgagcaucaaggcggggaacgacaucgccgccugccugcggaagaacggcaagaaggugauccagcugucccgcaagaccuucgacagcgaguacgucaagacccggacgaacgacugggacuucguggugaccaccgacaucuccgagaugggcgccaacuucaaggcggagcgcgucaucgacccccggcgcugcaugaagcccgugauccucaccgacggggaggagcgggugauccuggccggccccaugccggucacgcacagcuccgccgcccagcgccgggggcgcaucggccggaaccccaagaacgagaacgaccaguacaucuacaugggggagccccuggagaacgacgaggacugcgcccacuggaaggaggcgaagaugcuccuggacaacaucaacacccccgagggcaucaucccgagcauguucgagcccgagcgcgagaagguggacgccaucgacggcgaguaccggcugcgcggggaggcccgcaagaccuucguggaccucaugcggcgcggcgaccugcccgucuggcuggccuacaagguggccgcggaggggaucaacuacgccgaccggcgcuggugcuucgacggcaucaagaacaaccagauccucgaggagaacguggaggucgagaucuggaccaaggagggggagcggaagaagcugaagccgcgcuggcuggacgcccggaucuacuccgacccccucgcccugaaggaguucaaggaguucgccgcgggccgcaagagccugacgcucaaccugaucaccgagaugggccggcugcccaccuucaugacccagaagacgcgcgacgcccucgacaaccuggccgugcugcacaccgccgaggccggcgggcgggccuacaaccacgcccucuccgagcugcccgagacccuggagacccuccugcugcucacgcugcuggccaccgucaccgggggcaucuuccucuuccugaugagcggccgcgggaucggcaagaugacccuggggaugugcugcaucaucaccgccuccauccuccugugguacgcgcagauccagccgcacuggaucgccgccagcaucauccuggaguucuuccucaucgugcugcugauccccgagcccgagaagcagcggacgccccaggacaaccagcucaccuacguggucaucgccauccugaccgugguggccgcgaccauggccaacgagaugggcuuccuggagaagacgaagaaggaccucgggcugggcuccaucgccacccagcagccggagagcaacauccuggacaucgaccuccgccccgccuccgccuggacccuguacgcggucgccaccacguucaucacccccaugcugcggcacagcaucgagaacagcuccgugaacaucagccucaccgccaucgccaaccaggccaccgugcugaugggccuggggaagggcuggccccucuccaagauggacaucggggucccgcugcuggcgaucggcugcuacagccaggugaaccccaucacgcucaccgccgcccugcugcuccugguggcccacuacgcgaucaucgggcccggccugcaggccaaggccacccgcgaggcccagaagcgggccgcggccggcaucaugaagaaccccaccgucgacgggaucacggugaucgaccucgacccgauccccuacgaccccaaguucgagaagcagcugggccaggugaugcugcucauccugugcgucacccaggugcugaugaugcgcaccaccugggcccucugcgaggcccugacgcuggccaccgggcccaucuccacccucugggagggcaacccggggcgguucuggaacaccacgaucgcggugagcauggccaacaucuuccgcggcuccuaccuggccggcgccgggcuccucuucagcaucaugaagaacaccaccaacacccggcgcggcacggggaacaucggcgagacccugggcgagaaguggaagucccgccugaacgcccucgggaaguccgaguuccagaucuacaagaaguccggcauccaggaggucgaccggacccuggcgaaggaggggaucaagcgcggcgagaccgaccaccacgccgugagccggggguccgccaagcugcgcugguucguggagcggaacauggucacgcccgagggcaaggugguggaccucggcugcgggcgcggcggguggagcuacuacugcggcgggcugaagaacgucaaggaggugaagggccugaccaagggcgggcccggccacgaggagcccaucccgauguccaccuacggguggaaccucgugcggcugcagagcggcgucgacguguucuucaucccgcccgagaagugcgacacccugcucugcgacaucggggaguccagccccaacccgacgguggaggccggccgcacccugcggguccugaaccucguggagaacuggcugaacaacaacacccaguucugcaucaaggugcugaaccccuacaugcccuccgucaucgagaagauggaggcgcugcagcgcaaguacggcggggcccucgugcggaacccgcugagccgcaacagcacccacgagauguacuggguguccaacgccagcggcaacaucgucuccagcgugaacaugaucucccggaugcugaucaaccgcuucaccaugcggcacaagaaggccacguacgagcccgacguggaccucgggagcggcacccgcaacaucgggaucgaguccgagguccccaaccuggacaucaucggcaagcggaucgagaagaucaagcaggagcacgagaccagcuggcacuacgaccaggaccaccccuacaagaccugggccuaccacggcuccuacgagacgaagcagaccgggagcgcguccagcauggugaacggcgugguccgccugcucaccaagccgugggacgugcugcccaccgugacgcagauggccaugaccgacaccacccccuucgggcagcagcgggucuucaaggagaagguggacacgcgcacccaggagcccaaggagggcaccaagaagcugaugaagaucaccgccgaguggcucuggaaggagcugggcaagaagaagacgccgcgcaugugcacccgggaggaguucacccgcaaggugcgguccaacgccgcccugggggcgaucuucaccgacgagaacaaguggaaguccgcccgcgaggccgucgaggacucccgguucugggagcucguggacaaggagcgcaaccugcaccuggagggcaagugcgagacgugcguguacaacaugauggggaagcgggagaagaagcucggcgaguucgggaaggccaagggcagccgcgccaucugguacauguggcugggcgcgcgguuccuggaguucgaggcccucggguuccugaacgaggaccacugguucucccgcgagaacagccuguccggcgucgagggggagggccuccacaagcugggguacauccugcgggacgugagcaagaaggagggcggcgccauguacgccgacgacaccgcggggugggacacccgcaucacccucgaggaccugaagaacgaggagauggucacgaaccacauggagggcgagcacaagaagcuggccgaggccaucuucaagcucaccuaccagaacaagguggugcggguccagcgccccacgccccgggggaccgugauggacaucaucagccgccgggaccagcgcggcuccggccagguggggacguacggccugaacaccuucaccaacauggaggcccagcugauccggcagauggagggggagggcgucuucaagaacauccagcaccucaccgugacggaggagguggccguccagaacuggcuggcgcgcguggggcgggagcgccugagccgcauggccaucuccggcgacgacugcguggucaagccccucgacgaccgguucgccaacgcccugaccgcccugaacgacaugggcaagauccgcaaggacauccagcagugggagccgagcaagggguggaacgacuggacccaggugcccuucugcucccaccacuuccacgagcucaucaugaaggacggccgggugcuggucgugcccugccgcaaccaggacgagcugaucgggcgggcgcgcaucagccagggcgccggguggucccuccgggagaccgccugccugggcaagagcuacgcccagauguggucccugauguacuuccaccgccgggaccuccgccuggccgcgaacgccaucugcagcgccgugcccucccacugggucccgacgagccggaccaccugguccauccacgccaagcacgaguggaugaccaccgaggacaugcugacgguguggaaccgcguguggauccgggagaaccccuggauggaggacaagacccccgucgagagcugggaggagauccccuaccucggcaagcgcgaggaccaguggugcgggucccugaucggccugaccagccgggccaccugggcgaagaacauccaggccgccaucaaccaggugcgcucccucaucgggaacgaggaguacacggacuacaugccgagcaugaagcgguuccgccgggaggaggaggaggccggcgugcugugguga

SEQ ID NO: 9166 - RNA, 9876 nt, Artificial Sequence
  derived and/or modified CDS sequence (opt1) from DENV-2__GQ868622__SS-prME
agcgcgggcaugaucaucaugcugauccccaccgugauggccuuccaccucaccacccggaacggggagccccacaugaucgugggcauccaggagaagggcaagagccugcuguucaagaccgaggacggcgugaacaugugcacccucauggcgauggaccugggggagcugugcgaggacaccaucaccuacaagugcccccuccugcggcagaacgagcccgaggacaucgacugcuggugcaacagcaccuccaccugggugaccuacgggaccugcaccaccaccggcgagcaccgccgggagaagcggagcgucgcccuggugccccacguggggaugggccucgagacccggaccgagaccuggauguccagcgagggggccuggaagcacgcccagcgcaucgagaccuggauccugcggcacccgggcuucacgaucauggccgcgauccuggccuacaccaucgggaccacccacuuccagcgcgcccucaucuucauccugcugacggccgucgcgcccuccaugaccaugcggugcaucggcaucagcaaccgcgacuucguggagggcguguccgggggcagcugggucgacaucgugcucgagcacggguccugcgugaccaccauggccaagaacaagcccacgcuggacuucgagcugaucaagaccgaggcccggcagcccgccacccuccgcaaguacugcaucgaggccaagcugaccaacacgaccaccgagagccggugccccacccagggcgagcccucccugaaggaggagcaggacaagcgcuucgucugcaagcacagcaugguggaccggggcugggggaacggcugcgggcuguucggcaagggcgggaucgugacgugcgcgauguucacgugcaagaagaacauggagggcaagaucguccagcccgagaaccuggaguacaccaucguggugacgccccacuccggggaggagcacgccgucggcaacgacacggggaagcacggcaaggagaucaaggugaccccgcagagcuccaucaccgaggccgagcugaccggguacggcaccgugacgauggagugcagcccccgcaccggccucgacuucaacgagaugguccugcugcagauggagaacaaggccuggcucgugcaccggcagugguuccuggaccugccccuccccuggcugccgggggccgacaagcagggcuccaacuggauccagaaggagacccuggugaccuucaagaacccccacgcgaagaagcaggacgucgugguccucgggagccaggagggcgccaugcacacggcccugaccggggccaccgagauccagaugagcuccggcaaccuccuguucaccggccaccugaagugccgccugcggauggacaagcuccagcugaaggggaugagcuacuccaugugcacgggcaaguucaagguggugaaggagaucgccgagacccagcacgggaccaucgucauccgcgugcaguacgagggcgacggcagccccugcaagauccccuucgagaucauggaccuggagaagcgguacgugcucgggcgccugaucaccgucaacccgaucgugacggagaaggacucccccgugaacaucgaggcggagccgcccuucggcgacagcuacaucaucaucggggucgagccgggccagcugaagcucaacugguucaagaagggguccagcaucggccagauguucgagaccaccaugcgcggcgccaagcggauggccauccugggggacaccgccugggacuucggcucccucggcgggguguucacgagcaucgggaaggcccuccaccagguguucggggcgaucuacggcgccgccuucuccggggucagcuggaccaugaagauccugaucggcgugaucaucaccuggaucgggaugaacucccgcagcaccucccugagcgugucccugguccucgugggcaucgugacgcuguaccugggggucauggugcaggccgacagcggcugcguggucuccuggaagaacaaggagcucaagugcggcagcgggaucuucaucaccgacaacgugcacaccuggaccgagcaguacaaguuccagcccgagagccccuccaagcuggcgagcgccauccagaaggcccaggaggagggcaucugcgggauccgguccgugacgcgccuggagaaccucauguggaagcagaucacccccgagcugaaccacauccuggccgagaacgaggucaagcucaccaucaugaccggcgacaucaaggggaucaugcaggccggcaagcggagccugcgcccgcagcccacggagcugaaguacuccuggaagaccuggggcaaggcgaagaugcucagcaccgagucccacaaccagaccuuccugaucgacgggcccgagacggccgagugcccgaacaccaaccgggccuggaacagccuggagguggaggacuacggcuucgggguguucaccaccaacaucuggcucaagcugaaggagaagcaggacgccuucugcgacuccaagcugaugagcgccgcgaucaaggacaaccgcgccguccacgccgacaugggcuacuggaucgaguccgcccucaacgacacguggaagaucgagaaggccagcuucaucgaggugaagaacugccacuggcccaagucccacacccuguggagcaacggcgugcuggaguccgagaugaucauccccaagaaccucgcggggcccgucagccagcacaacuaccggccgggcuaccacacccagaucgccgggcccuggcaccugggcaagcuggagauggacuucgacuucugcgacgggaccaccgugaucgugacggaggacugcggcaaccgcggccccucccuccggaccaccaccgccagcgggaagcugaucacggaguggugcugccgcagcugcacccugcccccgcuccgguaccgcggcgaggacgggugcugguacggcauggagauccggccccugaaggagaaggaggagaaccuggucaacucccucgugaccgccgggcacggccagguggacaacuucagccugggcguccuggggauggcccuguuccuggaggagaugcugcgcacccgggugggcacgaagcacgccauccuccugguggccgucuccuucgugacccugaucaccgggaacaugagcuucaaggaccucggccgcguggucgugauggugggggccaccaugacggacgacaucggcaugggcgucaccuaccuggcccugcucgcggccuucaaggugcggcccaccuucgccgccgggcugcugcuccgcaagcugaccuccaaggagcugaugaugacgaccaucggcaucgugcuccugagccaguccaccauccccgagaccauccuggagcucacggacgcccuggcgcuggggaugaugguccucaagaucgugcgcgacauggagaaguaccagcuggccgugaccaucauggccauccugugcgucccgaacgccgugauccuccagaacgccuggaaggucagcugcaccauccuggcggugguguccgucagcccccugcuccugaccuccagccagcagaagacggacuggaucccccuggcccucaccaucaagggccugaaccccaccgccaucuuccugaccacgcucucccggaccaacaagaagcgcagcuggccgcugaacgaggccaucauggcggugggcaugguguccauccuggccagcucccuccugaagaacgacauccccaugaccgggccccuggucgccggcgggcuccugaccgugugcuacgugcugacgggccggagcgccgaccucgagcuggagcgcgccaccgacgucaagugggaggaccaggcggagaucuccgggagcagccccauccuguccaucaccaucagcgaggacggcuccaugagcaucaagaacgaggaggaggagcagacccucacgauccugauccggaccggccugcucgugaucuccgggcuguucccggugagcauccccaucaccgccgccgccugguaccugugggaggucaagaagcagcgcgccggcgugcucugggacgugcccagcccgccgcccauggggaaggcggagcuggaggacggcgccuaccggaucaagcagaaggggauccugggcuacagccagaucggcgccggggucuacaaggagggcaccuuccacaccauguggcacgugacgcgcggggccgugcucaugcacaagggcaagcggaucgagcccuccugggccgacgucaagaaggaccugaucagcuacgggggcggcuggaagcuggagggggaguggaaggagggcgaggagguccaggugcucgcgcuggagcccgggaagaacccccgcgccguccagaccaagcccggccuguucaagaccaacaccgggacgaucggcgccgugucccucgacuucagccccggcaccuccgggagccccaucaucgacaagaagggcaagguggucgggcuguacggcaacggcguggugacccgguccggggccuacgucagcgccaucgcgcagaccgagaaguccaucgaggacaaccccgagaucgaggacgacaucuuccgcaagcggcgccugacgaucauggaccugcaccccggcgccgggaagaccaagcgguaccuccccgccaucgugcgcgaggccaucaagcggggccugcgcacccugauccucgcgccgacccggguggucgccgccgagauggaggaggcccugcgcgggcugcccauccgguaccagacgcccgccauccgcgcggagcacaccggccgcgagaucguggaccucaugugccacgccaccuucaccaugcggcugcugagccccgugcgcgucccgaacuacaaccucaucaucauggacgaggcccacuucacggaccccgccuccaucgccgcgcggggcuacaucagcacccgcguggagaugggggaggccgccggcaucuucaugaccgccacgccgcccgggagccgggacccguucccccaguccaacgcccccaucaucgacgaggagcgcgagauccccgagcggagcuggaacuccggccacgagugggugacggacuucaaggggaagaccgucugguucgugccgagcaucaaggcgggcaacgacaucgccgccugccugcgcaagaacggcaagaaggugauccagcugucccggaagaccuucgacagcgaguacgucaagacccgcacgaacgacugggacuucguggugaccaccgacaucuccgagaugggggccaacuucaaggcggagcgggucaucgacccccgccggugcaugaagcccgugauccucaccgacggcgaggagcgcgugauccuggccgggcccaugccggucacgcacagcuccgccgcccagcggcgcggccggaucgggcgcaaccccaagaacgagaacgaccaguacaucuacaugggcgagccccuggagaacgacgaggacugcgcccacuggaaggaggcgaagaugcuccuggacaacaucaacacccccgagggcaucaucccgagcauguucgagcccgagcgggagaagguggacgccaucgacggggaguaccgccugcgcggcgaggcccggaagaccuucguggaccucaugcgccgcggggaccugcccgucuggcuggccuacaagguggccgcggagggcaucaacuacgccgaccgccgguggugcuucgacgggaucaagaacaaccagauccucgaggagaacguggaggucgagaucuggaccaaggagggcgagcgcaagaagcugaagccgcgguggcuggacgcccgcaucuacuccgacccccucgcccugaaggaguucaaggaguucgccgcgggccggaagucccugacgcucaaccugaucaccgagauggggcgccugcccaccuucaugacccagaagacgcgggacgcccucgacaaccuggccgugcugcacaccgccgaggcgggcgggcgcgccuacaaccacgcccucuccgagcugcccgagacccuggagacccuccugcugcucacgcugcuggccaccgucaccggcggcaucuuccucuuccugaugagcgggcggggcaucgggaagaugacccugggcaugugcugcaucaucaccgccuccauccuccugugguacgcgcagauccagccgcacuggaucgccgccagcaucauccuggaguucuuccucaucgugcugcugauccccgagcccgagaagcagcgcacgccccaggacaaccagcucaccuacguggucaucgccauccugaccgugguggccgcgaccauggccaacgagaugggguuccuggagaagacgaagaaggaccucggccugggcuccaucgccacccagcagccggagagcaacauccuggacaucgaccuccggcccgccuccgccuggacccuguacgcggucgccaccacguucgugacccccaugcugcgccacagcaucgagaacagcuccgugaacgucagccucaccgccaucgccaaccaggccaccgugcugauggggcugggcaagggguggccccucuccaagauggacaucggcgugccgcugcuggcgaucgggugcuacagccaggucaaccccaucacgcucaccgccgcccugcugcuccugguggcccacuacgcgaucaucggccccggccugcaggccaaggccacccgggaggcccagaagcgcgccgcggccgggaucaugaagaaccccaccguggacggcaucacggucaucgaccucgacccgauccccuacgaccccaaguucgagaagcagcugggccaggugaugcugcucauccugugcgugacccagguccugaugaugcggaccaccugggcccucugcgaggcccugacgcuggccaccggccccaucuccacccucugggaggggaacccgggccgcuucuggaacaccacgaucgcggugagcauggccaacaucuuccggggcuccuaccuggccggggccggccuccucuucagcaucaugaagaacaccaccaacacccgccgcgggacgggcaacaucggcgagacccugggggagaaguggaagucccggcugaacgcccucggcaagagcgaguuccagaccuacaagaaguccgggauccaggagguggaccgcacccuggcgaaggagggcaucaagcgcggggagacggaccaccacgccgucagccgcggcuccgccaagcugcggugguucguggagcgcaacauggugacccccgagggcaaggucguggaccucgggugcggccgcggcggguggagcuacuacugcggcgggcugaagaacgugcgcgaggucaaggggcugaccaagggcggccccgggcacgaggagcccaucccgauguccaccuacggcuggaaccucgugcggcugcagagcgggguggacgucuucuucaucccgcccgagaagugcgacacgcugcucugcgacaucggcgaguccagccccaacccgaccguggaggccggccgcacccugcgggugcugaaccucgucgagaacuggcugaacaacaacacccaguucugcaucaaggugcugaaccccuacaugcccuccgugaucgagaagauggaggcgcugcagcgcaaguacgggggcgcccucguccggaacccgcugagccgcaacagcacccacgagauguacuggguguccaacgccagcgggaacaucguguccagcgucaacaugaucucccggaugcugaucaaccgcuucacgaugcggcacaagaaggccaccuacgagcccgacguggaccucggcagcgggacccgcaacaucggcaucgaguccgagauccccaaccuggacaucaucggcaagcggaucgagaagaucaagcaggagcacgagaccagcuggcacuacgaccaggaccaccccuacaagacgugggccuaccacggguccuacgagaccaagcagaccggcagcgcguccagcauggugaacggggucgugcgccugcucaccaagccgugggacgugcugcccacggucacccagauggccaugaccgacaccacgcccuucggccagcagcgcguguucaaggagaagguggacacccggacccaggagcccaaggagggcaccaagaagcugaugaagaucacggccgaguggcucuggaaggagcuggggaagaagaagaccccgcgcaugugcacccgggaggaguucacccgcaagguccgguccaacgccgcccugggcgcgaucuucacggacgagaacaaguggaaguccgcccgcgaggccguggaggaccggcgcuucugggagcucguggacaaggagcggaaccugcaccuggaggggaagugcgagaccugcgucuacaacaugaugggcaagcgcgagaagaagcucggggaguucggcaaggccaagggcucccgggccaucugguacauguggcugggggcgcgcuuccuggaguucgaggcccucggcuuccugaacgaggaccacugguucagccgggagaacucccugagcgggguggagggcgaggggcuccacaagcugggcuacauccugcgcgacgucuccaagaaggagggcggggccauguacgccgacgacaccgcgggcugggacacccggaucacgcucgaggaccugaagaacgaggagauggugaccaaccacauggagggggagcacaagaagcuggccgaggccaucuucaagcucaccuaccagaacaaggugguccgcgugcagcggcccacgccccggggcacggugauggacaucaucagccggcgcgaccagcgggggagcggccaggucggcaccuacgggcugaacaccuucaccaacauggaggcccagcugauccgccagauggagggcgaggggguguucaagaacauccagcaccucacggccaccgaggagguggcgguccagaacuggcuggcccgcgugggccgggagcgccugucccggauggccaucagcggcgacgacugcguggucaagccccucgacgaccgcuucgccaacgcccugaccgcgcugaacgacauggggaagauccggaaggacauccagcagugggagccguccaagggcuggaacgacuggacccaggugcccuucugcagccaccacuuccacgagcucaucaugaaggacgggcgcgugcuggucgugcccugccggaaccaggacgagcugaucggccgcgcccggaucucccagggggccggcuggagccuccgcgagacggccugccugggcaaguccuacgcccagauguggagccugauguacuuccaccggcgcgaccuccggcuggcggccaacgccaucugcuccgccgugcccagccacugggucccgaccucccgcaccaccuggagcauccacgccaagcacgaguggaugaccacggaggacaugcugaccguguggaaccggguguggauccgcgagaaccccuggauggaggacaagacccccgucgaguccugggaggagauccccuaccucgggaagcgggaggaccaguggugcggcagccugaucgggcugaccucccgcgcgacgugggccaagaacauccaggccgccaucaaccaggugcggagccucaucggcaacgaggaguacaccgacuacaugccguccaugaagcgcuuccgccgggaggaggaggaggcgggggugcugugguga

SEQ ID NO: 9167 - RNA, 9876 nt, Artificial Sequence
  derived and/or modified CDS sequence (opt1) from DENV-2__FJ639705__SS-prME
agcgcgggcaugaucaucaugcugauccccaccgugauggccuuccaccucaccacccggaacggggagccccacaugaucgugggcauccaggagaagggcaagagccugcuguucaagaccgaggacggcgugaacaugugcacccucauggcgauggaccugggggagcugugcgaggacaccaucaccuacaagugcccccuccugcggcagaacgagcccgaggacaucgacugcuggugcaacagcaccagcaccugggugaccuacgggaccugcaccaccaccggcgagcaccggcgggagaagcgcagcgucgcccuggugccccacguggggaugggccucgagacccggaccgagaccuggauguccagcgagggggccuggaagcacgcccagcggaucgagaccuggauccugcggcacccgggcuucacgaucauggccgcgauccuggccuacaccaucgggaccacccacuuccagcgcgcccucaucuucauccugcugacggccgucgcgcccuccaugaccaugcggugcaucggcaucagcaaccgcgacuucguggagggcguguccgggggcagcugggucgacaucgugcucgagcacggguccugcgugaccaccauggccaagaacaagcccacgcuggacuucgagcugaucaagaccgaggcccggcagcccgccacccuccgcaaguacugcaucgaggccaagcugaccaacacgaccaccgagagccggugccccacccagggcgagcccucccugaaggaggagcaggacaagcgcuucgucugcaagcacagcaugguggaccggggcugggggaacggcugcgggcuguucggcaagggcgggaucgugacgugcgcgauguucacgugcaagaagaacauggagggcaagaucguccagcccgagaaccuggaguacaccaucguggugacgccccacuccggggaggagcacgccgucggcaacgacacggggaagcacggcaaggagaucaaggugaccccgcagagcuccaucaccgaggccgagcugaccggguacggcaccgugacgauggagugcagcccccgcaccggccucgacuucaacgagaugguccugcugcagauggagaacaaggccuggcucgugcaccggcagugguuccuggaccugccccuccccuggcugccgggggccgacaagcagggcuccaacuggauccagaaggagacccuggugaccuucaagaacccccacgcgaagaagcaggacgucgugguccucgggagccaggagggcgccaugcacacggcccugaccggggccaccgagauccagaugagcuccggcaaccuccuguucaccggccaccugaagugccgccugcggauggacaagcuccagcugaaggggaugagcuacuccaugugcacgggcaaguucaagguggugaaggagaucgccgagacccagcacgggaccaucgucauccgcgugcaguacgagggcgacggcagccccugcaagauccccuucgagaucauggaccuggagaagcgguacgugcucgggcgccugaucaccgucaacccgaucgugacggagaaggacucccccgugaacaucgaggcggagccgcccuucggcgacagcuacaucaucaucggggucgagccgggccagcugaagcucaacugguucaagaagggguccagcaucggccagauguucgagaccaccaugcgcggcgccaagcggauggccauccugggggacaccgccugggacuucggcucccucggcgggguguucacgagcaucgggaaggcccuccaccagguguucggggcgaucuacggcgccgccuucuccggggucagcuggaccaugaagauccugaucggcgugaucaucaccuggaucgggaugaacucccgcagcaccucccugagcgugucccugguccucgugggcaucgugacgcuguaccugggggucauggugcaggccgacagcggcugcguggucuccuggaagaacaaggagcucaagugcggcagcgggaucuucaucaccgacaacgugcacaccuggaccgagcaguacaaguuccagcccgagagccccuccaagcuggcgagcgccauccagaaggcccaggaggagggcaucugcgggauccgguccgugacgcgccuggagaaccucauguggaagcagaucacccccgagcugaaccacauccuggccgagaacgaggucaagcucaccaucaugaccggcgacaucaaggggaucaugcaggccggcaagcggagccugcgcccgcagcccacggagcugaaguacuccuggaagaccuggggcaaggcgaagaugcucagcaccgagucccacaaccagaccuuccugaucgacgggcccgagacggccgagugcccgaacaccaaccgggccuggaacagccuggagguggaggacuacggcuucgggguguucaccaccaacaucuggcucaagcugaaggagaagcaggacgccuucugcgacuccaagcugaugagcgccgcgaucaaggacaaccgcgccguccacgccgacaugggcuacuggaucgaguccgcccucaacgacacguggaagaucgagaaggccagcuucaucgaggugaagaacugccacuggcccaagucccacacccuguggagcaacggcgugcuggaguccgagaugaucauccccaagaaccucgcggggcccgucagccagcacaacuaccggccgggcuaccacacccagaucgccgggcccuggcaccugggcaagcuggagauggacuucgacuucugcgacgggaccaccgugaucgugacggaggacugcggcaaccgcggccccucccuccggaccaccaccgccagcgggaagcugaucacggaguggugcugccgcagcugcacccugcccccgcuccgguaccgcggcgaggacgggugcugguacggcauggagauccggccccugaaggagaaggaggagaaccuggucaacucccucgugaccgccgggcacggccagguggacaacuucagccugggcguccuggggauggcccucuuccuggaggagaugcugcgcacccgggugggcacgaagcacgccauccuccugguggccgucuccuucgugacccugaucaccgggaacaugagcuucaaggaccucggccgcguggucgugauggugggggccaccaugacggacgacaucggcaugggcgucaccuaccuggcccugcucgcggccuucaaggugcggcccaccuucgccgccgggcugcugcuccgcaagcugaccuccaaggagcugaugaugacgaccaucggcaucgugcuccugagccaguccaccauccccgagaccauccuggagcucacggacgcccuggcgcuggggaugaugguccucaagaucgugcgcgacauggagaaguaccagcuggccgugaccaucauggccauccugugcgucccgaacgccgugauccuccagaacgccuggaaggucagcugcaccauccuggcggugguguccgucagcccccugcuccugaccuccagccagcagaagacggacuggaucccccuggcccucaccaucaagggccugaaccccaccgccaucuuccugaccacgcucucccggaccaacaagaagcgcagcuggccgcugaacgaggccaucauggcggugggcaugguguccauccuggccagcucccuccugaagaacgacauccccaugaccgggccccuggucgccggcgggcuccugaccgugugcuacgugcugacgggccggagcgccgaccucgagcuggagcgcgccaccgacgucaagugggaggaccaggcggagaucuccgggagcagccccauccuguccaucaccaucagcgaggacggcuccaugagcaucaagaacgaggaggaggagcagacccucacgauccugauccggaccggccugcucgugaucuccgggcuguucccggugagcauccccaucaccgccgccgccugguaccugugggaggucaagaagcagcgcgccggcgugcucugggacgugcccagcccgccgcccauggggaaggcggagcuggaggacggcgccuaccggaucaagcagaaggggauccugggcuacagccagaucggcgccggggucuacaaggagggcaccuuccacaccauguggcacgugacgcgcggggccgugcucaugcacaagggcaagcggaucgagcccuccugggccgacgucaagaaggaccugaucagcuacgggggcggcuggaagcuggagggggaguggaaggagggcgaggagguccaggugcucgcgcuggagcccgggaagaacccccgcgccguccagaccaagcccggccuguucaagaccaacaccgggacgaucggcgccgugucccucgacuucagccccggcaccuccgggagccccaucaucgacaagaagggcaagguggucgggcuguacggcaacggcguggugacccgguccggggccuacgucagcgccaucgcgcagaccgagaaguccaucgaggacaaccccgagaucgaggacgacaucuuccgcaagcggcgccugacgaucauggaccugcaccccggcgccgggaagaccaagcgguaccuccccgccaucgugcgcgaggccaucaagcggggccugcgcacccugauccucgcgccgacccggguggucgccgccgagauggaggaggcccugcgcgggcugcccauccgguaccagacgcccgccauccgcgcggagcacaccggccgcgagaucguggaccucaugugccacgccaccuucaccaugcggcugcugagccccgugcgcgucccgaacuacaaccucaucaucauggacgaggcccacuucacggaccccgccuccaucgccgcgcggggcuacaucagcacccgcguggagaugggggaggccgccggcaucuucaugaccgccacgccgcccgggagccgggacccguucccccaguccaacgcccccaucaucgacgaggagcgcgagauccccgagcggagcuggaacuccggccacgagugggugacggacuucaaggggaagaccgucugguucgugccgagcaucaaggcgggcaacgacaucgccgccugccugcgcaagaacggcaagaaggugauccagcugucccggaagaccuucgacagcgaguacgucaagacccgcacgaacgacugggacuucguggugaccaccgacaucuccgagaugggggccaacuucaaggcggagcgggucaucgacccccgccggugcaugaagcccgugauccucaccgacggcgaggagcgcgugauccuggccgggcccaugccggucacgcacagcuccgccgcccagcggcgcggccggaucgggcgcaaccccaagaacgagaacgaccaguacaucuacaugggcgagccccuggagaacgacgaggacugcgcccacuggaaggaggcgaagaugcuccuggacaacaucaacacccccgagggcaucaucccgagcauguucgagcccgagcgggagaagguggacgccaucgacggggaguaccgccugcgcggcgaggcccggaagaccuucguggaccucaugcgccgcggggaccugcccgucuggcuggccuacaagguggccgcggagggcaucaacuacgccgaccgccgguggugcuucgacgggaucaagaacaaccagauccucgaggagaacguggaggucgagaucuggaccaaggagggcgagcgcaagaagcugaagccgcgguggcuggacgcccgcaucuacuccgacccccucgcccugaaggaguucaaggaguucgccgcgggccggaagucccugacgcucaaccugaucaccgagauggggcgccugcccaccuucaugacccagaagacgcgggacgcccucgacaaccuggccgugcugcacaccgccgaggcgggcgggcgcgccuacaaccacgcccucuccgagcugcccgagacccuggagacccuccugcugcucacgcugcuggccaccgucaccggcggcaucuuccucuuccugaugagcgggcggggcaucgggaagaugacccugggcaugugcugcaucaucaccgccuccauccuccugugguacgcgcagauccagccgcacuggaucgccgccagcaucauccuggaguucuuccucaucgugcugcugauccccgagcccgagaagcagcgcacgccccaggacaaccagcucaccuacguggucaucgccauccugaccgugguggccgcgaccauggccaacgagaugggguuccuggagaagacgaagaaggaccucggccugggcuccaucgccacccagcagccggagagcaacauccuggacaucgaccuccggcccgccuccgccuggacccuguacgcggucgccaccacguucgugacccccaugcugcgccacagcaucgagaacagcuccgugaacgucagccucaccgccaucgccaaccaggccaccgugcugauggggcugggcaagggguggccccucuccaagauggacaucggcgugccgcugcuggcgaucgggugcuacagccaggucaaccccaucacgcucaccgccgcccugcugucccucguggcccacuacgcgaucaucggccccggccugcaggccaaggccacccgggaggcccagaagcgcgccgcggccgggaucaugaagaaccccaccguggacggcaucacggucaucgaccuggacccgauccccuacgaccccaaguucgagaagcagcucggccaggugaugcugcugauccucugcgugacccagguccugaugaugcggaccaccugggcccugugcgaggcccucacgcuggccaccggccccaucagcacccugugggaggggaacccgggccgcuucuggaacaccacgaucgcgguguccauggccaacaucuuccggggcagcuaccucgccggggccggccugcuguucuccaucaugaagaacaccaccaacacccgccgcgggacgggcaacaucggcgagacccucggggagaaguggaagucccggcugaacgcccugggcaaguccgaguuccagaccuacaagaaguccgggauccaggagguggaccgcacccucgcgaaggagggcaucaagcgcggggagacggaccaccacgccgucucccgcggcagcgccaagcugcggugguucguggagcgcaacauggugacccccgagggcaaggucguggaccuggggugcggccgcggcgggugguccuacuacugcggcgggcucaagaacgugcgcgaggucaaggggcugaccaagggcggccccgggcacgaggagcccaucccgaugagcaccuacggcuggaaccuggugcggcuccaguccgggguggacgucuucuucaucccgcccgagaagugcgacacgcugcugugcgacaucggcgagagcucccccaacccgaccguggaggccggccgcacccuccgggugcugaaccuggucgagaacuggcucaacaacaacacccaguucugcaucaaggugcugaaccccuacaugcccagcgugaucgagaagauggaggcgcugcagcgcaaguacgggggcgcccugguccggaacccgcucagccgcaacuccacccacgagauguacugggugagcaacgccuccgggaacaucgugagcuccgucaacaugaucagccggaugcugaucaaccgcuucacgaugcggcacaagaaggccaccuacgagcccgacguggaccugggcuccgggacccgcaacaucggcaucgagagcgagauccccaaccucgacaucaucggcaagcggaucgagaagaucaagcaggagcacgagaccuccuggcacuacgaccaggaccaccccuacaagacgugggccuaccacgggagcuacgagaccaagcagaccggcuccgcgagcuccauggugaacggggucgugcgccugcugaccaagccgugggacgugcuccccacggucacccagauggccaugaccgacaccacgcccuucggccagcagcgcguguucaaggagaagguggacacccggacccaggagcccaaggagggcaccaagaagcugaugaagaucacggccgaguggcuguggaaggagcucgggaagaagaagaccccgcgcaugugcacccgggaggaguucacccgcaagguccggagcaacgccgcccugggcgcgaucuucacggacgagaacaaguggaaguccgcccgcgaggccguggaggacagccgguucugggagcugguggacaaggagcgcaaccuccaccuggaggggaagugcgagaccugcgucuacaacaugaugggcaagcgggagaagaagcugggggaguucggcaaggccaagggcucccgcgccaucugguacauguggcucggggcgcgguuccuggaguucgaggcccugggcuuccucaacgaggaccacugguucagccgcgagaacucccugagcgggguggagggcgaggggcugcacaagcucggcuacauccugcgggacgucagcaagaaggagggcggggccauguacgccgacgacaccgcgggcugggacacccgcaucacgcuggaggaccucaagaacgaggagauggugaccaaccacauggagggggagcacaagaagcuggccgaggccaucuucaagcugaccuaccagaacaaggugguccgggugcagcgccccacgccccggggcacggugauggacaucaucucccgccgggaccagcgcgggagcggccaggucggcaccuacgggcucaacaccuucaccaacauggaggcccagcugauccggcagauggagggcgaggggguguucaagaacauccagcaccugacggccaccgaggagguggcgguccagaacuggcucgcccgcgugggccgcgagcggcugucccgcauggccaucagcggcgacgacugcguggucaagccccuggacgaccgguucgccaacgcccucaccgcgcugaacgacauggggaagauccgcaaggacauccagcagugggagccguccaagggcuggaacgacuggacccaggugcccuucugcagccaccacuuccacgagcugaucaugaaggacgggcgggugcucgucgugcccugccgcaaccaggacgagcugaucggccgggcccgcaucucccagggggccggcuggagccugcgggagacggccugccucggcaaguccuacgcccagauguggagccugauguacuuccaccgccgggaccugcgccucgcggccaacgccaucugcuccgccgugcccagccacugggucccgaccucccggaccaccuggagcauccacgccaagcacgaguggaugaccacggaggacaugcugaccguguggaaccgcguguggauccgggagaaccccuggauggaggacaagacccccgucgaguccugggaggagauccccuaccuggggaagcgcgaggaccaguggugcggcagccucaucgggcugaccucccgggcgacgugggccaagaacauccaggccgccaucaaccaggugcgcagccugaucggcaacgaggaguacaccgacuacaugccgagcaugaagcgguuccgccgcgaggaggaggaggcgggggugcucugguga

SEQ ID NO: 9168 - RNA, 9876 nt, Artificial Sequence
  derived and/or modified CDS sequence (opt1) from DENV-2__FJ639706__SS-prME
agcgccggcaugaucaucaugcugauccccaccgugauggccuuccaccucaccacccgcaacggggagccccacaugaucgucggcauccaggagaaggggaagucccugcuguucaagaccgaggacggcgugaacaugugcacccucauggcgauggaccugggggagcugugcgaggacaccaucaccuacaagugcccccuccugcggcagaacgagcccgaggacaucgacugcuggugcaacagcaccuccaccugggugaccuacgggaccugcaccaccaccggcgagcaccgccgggagaagcgcagcgucgcccuggugccccacguggggaugggccucgagacccggaccgagaccuggauguccagcgagggggccuggaagcacgcccagcgcaucgagaccuggauccugcggcacccgggcuucacgaucauggccgcgauccuggccuacaccaucgggaccacccacuuccagcgcgcccucaucuucauccugcugacggccgucgcgcccuccaugaccaugcggugcaucggcaucagcaaccgcgacuucguggagggcguguccgggggcagcugggucgacaucgugcucgagcacggguccugcgugaccaccauggccaagaacaagcccacgcuggacuucgagcugaucaagaccgaggccaagcagcccgccacccuccggaaguacugcaucgaggccaagcugaccaacacgaccaccgagagccgcugccccacccagggcgagcccucccugaaggaggagcaggacaagcgguucgucugcaagcacagcaugguggaccgcggcugggggaacggcugcgggcuguucggcaagggcgggaucgugacgugcgcgauguucacgugcaagaagaacauggagggcaagaucguccagcccgagaaccuggaguacaccaucguggugacgccccacuccggggaggagcacgccgucggcaacgacacggggaagcacggcaaggagaucaaggugaccccgcagagcuccaucaccgaggccgagcugaccggguacggcaccgugacgauggagugcagcccccggaccggccucgacuucaacgagaugguccugcugcagauggagaacaaggccuggcucgugcaccgccagugguuccuggaccugccccuccccuggcugccgggggccgacaagcagggcuccaacuggauccagaaggagacccuggugaccuucaagaacccccacgcgaagaagcaggacgucgugguccucgggagccaggagggcgccaugcacacggcccugaccggggccaccgagauccagaugagcuccggcaaccuccuguucaccggccaccugaagugccggcugcgcauggacaagcuccagcugaaggggaugagcuacuccaugugcacgggcaaguucaagguggugaaggagaucgccgagacccagcacgggaccaucgucauccgggugcaguacgagggcgacggcagccccugcaagauccccuucgagaucauggaccuggagaagcgcuacgugcucgggcggcugaucaccgucaacccgaucgugacggagaaggacucccccgugaacaucgaggcggagccgcccuucggcgacagcuacaucaucaucggggucgagccgggccagcugaagcucaacugguucaagaagggguccagcaucggccagauguucgagaccaccaugcgcggcgccaagcgcauggccauccugggggacaccgccugggacuucggcucccucggcgggguguucacgagcaucgggaaggcccuccaccagguguucggcgcgaucuacggcgccgccuucuccggggucagcuggaccaugaagauccugaucggcgugaucaucaccuggaucgggaugaacucccggagcaccucccugagcgugucccugguccucgugggcaucgugacgcuguaccugggggucauggugcaggccgacagcggcugcguggucuccuggaagaacaaggagcucaagugcggcagcgggaucuucaucaccgacaacgugcacaccuggaccgagcaguacaaguuccagcccgagagccccuccaagcuggcgagcgccauccagaaggcccaggaggagggcaucugcgggauccgcuccgugacgcggcuggagaaccucauguggaagcagaucacccccgagcugaaccacauccuggccgagaacgaggucaagcucaccaucaugaccggcgacaucaaggggaucaugcaggccggcaagcgcagccugcggccgcagcccacggagcugaaguacuccuggaagaccuggggcaaggcgaagaugcucagcaccgagucccacaaccagaccuuccugaucgacgggcccgagacggccgagugcccgaacaccaaccgcgccuggaacagccuggagguggaggacuacggcuucgggguguucaccaccaacaucuggcucaagcugaaggagaagcaggacgccuucugcgacuccaagcugaugagcgccgcgaucaaggacaaccgggccguccacgccgacaugggcuacuggaucgaguccgcccucaacgacacguggaagaucgagaaggccagcuucaucgaggugaagaacugccacuggcccaagucccacacccuguggagcaacggcgugcuggaguccgagaugaucauccccaagaaccucgcggggcccgucagccagcacaacuaccgcccgggcuaccacacccagaucgccgggcccuggcaccugggcaagcuggagauggacuucgacuucugcgacgggaccaccgugaucgugacggaggacugcggcaaccggggccccucccuccgcaccaccaccgccagcgggaagcugaucacggaguggugcugccggagcugcacccugcccccgcuccgcuaccggggcgaggacgggugcugguacggcauggagauccgcccccugaaggagaaggaggagaaccuggucaacucccucgugaccgccgggcacggccagguggacaacuucagccugggcguccuggggauggcccuguuccuggaggagaugcugcggacccgcgugggcacgaagcacgccauccuccugguggccgucuccuucgugacccugaucaccgggaacaugagcuucaaggaccucggccggguggucgugauggugggggccaccaugacggacgacaucggcaugggcgucaccuaccuggcccugcucgcggccuucaaggugcgccccaccuucgccgccgggcugcugcuccggaagcugaccuccaaggagcugaugaugacgaccaucggcaucgcccuccugagccaguccaccauccccgagaccauccuggagcucacggacgcgcuggcccuggggaugauggugcucaagaucguccgcgacauggagaaguaccagcuggccgugaccaucauggccauccugugcgugccgaacgccgucauccuccagaacgcguggaaggugagcugcaccauccuggccgucguguccgugagcccccugcuccugaccuccagccagcagaagacggacuggaucccccuggcccucaccaucaagggccugaaccccaccgccaucuuccugaccacgcucucccgcaccaacaagaagcggagcuggccgcugaacgaggcgaucauggccgucggcaugguguccauccuggccagcucccuccugaagaacgacauccccaugaccgggccccugguggccggcgggcuccugaccgucugcuacgugcugacgggccgcagcgccgaccucgagcuggagcgggcgaccgacgugaagugggaggaccaggccgagaucuccgggagcagccccauccuguccaucaccaucagcgaggacggcuccaugagcaucaagaacgaggaggaggagcagacccucacgauccugauccgcaccggccugcucgucaucuccgggcuguucccggugagcauccccaucaccgccgccgccugguaccugugggaggugaagaagcagcgggcgggcguccucugggacgugcccagcccgccgcccauggggaaggccgagcuggaggacggcgccuaccgcaucaagcagaaggggauccugggcuacagccagaucggcgccgggguguacaaggagggcaccuuccacaccauguggcacgucacgcgcggggcggugcucaugcacaagggcaagcgcaucgagcccuccugggcggacgugaagaaggaccugaucagcuacgggggcggcuggaagcuggagggggaguggaaggagggcgaggagguccaggugcucgcccuggagcccgggaagaacccccgggccgugcagaccaagcccggccuguucaagaccaacaccgggacgaucggcgccgucucccucgacuucagccccggcaccuccgggagccccaucaucgacaagaagggcaaggugguggggcuguacggcaacggcgucgugacccgcuccggggccuacgugagcgcgaucgcccagaccgagaaguccaucgaggacaaccccgagaucgaggacgacaucuuccggaagcgccggcugacgaucauggaccugcaccccggcgccgggaagaccaagcgcuaccuccccgccaucguccgggaggcgaucaagcgcggccugcggacccugauccucgccccgacccgcgugguggccgccgagauggaggaggcccugcgggggcugcccauccgcuaccagacgcccgcgauccgggccgagcacaccggccgcgagaucgucgaccucaugugccacgccaccuucaccaugcgccugcugagccccgugcgggugccgaacuacaaccucaucaucauggacgaggcccacuucacggaccccgccuccaucgcggcccgcggcuacaucagcacccgggucgagaugggggaggccgccggcaucuucaugaccgccacgccgcccgggagccgcgacccguucccccaguccaacgcgcccaucaucgacgaggagcgggagauccccgagcgcagcuggaacuccggccacgagugggugacggacuucaaggggaagaccgugugguucgucccgagcaucaaggccggcaacgacaucgccgccugccugcggaagaacggcaagaaggugauccagcugucccgcaagaccuucgacagcgaguacgugaagacccggacgaacgacugggacuucgucgugaccaccgacaucuccgagaugggggcgaacuucaaggccgagcgcgugaucgacccccggcgcugcaugaagcccgucauccucaccgacggcgaggagcgggugauccuggccgggcccaugccggugacgcacagcuccgccgcccagcgccggggccgcaucgggcggaaccccaagaacgagaacgaccaguacaucuacaugggcgagccccuggagaacgacgaggacugcgcgcacuggaaggaggccaagaugcuccuggacaacaucaacacccccgagggcaucaucccgagcauguucgagcccgagcgcgagaaggucgacgccaucgacggggaguaccggcugcgcggcgaggcccgcaagaccuucguggaccucaugcggcgcggggaccugcccguguggcuggccuacaaggucgcggccgagggcaucaacuacgccgaccggcgcuggugcuucgacgggaucaagaacaaccagauccucgaggagaacguggagguggagaucuggaccaaggagggcgagcggaagaagcugaagccgcgcuggcuggacgcccggaucuacuccgacccccucgcccugaaggaguucaaggaguucgcggccggccgcaagagccugacgcucaaccugaucaccgagauggggcggcugcccaccuucaugacccagaagacgcgcgacgcccucgacaaccuggccguccugcacaccgcggaggccggcgggcgggccuacaaccacgcccucuccgagcugcccgagacccuggagacccuccugcugcucacgcugcuggccaccgugaccggcggcaucuuccucuuccugaugagcgggcgcggcaucgggaagaugacccugggcaugugcugcaucaucaccgcguccauccuccugugguacgcccagauccagccgcacuggaucgccgccagcaucauccuggaguucuuccucaucguccugcugauccccgagcccgagaagcagcggacgccccaggacaaccagcucaccuacguggugaucgccauccugaccgucguggcggccaccauggccaacgagaugggguuccuggagaagacgaagaaggaccucggccugggcuccaucgccacccagcagccggagagcaacauccuggacaucgaccuccgccccgccuccgcguggacccuguacgccguggccaccacguucgucacccccaugcugcggcacagcaucgagaacagcuccgugaacgugagccucaccgccaucgccaaccaggcgaccguccugauggggcugggcaagggguggccccucuccaagauggacaucggcgugccgcugcuggccaucgggugcuacagccaggugaaccccaucacgcucaccgccgcccugcugcuccuggucgcgcacuacgccaucaucggccccggccugcaggccaaggccacccgcgaggcccagaagcgggcggccgccgggaucaugaagaaccccaccguggacggcaucacggugaucgaccucgacccgauccccuacgaccccaaguucgagaagcagcuggggcaggucaugcugcucauccugugcgugacccaggugcugaugaugcgcaccaccugggcccucugcgaggcccugacgcuggcgaccggccccaucuccacccucugggaggggaacccgggccgguucuggaacaccacgaucgccgucagcauggccaacaucuuccgcggcuccuaccuggccggggccggccuccucuucagcaucaugaagaacaccaccaacacccggcgcgggacgggcaacaucggcgagacccugggggagaaguggaagucccgccugaacgcgcucggcaagagcgaguuccagaccuacaagaaguccgggauccaggagguggaccggacccuggccaaggagggcaucaagcgcggggagacggaccaccacgccgugagccggggcuccgccaagcugcgcugguucgucgagcggaacauggugacccccgagggcaagguggucgaccucgggugcggccgcgggggcuggagcuacuacugcgggggccugaagaacgugcgggaggugaagggccugaccaagggcggccccgggcacgaggagcccaucccgauguccaccuacggcuggaaccucguccgccugcagagcgggguggacguguucuucaucccgcccgagaagugcgacacgcugcucugcgacaucggcgaguccagccccaacccgaccgucgaggcgggccggacccugcgcgugcugaaccucguggagaacuggcugaacaacaacacccaguucugcaucaagguccugaaccccuacaugcccuccgugaucgagaagauggaggcccugcagcggaaguacgggggcgcccucgugcgcaacccgcugagccggaacagcacccacgagauguacugggucuccaacgccagcgggaacaucguguccagcgugaacaugaucucccgcaugcugaucaaccgguucacgaugcgccacaagaaggccaccuacgagcccgacgucgaccucggcagcgggacccggaacaucggcaucgaguccgagauccccaaccuggacaucaucggcaagcgcaucgagaagaucaagcaggagcacgagaccagcuggcacuacgaccaggaccaccccuacaagacgugggcguaccacggguccuacgagaccaagcagaccggcagcgccuccagcauggugaacggggugguccggcugcucaccaagccgugggacgugcugcccacggugacccagauggccaugaccgacaccacgcccuucggccagcagcgcgucuucaaggagaagguggacacccgcacccaggagcccaaggagggcaccaagaagcugaugaagaucacggccgaguggcucuggaaggagcuggggaagaagaagaccccgcggaugugcacccgcgaggaguucacccggaaggugcgcuccaacgccgcgcugggcgccaucuucacggacgagaacaaguggaaguccgcccgggaggccgucgaggacucccgcuucugggagcucguggacaaggagcggaaccugcaccuggaggggaagugcgagaccugcguguacaacaugaugggcaagcgcgagaagaagcucggggaguucggcaaggccaagggcagccgggcgaucugguacauguggcugggggcccgcuuccuggaguucgaggcccucggcuuccugaacgaggaccacugguucucccgggagaacagccuguccggggucgagggcgaggggcuccacaagcugggcuacauccugcgcgacgugagcaagaaggagggcggggccauguacgcggacgacaccgccggcugggacacccggaucacgcucgaggaccugaagaacgaggagauggucaccaaccacauggagggggagcacaagaagcuggccgaggccaucuucaagcucaccuaccagaacaagguggugcgcguccagcggcccacgccccggggcacggugauggacaucaucagccggaaggaccagcgcggguccggccaggugggcaccuacgggcugaacaccuucaccaacauggaggcccagcugauccggcagauggagggcgagggggucuucaagaacauccagcaccucacggcgaccgaggagguggccgugcagaacuggcuggcccgcgucggccgggagcgccugagccgcauggccaucuccggcgacgacugcguggugaagccccucgacgaccgguucgccaacgcgcugaccgcccugaacgacauggggaagauccgcaaggacauccagcagugggagccgagcaagggcuggaacgacuggacccagguccccuucugcucccaccacuuccacgagcucaucaugaaggacgggcgggugcuggugguccccugccgcaaccaggacgagcugaucggccgggcccgcaucagccagggggccggcuggucccuccgggagacggccugccugggcaagagcuacgcgcagauguggucccugauguacuuccaccgccgggaccuccgccuggccgccaacgccaucugcagcgccgugcccucccacugggugccgaccagccggaccaccugguccauccacgcgaagcacgaguggaugaccacggaggacaugcugaccgucuggaaccgcguguggauccgggagaaccccuggauggaggacaagacccccguggagagcugggaggagauccccuaccucgggaagcgcgaggaccaguggugcggcucccugaucgggcugaccagccgggccacgugggccaagaacauccaggccgcgaucaaccagguccgcucccucaucggcaacgaggaguacaccgacuacaugccgagcaugaagcgguuccgccgggaggaggaggaggccggggugcugugguga

SEQ ID NO: 9169 - RNA, 9876 nt, Artificial Sequence
  derived and/or modified CDS sequence (opt1) from DENV-2__FJ639707__SS-prME
agcgcggggaugaucaucaugcugauccccaccgugauggccuuccaccucaccacccgcaacggggagccccacaugaucgucggcauccaggagaaggggaagucccugcuguucaagaccgaggacggcgugaacaugugcacccucauggcgauggaccugggggagcugugcgaggacaccaucaccuacaagugcccccuccugcggcagaacgagcccgaggacaucgacugcuggugcaacagcaccagcaccugggugaccuacgggaccugcaccaccaccggcgagcaccgccgggagaagcgcagcgucgcccuggugccccacguggggaugggccucgagacccggaccgagaccuggauguccagcgagggggccuggaagcacgcccagcgcaucgagaccuggauccugcggcacccgggcuucacgaucauggccgcgauccuggccuacaccaucgggaccacccacuuccagcgcguccucaucuucauccugcugacggccguggcccccuccaugaccaugcggugcaucggcaucagcaaccgcgacuucguggagggcgucuccgggggcagcuggguggacaucgugcucgagcacggguccugcgucaccaccauggcgaagaacaagcccacgcuggacuucgagcugaucaagaccgaggccaagcagcccgccacccuccggaaguacugcaucgaggccaagcugaccaacacgaccaccgagagccgcugccccacccagggcgagcccucccugaaggaggagcaggacaagcgguucgugugcaagcacagcaugguggaccgcggcugggggaacggcugcggccuguucggcaagggcgggaucgucacgugcgccauguucacgugcaagaagaacauggagggcaagaucgugcagcccgagaaccuggaguacaccaucguggucacgccccacuccggggaggagcacgcggugggcaacgacacggggaagcacggcaaggagaucaaggugaccccgcagagcuccaucaccgaggccgagcugaccggguacggcaccgucacgauggagugcagcccccggaccggccucgacuucaacgagauggugcugcugcagauggagaacaaggccuggcucgugcaccgccagugguuccuggaccugccccuccccuggcugccgggggccgacaagcaggaguccaacuggauccagaaggagacccuggucaccuucaagaacccccacgccaagaagcaggacguggucgugcucggcagccaggagggggcgaugcacacggcccugaccggcgccaccgagauccagaugagcuccgggaaccuccuguucaccggccaccugaagugccggcugcgcauggacaagcuccagcugaagggcaugagcuacuccaugugcacggggaaguucaagguggucaaggagaucgccgagacccagcacggcaccaucgugauccgggugcaguacgagggggacggcagccccugcaagauccccuucgagaucauggaccuggagaagcgcuacauccucggccggcugaucaccgucaacccgaucgugacggagaaggacucccccgugaacaucgaggccgagccgcccuucggggacagcuacaucaucaucggcgucgagccggggcagcugaagcucaacugguucaagaagggcuccagcaucgggcagauguucgagaccaccaugcgcggcgcgaagcgcauggccauccugggcgacaccgccugggacuucgggucccugggcgggguguucacgagcaucggcaaggcccuccaccagguguucggggccaucuacggcgcggccuucuccggcgucagcuggaccaugaagauccugaucggggugaucaucaccuggaucggcaugaacucccggagcaccucccugagcgugucccugguccucguggggaucgugacgcuguaccugggcgucauggugcaggccgacagcgggugcguggucuccuggaagaacaaggagcucaagugcggcagcggcaucuucaucaccgacaacgugcacaccuggaccgagcaguacaaguuccagcccgagagccccuccaagcuggccagcgcgauccagaaggcccaggaggaggggaucugcggcauccgcuccgugacgcggcuggagaaccucauguggaagcagaucacccccgagcugaaccacauccuggccgagaacgaggucaagcucaccaucaugaccggggacaucaagggcaucaugcaggccgggaagcgcagccugcggccgcagcccacggagcugaaguacuccuggaagaccuggggcaaggccaagaugcucagcaccgaguccuacaaccagaccuuccugaucgacggccccgagacgaccgagugcccgaacaccaaccgcgcguggaacagccuggagguggaggacuacggguucggcguguucaccacgaacaucuggcucaagcugaaggagaagcaggacgccuucugcgacuccaagcugaugagcgccgccaucaaggacaaccgggccguccacgcggacaugggguacuggaucgaguccgcccucaacgacaccuggaagaucgagaaggccagcuucaucgaggugaagaacugccacuggcccaagucccacacccuguggagcaacggcgugcuggaguccgagaugaucauccccaagaaccucgccggccccgucagccagcacaacuaccgcccgggguaccacacccagaucgccggccccuggcaccuggggaagcuggagauggacuucgacuucugcgacggcaccacggugaucgugaccgaggacugcgggaaccggggccccucccuccgcaccaccacggcgagcggcaagcugaucaccgaguggugcugccggagcugcacccugcccccgcuccgcuaccgcggggaggacggcugcugguacgggauggagauccgcccccugaaggagaaggaggagaaccuggucaacucccucgugaccgccggccacggccagguggacaacuucagccugggcguccugggcauggcccucuuccuggaggagaugcugcggacgcgcguggggaccaagcacgccauccuccugguggcggucuccuucaugacccugaucaccggcaacaugagcuucaaggaccucgggcgggugguggucauggugggcgccacgauggccgacgacaucgggaugggcgugaccuaccuggcccugcucgccgcguucaagguccgccccaccuucgccgccggccugcugcuccggaagcugaccuccaaggagcugaugaugacgaccaucgggaucgugcuccugagccaguccaccauccccgagaccgugcuggagcucacggacgcccuggcccugggcaugaugguccucaagaucgugcgcaacauggagaaguaccagcuggcggugaccaucauggccauccugugcgucccgaacgccgugauccuccagaacgccuggaaggucagcugcaccauccuggccgugguguccgucagcccccugcuccugaccuccagccagcagaagacggacuggaucccccuggcgcucaccaucaaggggcugaaccccaccgccaucuuccugaccacgcucucccgcaccaacaagaagcggagcuggccgcugaacgaggccaucauggccgugggcaugguguccauccuggcgagcucccuccugaagaacgacauccccaugaccggcccccuggccgccgggggccuccugaccgucugcuacgugcugacggggcgcagcgccgaccucgagcuggagcgggccaccgacgugaagugggaggaccaggcggagaucuccggcagcagccccauccuguccaucaccaucagcgaggacggguccaugagcaucaagaacgaggaggaggagcagacccucacgauccugauccgcaccggccugcucgucaucuccggccuguucccgaucagcauccccaucaccgccgccgccugguaccugugggaggugaagaagcagcgggccggggugcucugggacguccccagcccgccgcccaugggcaaggcggagcuggaggacggggccuaccgcaucaagcagaagggcauccugggguacagccagaucggcgccggcguguacaaggaggggaccuuccacaccauguggcacgugacgcggggcgccguccucaugcacaaggggaagcgcaucgagcccuccugggccgacgugaagaaggaccugaucagcuacggcgggggcuggaagcuggagggcgaguggaaggagggggaggaggugcagguccucgcgcuggagcccggcaagaacccccgggccgugcagaccaagcccgggcuguucaagaccaacaccggcacgaucggggccgugucccucgacuucagccccggcaccuccggcagccccaucaucgacaagaaggggaaggucgugggccuguacgggaacggcguggucacccgcuccggcgccuacgugagcgccaucgcgcagaccgagaaguccaucgaggacaaccccgagaucgaggacgacaucuuccggaagcgccggcugacgaucauggaccugcaccccggggccggcaagaccaagcgcuaccuccccgccaucgugcgggaggccaucaagcgcgggcugcggacccugauccucgcgccgacccgcgucguggccgccgagauggaggaggcccugcggggccugcccauccgcuaccagacgcccgccauccgggcggagcacaccgggcgcgagaucguggaccucaugugccacgccaccuucaccaugcgccugcugagccccguccgggugccgaacuacaaccucaucaucauggacgaggcccacuucacggaccccgccuccaucgccgcgcgcggcuacaucagcacccggguggagaugggcgaggccgccgggaucuucaugaccgccacgccgcccggcagccgcgacccguucccccaguccaacgcccccaucaucgacgaggagcgggagauccccgagcgcagcuggaacuccgggcacgagugggucacggacuucaagggcaagaccgugugguucgugccgagcaucaaggcggggaacgacaucgccgccugccugcggaagaacggcaagaaggucauccagcugucccgcaagaccuucgacagcgaguacgccaagacccggacgaacgacugggacuucguggugaccaccgacaucuccgagaugggcgcgaacuucaaggccgagcgcgucaucgacccccggcgcugcaugaagcccgugauccucaccgacggggaggagcgggugauccuggccggccccaugccggucacgcacagcuccgccgcccagcgccgggggcgcaucggccggaaccccaagaacgagaacgaccaguacaucuacaugggggagccccuggagaacgacgaggacugcgcgcacuggaaggaggccaagaugcuccuggacaacaucaacacccccgagggcaucaucccgagcauguucgagcccgagcgcgagaagguggacgccaucgacggcgaguaccggcugcgcggggaggcccgcaagaccuucguggaccucaugcggcgcggcgaccugcccgucuggcuggccuacaagguggcggccgaggggaucaacuacgccgaccggcgcuggugcuucgacggcaucaagaacaaccagauccucgaggagaacguggaggucgagaucuggaccaaggagggggagcggaagaagcugaagccgcgcuggcuggacucccggaucuacagcgacccccucgcccugaaggaguucaaggaguucgccgcgggccgcaagucccugacgcucaaccugaucaccgagaugggccggcugcccaccuucaugacccagaagacgcgcgacgcccucgacaaccuggccgugcugcacaccgccgaggccggcgggcgggccuacaaccacgcccucagcgagcugcccgagacccuggagacccuccugcugcucacgcugcuggccaccgugaccgggggcaucuuccucuuccugauguccggccgcgggaucggcaagaugacccuggggaugugcugcaucaucaccgccagcauccuccugugguacgcgcagauccagccgcacuggaucgccgccuccaucauccuggaguucuuccucaucguccugcugauccccgagcccgagaagcagcggacgccccaggacaaccagcucaccuacguggucaucgccauccugaccgugguggccgcgaccauggccaacgagaugggcuuccuggagaagacgaagaaggaccucgggcugggcagcaucgccacccagcagccggaguccaacauccuggacaucgaccuccgccccgccagcgccuggacccuguacgcggucgccaccacguucgugacccccaugcugcggcacagcaucgagaacuccagcgugaacgucucccucaccgccaucgccaaccaggccaccgugcuggugggccuggggaagggcuggccccucagcaagauggacaucggggucccgcugcuggcgaucggcugcuacucccaggugaaccccaucacgcucaccgccgcccugcugcuccugguggcccacuacgcgaucaucgggcccggccugcaggccaaggccacccgcgaggcccagaagcgggccgcggccggcaucaugaagaaccccaccgucgacgggaucacggugaucgaccucgacccgauccccuacgaccccaaguucgagaagcagcugggccaggugaugcugcucauccugugcgucacccaggugcugaugaugcgcaccaccugggcccucugcgaggcccugacgcuggccaccgggcccaucagcacccucugggagggcaacccggggcgguucuggaacaccacgaucgcgguguccauggccaacaucuuccgcggcagcuaccuggccggcgccgggcuccucuucuccaucaugaagaacaccaccaacacccggcgcggcacggggaacaucggcgagacccugggcgagaaguggaagucccgccugaacgcccucgggaaguccgaguuccagaucuacaagaaguccggcauccaggaggucgaccggacccuggcgaaggaggggaucaagcgcggcgagaccgaccaccacgccgugucccgggggagcgccaagcugcgcugguucguggagcggaacauggucacgcccgagggcaaggugguggaccucggcugcgggcgcggcgggugguccuacuacugcggcgggcugaagaacguccgggaggugaagggccugaccaagggcgggcccggccacgaggagcccaucccgaugagcaccuacggguggaaccucgugcgccugcaguccggcgucgacguguucuucaucccgcccgagaagugcgacacccugcucugcgacaucggggagagcucccccaacccgacgguggaggccggccggacccugcgcguccugaaccucguggagaacuggcugaacaacaacacccaguucugcaucaaggugcugaaccccuacaugcccagcgucaucgagaagauggaggcgcugcagcggaaguacggcggggcccucgugcgcaacccgcugagccggaacuccacccacgagauguacugggugagcaacgccuccggcaacaucgucagcuccgugaacaugaucagccgcaugcugaucaaccgguucaccaugcgccacaagaaggccacguacgagcccgacguggaccucggguccggcacccggaacaucgggaucgagagcgagguccccaaccuggacaucaucggcaagcgcaucgagaagaucaagcaggagcacgagaccuccuggcacuacgaccaggaccaccccuacaagaccugggccuaccacggcagcuacgagacgaagcagaccggguccgcgagcuccauggugaacggcgugguccggcugcucaccaagccgugggacgugcugcccaccgugacgcagauggccaugaccgacaccacccccuucgggcagcagcgcgucuucaaggagaagguggacacgcgcacccaggagcccaaggagggcaccaagaagcugaugaagaucaccgccgaguggcucuggaaggagcugggcaagaagaagacgccgcggaugugcacccgcgaggaguucacccggaaggugcgcagcaacgccgcccugggggcgaucuucaccgacgagaacaaguggaaguccgcccgggaggccgucgaggacagccgcuucugggagcucguggacaaggagcggaaccugcaccuggagggcaagugcgagacgugcguguacaacaugauggggaagcgcgagaagaagcucggcgaguucgggaaggccaagggcucccgggccaucugguacauguggcugggcgcgcgcuuccuggaguucgaggcccucggguuccugaacgaggaccacugguucagccgggagaacucccugagcggcgucgagggggagggccuccacaagcugggguacauccugcgcgacgugagcaagaaggagggcggcgccauguacgccgacgacaccgcggggugggacacccggaucacccucgaggaccugaagaacgaggagauggucacgaaccacauggagggcgagcacaagaagcuggccgaggccaucuucaagcucaccuaccagaacaagguggugcgcguccagcggcccacgccccgggggaccgugauggacaucaucucccggcgcgaccagcggggcagcggccagguggggacguacggccugaacaccuucaccaacauggaggcccagcugauccgccagauggagggggagggcgucuucaagaacauccagcaccucaccgugacggaggagguggccguccagaacuggcuggcgcggguggggcgcgagcgccugucccggauggccaucagcggcgacgacugcguggucaagccccucgacgaccgcuucgccaacgcccugaccgcccugaacgacaugggcaagauccggaaggacauccagcagugggagccguccaagggguggaacgacuggacccaggugcccuucugcagccaccacuuccacgagcucaucaugaaggacggccgcgugcuggucgugcccugccggaaccaggacgagcugaucgggcgcgcgcggaucucccagggcgccggguggagccuccgcgagaccgccugccugggcaaguccuacgcccagauguggagccugauguacuuccaccggcgcgaccuccggcuggccgcgaacgccaucugcuccgccgugcccagccacugggucccgacgucccgcaccaccuggagcauccacgccaagcacgaguggaugaccaccgaggacaugcugacgguguggaaccggguguggauccgcgagaaccccuggauggaggacaagacccccgucgaguccugggaggagauccccuaccucggcaagcgggaggaccaguggugcgggagccugaucggccugaccucccgcgccaccugggcgaagaacauccaggccgccaucaaccaggugcggagccucaucgggaacgaggaguacacggacuacaugccgagcaugaagcgcuuccggcgcgaggaggaggaggccggcgugcugugguga

SEQ ID NO: 9170 - RNA, 9876 nt, Artificial Sequence
  derived and/or modified CDS sequence (opt1) from DENV-2__FJ639708__SS-prME
agcgcggggaugaucaucaugcugauccccaccgugauggccuuccaccucaccacccgcaacggggagccccacaugaucgucggcauccaggagaaggggaagucccugcuguucaagaccgaggacggcgugaacaugugcacccucauggcgauggaccugggggagcugugcgaggacaccaucaccuacaagugcccccuccugcggcagaacgagcccgaggacaucgacugcuggugcaacagcaccagcaccugggugaccuacgggaccugcaccaccaccggcgagcaccgccgggagaagcgcagcgucgcccuggugccccacguggggaugggccucgagacccggaccgagaccuggauguccagcgagggggccuggaagcacgcccagcgcaucgagaccuggauccugcggcacccgggcuucacgaucauggccgcgauccuggccuacaccaucgggaccacccacuuccagcgcguccucaucuucauccugcugacggccguggcccccuccaugaccaugcggugcaucggcaucagcaaccgcgacuucguggagggcgucuccgggggcagcuggguggacaucgugcucgagcacggguccugcgucaccaccauggcgaagaacaagcccacgcuggacuucgagcugaucaagaccgaggccaagcagcccgccacccuccggaaguacugcaucgaggccaagcugaccaacacgaccaccgagagccgcugccccacccagggcgagcccucccugaaggaggagcaggacaagcgguucgugugcaagcacagcaugguggaccgcggcugggggaacggcugcggccuguucggcaagggcgggaucgucacgugcgccauguucacgugcaagaagaacauggagggcaagaucgugcagcccgagaaccuggaguacaccaucguggucacgccccacuccggggaggagcacgcggugggcaacgacacggggaagcacggcaaggagaucaaggugaccccgcagagcuccaucaccgaggccgagcugaccggguacggcaccgucacgauggagugcagcccccggaccggccucgacuucaacgagauggugcugcugcagauggagaacaaggccuggcucgugcaccgccagugguuccuggaccugccccuccccuggcugccgggggccgacaagcaggaguccaacuggauccagaaggagacccuggucaccuucaagaacccccacgccaagaagcaggacguggucgugcucggcagccaggagggggcgaugcacacggcccugaccggcgccaccgagauccagaugagcuccgggaaccuccuguucaccggccaccugaagugccggcugcgcauggacaagcuccagcugaagggcaugagcuacuccaugugcacggggaaguucaagguggucaaggagaucgccgagacccagcacggcaccaucgugauccgggugcaguacgagggggacggcagccccugcaagauccccuucgagaucauggaccuggagaagcgcuacauccucggccggcugaucaccgucaacccgaucgugacggagaaggacucccccgugaacaucgaggccgagccgcccuucggggacagcuacaucaucaucggcgucgagccggggcagcugaagcucaacugguucaagaagggcuccagcaucgggcagauguucgagaccaccaugcgcggcgcgaagcgcauggccauccugggcgacaccgccugggacuucgggucccugggcgggguguucacgagcaucggcaaggcccuccaccagguguucggggccaucuacggcgcggccuucuccggcgucagcuggaccaugaagauccugaucggggugaucaucaccuggaucggcaugaacucccggagcaccucccugagcgugucccugguccucguggggaucgugacgcuguaccugggcgucauggugcaggccgacagcgggugcguggucuccuggaagaacaaggagcucaagugcggcagcggcaucuucaucaccgacaacgugcacaccuggaccgagcaguacaaguuccagcccgagagccccuccaagcuggccagcgcgauccagaaggcccaggaggaggggaucugcggcauccgcuccgugacgcggcuggagaaccucauguggaagcagaucacccccgagcugaaccacauccuggccgagaacgaggucaagcucaccaucaugaccggggacaucaagggcaucaugcaggccgggaagcgcagccugcggccgcagcccacggagcugaaguacuccuggaagaccuggggcaaggccaagaugcucagcaccgaguccuacaaccagaccuuccugaucgacggccccgagacggcggagugcccgaacaccaaccgcgccuggaacagccuggagguggaggacuacggguucggcguguucaccaccaacaucuggcucaagcugaaggagaagcaggacgccuucugcgacuccaagcugaugagcgccgccaucaaggacaaccgggcgguccacgccgacaugggguacuggaucgaguccgcccucaacgacacguggaagaucgagaaggccagcuucaucgaggugaagaacugccacuggcccaagucccacacccuguggagcaacggcgugcuggaguccgagaugaucauccccaagaaccucgccggccccgucagccagcacaacuaccgcccgggguaccacacccagaucgcgggccccuggcaccuggggaagcuggagauggacuucgacuucugcgacggcaccaccgugaucgugacggaggacugcgggaaccggggccccucccuccgcaccaccaccgccagcggcaagcugaucacggaguggugcugccggagcugcacccugcccccgcuccgcuaccgcggggaggacggcugcugguacgggauggagauccgcccccugaaggagaaggaggagaaccuggucaacucccucgugaccgccggccacggccagguggacaacuucagccugggcguccugggcauggcccucuuccuggaggagaugcugcggacccgcguggggacgaagcacgcgauccuccugguggccgucuccuucaugacccugaucaccggcaacaugagcuucaaggaccucgggcgggugguggucauggugggcgccaccauggccgacgacaucgggaugggcgugacguaccuggcccugcucgcggccuucaagguccgccccaccuucgccgccggccugcugcuccggaagcugaccuccaaggagcugaugaugaccacgaucgggaucgugcuccugagccaguccaccauccccgagaccgugcuggagcucaccgacgcccuggcgcugggcaugaugguccucaagaucgugcgcaacauggagaaguaccagcuggccgugacgaucauggccauccugugcgucccgaacgccgugauccuccagaacgccuggaaggucagcugcaccauccuggcggugguguccgucagcccccugcuccugaccuccagccagcagaagaccgacuggaucccccuggcccucacgaucaaggggcugaaccccaccgccaucuuccugaccacccucucccgcacgaacaagaagcggagcuggccgcugaacgaggccaucauggcggugggcaugguguccauccuggccagcucccuccugaagaacgacauccccaugaccggcccccuggucgccgggggccuccugaccgugugcuacgugcugaccgggcgcagcgccgaccucgagcuggagcgggccacggacgucaagugggaggaccaggcggagaucuccggcagcagccccauccuguccaucaccaucagcgaggacggguccaugagcaucaagaacgaggaggaggagcagacccucaccauccugauccgcacgggccugcucgugaucuccggccuguucccgaucagcauccccaucaccgccgccgccugguaccugugggaggugaagaagcagcgggccgggguccucugggacgugcccagcccgccgcccaugggcaaggcggagcuggaggacggggccuaccgcaucaagcagaagggcauccugggguacagccagaucggcgccggcguguacaaggaggggaccuuccacaccauguggcacgucacccggggcgccgugcucaugcacaaggggaagcgcaucgagcccuccugggccgacgugaagaaggaccugaucagcuacggcgggggcuggaagcuggagggcgaguggaaggagggggaggagguccaggugcucgcgcuggagcccggcaagaacccccgggccgugcagacgaagcccgggcuguucaagaccaacaccggcaccaucggggccgucucccucgacuucagccccggcacguccggcagccccaucaucgacaagaaggggaagguggugggccuguacgggaacggcgucgugacccgcuccggcgccuacgugagcgccaucgcgcagaccgagaaguccaucgaggacaaccccgagaucgaggacgacaucuuccggaagcgccggcugaccaucauggaccugcaccccggggccggcaagacgaagcgcuaccuccccgccaucguccgggaggccaucaagcgcgggcugcggacccugauccucgcgccgacccgcgugguggccgccgagauggaggaggcccugcggggccugcccauccgcuaccagacccccgccauccgggcggagcacacggggcgcgagaucgucgaccucaugugccacgccaccuucaccaugcgccugcugagccccgugcgggugccgaacuacaaccucaucaucauggacgaggcccacuucaccgaccccgccuccaucgccgcgcgcggcuacaucagcacgcgggucgagaugggcgaggccgccgggaucuucaugaccgccacgccgcccggcagccgcgacccguucccccaguccaacgcccccaucaucgacgaggagcgggagauccccgagcgcagcuggaacuccgggcacgagugggugaccgacuucaagggcaagacggugugguucgucccgagcaucaaggcggggaacgacaucgccgccugccugcggaagaacggcaagaaggugauccagcugucccgcaagaccuucgacagcgaguacgugaagacccggaccaacgacugggacuucgucgugacgaccgacaucuccgagaugggcgccaacuucaaggcggagcgcgugaucgacccccggcgcugcaugaagcccgucauccucaccgacggggaggagcgggugauccuggccggccccaugccggugacccacagcuccgccgcccagcgccgggggcgcaucggccggaaccccaagaacgagaacgaccaguacaucuacaugggggagccccuggagaacgacgaggacugcgcccacuggaaggaggcgaagaugcuccuggacaacaucaacacgcccgagggcaucaucccgagcauguucgagcccgagcgcgagaaggucgacgccaucgacggcgaguaccggcugcgcggggaggcccgcaagaccuucguggaccucaugcggcgcggcgaccugcccguguggcuggccuacaaggucgccgcggaggggaucaacuacgccgaccggcgcuggugcuucgacggcaucaagaacaaccagauccucgaggagaacguggagguggagaucuggaccaaggagggggagcggaagaagcugaagccgcgcuggcuggacgcccggaucuacuccgacccccucgcccugaaggaguucaaggaguucgccgcgggccgcaagagccugacccucaaccugaucacggagaugggccggcugcccaccuucaugacccagaagacccgcgacgcccucgacaaccuggccguccugcacacggccgaggccggcgggcgggccuacaaccacgcccucuccgagcugcccgagacccuggagacccuccugcugcucacccugcuggccacggugaccgggggcaucuuccucuuccugaugagcggccgcgggaucggcaagaugacccuggggaugugcugcaucaucaccgccuccauccuccugugguacgcgcagauccagccgcacuggaucgccgccagcaucauccuggaguucuuccucaucguccugcugauccccgagcccgagaagcagcggacgccccaggacaaccagcucacguacguggugaucgccauccugaccgucguggccgcgaccauggccaacgagaugggcuuccuggagaagaccaagaaggaccucgggcugggcuccaucgccacgcagcagccggagagcaacauccuggacaucgaccuccgccccgccuccgccuggacccuguacgcgguggccaccaccuucgucacgcccaugcugcggcacagcaucgagaacagcuccgugaacgugagccucaccgccaucgccaaccaggccaccguccugaugggccuggggaagggcuggccccucuccaagauggacaucggggugccgcugcuggcgaucggcugcuacagccaggugaaccccaucacccucacggccgcccugcugcuccuggucgcccacuacgcgaucaucgggcccggccugcaggccaaggccacccgcgaggcccagaagcgggccgcggccggcaucaugaagaaccccaccguggacgggaucaccgugaucgaccucgacccgauccccuacgaccccaaguucgagaagcagcugggccaggucaugcugcucauccugugcgugacccaggugcugaugaugcgcaccaccugggcccucugcgaggcccugacccuggccacggggcccaucuccacccucugggagggcaacccggggcgguucuggaacaccaccaucgcggucagcauggccaacaucuuccgcggcuccuaccuggccggcgccgggcuccucuucagcaucaugaagaacacgaccaacacccggcgcggcaccgggaacaucggcgagacgcugggcgagaaguggaagucccgccugaacgcccucgggaaguccgaguuccagaucuacaagaaguccggcauccaggagguggaccggacccuggcgaaggaggggaucaagcgcggcgagaccgaccaccacgccgugagccggggguccgccaagcugcgcugguucgucgagcggaacauggugacccccgagggcaagguggucgaccucggcugcgggcgcggcggguggagcuacuacugcggcgggcugaagaacgugcgggaggugaagggccugacgaagggcgggcccggccacgaggagcccaucccgauguccaccuacggguggaaccucguccgccugcagagcggcguggacguguucuucaucccgcccgagaagugcgacacccugcucugcgacaucggggaguccagccccaacccgaccgucgaggccggccggacgcugcgcgugcugaaccucguggagaacuggcugaacaacaacacccaguucugcaucaagguccugaaccccuacaugcccuccgugaucgagaagauggaggcgcugcagcggaaguacggcggggcccucgugcgcaacccgcugagccggaacagcacccacgagauguacugggucuccaacgccagcggcaacaucguguccagcgugaacaugaucucccgcaugcugaucaaccgguucaccaugcgccacaagaaggccaccuacgagcccgacgucgaccucgggagcggcacgcggaacaucgggaucgaguccgaggugcccaaccuggacaucaucggcaagcgcaucgagaagaucaagcaggagcacgagaccagcuggcacuacgaccaggaccaccccuacaagaccugggccuaccacggcuccuacgagaccaagcagacggggagcgcguccagcauggugaacggcgucgugcggcugcucaccaagccgugggacgugcugcccaccgucacccagauggccaugacggacaccacccccuucgggcagcagcgcguguucaaggagaagguggacacccgcacgcaggagcccaaggagggcaccaagaagcugaugaagaucaccgccgaguggcucuggaaggagcugggcaagaagaagaccccgcggaugugcacgcgcgaggaguucacccggaagguccgcuccaacgccgcccugggggcgaucuucaccgacgagaacaaguggaaguccgcccgggaggccguggaggacucccgcuucugggagcucguggacaaggagcggaaccugcaccuggagggcaagugcgagaccugcgucuacaacaugauggggaagcgcgagaagaagcucggcgaguucgggaaggccaagggcagccgggccaucugguacauguggcugggcgcgcgcuuccuggaguucgaggcccucggguuccugaacgaggaccacugguucucccgggagaacagccuguccggcguggagggggagggccuccacaagcugggguacauccugcgcgacgucagcaagaaggagggcggcgccauguacgccgacgacacggcggggugggacacccggaucacccucgaggaccugaagaacgaggagauggugaccaaccacauggagggcgagcacaagaagcuggccgaggccaucuucaagcucacguaccagaacaaggugguccgcgugcagcggcccacgccccgggggaccgugauggacaucaucagccggcgcgaccagcggggcuccgggcaggucggcaccuacggccugaacacguucaccaacauggaggcccagcugauccgccagauggagggggagggcguguucaagaacauccagcaccucaccgugaccgaggaggucgccgugcagaacuggcuggcgcggguggggcgcgagcgccugagccggauggccaucuccggcgacgacugcgucgugaagccccucgacgaccgcuucgccaacgcccugacggcccugaacgacaugggcaagauccggaaggacauccagcagugggagccgagcaagggguggaacgacuggacccaggugcccuucugcucccaccacuuccacgagcucaucaugaaggacggccgcguccugguggugcccugccggaaccaggacgagcugaucgggcgcgcgcggaucagccagggcgccggguggucccuccgcgagaccgccugccugggcaagagcuacgcccagauguggucccugauguacuuccaccggcgcgaccuccggcuggccgcgaacgccaucugcagcgccguccccucccacugggugccgaccagccgcacgaccugguccauccacgccaagcacgaguggaugaccaccgaggacaugcugaccguguggaaccgggucuggauccgcgagaaccccuggauggaggacaagacgcccguggagagcugggaggagauccccuaccucggcaagcgggaggaccaguggugcgggucccugaucggccugaccagccgcgccaccugggcgaagaacauccaggccgccaucaaccaggugcggucccucaucgggaacgaggaguacaccgacuacaugccgagcaugaagcgcuuccggcgcgaggaggaggaggccggcguccugugguga

SEQ ID NO: 9171 - RNA, 9876 nt, Artificial Sequence
  derived and/or modified CDS sequence (opt1) from DENV-2__FJ639709__SS-prME
agcgccggcaugaucaucaugcugauccccaccgugauggccuuccaccucaccacccggaacggggagccccacaugaucgugggcauccaggagaagggcaagagccugcuguucaagaccgaggacggggugaacaugugcacccucauggcgauggaccugggggagcugugcgaggacaccaucaccuacaagugcccccuccugcggcagaacgagcccgaggacaucgacugcuggugcaacagcaccagcaccugggugaccuacggcacgugcaccaccaccggcgagcaccgccgggagaagcgcagcgucgcccuggugccccacguggggaugggccucgagacgcggaccgagaccuggaugagcagcgagggggccuggaagcacgcccagcgcaucgagaccuggauccugcggcacccgggcuucacgaucauggccgcgauccuggccuacaccaucgggaccacccacuuccagcgcgcccucaucuucauccugcugacggccgucgcgcccuccaugaccaugcggugcaucggcaucagcaaccgcgacuucguggagggcguguccgggggcagcugggucgacaucgugcucgagcacggguccugcgugaccaccauggccaagaacaagcccacgcuggacuucgagcugaucaagaccgaggccaagcagcccgccacccuccggaaguacugcaucgaggccaagcugaccaacacgaccaccgagagccgcugccccacccagggcgagcccucccugaaggaggagcaggacaagcgguucgucugcaagcacagcaugguggaccgcggcugggggaacggcugcgggcuguucggcaagggcgggaucgugacgugcgcgauguucacgugcaagaagaacauggagggcaagaucguccagcccgagaaccuggaguacaccaucguggugacgccccacuccggggaggagcacgccgucggcaacgacacggggaagcacggcaaggagaucaaggugaccccgcagagcuccaucaccgaggccgagcugaccggguacggcaccgugacgauggagugcagcccccggaccggccucgacuucaacgagaugguccugcugcagauggagaacaaggccuggcucgugcaccgccagugguuccuggaccugccccuccccuggcugccgggggccgacaagcagggcuccaacuggauccagaaggagacccuggugaccuucaagaacccccacgcgaagaagcaggacgucgugguccucgggagccaggagggcgccaugcacacggcccugaccggggccaccgagauccagaugagcuccggcaaccuccuguucaccggccaccugaagugccggcugcgcauggacaagcuccagcugaaggggaugagcuacuccaugugcacgggcaaguucaagguggugaaggagaucgccgagacccagcacgggaccaucgucauccgggugcaguacgagggcgacggcagccccugcaagauccccuucgagaucauggaccuggagaagcgcuacgugcucgggcggcugaucaccgucaacccgaucgugacggagaaggacucccccgugaacaucgaggcggagccgcccuucggcgacagcuacaucaucaucggggucgagccgggccagcugaagcucaacugguucaagaagggguccagcaucggccagauguucgagaccaccaugcgcggcgccaagcgcauggccauccugggggacaccgccugggacuucggcucccucggcgggguguucacgagcaucgggaaggcccuccaccagguguucggggcgaucuacggcgccgccuucuccggggucagcuggaccaugaagauccugaucggcgugaucaucaccuggaucgggaugaacucccggagcaccucccugagcgugucccugguccucgugggcaucgugacgcuguaccugggggucauggugcaggccgacagcggcugcguggucuccuggaagaacaaggagcucaagugcggcagcgggaucuucaucaccgacaacgugcacaccuggaccgagcaguacaaguuccagcccgagagccccuccaagcuggcgagcgccauccagaaggcccaggaggagggcaucugcgggauccgcuccgugacgcggcuggagaaccucauguggaagcagaucacccccgagcugaaccacauccuggccgagaacgaggucaagcucaccaucaugaccggcgacaucaaggggaucaugcaggccggcaagcgcagccugcggccgcagcccacggagcugaaguacuccuggaagaccuggggcaaggcgaagaugcucagcaccgagucccacaaccagaccuuccugaucgacgggcccgagacggccgagugcccgaacaccaaccgcgccuggaacagccuggagguggaggacuacggcuucgggguguucaccaccaacaucuggcucaagcugaaggagaagcaggacgccuucugcgacuccaagcugaugagcgccgcgaucaaggacaaccgggccguccacgccgacaugggcuacuggaucgaguccgcccucaacgacacguggaagaucgagaaggccagcuucaucgaggugaagaacugccacuggcccaagucccacacccuguggagcaacggcgugcuggaguccgagaugaucauccccaagaaccucgcggggcccgucagccagcacaacuaccgcccgggcuaccacacccagaucgccgggcccuggcaccugggcaagcuggagauggacuucgacuucugcgacgggaccaccgugaucgugacggaggacugcggcaaccggggccccucccuccgcaccaccaccgccagcgggaagcugaucacggaguggugcugccggagcugcacccugcccccgcuccgcuaccggggcgaggacgggugcugguacggcauggagauccgcccccugaaggagaaggaggagaaccuggucaacucccucgugaccgccgggcacggccagguggacaacuucagccugggcguccuggggauggcccuguuccuggaggagaugcugcggacccgcgugggcacgaagcacgccauccuccugguggccgucuccuucgugacccugaucaccgggaacaugagcuucaaggaccucggccggguggucgugauggugggggccaccaugacggacgacaucggcaugggcgucaccuaccuggcccugcucgcggccuucaaggugcgccccaccuucgccgccgggcugcugcuccggaagcugaccuccaaggagcugaugaugacgaccaucggcaucgugcuccugagccagaccaccauccccgagacgauccuggagcucaccgacgcccuggcgcuggggaugaugguccucaagaucgugcgcgacauggagaaguaccagcuggccgugaccaucauggccauccugugcgucccgaacgccgugauccuccagaacgccuggaaggucuccugcaccauccuggcgguggugagcgucagcccccugcuccugacgagcucccagcagaagaccgacuggaucccccuggcccucaccaucaagggccugaaccccaccgccaucuuccugacgacccucagccgcaccaacaagaagcgguccuggccgcugaacgaggccaucauggcggugggcauggugagcauccuggccuccagccuccugaagaacgacauccccaugaccgggccccuggucgccggcgggcuccugacggugugcuacgugcugaccggccgcuccgccgaccucgagcuggagcgggccaccgacgucaagugggaggaccaggcggagaucagcggguccagccccauccugagcaucaccaucuccgaggacggcagcauguccaucaagaacgaggaggaggagcagacgcucaccauccugauccgcaccggccugcucgugaucagcgggcuguucccgguguccauccccaucaccgccgccgccugguaccugugggaggucaagaagcagcgggccggcgugcucugggacgugcccuccccgccgcccauggggaaggcggagcuggaggacggcgccuaccgcaucaagcagaaggggauccugggcuacucccagaucggcgccggggucuacaaggagggcaccuuccacacgauguggcacgugacccgcggggcggugcucaugcacaagggcaagcgcaucgagcccagcugggccgacgucaagaaggaccugaucuccuacgggggcggcuggaagcuggagggggaguggaaggagggcgaggagguccaggugcucgcgcuggagcccgggaagaacccccgggccguccagaccaagcccggccuguucaagaccaacacggggaccaucggcgccgugagccucgacuucucccccggcaccagcgggucccccaucaucgacaagaagggcaagguggucgggcuguacggcaacggcguggugacccgcagcggggccuacgucuccgccaucgcgcagacggagaaguccaucgaggacaaccccgagaucgaggacgacaucuuccggaagcgccggcugaccaucauggaccugcaccccggcgccgggaagaccaagcgcuaccuccccgccaucgugcgggaggccaucaagcgcggccugcggacccugauccucgcgccgacgcgcguggucgccgccgagauggaggaggcccugcgggggcugcccauccgcuaccagacccccgccauccgggcggagcacaccggccgcgagaucguggaccucaugugccacgccaccuucacgaugcgccugcugucccccgugcgggucccgaacuacaaccucaucaucauggacgaggcccacuucaccgaccccgccagcaucgccgcgcgcggcuacaucuccacccggguggagaugggggaggccgccggcaucuucaugaccgccacgccgcccgggagccgcgacccguucccccagagcaacgcccccaucaucgacgaggagcgggagauccccgagcgcuccuggaacagcggccacgagugggugaccgacuucaaggggaagaccgucugguucgugccguccaucaaggcgggcaacgacaucgccgccugccugcggaagaacggcaagaaggugauccagcugagccgcaagaccuucgacuccgaguacgucaagacgcggaccaacgacugggacuucguggugaccaccgacaucagcgagaugggggccaacuucaaggcggagcgcgucaucgacccccggcgcugcaugaagcccgugauccucacggacggcgaggagcgggugauccuggccgggcccaugccggucacccacuccagcgccgcccagcgccggggccgcaucgggcggaaccccaagaacgagaacgaccaguacaucuacaugggcgagccccuggagaacgacgaggacugcgcccacuggaaggaggcgaagaugcuccuggacaacaucaacacccccgagggcaucaucccguccauguucgagcccgagcgcgagaagguggacgccaucgacggggaguaccggcugcgcggcgaggcccgcaagaccuucguggaccucaugcggcgcggggaccugcccgucuggcuggccuacaagguggccgcggagggcaucaacuacgccgaccggcgcuggugcuucgacgggaucaagaacaaccagauccucgaggagaacguggaggucgagaucuggacgaaggagggcgagcggaagaagcugaagccgcgcuggcuggacgcccggaucuacagcgacccccucgcccugaaggaguucaaggaguucgccgcgggccgcaagucccugacccucaaccugaucaccgagauggggcggcugcccaccuucaugacgcagaagacccgcgacgcccucgacaaccuggccgugcugcacaccgccgaggcgggcgggcgggccuacaaccacgcccucagcgagcugcccgagacccuggagacgcuccugcugcucacccugcuggccaccgucaccggcggcaucuuccucuuccugauguccgggcgcggcaucgggaagaugacccugggcaugugcugcaucaucacggccagcauccuccuguggaacgcgcagauccagccgcacuggaucgccgccuccaucauccuggaguucuuccucaucgugcugcugauccccgagcccgagaagcagcggacgccccaggacaaccagcucaccuacguggucaucgccauccugaccgugguggccgcgacgauggccaacgagaugggguuccuggagaagaccaagaaggaccucggccugggcagcaucgccacccagcagccggaguccaacauccuggacaucgaccuccgccccgccagcgccuggacccuguacgcggucgccacgaccuucgugacccccaugcugcggcacuccaucgagaacagcagcgugaacgucucccucaccgccaucgccaaccaggccacggugcugauggggcugggcaagggguggccccucagcaagauggacaucggcgugccgcugcuggcgaucgggugcuacucccaggucaaccccaucacccucaccgccgcccugcugcuccugguggcccacuacgcgaucaucggccccggccugcaggccaaggccacccgcgaggcccagaagcgggccgcggccgggaucaugaagaaccccacgguggacggcaucaccgucaucgaccucgacccgauccccuacgaccccaaguucgagaagcagcugggccaggugaugcugcucauccugugcgugacccagguccugaugaugcgcaccacgugggcccucugcgaggcccugacccuggccaccggccccaucagcacccucugggaggggaacccgggccgguucuggaacacgaccaucgcgguguccauggccaacaucuuccgcggcagcuaccuggccggggccggccuccucuucuccaucaugaagaacaccaccaacacgcggcgcgggaccggcaacaucggcgagacccugggggagaaguggaagucccgccugaacgcccucggcaaguccgaguuccagaccuacaagaaguccgggauccaggagguggaccggacgcuggcgaaggagggcaucaagcgcggggagaccgaccaccacgccgucucccggggcagcgccaagcugcgcugguucguggagcggaacauggugacccccgagggcaaggucguggaccucgggugcggccgcgggggcugguccuacuacugcgggggccugaagaacgugcgggaggucaagggccugaccaagggcgggcccgggcacgaggagcccaucccgaugagcacguacggcuggaaccucgugcgccugcaguccgggguggacgucuucuucaucccgcccgagaagugcgacacccugcucugcgacaucggcgagagcucccccaacccgaccguggaggccggccggacccugcgcgugcugaaccucgucgagaacuggcugaacaacaacacccaguucugcaucaaggugcugaaccccuacaugcccagcgugaucgagaagauggaggcgcugcagcggaaguacgggggcgcccucguccgcaacccgcugucccggaacagcacgcacgagauguacugggugagcaacgccuccgggaacaucgugagcuccgucaacaugaucagccgcaugcugaucaaccgguucaccaugcgccacaagaaggccaccuacgagcccgacguggaccucggcuccgggacccggaacaucggcaucgagagcgagauccccaaccuggacaucaucggcaagcgcaucgagaagaucaagcaggagcacgagacguccuggcacuacgaccaggaccaccccuacaagaccugggccuaccacgggagcuacgagaccaagcagaccggcuccgcgagcuccauggugaacggggucgugcggcugcucacgaagccgugggacgugcugcccaccgucacccagauggccaugaccgacacgacccccuucggccagcagcgcguguucaaggagaagguggacacccgcacccaggagcccaaggagggcacgaagaagcugaugaagaucaccgccgaguggcucuggaaggagcuggggaagaagaagaccccgcggaugugcacccgcgaggaguucacgcggaagguccgcagcaacgccgcccugggcgcgaucuucaccgacgagaacaaguggaaguccgcccgggaggccguggaggacagccgcuucugggagcucguggacaaggagcggaaccugcaccuggaggggaagugcgagaccugcgucuacaacaugaugggcaagcgcgagaagaagcucggggaguucggcaaggccaagggcucccgggccaucugguacauguggcugggggcgcgcuuccuggaguucgaggcccucggcuuccugaacgaggaccacugguucagccgggagaacucccugagcgggguggagggcgaggggcuccacaagcugggcuacauccugcgcgacgucuccaagaaggagggcggggccauguacgccgacgacaccgcgggcugggacacgcggaucacccucgaggaccugaagaacgaggagauggugaccaaccacauggagggggagcacaagaagcuggccgaggccaucuucaagcucaccuaccagaacaaggugguccgcgugcagcggcccacgccccgcggcaccgugauggacaucaucagccggcgcgaccagcgggggagcggccaggucggcaccuacgggcugaacaccuucacgaacauggaggcccagcugauccgccagauggagggcgaggggguguucaagaacauccagcaccucaccgccaccgaggagguggcgguccagaacuggcuggcccgggugggccgcgagcgccugucccggauggccaucagcggcgacgacugcguggucaagccccucgacgaccgcuucgccaacgcccugaccgcgcugaacgacauggggaagauccggaaggacauccagcagugggagccguccaagggcuggaacgacuggacccaggugcccuucugcagccaccacuuccacgagcucaucaugaaggacgggcgcgugcuggucgugcccugccggaaccaggacgagcugaucggccgcgcccggaucucccagggggccggcuggagccuccgcgagaccgccugccugggcaaguccuacgcccagauguggagccugauguacuuccaccggcgcgaccuccggcuggcggccaacgccaucugcuccgccgugcccagccacugggucccgaccucccgcaccaccuggagcauccacgccaagcacgaguggaugacgaccgaggacaugcugaccguguggaaccggguguggauccgcgagaaccccuggauggaggacaagacccccgucgaguccugggaggagauccccuaccucgggaagcgggaggaccaguggugcggcagccugaucgggcugacgucccgcgcgaccugggccaagaacauccaggccgccaucaaccaggugcggagccucaucggcaacgaggaguacaccgacuacaugccguccaugaagcgcuuccggcgcgaggaggaggaggcgggggugcugugguga

SEQ ID NO: 9172 - RNA, 9876 nt, Artificial Sequence
  derived and/or modified CDS sequence (opt1) from DENV-2__FJ639710__SS-prME
agcgcgggcaugaucaucaugcugauccccaccgugauggccuuccaccucaccacccggaacggggagccccacaugaucgucggcauccaggagaagggcaagagccugcuguucaagaccgaggacggcgugaacaugugcacccucauggcgauggaccugggggagcugugcgaggacaccaucaccuacaagugcccccuccugcggcagaacgagcccgaggacaucgacugcuggugcaacagcaccuccaccugggugaccuacgggaccugcaccaccaccggcgagcaccgccgggagaagcggagcgucgcccuggugccccacguggggaugggccucgagacccggaccgagaccuggauguccagcgagggggccuggaagcacgcccagcgcaucgagaccuggauccugcggcacccgggcuucacgaucauggccgcgauccuggccuacaccaucgggaccacccacuuccagcgcgcccucaucuucauccugcugacggccgucgcgcccuccaugaccaugcggugcaucggcaucagcaaccgcgacuucguggagggcguguccgggggcagcugggucgacaucgugcucgagcacggguccugcgugaccaccauggccaagaacaagcccacgcuggacuucgagcugaucaagaccgaggccaagcagcccgccacccuccggaaguacugcaucgaggccaagcugaccaacacgaccaccgagagccgcugccccacccagggcgagcccucccugaaggaggagcaggacaagcgguucgucugcaagcacagcaugguggaccgcggcugggggaacggcugcgggcuguucggcaagggggcgaucgugacgugcgccauguucacgugcaagaagaacauggagggcaagaucguccagcccgagaaccuggaguacaccaucguggugacgccccacuccggcgaggagcacgccgucgggaacgacacgggcaagcacgggaaggagaucaaggugaccccgcagagcuccaucaccgaggccgagcugaccggcuacgggaccgugacgauggagugcagcccccggaccggccucgacuucaacgagaugguccugcugcagauggagaacaaggccuggcucgugcaccgccagugguuccuggaccugccccuccccuggcugccgggcgcggacaagcaggaguccaacuggauccagaaggagacccuggugaccuucaagaacccccacgccaagaagcaggacgucgugguccucgggagccaggagggcgccaugcacacggcccugaccggggccaccgagauccagaugagcuccggcaaccuccuguucaccgggcaccugaagugccggcugcgcauggacaagcuccagcugaagggcaugagcuacuccaugugcacgggcaaguucaagguggugaaggagaucgcggagacccagcacgggaccaucgucauccgggugcaguacgagggcgacgggagccccugcaagauccccuucgagaucauggaccuggagaagcgcuacgugcucggccggcugaucaccgucaacccgaucgugacggagaaggacucccccgugaacaucgaggccgagccgcccuucggcgacagcuacaucaucaucggggucgagccgggccagcugaagcucaacugguucaagaagggguccagcaucggccagauguucgagaccaccaugcgcggggccaagcgcauggccauccugggcgacaccgccugggacuucggcucccucggcgggguguucacgagcaucgggaaggcgcuccaccagguguucggggccaucuacggggccgccuucuccggcgucagcuggaccaugaagauccugaucggcgugaucaucaccuggaucgggaugaacucccggagcaccucccugagcgugucccugauccucgucggcaucgugacgcuguaccugggggugaugguccaggcggacagcggcugcgugguguccuggaagaacaaggagcucaagugcgggagcggcaucuucaucaccgacaacguccacaccuggaccgagcaguacaaguuccagcccgagagccccuccaagcuggccagcgccauccagaaggcccaggaggagggcaucugcgggauccgcuccgugacgcggcuggagaaccucauguggaagcagaucacccccgagcugaaccacauccuggccgagaacgaggugaagcucaccaucaugaccggcgacaucaaggggaucaugcaggcgggccgccggagccugcgcccgcagcccacggagcugaaguacuccuggaagaccugggggaaggccaagaugcucagcaccgaguccuacaaccagaccuuccugaucgacggccccgagacgaccgagugcccgaacaccaaccgggccuggaacagccuggaggucgaggacuacggcuucgggguguucaccacgaacaucuggcucaagcugaaggagaagcaggacgccuucugcgacuccaagcugaugagcgccgcgaucaaggacaaccgcgccgugcacgccgacaugggcuacuggaucgaguccgcccucaacgacaccuggaagaucgagaaggccagcuucaucgaggucaagaacugccacuggcccaagucccacacccuguggagcaacggggugcuggaguccgagaugaucauccccaagaaccucgcgggccccgugagccagcacaacuaccggccgggcuaccacacccagaucgccgggcccuggcaccugggcaagcuggagauggacuucgacuucugcgacgggaccacggucaucgugaccgaggacugcggcaaccgcgggcccucccuccggaccaccacggccagcggcaagcugaucaccgaguggugcugccgcagcugcacccugcccccgcuccgguaccgcggcgaggacgggugcugguacggcauggagauccggccccugaaggagaaggaggagaaccuggugaacucccucgucaccgccgggcacggccagguggacaacuucagccugggggugcugggcauggcccuguuccuggaggagaugcugcgcacgcgggucggcaccaagcacgccauccuccugguggccguguccuucgucacccugaucaccgggaacaugagcuucaaggaccucggccgcgugguggucauggugggggccacgauggccgacgacaucggcaugggggugaccuaccuggcgcugcucgccgccuucaagguccggcccaccuucgccgccggccugcugcuccgcaagcugaccuccaaggagcugaugaugacgaccaucggcaucgugcuccugagccaguccaccauccccgagaccauccuggagcucacggacgcgcuggcccuggggaugauggugcucaagaucguccgcaacauggagaaguaccagcuggccgugaccaucauggccauccugugcgugccgaacgccgucauccuccagaacgcguggaaggugagcugcaccauccuggccgucguguccgugagcccccugcuccugaccuccagccagcagaagacggacuggaucccccuggcccucaccaucaagggccugaaccccaccgccaucuuccugaccacgcucucccggaccaacaagaagcgcagcuggccgcugaacgaggcgaucauggccgucgggaugguguccauccuggccagcucccuccugaagaacgacauccccaugaccggcccccugguggccggcgggcuccugaccgucugcuacgugcugacgggccggagcgccgaccucgagcuggagcgcgcgaccgacgugaagugggaggagcaggccgagaucuccgggagcagccccauccuguccaucaccaucagcgaggacggcuccaugagcaucaagaacgaggaggaggagcagacccucacgauccugauccggaccgggcugcucgucaucuccggccuguucccgaucagcauccccaucaccgccgccgccugguaccugugggaggugaagaagcagcgcgcgggcgugcucugggacguccccagcccgccgcccauggggaaggccgagcuggaggacggcgccuaccggaucaagcagaaggggauccugggcuacagccagaucggggccggcguguacaaggagggcaccuuccacaccauguggcacgugacgcgcggggccguccucaugcacaagggcaagcggaucgagcccuccugggcggacgugaagaaggaccugaucagcuacgggggcggguggaagcuggagggcgaguggaaggagggcgaggaggugcagguccucgcccuggagcccgggaagaacccccgcgccgugcagaccaagcccggccuguucaagaccaacaccgggacgaucggcgccgugucccucgacuucagccccgggaccuccggcagccccaucaucgacaagaagggcaaggucguggggcuguacggcaacgggguggucacccgguccggcgccuacgugagcgcgaucgcccagaccgagaaguccaucgaggacaaccccgagaucgaggacgacaucuuccgcaagcggcgccugacgaucauggaccugcaccccggcgccgggaagaccaagcgguaccuccccgccaucgugcgcgaggcgaucaagcggggccugcgcacccugauccucgccccgacccgggucguggccgccgagauggaggaggcccugcgcgggcugcccauccgguaccagacgcccgcgauccgcgccgagcacaccggccgcgagaucguggaccucaugugccacgccaccuucaccaugcggcugcugagccccguccgcgugccgaacuacaaccucaucaucauggacgaggcccacuucacggaccccgccuccaucgcggcccggggguacaucagcacccgcguggagaugggcgaggccgccggcaucuucaugaccgccacgccgcccgggagccgggacccguucccccaguccaacgcgcccaucaucgacgaggagcgcgagauccccgagcggagcuggaacuccggccacgaguggaucacggacuucaaggggaagaccgucugguucgugccgagcaucaaggccggcaacgacaucgccgccugccugcgcaagaacgggaagaaggugauccagcugucccggaagaccuucgacagcgaguacgucaagacccgcacgaacgacugggacuucguggugaccaccgacaucuccgagaugggcgcgaacuucaaggccgagcgggucaucgacccccgccggugcaugaagcccgugauccucaccgacggcgaggagcgcgugauccuggccgggcccaugccggucacgcacagcuccgccgcccagcggcgcggccggaucgggcgcaaccccaagaacgagaacgaccaguacaucuacaugggcgagccccuggagaacgacgaggacugcgcgcacuggaaggaggccaagaugcuccuggacaacaucaacacccccgaggggaucaucccgagcauguucgagcccgagcgggagaagguggacgccaucgacggcgaguaccgccugcgcggcgaggcccggaagaccuucguggaccucaugcgccgcggggaccugcccgucuggcuggccuacaagguggcggccgagggcaucaacuacgccgaccgccgguggugcuucgacgggaucaagaacaaccagauccucgaggagaacguggaggucgagaucuggaccaaggagggcgagcgcaagaagcugaagccgcgguggcuggacgcccgcaucuacuccgacccccucgcccugaaggaguucaaggaguucgcggccgggcggaagucccugacgcucaaccugaucaccgagaugggccgccugcccaccuucaugacccagaagacgcgggacgcccucgacaaccuggccgugcugcacaccgcggaggccggcgggcgcgccuacaaccacgcccucuccgagcugcccgagacccuggagacccuccugcugcucacgcugcuggccaccgugaccggcgggaucuuccucuuccugaugagcggccggggcaucgggaagaugacccugggcaugugcugcaucaucaccgcguccauccuccugugguacgcccagauccagccgcacuggaucgccgccagcaucauccuggaguucuuccucaucguccugcugauccccgagcccgagaagcagcgcacgccccaggacaaccagcucaccuacguggucaucgccauccugaccgugguggcggccaccauggccaacgagaugggguuccuggagaagacgaagaaggaccucggccugggguccaucgccacccagcagccggagagcaacauccuggacaucgaccuccggcccgccuccgcguggacccuguacgccgucgccaccacguucaucacccccaugcugcgccacagcaucgagaacagcuccgugaacaccagccucaccgccaucgccaaccaggcgacggugcugaugggccugggcaagggguggccccucuccaagauggacaucggcgucccgcugcuggccaucgggugcuacagccaggugaaccccaucacccucaccgccgcccugcugcuccugguggcgcacuacgccaucaucggccccgggcugcaggccaaggccacccgggaggcccagaagcgcgcggccgccggcaucaugaagaaccccacggucgacggcaucaccgugaucgaccucgacccgauccccuacgaccccaaguucgagaagcagcugggccaggugaugcugcucauccugugcgucacccaggugcugaugaugcggaccacgugggcccucugcgaggcccugacccuggcgaccggccccaucuccacccucugggaggggaacccgggccgcuucuggaacacgaccaucgccgugagcauggccaacaucuuccggggguccuaccuggccggcgccggccuccucuucagcaucaugaagaacaccaccaacacgcgccgcgggaccggcaacaucggggagacccugggcgagaaguggaagucccggcugaacgcgcucggcaagagcgaguuccagaucuacaagaaguccgggauccaggaggucgaccgcacccuggccaaggagggcaucaagcgcggggagacggaccaccacgccgugagccgcggcuccgccaagcugcggugguucguggagcgcaacauggucacccccgaggggaaggugguggaccucggcugcggccgcggcggguggagcuacuacugcggcgggcugaagaacgucaaggaggugaaggggcugaccaagggcgggcccgggcacgaggagcccaucccgauguccaccuacggcuggaaccucgugcgccugcagagcggggucgacguguucuucaucccgcccgagaagugcgacacgcugcucugcgacaucggcgaguccagccccaacccgaccguggaggcggggcggacccugcgcguccugaaccucguggagaacuggcugaacaacaacacccaguucugcaucaaggugcugaaccccuacaugcccuccgucaucgagaagauggaggcccugcagcggaaguacggcggcgcccucgugcgcaacccgcugagccggaacagcacccacgagauguacuggguguccaacgccagcgggaacaucgucuccagcgugaacaugaucucccgcaugcugaucaaccgguucacgaugcgccacaagaaggccaccuacgagcccgacguggaccucggcagcgggacccggaacaucggcaucgaguccgagguccccaaccuggacaucaucgggaagcgcaucgagaagaucaagcaggagcacgagaccagcuggcacuacgaccaggaccaccccuacaagacgugggcguaccacggcuccuacgagaccaagcagaccggcagcgccuccagcauggugaacggggugguccggcugcucaccaagccgugggacgugcugcccacggugacccagauggccaugaccgacaccacgcccuucggccagcagcgcgucuucaaggagaagguggacacccgcacccaggagcccaaggaggggaccaagaagcugaugaagaucacggccgaguggcucuggaaggagcugggcaagaagaagaccccgcggaugugcacccgcgaggaguucacccggaaggugcgcuccaacgccgcgcugggcgccaucuucacggacgagaacaaguggaaguccgcccgggaggccgucgaggacucccgcuucugggagcucguggacaaggagcggaaccugcaccuggaggggaagugcgagaccugcguguacaacaugaugggcaagcgcgagaagaagcucggggaguucggcaaggccaaggggagccgggcgaucugguacauguggcugggcgcccgcuuccuggaguucgaggcccucggcuuccugaacgaggaccacugguucucccgggagaacagccuguccggggucgagggcgaggggcuccacaagcugggcuacauccugcgcgacgugagcaagaaggagggcggggccauguacgcggacgacaccgccggcugggacacccggaucacgcucgaggaccugaagaacgaggagauggugaccaaccacauggagggggagcacaagaagcuggccgaggccaucuucaagcucaccuaccagaacaaggucgugcgcguccagcggcccacgccccggggcacggugauggacaucaucagccggcgcgaccagcggggguccggccagguggggaccuacggccugaacaccuucaccaacauggaggcccagcugauccgccagauggagggcgagggggucuucaagaacauccagcaccucacggugaccgaggagguggcgguccagaacuggcuggcccgggugggccgcgagcgccugagccggauggccaucuccggggacgacugcguggucaagccccucgacgaccgcuucgccaacgcccugaccgcgcugaacgacaugggcaagauccggaaggacauccagcagugggagccgagcaagggcuggaacgacuggacccaggugcccuucugcucccaccacuuccacgagcucaucaugaaggacgggcgcgugcuggucgugcccugccggaaccaggacgagcugaucggccgcgcccggaucagccagggggccggcuggucccuccgcgagacggccugccugggcaagagcuacgcccagauguggucccugaucuacuuccaccggcgcgaccuccggcuggcggccaacgccaucugcagcgccgugcccucccacugggucccgaccagccgcaccaccugguccauccacgccaagcacgaguggaugaccacggaggacaugcugaccguguggaaccggguguggauccgcgagaaccccuggauggaggacaagacccccgucgagagcugggaggagauccccuaccucggcaagcgggaggaccaguggugcggcucccugaucgggcugaccagccgcgcgacgugggccaagaacauccaggccgccaucaaccaggugcggucccucaucggcaacgaggaguacaccgacuacaugccgagcaugaagcgcuuccggcgcgaggaggaggaggcgggggugcugugguga

SEQ ID NO: 9173 - RNA, 9876 nt, Artificial Sequence
  derived and/or modified CDS sequence (opt1) from DENV-2__GQ868623__SS-prME
agcgccggcaugaucaucaugcugauccccaccgugauggccuuccaccucaccacccggaacggggagccccacaugaucgucggcauccaggagaaggggaagucccugcuguucaagaccgaggacggcgugaacaugugcacccucauggcgauggaccugggggagcugugcgaggacaccaucaccuacaagugcccccuccugcggcagaacgagcccgaggacaucgacugcuggugcaacagcaccuccaccugggugaccuacgggaccugcaccaccaccggcgagcaccgccgggagaagcgcagcgucgcccuggugccccacguggggaugggccucgagacgcggaccgagaccuggauguccagcgagggggccuggaagcacgcccagcgcaucgagaccuggauccugcggcacccgggcuucacgaucauggccgcgauccuggccuacaccaucgggaccacccacuuccagcgcgcccucaucuucauccugcugacggccgucgcgcccuccaugaccaugcggugcaucggcaucagcaaccgcgacuucguggagggcguguccgggggcagcugggucgacaucgugcucgagcacggguccugcgugaccaccauggccaagaacaagcccacgcuggacuucgagcugaucaagaccgaggccaagcagcccgccacccuccggaaguacugcaucgaggccaagcugaccaacacgaccaccgagagccgcugccccacccagggcgagcccucccugaaggaggagcaggacaagcgguucgucugcaagcacagcaugguggaccgcggcugggggaacggcugcgggcuguucggcaagggcgggaucgugacgugcgcgauguucacgugcaagaagaacauggagggcaagaucguccagcccgagaaccuggaguacaccaucguggugacgccccacuccggggaggagcacgccgucggcaacgacacggggaagcacggcaaggagaucaaggugaccccgcagagcuccaucaccgaggccgagcugaccggguacggcaccgugacgauggagugcagcccccggaccggccucgacuucaacgagaugguccugcugcagauggagaacaaggccuggcucgugcaccgccagugguuccuggaccugccccuccccuggcugccgggggccgacaagcagggcuccaacuggauccagaaggagacccuggugaccuucaagaacccccacgcgaagaagcaggacgucgugguccucgggagccaggagggcgccaugcacacggcccugaccggggccaccgagauccagaugagcuccggcaaccuccuguucaccggccaccugaagugccggcugcgcauggacaagcuccagcugaaggggaugagcuacuccaugugcacgggcaaguucaagguggugaaggagaucgccgagacccagcacgggaccaucgucauccgggugcaguacgagggcgacggcagccccugcaagauccccuucgagaucauggaccuggagaagcgcuacgugcucgggcggcugaucaccgucaacccgaucgugacggagaaggacucccccgugaacaucgaggcggagccgcccuucggcgacagcuacaucaucaucggggucgagccgggccagcugaagcucaacugguucaagaagggguccagcaucggccagauguucgagaccaccaugcgcggcgccaagcgcauggccauccugggggacaccgccugggacuucggcucccucggcgggguguucacgagcaucgggaaggcccuccaccagguguucggcgcgaucuacggcgccgccuucuccggggucagcuggaccaugaagauccugaucggcgugaucaucaccuggaucgggaugaacucccggagcaccucccugagcgugucccugguccucgugggcaucgugacgcuguaccugggggucauggugcaggccgacagcggcugcguggucuccuggaagaacaaggagcucaagugcggcagcgggaucuucaucaccgacaacgugcacaccuggaccgagcaguacaaguuccagcccgagagccccuccaagcuggcgagcgccauccagaaggcccaggaggagggcaucugcgggauccgcuccgugacgcggcuggagaaccucauguggaagcagaucacccccgagcugaaccacauccuggccgagaacgaggucaagcucaccaucaugaccggcgacaucaaggggaucaugcaggccggcaagcgcagccugcggccgcagcccacggagcugaaguacuccuggaagaccuggggcaaggcgaagaugcucagcaccgagucccacaaccagaccuuccugaucgacgggcccgagacggccgagugcccgaacaccaaccgcgccuggaacagccuggagguggaggacuacggcuucgggguguucaccaccaacaucuggcucaagcugaaggagaagcaggacgccuucugcgacuccaagcugaugagcgccgcgaucaaggacaaccgggccguccacgccgacaugggcuacuggaucgaguccgcccucaacgacacguggaagaucgagaaggccagcuucaucgaggugaagaacugccacuggcccaagucccacacccuguggagcaacggcgugcuggaguccgagaugaucauccccaagaaccucgcggggcccgucagccagcacaacuaccgcccgggcuaccacacccagaucgccgggcccuggcaccugggcaagcuggagauggacuucgacuucugcgacgggaccaccgugaucgugacggaggacugcggcaaccggggccccucccuccgcaccaccaccgccagcgggaagcugaucacggaguggugcugccggagcugcacccugcccccgcuccgcuaccggggcgaggacgggugcugguacggcauggagauccgcccccugaaggagaaggaggagaaccuggucaacucccucgugaccgccgggcacggccagguggacaacuucagccugggcguccuggggcucgcgcuguuccuggaggagaugcuccggacccgcgugggcacgaagcacgccauccugcugguggccgucuccuucgugacccucaucaccgggaacaugagcgugaaggaccugggccgggucguggugauggucggggccaccaugacggacgacaucggcaugggcgugaccuaccuggcccuccuggcggccuucaaggugcgccccaccuucgccgccgggcugcuccugcggaagcugaccuccaaggagcucaugaugacgaccaucggcaucguccugcugagccaguccaccauccccgagaccauccucgagcugacggacgcccuggcgcucgggaugauggugcugaagaucgugcgcgacauggagaaguaccagcuggccgucaccaucauggccauccucugcgugccgaacgccgucauccugcagaacgccuggaaggugagcugcaccauccuggcgguggucuccgugagcccccuccugcugaccuccagccagcagaagacggacuggaucccccucgcccugaccaucaagggccugaaccccaccgccaucuuccucaccacgcugucccgcaccaacaagaagcggagcuggccgcugaacgaggccaucauggcggugggcauggucuccauccucgccagcucccugcugaagaacgacauccccaugaccgggccccucguggccggcgggcugcugaccgugugcuacguccucacgggccgcagcgccgaccuggagcuggagcgggccaccgacgugaagugggaggaccaggcggagaucuccgggagcagccccauccucuccaucaccaucagcgaggacggcuccaugagcaucaagaacgaggaggaggagcagacccugacgauccugauccgcaccggccuccuggugaucuccgggcuguucccggucagcauccccaucaccgccgccgccugguaccucugggaggugaagaagcagcgggccggcgugcugugggacguccccagcccgccgcccauggggaaggcggagcuggaggacggcgccuaccgcaucaagcagaaggggauccucggcuacagccagaucggcgccgggguguacaaggagggcaccuuccacaccauguggcacgugacgcgcggggccguccugaugcacaagggcaagcgcaucgagcccuccugggccgacgugaagaaggaccugaucagcuacgggggcggcuggaagcucgagggggaguggaaggagggcgaggaggugcagguccuggcgcuggagcccgggaagaacccccgggccgugcagaccaagcccggccucuucaagaccaacaccgggacgaucggcgccgugucccuggacuucagccccggcaccuccgggagccccaucaucgacaagaagggcaaggucguggggcuguacggcaacggcguggucacccgcuccggggccuacgugagcgccaucgcgcagaccgagaaguccaucgaggacaaccccgagaucgaggacgacaucuuccggaagcgccggcugacgaucauggaccuccaccccggcgccgggaagaccaagcgcuaccugcccgccaucgugcgggaggccaucaagcgcggccugcggacccucauccuggcgccgacccgcgucguggccgccgagauggaggaggcccugcgggggcuccccauccgcuaccagacgcccgccauccgggcggagcacaccggccgcgagaucguggaccugaugugccacgccaccuucaccaugcgccugcucagccccguccgggugccgaacuacaaccugaucaucauggacgaggcccacuucacggaccccgccuccaucgccgcgcgcggcuacaucagcacccggguggagaugggggaggccgccggcaucuucaugaccgccacgccgcccgggagccgcgacccguucccccaguccaacgcccccaucaucgacgaggagcgggagauccccgagcgcagcuggaacuccggccacgagugggucacggacuucaaggggaagaccgugugguucgugccgagcaucaaggcgggcaacgacaucgccgccugccugcggaagaacggcaagaaggucauccagcucucccgcaagaccuucgacagcgaguacgugaagacccggacgaacgacugggacuucguggucaccaccgacaucuccgagaugggggccaacuucaaggcggagcgcgugaucgacccccggcgcugcaugaagcccgugauccugaccgacggcgaggagcgggucauccuggccgggcccaugccggugacgcacagcuccgccgcccagcgccggggccgcaucgggcggaaccccaagaacgagaacgaccaguacaucuacaugggcgagccccucgagaacgacgaggacugcgcccacuggaaggaggcgaagaugcugcuggacaacaucaacacccccgagggcaucaucccgagcauguucgagcccgagcgcgagaagguggacgccaucgacggggaguaccggcuccgcggcgaggcccgcaagaccuucgucgaccugaugcggcgcggggaccugcccguguggcucgccuacaagguggccgcggagggcaccaacuacgccgaccggcgcuggugcuucgacgggaucaagaacaaccagauccuggaggagaacgucgagguggagaucuggacgaaggagggcgagcggaagaagcugaagccgcgcuggcucgacgcccggaucuacuccgacccccuggcccugaaggaguucaaggaguucgccgcgggccgcaagagccucacccugaaccugaucaccgagauggggcggcuccccaccuucaugacgcagaagacccgcgacgcccuggacaaccuggccguccuccacaccgccgaggcgggcgggcgggccuacaaccacgcccuguccgagcugcccgagacccucgagacgcugcugcuccugacccugcucgccaccgugaccggcggcaucuuccuguuccugaugagcgggcgcggcaucgggaagaugacccucggcaugugcugcaucaucacggccuccauccugcugugguacgcgcagauccagccgcacuggaucgccgccagcaucauccucgaguucuuccugaucgugcugcucauccccgagcccgagaagcagcggacgccccaggacaaccagcugaccuacgucgugaucgccauccugaccguggucgccgcgacgauggccaacgagaugggguuccucgagaagaccaagaaggaccugggccugggcuccaucgccacccagcagccggagagcaacauccucgacaucgaccugcgccccgccuccgccuggacccuguacgcgguggccacgaccuucgugacccccaugcuccggcacagcaucgagaacagcuccgucaacgugagccugaccgccaucgccaaccaggccacggugcugauggggcucggcaagggguggccccuguccaagauggacaucggcgucccgcugcucgcgaucgggugcuacagccaggugaaccccaucacccugaccgccgcccugcuccugcugguggcccacuacgcgaucaucggccccggccuccaggccaaggccacccgcgaggcccagaagcgggccgcggccgggaucaugaagaaccccacggucgacggcaucaccgugaucgaccuggacccgauccccuacgaccccaaguucgagaagcagcugggccaggugaugcuccugauccugugcgucacccaggugcucaugaugcgcaccacgugggcccugugcgaggcccugacccucgccaccggccccaucuccacccugugggaggggaacccgggccgguucuggaacacgaccaucgcggugagcauggccaacaucuuccgcggcuccuaccuggccggggccggccuccuguucagcaucaugaagaacaccaccaacacgcggcgcgggaccggcaacaucggcgagacccugggggagaaguggaagucccgccucaacgcccugggcaagagcgaguuccagaccuacaagaaguccgggauccaggaggucgaccggacgcuggcgaaggagggcaucaagcgcggggagaccgaccaccacgccgugagccggggcuccgccaagcuccgcugguucguggagcggaacauggucacccccgagggcaaggugguggaccuggggugcggccgcgggggcuggagcuacuacugcgggggccugaagaacguccgggaggugaagggccucaccaagggcgggcccgggcacgaggagcccaucccgauguccacguacggcuggaaccuggugcgccugcagagcggggucgacguguucuucaucccgcccgagaagugcgacacccuccugugcgacaucggcgaguccagccccaacccgaccguggaggccggccggacccugcgcguccucaaccugguggagaacuggcugaacaacaacacccaguucugcaucaaggugcugaaccccuacaugcccuccgucaucgagaagauggaggcgcuccagcggaagcacgggggcgcccuggugcgcaacccgcugagccggaacagcacgcacgagauguacuggguguccaacgccagcgggaacaucgucuccagcgugaacaugaucucccgcaugcucaucaaccgguucaccaugcgccacaagaaggccaccuacgagcccgacguggaccugggcagcgggacccggaacaucggcaucgaguccgagauccccaaccuggacaucaucggcaagcgcaucgagaagaucaagcaggagcacgagacgagcuggcacuacgaccaggaccaccccuacaagaccugggccuaccacggguccuacgagaccaagcagaccggcagcgcguccagcauggucaacgggguggugcggcuccugacgaagccgugggacguccugcccaccgugacccagauggccaugaccgacacgacccccuucggccagcagcgcguguucaaggagaaggucgacacccgcacccaggagcccaaggagggcacgaagaagcucaugaagaucaccgccgaguggcuguggaaggagcuggggaagaagaagaccccgcggaugugcacccgcgaggaguucacgcggaaggugcgcuccaacgccgcccucggcgcgaucuucaccgacgagaacaaguggaaguccgcccgggaggccguggaggacucccgcuucugggagcuggucgaccgggagcgcaaccugcaccucgaggggaagugcgagaccugcguguacaacaugaugggcaagcgggagaagaagcugggggaguucggcaaggccaagggcagccgcgccaucugguacauguggcugggggcgcgguuccucgaguucgaggcccugggcuuccugaacgaggaccacugguucucccgcgagaacagccucuccggggucgagggcgaggggcugcacaagcugggcuacauccuccgggacgugagcaagaaggagggcggggccauguacgccgacgacaccgcgggcugggacacgcgcaucacccuggaggaccugaagaacgaggagauggugaccaaccacauggagggggagcacaagaagcucgccgaggccaucuucaagcugaccuaccagaacaaggucgugcgggugcagcgccccacgccccggggcaccgucauggacaucaucagccgccgggaccagcgcggguccggccaggugggcaccuacgggcugaacaccuucacgaacauggaggcccagcucauccggcagauggagggcgaggggguguucaagaacauccagcaccugaccgccaccgaggaggucgcggugcagaacuggcuggcccgcgugggccgcgagcggcucagccgcauggccaucuccggcgacgacugcgucgugaagccccuggacgaccgguucgccaacgcccugaccgcgcucaacgacauggggaagauccgcaaggacauccagcagugggagccgagcaagggcuggaacgacuggacccaggugcccuucugcucccaccacuuccacgagcugaucaugaaggacgggcggguccugguggugcccugccgcaaccaggacgagcucaucggccgggcccgcaucagccagggggccggcuggucccugcgggagaccgccugccugggcaagagcuacgcccagauguggucccucauguacuuccaccgccgggaccugcgccuggcggccaacgccaucugcagcgccguccccucccacugggugccgaccagccggaccaccugguccauccacgccaagcacgaguggaugacgaccgaggacaugcucaccguguggaaccgcgucuggauccgggagaaccccuggauggaggacaagacccccguggagagcugggaggagauccccuaccuggggaagcgcgaggaccaguggugcggcucccugaucgggcucacgagccgggcgaccugggccaagaacauccaggccgccaucaaccaggugcgcucccugaucggcaacgaggaguacaccgacuacaugccgagcaugaagcgguuccgccgcgaggaggaggaggcggggguccugugguga

SEQ ID NO: 9174 - RNA, 9876 nt, Artificial Sequence
  derived and/or modified CDS sequence (opt1) from DENV-2__GQ868624__SS-prME
agcgcgggcaugaucaucaugcugauccccaccgugauggccuuccaccucaccacccgcaacggggagccccacaugaucgucggcauccaggagaaggggaagucccugcuguucaagaccgaggacggcgugaacaugugcacccucauggcgauggaccugggggagcugugcgaggacaccaucaccuacaagugcccccuccugcggcagaacgagcccgaggacaucgacugcuggugcaacagcaccagcaccugggugaccuacgggaccugcaccaccaccggcgagcaccgccgggagaagcgcagcgucgcccuggugccccacguggggaugggccucgagacccggaccgagaccuggauguccagcgagggggccuggaagcacgcccagcgcaucgagaccuggauccugcggcacccgggcuucacgaucauggccgcgauccuggccuacaccaucgggaccacccacuuccagcgcguccucaucuucauccugcugacggccguggcccccuccaugaccaugcggugcaucggcaucagcaaccgcgacuucguggagggcgucuccgggggcagcuggguggacaucgugcucgagcacggguccugcgucaccaccauggcgaagaacaagcccacgcuggacuucgagcugaucaagaccgaggccaagcagcccgccacccuccggaaguacugcaucgaggccaagcugaccaacacgaccaccgagagccgcugccccacccagggcgagcccucccugaaggaggagcaggacaagcgguucgugugcaagcacagcaugguggaccgcggcugggggaacggcugcggccuguucggcaagggcgggaucgucacgugcgccauguucacgugcaagaagaacauggagggcaagaucgugcagcccgagaaccuggaguacaccaucguggucacgccccacuccggggaggagcacgcggugggcaacgacacggggaagcacggcauggagaucaaggugaccccgcagagcuccaucaccgaggccgagcugaccggguacggcaccgucacgauggagugcagcccccggaccggccucgacuucaacgagauggugcugcugcagauggagaacaaggccuggcucgugcaccgccagugguuccuggaccugccccuccccuggcugccgggggccgacaagcaggaguccaacuggauccagaaggagacccuggucaccuucaagaacccccacgccaagaagcaggacguggucgugcucggcagccaggagggggcgaugcacacggcccugaccggcgccaccgagauccagaugagcuccgggaaccuccuguucaccggccaccugaagugccggcugcgcauggacaagcuccagcugaagggcaugagcuacuccaugugcacggggaaguucaagguggucaaggagaucgccgagacccagcacggcaccaucgugauccgggugcaguacgagggggacggcagccccugcaagauccccuucgagaucauggaccuggagaagcgcuacguccucggccggcugaucaccgugaacccgaucgugacggagaaggacucccccgucaacaucgaggccgagccgcccuucggggacagcuacaucaucaucggcguggagccggggcagcugaagcucaacugguucaagaagggcuccagcaucgggcagauguucgagaccaccaugcgcggcgcgaagcgcauggccauccugggcgacaccgccugggacuucgggucccugggcgggguguucacgagcaucggcaaggcccuccaccaggucuucggggccaucuacggcgcggccuucuccggcgugagcuggaccaugaagauccugaucggggugaucaucaccuggaucggcaugaacucccggagcaccucccugagcgucucccuggugcucguggggaucgucacgcuguaccugggcgugauggugcaggccgacagcgggugcgucguguccuggaagaacaaggagcucaagugcggcagcggcaucuucaucaccgacaacgugcacaccuggaccgagcaguacaaguuccagcccgagagccccuccaagcuggccagcgcgauccagaaggcccaggaggaggggaucugcggcauccgcuccgucacgcggcuggagaaccucauguggaagcagaucacccccgagcugaaccacauccuggccgagaacgaggugaagcucaccaucaugaccggggacaucaagggcaucaugcaggccgggaagcgcagccugcggccgcagcccacggagcugaaguacuccuggaagaccuggggcaaggccaagaugcucagcaccgaguccuacaaccagaccuuccugaucgacggccccgagacggcggagugcccgaacaccaaccgcgccuggaacagccuggagguggaggacuacggguucggcgucuucaccaccaacaucuggcucaagcugaaggagaagcaggacgccuucugcgacuccaagcugaugagcgccgccaucaaggacaaccgggcggugcacgccgacaugggguacuggaucgaguccgcccucaacgacacguggaagaucgagaaggccagcuucaucgaggugaagaacugccacuggcccaagucccacacccuguggagcaacggcguccuggaguccgagaugaucauccccaagaaccucgccggccccgugagccagcacaacuaccgcccgggguaccacacccagaucgcgggccccuggcaccuggggaagcuggagauggacuucgacuucugcgacggcaccaccgugaucgucacggaggacugcgggaaccggggccccucccuccgcaccaccaccgccagcggcaagcugaucacggaguggugcugccggagcugcacccugcccccgcuccgcuaccgcggggaggacggcugcugguacgggauggagauccgcccccugaaggagaaggaggagaaccuggugaacucccucgugaccgccggccacgggcaggucgacaacuucagccugggcgugcugggcauggcccucuuccuggaggagaugcugcggacccgcguggggacgaagcacgcgauccuccuggucgccguguccuucgugacccugaucaccggcaacaugagcuucaaggaccucgggcgggucguggugauggucggcgccaccauggccgacgacaucgggaugggcgugacguaccuggcccugcucgcggccuucaaggugcgccccaccuucgccgccggccugcugcuccggaagcugaccuccaaggagcugaugaugaccacgaucgggaucguccuccugagccaguccaccauccccgagaccgugcuggagcucaccgacgcccuggcgcugggcaugauggugcucaagaucguccgcaacauggagaaguaccagcuggccgugacgaucauggccauccugugcgucccgaacgccgugauccuccagaacgccuggaaggugagcugcaccauccuggcggucguguccgugagcccccugcuccugaccuccagccagcagaagaccgacuggaucccccuggcccucacgaucaaggggcugaaccccaccgccaucuuccugaccacccucucccgcacgaacaagaagcggagcuggccgcugaacgaggccaucauggcggucggcaugguguccauccuggccagcucccuccugaagaacgacauccccaugaccggcccccugguggccgggggccuccugaccgucugcuacgugcugaccgggcgcagcgccgaccucgagcuggagcgggccacggacgugaagugggaggaccaggcggagaucuccggcagcagccccauccuguccaucaccaucagcgaggacggguccaugagcaucaagaacgaggaggaggagcagacccucaccauccugauccgcacgggccugcucgucaucuccggccuguucccgaucagcauccccaucaccgccgccgccugguaccugugggaggugaagaagcagcgggccggggugcucugggacguccccagcccgccgcccaugggcaaggcggagcuggaggacggggccuaccgcaucaagcagaagggcauccugggguacagccagaucggcgccggcguguacaaggaggggaccuuccacaccauguggcacgugacccggggcgccguccucaugcacaaggggaagcgcaucgagcccuccugggccgacgugaagaaggaccugaucagcuacggcgggggcuggaagcuggagggcgaguggaaggagggggaggaggugcagguccucgcgcuggagcccggcaagaacccccgggccgugcagacgaagcccgggcuguucaagaccaacaccggcaccaucggggccgugucccucgacuucagccccggcacguccggcagccccaucaucgacaagaaggggaaggucgugggccuguacgggaacggcguggucacccgcuccggcgccuacgugagcgccaucgcgcagaccgagaaguccaucgaggacaaccccgagaucgaggacgacaucuuccggaagcgccggcugaccaucauggaccugcaccccggggccggcaagacgaagcgcuaccuccccgccaucgugcgggaggccaucaagcgcgggcugcggacccugauccucgcgccgacccgcgucguggccgccgagauggaggaggcccugcggggccugcccauccgcuaccagacccccgccauccgggcggagcacacggggcgcgagaucguggaccucaugugccacgccaccuucaccaugcgccugcugagccccguccgggugccgaacuacaaccucaucaucauggacgaggcccacuucaccgaccccgccuccaucgccgcgcgcggcuacaucagcacgcggguggagaugggcgaggccgccgggaucuucaugaccgccacgccgcccggcagccgcgacccguucccccaguccaacgcccccaucaucgacgaggagcgggagauccccgagcgcagcuggaacuccgggcacgagugggucaccgacuucaagggcaagacggugugguucgugccgagcaucaaggcggggaacgacaucgccgccugccugcggaagaacggcaagaaggucauccagcugucccgcaagaccuucgacagcgaguacgugaagacccggaccaacgacugggacuucguggucacgaccgacaucuccgagaugggcgccaacuucaaggcggagcgcgugaucgacccccggcgcugcaugaagcccgugauccucaccgacggggaggagcgggucauccuggccggccccaugccggugacccacagcuccgccgcccagcgccgggggcgcaucggccggaaccccaagaacgagaacgaccaguacaucuacaugggggagccccuggagaacgacgaggacugcgcccacuggaaggaggcgaagaugcuccuggacaacaucaacacgcccgagggcaucaucccgagcauguucgagcccgagcgcgagaagguggacgccaucgacggcgaguaccggcugcgcggggaggcccgcaagaccuucgucgaccucaugcggcgcggcgaccugcccguguggcuggccuacaagguggccgcggaggggaucaacuacgccgaccggcgcuggugcuucgacggcaucaagaacaaccagauccucgaggagaacgucgagguggagaucuggaccaaggagggggagcggaagaagcugaagccgcgcuggcuggacgcccggaucuacuccgacccccucgcccugaaggaguucaaggaguucgccgcgggccgcaagagccugacccucaaccugaucacggagaugggccggcugcccaccuucaugacccagaagacccgcgacgcccucgacaaccuggccguccugcacacggccgaggccggcgggcgggccuacaaccacgcccucuccgagcugcccgagacccuggagacccuccugcugcucacccugcuggccacggugaccgggggcaucuuccucuuccugaugagcggccgcgggaucggcaagaugacccuggggaugugcugcaucaucaccgccuccauccuccugugguacgcgcagauccagccgcacuggaucgccgccagcaucauccuggaguucuuccucaucgugcugcugauccccgagcccgagaagcagcggacgccccaggacaaccagcucacguacgucgugaucgccauccugaccguggucgccgcgaccauggccaacgagaugggcuuccuggagaagaccaagaaggaccucgggcugggcuccaucgccacgcagcagccggagagcaacauccuggacaucgaccuccgccccgccuccgccuggacccuguacgcgguggccaccaccuucgugacgcccaugcugcggcacagcaucgagaacagcuccgucaacgugagccucaccgccaucgccaaccaggccaccgugcugaugggccuggggaagggcuggccccucuccaagauggacaucggggucccgcugcuggcgaucggcugcuacagccaggugaaccccaucacccucacggccgcccugcugcuccugguggcccacuacgcgaucaucgggcccggccugcaggccaaggccacccgcgaggcccagaagcgggccgcggccggcaucaugaagaaccccaccgucgacgggaucaccgugaucgaccucgacccgauccccuacgaccccaaguucgagaagcagcugggccaggugaugcugcucauccugugcgucacccaggugcugaugaugcgcaccaccugggcccucugcgaggcccugacccuggccacggggcccaucuccacccucugggagggcaacccggggcgguucuggaacaccaccaucgcggugagcauggccaacaucuuccgcggcuccuaccuggccggcgccgggcuccucuucagcaucaugaagaacacgaccaacacccggcgcggcaccgggaacaucggcgagacgcugggcgagaaguggaagucccgccugaacgcccucgggaaguccgaguuccagaucuacaagaaguccggcauccaggaggucgaccggacccuggcgaaggaggggaucaagcgcggcgagaccgaccaccacgccgugagccggggguccgccaagcugcgcugguucguggagcggaacauggucacccccgagggcaaggugguggaccucggcugcgggcgcggcggguggagcuacuacugcggcgggcugaagaacguccgggaggugaagggccugacgaagggcgggcccggccacgaggagcccaucccgauguccaccuacggguggaaccucgugcgccugcagagcggcgucgacguguucuucaucccgcccgagaagugcgacacccugcucugcgacaucggggaguccagccccaacccgaccguggaggccggccggacgcugcgcguccugaaccucguggagaacuggcugaacaacaacacccaguucugcaucaaggugcugaaccccuacaugcccuccgucaucgagaagauggaggcgcugcagcggaaguacggcggggcccucgugcgcaacccgcugagccggaacagcacccacgagauguacuggguguccaacgccagcggcaacaucgucuccagcgugaacaugaucucccgcaugcugaucaaccgguucaccaugcgccacaagaaggccaccuacgagcccgacguggaccucgggagcggcacgcggaacaucgggaucgaguccgagauccccaaccuggacaucaucggcaagcgcaucgagaagaucaaggaggagcacgagaccagcuggcacuacgaccaggaccaccccuacaagaccugggccuaccacggcuccuacgagaccaagcagacggggagcgcguccagcauggucaacggcguggugcggcugcucaccaagccgugggacguccugcccaccgugacccagauggccaugacggacaccacccccuucgggcagcagcgcguguucaaggagaaggucgacacccgcacgcaggagcccaaggagggcaccaagaagcugaugaagaucaccgccgaguggcucuggaaggagcugggcaagaagaagaccccgcggaugugcacgcgcgaggaguucacccggaaggugcgcuccaacgccgcccugggggcgaucuucaccgacgagaacaaguggaaguccgcccgggaggccguggaggacucccgcuucugggagcucgucgacaaggagcggaaccugcaccuggagggcaagugcgagaccugcguguacaacaugauggggaagcgcgagaagaagcucggcgaguucgggaaggccaagggcagccgggccaucugguacauguggcugggcgcgcgcuuccuggaguucgaggcccucggguuccugaacgaggaccacugguucucccgggagaacagccuguccggcgucgagggggagggccuccacaagcugggguacauccugcgcgacgugagcaagaaggagggcggcgccauguacgccgacgacacggcggggugggacacccggaucacccucgaggaccugaagaacgaggagauggugaccaaccacauggagggcgagcacaagaagcuggccgaggccaucuucaagcucacguaccagaacaaggucgugcgcgugcagcggcccacgccccgggggaccgucauggacaucaucagccggcgcgaccagcggggcuccggccagguggggaccuacggccugaacacguucaccaacauggaggcccagcugauccgccagauggagggggagggcguguucaagaacauccagcaccucaccgucaccgaggaggccgcggugcagaacuggcuggcccggguggggcgcgagcgccugagccggauggccaucuccggcgacgacugcgucgugaagccccucgacgaccgcuucgccaacgcccugacggcgcugaacgacaugggcaagauccggaaggacauccagcagugggagccgagcaagggguggaacgacuggacccaggugcccuucugcucccaccacuuccacgagcucaucaugaaggacggccgcguccugguggugcccugccggaaccaggacgagcugaucgggcgcgcccggaucagccagggcgccggguggucccuccgcgagaccgccugccugggcaagagcuacgcccagauguggucccugauguacuuccaccggcgcgaccuccggcuggcggccaacgccaucugcagcgccguccccucccacugggugccgaccagccgcacgaccugguccauccacgccaagcacgaguggaugaccaccgaggacaugcugaccguguggaaccgggucuggauccgcgagaaccccuggauggaggacaagacgcccguggagagcugggaggagauccccuaccucggcaagcgggaggaccaguggugcgggucccugaucggccugaccagccgcgcgaccugggccaagaacauccaggccgccaucaaccaggugcggucccucaucgggaacgaggaguacaccgacuacaugccgagcaugaagcgcuuccggcgcgaggaggaggaggcgggcguccugugguga

SEQ ID NO: 9175 - RNA, 9876 nt, Artificial Sequence
  derived and/or modified CDS sequence (opt1) from DENV-2__FJ639717__SS-prME
agcgccggcaugaucaucaugcugauccccaccgugauggccuuccaccucaccacccgcaacggggagccccacaugaucgugggcauccaggagaagggcaagagccugcuguucaagaccgaggacggcgugaacaugugcacccucauggcgauggaccugggggagcugugcgaggacaccaucaccuacaagugcccccuccugcggcagaacgagcccgaggacaucgacugcuggugcaacagcaccagcaccugggugaccuacgggaccugcaccaccaccggcgagcaccgccgggagaagcgcagcgucgcccuggugccccacguggggaugggccucgagacccggaccgagaccuggauguccagcgagggggccuggaagcacgcccagcgcaucgagaccuggauccugcggcacccgggcuucacgaucauggccgcgauccuggccuacaccaucgggaccacccacuuccagcgcgcccucaucuucauccugcugacggccgucgcgcccuccaugaccaugcggugcaucggcaucagcaaccgcgacuucguggagggcguguccgggggcagcugggucgacaucgugcucgagcacggguccugcgugaccaccauggccaagaacaagcccacgcuggacuucgagcugaucaagaccgaggccaagcagcccgccacccuccggaaguacugcaucgaggccaagcugaccaacacgaccaccgagagccgcugccccacccagggcgagcccucccugaaggaggagcaggacaagcgguucgucugcaagcacagcaugguggaccgcggcugggggaacggcugcgggcuguucggcaagggcgggaucgugacgugcgcgauguucacgugcaagaagaacauggagggcaagaucguccagcccgagaaccuggaguacaccaucguggugacgccccacuccggggaggagcacgccgucggcaacgacacggggaagcacggcaaggagaucaaggugaccccgcagagcuccaucaccgaggccgagcugaccggguacggcaccgugacgauggagugcagcccccggaccggccucgacuucaacgagaugguccugcugcagauggaguccaaggccuggcucgugcaccgccagugguuccuggaccugccccuccccuggcugccgggggccgacaagcagggcagcaacuggauccagaaggagacccuggugaccuucaagaacccccacgcgaagaagcaggacgucgugguccucgggagccaggagggcgccaugcacacggcccugaccggggccaccgagauccagauguccagcggcaaccuccuguucaccggccaccugaagugccggcugcgcauggacaagcuccagcugaaggggauguccuacagcaugugcacgggcaaguucaagguggugaaggagaucgccgagacccagcacgggaccaucgucauccgggugcaguacgagggcgacggcucccccugcaagauccccuucgagaucauggaccuggagaagcgcuacgugcucgggcggcugaucaccgucaacccgaucgugacggagaaggacagccccgugaacaucgaggcggagccgcccuucggcgacuccuacaucaucaucggggucgagccgggccagcugaagcucaacugguucaagaaggggagcuccaucggccagauguucgagaccaccaugcgcggcgccaagcgcauggccauccugggggacaccgccugggacuucggcagccucggcgggguguucacguccaucgggaaggcccuccaccagguguucggggcgaucuacggcgccgccuucagcggggucuccuggaccaugaagauccugaucggcgugaucaucaccuggaucgggaugaacagccgguccaccagccuguccgugagccugguccucgugggcaucgugacgcuguaccugggggucauggugcaggccgacuccggcugcguggucagcuggaagaacaaggagcucaagugcggcagcgggaucuucaucaccgacaacgugcacaccuggaccgagcaguacaaguuccagcccgagucccccagcaagcuggcguccgccauccagaaggcccaggaggagggcaucugcgggauccgcagcgugacgcggcuggagaaccucauguggaagcagaucacccccgagcugaaccacauccuggccgagaacgaggucaagcucaccaucaugaccggcgacaucaaggggaucaugcaggccggcaagcgcucccugcggccgcagcccacggagcugaaguacagcuggaagaccuggggcaaggcgaagaugcucuccaccgagagccacaaccagaccuuccugaucgacgggcccgagacggccgagugcccgaacaccaaccgcgccuggaacucccuggagguggaggacuacggcuucgggguguucaccaccaacaucuggcucaagcugaaggagaagcaggacgccuucugcgacagcaagcugauguccgccgcgaucaaggacaaccgggccguccacgccgacaugggcuacuggaucgagagcgcccucaacgacacguggaagaucgagaaggccuccuucaucgaggugaagaacugccacuggcccaagagccacacccugugguccaacggcgugcuggagagcgagaugaucauccccaagaaccucgcggggcccgucucccagcacaacuaccgcccgggcuaccacacccagaccgccgggcccuggcaccugggcaagcuggagauggacuucgacuucugcgacgggaccacggugaucgugaccgaggacugcggcaaccggggccccagccuccgcaccaccacggccagcgggaagcugaucaccgaguggugcugccgguccugcacccugcccccgcuccgcuaccggggcgaggacgggugcugguacggcauggagauccgcccccugaaggagaaggaggagaaccuggucaacagccucgugaccgccgggcacggccagguggacaacuucucccugggcguccuggggauggcccuguuccuggaggagaugcugcggacgcgcgugggcaccaagcacgccauccuccugguggccgucagcuucgugacccugaucaccgggaacauguccuucaaggaccucggccggguggucgugaugguggggacgaccaugaccgacgacaucggcaugggcgucaccuaccuggcccugcucgccgcguucaaggugcgccccacguucgccgccgggcugcugcuccggaagcugaccagcaaggagcugaugaugaccaccaucggcaucgugcuccugucccagagcacgauccccgagaccauccuggagcucaccgacgcccuggcccuggggaugaugguccucaagaucgugcgcgacauggagaaguaccagcuggcggugaccaucauggccauccugugcgucccgaacgccgugauccuccagaacgccuggaaggucuccugcacgauccuggccguggugagcgucagcccccugcuccugaccagcucccagcagaagaccgacuggaucccccuggcgcucaccaucaagggccugaaccccacggccaucuuccugaccacccucagccgcaccaacaagaagcgguccuggccgcugaacgaggccaucauggccgugggcauggugagcauccuggcguccagccuccugaagaacgacauccccaugacggggccccuggucgccggcgggcuccugaccgugugcuacgugcugaccggccgcuccgccgaccucgagcuggagcgggccaccgacgucaagugggaggaccaggccgagaucagcgggagcucccccauccugagcaucacgaucuccgaggacggcagcauguccaucaagaacgaggaggaggagcagacccucaccauccugauccgcaccggccugcucgugaucagcgggcuguucccgguguccauccccaucaccgcggccgccugguaccugugggaggucaagaagcagcgggccggcgugcucugggacgugcccuccccgccgcccauggggaaggccgagcuggaggacggcgcguaccgcaucaagcagaaggggauccugggcuacucccagaucggcgccggggucuacaaggagggcacguuccacaccauguggcacgugacccgcggggcggugcucaugcacaagggcaagcgcaucgagcccagcugggccgacgucaagaaggaccugaucuccuacgggggcggcuggaagcuggagggggaguggaaggagggcgaggagguccaggugcucgcccuggagcccgggaagaacccccgggcgguccagaccaagcccggccuguucaagacgaacaccgggaccaucggcgccgugagccucgacuucucccccggcaccagcgggucccccaucaucgacaagaagggcaagguggucgggcuguacggcaacggcguggugacgcgcagcggggccuacgucuccgccaucgcccagaccgagaaguccaucgaggacaaccccgagaucgaggacgacaucuuccggaagcgccggcugaccaucauggaccugcaccccggcgcggggaagaccaagcgcuaccuccccgccaucgugcgggaggccaucaagcgcggccugcggacgcugauccucgccccgacccgcguggucgcggccgagauggaggaggcccugcgggggcugcccauccgcuaccagacccccgccauccgggccgagcacaccggccgcgagaucguggaccucaugugccacgcgacguucaccaugcgccugcugucccccgugcgggucccgaacuacaaccucaucaucauggacgaggcccacuucaccgaccccgccagcaucgccgcccgcggcuacaucagcacccggguggagaugggggaggcggccggcaucuucaugacggccacgccgcccgggucccgcgacccguucccccagagcaacgcccccaucaucgacgaggagcgggagauccccgagcgcuccuggaacaccggccacgagugggugaccgacuucaaggggaagacggucugguucgugccgagcaucaaggccggcaacgacaucgcggccugccugcggaagaacggcaagaaggugauccagcugucccgcaagaccuucgacagcgaguacgucaagacccggaccaacgacugggacuucguggugacgaccgacaucuccgagaugggggccaacuucaaggccgagcgcgucaucgacccccggcgcugcaugaagcccgugauccucaccgacggcgaggagcgggugauccuggcggggcccaugccggucacccacagcuccgccgcccagcgccggggccgcaucgggcggaaccccaagaacgagaacgaccaguacaucuacaugggcgagccccuggagaacgacgaggacugcgcccacuggaaggaggccaagaugcuccuggacaacaucaacacgcccgagggcaucaucccgagcauguucgagcccgagcgcgagaagguggacgcgaucgacggggaguaccggcugcgcggcgaggcccgcaagaccuucguggaccucaugcggcgcggggaccugcccgucuggcuggccuacaagguggccgccgagggcaucaacuacgcggaccggcgcuggugcuucgacgggaucaagaacaaccagauccucgaggagaacguggaggucgagaucuggaccaaggagggcgagcggaagaagcugaagccgcgcuggcuggacgcccggaucuacuccgacccccucgcccugaaggaguucaaggaguucgccgccggccgcaagagccugacccucaaccugaucacggagauggggcggcugcccaccuucaugacccagaagacccgcgacgcgcucgacaaccuggccgugcugcacacggccgaggccggcgggcgggcguacaaccacgcccucuccgagcugcccgagacccuggagacccuccugcugcucacccugcuggccaccgucacgggcggcaucuuccucuuccugaugagcgggcgcggcaucgggaagaugacccugggcaugugcugcaucaucaccgccuccgugcuccugugguacgcccagauccagccgcacuggaucgcggccagcaucauccuggaguucuuccucaucgugcugcugauccccgagcccgagaagcagcggacgccccaggacaaccagcucacguacgucgugaucgccauccugaccguggucgccgccaccauggcgaacgagaugggguuccuggagaagaccaagaaggaccucggccugggcuccaucgccacgcagcagccggagagcaacauccuggacaucgaccuccgccccgccuccgccuggacccuguacgccguggcgaccaccuucgugacgcccaugcugcggcacagcaucgagaacagcuccgucaacgugagccucaccgccaucgccaaccaggccaccgugcugauggggcugggcaagggguggccccucuccaagauggacaucggcgucccgcugcuggccaucgggugcuacagccaggugaaccccaucacccucacggcggcccugcugcuccugguggcccacuacgccaucaucggccccggccugcaggcgaaggccacccgcgaggcccagaagcgggccgccgcggggaucaugaagaaccccaccgucgacggcaucaccgugaucgaccucgacccgauccccuacgaccccaaguucgagaagcagcugggccaggugaugcugcucauccugugcgucacccaggugcugaugaugcgcaccaccugggcccucugcgaggcccugacccuggccacgggccccaucuccacccucugggaggggaacccgggccgguucuggaacaccaccaucgccgugagcauggcgaacaucuuccgcggcuccuaccuggccggggccggccuccucuucagcaucaugaagaacacgaccaacacccggcgcgggaccggcaacaucggcgagacgcugggggagaaguggaagucccgccugaacgcccucggcaagagcgaguuccagaccuacaagaaguccgggauccaggaggucgaccggacccuggccaaggagggcaucaagcgcggggagaccgaccaccacgcggugagccggggcuccgccaagcugcgcugguucguggagcggaacauggucacgcccgagggcaaggugguggaccucgggugcggccgcgggggcuggagcuacuacugcgggggccugaagaacguccgggaggugaagggccugaccaagggcgggcccgggcacgaggagcccaucccgauguccaccuacggcuggaaccucgugcgccugcagagcggggucgacguguucuucaucccgcccgagaagugcgacacccugcucugcgacaucggcgaguccagccccaacccgaccguggaggccggccggacgcugcgcguccugaaccucguggagaacuggcugaacaacaacacccaguucugcaucaaggugcugaaccccuacaugcccuccgucaucgagaagauggaggcccugcagcggaaguacgggggcgcgcucgugcgcaacccgcugagccggaacagcacccacgagauguacuggguguccaacgccagcgggaacaucgucuccagcgugaacaugaucucccgcaugcugaucaaccgguucaccaugcgccacaagaaggccacguacgagcccgacguggaccucggcagcgggacccggaacaucggcaucgaguccgagauccccaaccuggacaucaucggcaagcgcaucgagaagaucaagcaggagcacgagaccagcuggcacuacgaccaggaccaccccuacaagaccugggccuaccacggguccuacgagacgaagcagaccggcagcgccuccagcauggucaacgggguggugcggcugcucaccaagccgugggacguccugcccaccgugacgcagauggcgaugaccgacaccacccccuucggccagcagcgcguguucaaggagaaggucgacacgcgcacccaggagcccaaggagggcaccaagaagcugaugaagaucaccgccgaguggcucuggaaggagcuggggaagaagaagacgccgcggaugugcacccgcgaggaguucacccggaaggugcgcuccaacgccgcccugggcgccaucuucaccgacgagaacaaguggaaguccgcgcgggaggccguggaggacucccgcuucugggagcucgucgacaaggagcggaaccugcaccuggaggggaagugcgagacgugcguguacaacaugaugggcaagcgcgagaagaagcucggggaguucggcaaggccaagggcagccgggccaucugguacauguggcugggggcccgcuuccuggaguucgaggcgcucggcuuccugaacgaggaccacugguucucccgggagaacagccuguccggggucgagggcgaggggcuccacaagcugggcuacauccugcgcgacgugagcaagaaggagggcggggccauguacgccgacgacaccgccggcugggacacccggaucacccucgaggaccugaagaacgaggagauggugacgaaccacauggagggggagcacaagaagcuggcggaggccaucuucaagcucaccuaccagaacaaggucgugcgcgugcagcggcccacgccccggggcaccgucauggacaucaucagccggcgcgaccagcggggguccggccaggugggcacguacgggcugaacaccuucaccaacauggaggcccagcugauccgccagauggagggcgaggggguguucaagaacauccagcaccucaccgccacggaggaggucgccgugcagaacuggcuggcgcgggugggccgcgagcgccugagccggauggccaucuccggcgacgacugcgucgugaagccccucgacgaccgcuucgccaacgcccugaccgcccugaacgacauggggaagauccggaaggacauccagcagugggagccgagcaagggcuggaacgacuggacccaggugcccuucugcucccaccacuuccacgagcucaucaugaaggacgggcgcguccugguggugcccugccggaaccaggacgagcugaucggccgcgcgcggaucagccagggggccggcuggucccuccgcgagaccgccugccugggcaagagcuacgcccagauguggucccugauguacuuccaccggcgcgaccuccggcuggccgcgaacgccaucugcagcgccguccccucccacugggugccgaccagccgcacgaccugguccauccacgccaagcacgaguggaugaccaccgaggacaugcugacgguguggaaccgggucuggauccgcgagaaccccuggauggaggacaagacccccguggagagcugggaggagauccccuaccucgggaagcgggaggaccaguggugcggcucccugaucgggcugaccagccgcgccaccugggcgaagaacauccaggccgccaucaaccaggugcggucccucaucggcaacgaggaguacacggacuacaugccgagcaugaagcgcuuccggcgcgaggaggaggaggccgggguccugugguga

SEQ ID NO: 9176 - RNA, 9876 nt, Artificial Sequence
  derived and/or modified CDS sequence (opt1) from DENV-2__FJ639718__SS-prME
agcgcggggaugaucaucaugcugauccccaccgugauggccuuccaccucaccacccggaacggggagccccacaugaucgucggcauccaggagaaggggaagucccugcuguucaagaccgaggacggcgugaacaugugcacccucauggcgauggaccugggggagcugugcgaggacaccaucaccuacaagugcccccuccugcggcagaacgagcccgaggacaucgacugcuggugcaacagcaccagcaccugggugaccuacgggaccugcaccaccaccggcgagcaccggcgggagaagcgcagcgucgcccuggugccccacguggggaugggccucgagacccggaccgagaccuggauguccagcgagggggccuggaagcacgcccagcgcaucgagaccuggauccugcggcacccgggcuucacgaucauggccgcgauccuggccuacaccaucgggaccacccacuuccagcgcguccucaucuucauccugcugacggccguggcccccuccaugaccaugcggugcaucggcaucagcaaccgcgacuucguggagggcgucuccgggggcagcuggguggacaucgugcucgagcacggguccugcgucaccaccauggcgaagaacaagcccacgcuggacuucgagcugaucaagaccgaggccaagcagcccgccacccuccggaaguacugcaucgaggccaagcugaccaacacgaccaccgagagccgcugccccacccagggcgagcccucccugaaggaggagcaggacaagcgguucgugugcaagcacagcaugguggaccgcggcugggggaacggcugcggccuguucggcaagggcgggaucgucacgugcgccauguucacgugcaagaagaacauggagggcaagaucgugcagcccgagaaccuggaguacaccaucguggucacgccccacuccggggaggagcacgcggugggcaacgacacggggaagcacggcauggagaucaaggugaccccgcagagcuccaucaccgaggccgagcugaccggguacggcaccgucacgauggagugcagcccccggaccggccucgacuucaacgagauggugcugcugcagauggagaacaaggccuggcucgugcaccgccagugguuccuggaccugccccuccccuggcugccgggggccgacaagcaggaguccaacuggauccagaaggagacccuggucaccuucaagaacccccacgccaagaagcaggacguggucgugcucggcagccaggagggggcgaugcacacggcccugaccggcgccaccgagauccagaugagcuccgggaaccuccuguucaccggccaccugaagugccggcugcgcauggacaagcuccagcugaagggcaugagcuacuccaugugcacggggaaguucaagguggucaaggagaucgccgagacccagcacggcaccaucgugauccgggugcaguacgagggggacggcagccccugcaagauccccuucgagaucauggaccuggagaagcgcuacguccucggccggcugaucaccgugaacccgaucgugacggagaaggacucccccgucaacaucgaggccgagccgcccuucggggacagcuacaucaucaucggcguggagccggggcagcugaagcucaacugguucaagaagggcuccagcaucgggcagauguucgagaccaccaugcgcggcgcgaagcgcauggccauccugggcgacaccgccugggacuucgggucccugggcgggguguucacgagcaucggcaaggcccuccaccaggucuucggggccaucuacggcgcggccuucuccggcgugagcuggaccaugaagauccugaucggggugaucaucaccuggaucggcaugaacucccggagcaccucccugagcgucucccuggugcucguggggaucgucacgcuguaccugggcgugauggugcaggccgacagcgggugcgucguguccuggaagaacaaggagcucaagugcggcagcggcaucuucaucaccgacaacgugcacaccuggaccgagcaguacaaguuccagcccgagagccccuccaagcuggccagcgcgauccagaaggcccaggaggaggggaucugcggcauccgcuccgucacgcggcuggagaaccucauguggaagcagaucacccccgagcugaaccacauccuggccgagaacgaggugaagcucaccaucaugaccggggacaucaagggcaucaugcaggccgggaagcgcagccugcggccgcagcccacggagcugaaguacuccuggaagaccuggggcaaggccaagaugcucagcaccgaguccuacaaccagaccuuccugaucgacggccccgagacggcggagugcccgaacaccaaccgcgccuggaacagccuggagguggaggacuacggguucggcgucuucaccaccaacaucuggcucaagcugaaggagaagcaggacgccuucugcgacuccaagcugaugagcgccgccaucaaggacaaccgggcggugcacgccgacaugggguacuggaucgaguccgcccucaacgacacguggaagaucgagaaggccagcuucaucgaggugaagaacugccacuggcccaagucccacacccuguggagcaacggcguccuggaguccgagaugaucauccccaagaaccucgccggccccgugagccagcacaacuaccgcccgggguaccacacccagaucgcgggccccuggcaccuggggaagcuggagauggacuucgacuucugcgacggcaccaccgugaucgucacggaggacugcgggaaccggggccccucccuccgcaccaccaccgccagcggcaagcugaucacggaguggugcugccggagcugcacccugcccccgcuccgcuaccgcggggaggacggcugcugguacgggauggagauccgcccccugaaggagaaggaggagaaccuggugaacucccucgugaccgccggccacgggcaggucgacaacuucagccugggcgugcugggcauggcccucuuccuggaggagaugcugcggacccgcguggggacgaagcacgcgauccuccuggucgccguguccuucgugacccugaucaccggcaacaugagcuucaaggaccucgggcgggucguggugauggucggcgccaccauggccgacgacaucgggaugggcgugacguaccuggcccugcucgcggccuucaaggugcgccccaccuucgccgccggccugcugcuccggaagcugaccuccaaggagcugaugaugaccacgaucgggaucguccuccugagccaguccaccauccccgagaccgugcuggagcucaccgacgcccuggcgcugggcaugauggugcucaagaucguccgcaacauggagaaguaccagcuggccgugacgaucauggccauccugugcgucccgaacgccgugauccuccagaacgccuggaaggugagcugcaccauccuggcggucguguccgugagcccccugcuccugaccuccagccagcagaagaccgacuggaucccccuggcccucacgaucaaggggcugaaccccaccgccaucuuccugaccacccucucccgcacgaacaagaagcggagcuggccgcugaacgaggccaucauggcggucggcaugguguccauccuggccagcucccuccugaagaacgacauccccaugaccggcccccugguggccgggggccuccugaccgucugcuacgugcugaccgggcgcagcgccgaccucgagcuggagaaggccacggacgugaagugggaggaccaggcggagaucuccggcagcagccccauccuguccaucaccaucagcgaggacggguccaugagcaucaagaacgaggaggaggagcagacccucaccauccugauccggacgggccugcucgucaucuccggccuguucccgaucagcauccccaucaccgccgccgccugguaccugugggaggugaagaagcagcgcgccggggugcucugggacguccccagcccgccgcccaugggcaaggcggagcuggaggacggggccuaccggaucaagcagaagggcauccugggguacagccagaucggcgccggcguguacaaggaggggaccuuccacaccauguggcacgugacccgcggcgccguccucaugcacaaggggaagcggaucgagcccuccugggccgacgugaagaaggaccugaucagcuacggcgggggcuggaagcuggagggcgaguggaaggagggggaggaggugcagguccucgcgcuggagcccggcaagaacccccgcgccgugcagacgaagcccgggcuguucaagaccaacaccggcaccaucggggccgugucccucgacuucagccccggcacguccggcagccccaucaucgacaagaaggggaaggucgugggccuguacgggaacggcguggucacccgguccggcgccuacgugagcgccaucgcgcagaccgagaaguccaucgaggacaaccccgagaucgaggacgacaucuuccgcaagcggcgccugaccaucauggaccugcaccccggggccggcaagacgaagcgguaccuccccgccaucgugcgcgaggccaucaagcgggggcugcgcacccugauccucgcgccgacccgggucguggccgccgagauggaggaggcccugcgcggccugcccauccgguaccagacccccgccauccgcgcggagcacacggggcgggagaucguggaccucaugugccacgccaccuucaccaugcgccugcugagccccguccgcgugccgaacuacaaccucaucaucauggacgaggcccacuucaccgaccccgccuccaucgccgcgcggggcuacaucagcacgcgcguggagaugggcgaggccgccgggaucuucaugaccgccacgccgcccggcagccgggacccguucccccaguccaacgcccccaucaucgacgaggagcgcgagauccccgagcggagcuggaacuccgggcacgagugggucaccgacuucaagggcaagacggugugguucgugccgagcaucaaggcggggaacgacaucgccgccugccugcgcaagaacggcaagaaggucauccagcugucccggaagaccuucgacagcgaguacgugaagacccgcaccaacgacugggacuucguggucacgaccgacaucuccgagaugggcgccaacuucaaggcggagcgggugaucgacccccgccggugcaugaagcccgugauccucaccgacggggaggagcgcgucauccuggccggccccaugccggugacccacagcuccgccgcccagcggcgcgggcggaucggccgcaaccccaagaacgagaacgaccaguacaucuacaugggggagccccuggagaacgacgaggacugcgcccacuggaaggaggcgaagaugcuccuggacaacaucaacacgcccgagggcaucaucccgagcauguucgagcccgagcgggagaagguggacgccaucgacggcgaguaccgccugcgcggggaggcccgcaagaccuucgucgaccucaugcgccggggcgaccugcccguguggcuggccuacaagguggccgcggaggggaucaacuacgccgaccgccgguggugcuucgacggcaucaagaacaaccagauccucgaggagaacgucgagguggagaucuggaccaaggagggggagcgcaagaagcugaagccgcgguggcuggacgcccgcaucuacuccgacccccucgcccugaaggaguucaaggaguucgccgcgggccggaagucccugacccucaaccugaucacggagaugggccgccugcccaccuucaugacccagaagacccgggacgcccucgacaaccuggccguccugcacacggccgaggccggcgggcgcgccuacaaccacgcccucuccgagcugcccgagacccuggagacccuccugcugcucacccugcuggccacggugaccgggggcaucuuccucuuccugaugagcggccgggggaucggcaagaugacccuggggaugugcugcaucaucaccgccuccauccuccugugguacgcgcagauccagccgcacuggaucgccgccagcaucauccuggaguucuuccucaucgugcugcugauccccgagcccgagaagcagcgcacgccccaggacaaccagcucacguacgucgugaucgccauccugaccguggucgccgcgaccauggccaacgagaugggcuuccuggagaagaccaagaaggaccucgggcugggcuccaucgccacgcagcagccggagagcaacauccuggacaucgaccuccggcccgccuccgccuggacccuguacgcgguggccaccaccuucgugacgcccaugcugcgccacagcaucgagaacagcuccgucaacgugagccucaccgccaucgccaaccaggccaccgugcugaugggccuggggaagggcuggccccucuccaagauggacaucggggucccgcugcuggcgaucggcugcuacagccaggugaaccccaucacccucacggccgcccugcugcuccugguggcccacuacgcgaucaucgggcccggccugcaggccaaggccacccgggaggcccagaagcgcgccgcggccggcaucaugaagaaccccaccgucgacgggaucaccgugaucgaccucgacccgauccccuacgaccccaaguucgagaagcagcugggccaggugaugcugcucauccugugcgucacccaggugcugaugaugcggaccaccugggcccucugcgaggcccugacccuggccacggggcccaucuccacccucugggagggcaacccggggcgcuucuggaacaccaccaucgcggugagcauggccaacaucuuccggggcuccuaccuggccggcgccgggcuccucuucagcaucaugaagaacacgaccaacacccgccggggcaccgggaacaucggcgagacgcugggcgagaaguggaagucccgccugaacgcccucggcaagagcgaguuccagaucuacaagaaguccggcauccaggaggucgaccgcacccuggcgaaggaggggaucaagcggggcgagaccgaccaccacgccgugagccgcggguccgccaagcugcggugguucguggagcgcaacauggucacccccgagggcaaggugguggaccucggcugcgggcggggcggguggagcuacuacugcggcgggcugaagaacguccgcgaggugaagggccugacgaagggcgggcccggccacgaggagcccaucccgauguccaccuacggguggaaccucgugcggcugcagagcggcgucgacguguucuucaucccgcccgagaagugcgacacccugcucugcgacaucggggaguccagccccaacccgaccguggaggccggccgcacgcugcggguccugaaccucguggagaacuggcugaacaacaacacccaguucugcaucaaggugcugaaccccuacaugcccuccgucaucgagaagauggaggcgcugcagcgcaaguacggcggggcccucgugcggaacccgcugagccgcaacagcacccacgagauguacuggguguccaacgccagcggcaacaucgucuccagcgugaacaugaucucccggaugcugaucaaccgcuucaccaugcggcacaagaaggccaccuacgagcccgacguggaccucgggagcggcacgcgcaacaucgggaucgaguccgagauccccaaccuggacaucaucggcaagcggaucgagaagaucaaggaggagcacgagaccagcuggcacuacgaccaggaccaccccuacaagaccugggccuaccacggcuccuacgagaccaagcagacggggagcgcguccagcauggucaacggcguggugcgccugcucaccaagccgugggacguccugcccaccgugacccagauggccaugacggacaccacccccuucgggcagcagcggguguucaaggagaaggucgacacccgcacgcaggagcccaaggagggcaccaagaagcugaugaagaucaccgccgaguggcucuggaaggagcugggcaagaagaagaccccgcgcaugugcacgcgggaggaguucacccgcaaggugcgguccaacgccgcccugggggcgaucuucaccgacgagaacaaguggaaguccgcccgcgaggccguggaggacaaccgguucugggagcucgucgacaaggagcgcaaccugcaccuggagggcaagugcgagaccugcguguacaacaugauggggaagcgggagaagaagcucggcgaguucgggaaggccaagggcucccgcgccaucugguacauguggcugggcgcgcgguuccuggaguucgaggcccucggguuccugaacgaggaccacugguucagccgcgagaacucccugagcggcgucgagggggagggccuccacaagcugggguacauccugcgggacguguccaagaaggagggcggcgccauguacgccgacgacacggcggggugggacacccgcaucacccucgaggaccugaagaacgaggagauggugaccaaccacauggagggcgagcacaagaagcuggccgaggccaucuucaagcucacguaccagaacaaggucgugcgggugcagcgccccacgccccgggggaccgucauggacaucaucagccgccgggaccagcgcggcagcggccagguggggaccuacggccugaacacguucaccaacauggaggcccagcugauccggcagauggagggggagggcguguucaagaacauccagcaccucaccgucaccgaggaggccgcggugcagaacuggcuggcccgcguggggcgggagcgccugucccgcauggccaucagcggcgacgacugcgucgugaagccccucgacgaccgguucgccaacgcccugacggcgcugaacgacaugggcaagauccgcaaggacauccagcagugggagccguccaagggguggaacgacuggacccaggugcccuucugcagccaccacuuccacgagcucgucaugaaggacggccgggugcuggugguccccugccgcaaccaggacgagcugaucgggcgggcccgcaucucccagggcgccggguggagccuccgggagaccgccugccugggcaaguccuacgcccagauguggagccugauguacuuccaccgccgggaccuccgccuggcggccaacgccaucugcuccgccgugcccagccacugggugccgaccucccggacgaccuggagcauccacgccaagcacgaguggaugaccaccgaggacaugcugaccgucuggaaccgcguguggauccgggagaaccccuggauggaggacaagacgcccguggaguccugggaggagauccccuaccucggcaagcgcgaggaccaguggugcgggagccugaucggccugaccucccgggcgaccugggccaagaacauccaggccgccaucaaccagguccgcagccucaucgggaacgaggaguacaccgacuacaugccguccaugaagcgguuccgccgggaggaggaggaggcgggcgugcugugguga

SEQ ID NO: 9177 - RNA, 9876 nt, Artificial Sequence
  derived and/or modified CDS sequence (opt1) from DENV-2__GQ868625__SS-prME
agcgcggggaugaucaucaugcugauccccaccgugauggccuuccaccucaccacccgcaacggggagccccacaugaucgucgggauccaggagaaggggaagucccugcuguucaagaccgaggacggcgugaacaugugcacccucauggcgauggaccugggggagcugugcgaggacaccaucaccuacaagugcccccuccugcggcagaacgagcccgaggacaucgacugcuggugcaacagcaccagcaccugggugaccuacgggaccugcaccaccaccggcgagcaccgccgggagaagcgcagcgucgcccuggugccccacguggggaugggccucgagacccggaccgagaccuggauguccagcgagggggccuggaagcacgcccagcgcaucgagaccuggauccugcggcacccgggcuucacgaucauggccgcgauccuggccuacaccaucgggaccacccacuuccagcgcguccucaucuucauccugcugacggccguggcccccuccaugaccaugcggugcaucggcaucagcaaccgcgacuucguggagggcgucuccgggggcagcuggguggacaucgugcucgagcacggguccugcgucaccaccauggcgaagaacaagcccacgcuggacuucgagcugaucaagaccgaggccaagcagcccgccacccuccggaaguacugcaucgaggccaagcugaccaacacgaccaccgagagccgcugccccacccagggcgagcccucccugaaggaggagcaggacaagcgguucgugugcaagcacagcaugguggaccgcggcugggggaacggcugcggccuguucggcaagggcgggaucgucacgugcgccauguucacgugcaagaagaacauggagggcaagaucgugcagcccgagaaccuggaguacaccaucguggucacgccccacuccggggaggagcacgcggugggcaacgacacggggaagcacggcauggagaucaaggugaccccgcagagcuccaucaccgaggccgagcugaccggguacggcaccgucacgauggagugcagcccccggaccggccucgacuucaacgagauggugcugcugcagauggagaacaaggccuggcucgugcaccgccagugguuccuggaccugccccuccccuggcugccgggggccgacaagcaggaguccaacuggauccagaaggagacccuggucaccuucaagaacccccacgccaagaagcaggacguggucgugcucggcagccaggagggggcgaugcacacggcccugaccggcgccaccgagauccagaugagcuccgggaaccuccuguucaccggccaccugaagugccggcugcgcauggacaagcuccagcugaagggcaugagcuacuccaugugcacggggaaguucaagguggucaaggagaucgccgagacccagcacggcaccaucgugauccgggugcaguacgagggggacggcagccccugcaagauccccuucgagaucauggaccuggagaagcgcuacguccucggccggcugaucaccgugaacccgaucgugacggagaaggacucccccgucaacaucgaggccgagccgcccuucggggacagcuacaucaucaucggcguggagccggggcagcugaagcucaacugguucaagaagggcuccagcaucgggcgcauguucgagaccaccaugcgcggcgcgaagcggauggccauccugggcgacaccgccugggacuucgggucccugggcgggguguucacgagcaucggcaaggcccuccaccaggucuucggggccaucuacggcgcggccuucuccggcgugagcuggaccaugaagauccugaucggggugaucaucaccuggaucggcaugaacucccgcagcaccucccugagcgucucccuggugcucguggggaucgucacgcuguaccugggcgugauggugcaggccgacagcgggugcgucguguccuggaagaacaaggagcucaagugcggcagcggcaucuucaucaccgacaacgugcacaccuggaccgagcaguacaaguuccagcccgagagccccuccaagcuggccagcgcgauccagaaggcccaggaggaggggaucugcggcauccgguccgucacgcgccuggagaaccucauguggaagcagaucacccccgagcugaaccacauccuggccgagaacgaggugaagcucaccaucaugaccggggacaucaagggcaucaugcaggccgggaagcggagccugcgcccgcagcccacggagcugaaguacuccuggaagaccuggggcaaggccaagaugcucagcaccgaguccuacaaccagaccuuccugaucgacggccccgagacggcggagugcccgaacaccaaccgggccuggaacagccuggagguggaggacuacggguucggcgucuucaccaccaacaucuggcucaagcugaaggagaagcaggacgccuucugcgacuccaagcugaugagcgccgccaucaaggacaaccgcgcggugcacgccgacaugggguacuggaucgaguccgcccucaacgacacguggaagaucgagaaggccagcuucaucgaggugaagaacugccacuggcccaagucccacacccuguggagcaacggcguccuggaguccgagaugaucauccccaagaaccucgccggccccgugagccagcacaacuaccggccgggguaccacacccagaucgcgggccccuggcaccuggggaagcuggagauggacuucgacuucugcgacggcaccaccgugaucgucacggaggacugcgggaaccgcggccccucccuccggaccaccaccgccagcggcaagcugaucacggaguggugcugccgcagcugcacccugcccccgcuccgguaccgcggggaggacggcugcugguacgggauggagauccggccccugaaggagaaggaggagaaccuggugaacucccucgugaccgccggccacgggcaggucgacaacuucagccugggcgugcugggcauggcccucuuccuggaggagaugcugcgcacccggguggggacgaagcacgcgauccuccuggucgccguguccuucgugacccugaucaccggcaacaugagcuucaaggaccucgggcgcgucguggugauggucggcgccaccauggccgacgacaucgggaugggcgugacguaccuggcccugcucgcggccuucaaggugcggcccaccuucgccgccggccugcugcuccgcaagcugaccuccaaggagcugaugaugaccacgaucgggaucguccuccugagccaguccaccauccccgagaccgugcuggagcucaccgacgcccuggcgcugggcaugauggugcucaagaucguccgcaacauggagaaguaccagcuggccgugacgaucauggccauccugugcgucccgaacgccgugauccuccagaacgccuggaaggugagcugcaccauccuggcggucguguccgugagcccccugcuccugaccuccagccagcagaagaccgacuggaucccccuggcccucacgaucaaggggcugaaccccaccgccaucuuccugaccacccucucccggacgaacaagaagcgcagcuggccgcugaacgaggccaucauggcggucggcaugguguccauccuggccagcucccuccugaagaacgacauccccaugaccggcccccugguggccgggggccuccugaccgucugcuacgugcugaccgggcggagcgccgaccucgagcuggagcgcgccacggacgugaagugggaggaccaggcggagaucuccggcagcagccccauccuguccaucaccaucagcgaggacggguccaugagcaucaagaacgaggaggaggagcagacccucaccauccugauccggacgggccugcucgucaucuccggccuguucccgaucagcauccccaucaccgccgccgccugguaccugugggaggugaagaagcagcgcgccggggugcucugggacguccccagcccgccgcccaugggcaaggcggagcuggaggacggggccuaccggaucaagcagaagggcauccugggguacagccagaucggcgccggcguguacaaggaggggaccuuccacaccauguggcacgugacccgcggcgccguccucaugcacaaggggaagcggaucgagcccuccugggccgacgugaagaaggaccugaucagcuacggcgggggcuggaagcuggagggcgaguggaaggagggggaggaggugcagguccucgcgcuggagcccggcaagaacccccgcgccgugcagacgaagcccgggcuguucaagaccaacaccggcaccaucggggccgugucccucgacuucagccccggcacguccggcagccccaucaucgacaagaaggggaaggucgugggccuguacgggaacggcguggucacccgguccggcgccuacgugagcgccaucgcgcagaccgagaaguccaucgaggacaaccccgagaucgaggacgacaucuuccgcaagcggcgccugaccaucauggaccugcaccccggggccggcaagacgaagcgguaccuccccgccaucgugcgcgaggccaucaagcgggggcugcgcacccugauccucgcgccgacccgggucguggccgccgagauggaggaggcccugcgcggccugcccauccgguaccagacccccgccauccgcgcggagcacacggggcgcgagaucguggaccucaugugccacgccaccuucaccaugcggcugcugagccccguccgcgugccgaacuacaaccucaucaucauggacgaggcccacuucaccgaccccgccuccaucgccgcgcggggcuacaucagcacgcgcguggagaugggcgaggccgccgggaucuucaugaccgccacgccgcccggcagccgggacccguucccccaguccaacgcccccaucaucgacgaggagcgcgagauccccgagcggagcuggaacuccgggcacgagugggucaccgacuucaagggcaagacggugugguucgugccgagcaucaaggcggggaacgacaucgccgccugccugcgcaagaacggcaagaaggucauccagcugucccggaagaccuucgacagcgaguacgugaagacccgcaccaacgacugggacuucguggucacgaccgacaucuccgagaugggcgccaacuucaaggcggagcgggugaucgacccccgccggugcaugaagcccgugauccucaccgacggggaggagcgcgucauccuggccggccccaugccggugacccacagcuccgccgcccagcggcgcgggcggaucggccgcaaccccaagaacgagaacgaccaguacaucuacaugggggagccccuggagaacgacgaggacugcgcccacuggaaggaggcgaagaugcuccuggacaacaucaacacgcccgagggcaucaucccgagcauguucgagcccgagcgggagaagguggacgccaucgacggcgaguaccgccugcgcggggaggcccggaagaccuucgucgaccucaugcgccggggcgaccugcccguguggcuggccuacaagguggccgcggaggggaucaacuacgccgaccgccgguggugcuucgacggcaucaagaacaaccagauccucgaggagaacgucgagguggagaucuggaccaaggagggggagcgcaagaagcugaagccgcgguggcuggacgcccgcaucuacuccgacccccucgcccugaaggaguucaaggaguucgccgcgggccggaagucccugacccucaaccugaucacggagaugggccgccugcccaccuucaugacccagaagacccgggacgcccucgacaaccuggccguccugcacacggccgaggccggcgggcgcgccuacaaccacgcccucuccgagcugcccgagacccuggagacccuccugcugcucacccugcuggccacggugaccgggggcaucuuccucuuccugaugagcggccgggggaucggcaagaugacccuggggaugugcugcaucaucaccgccuccauccuccugugguacgcgcagauccagccgcacuggaucgccgccagcaucauccuggaguucuuccucaucgugcugcugauccccgagcccgagaagcagcgcacgccccaggacaaccagcucacguacgucgugaucgccauccugaccguggucgccgcgaccauggccaacgagaugggcuuccuggagaagaccaagaaggaccucgggcugggcuccaucgccacgcagcagccggagagcaacauccuggacaucgaccuccggcccgccuccgccuggacccuguacgcgguggccaccaccuucgugacgcccaugcugcgccacagcaucgagaacagcuccgucaacgugagccucaccgccaucgccaaccaggccaccgugcugaugggccuggggaagggcuggccccucuccaagauggacaucggggucccgcugcuggcgaucggcugcuacagccaggugaaccccaucacccucacggccgcccugcugcuccugguggcccacuacgcgaucaucgggcccggccugcaggccaaggccacccgggaggcccagaagcgcgccgcggccggcaucaugaagaaccccaccgucgacgggaucaccgugaucgaccucgacccgauccccuacgaccccaaguucgagaagcagcugggccaggugaugcugcucauccugugcgucacccaggugcugaugaugcggaccaccugggcccucugcgaggcccugacccuggccacggggcccaucuccacccucugggagggcaacccggggcgcuucuggaacaccaccaucgcggugagcauggccaacaucuuccggggcuccuaccuggccggcgccgggcuccucuucagcaucaugaagaacacgaccaacacccgccgcggcaccgggaacaucggcgagacgcugggcgagaaguggaagucccggcugaacgcccucggcaagagcgaguuccagaucuacaagaaguccggcauccaggaggucgaccgcacccuggcgaaggaggggaucaagcggggcgagaccgaccaccacgccgugagccgcggguccgccaagcugcggugguucguggagcgcaacauggucacccccgagggcaaggugguggaccucggcugcgggcggggcggguggagcuacuacugcggcgggcugaagaacguccgcgaggugaagggccugacgaagggcgggcccggccacgaggagcccaucccgauguccaccuacggguggaaccucgugcggcugcagagcggcgucgacguguucuucaucccgcccgagaagugcgacacccugcucugcgacaucggggaguccagccccaacccgaccguggaggccggccgcacgcugcggguccugaaccucguggagaacuggcugaacaacaacacccaguucugcaucaaggugcugaaccccuacaugcccuccgucaucgagaagauggaggcgcugcagcgcaaguacggcggggcccucgugcggaacccgcugagccgcaacagcacccacgagauguacuggguguccaacgccagcggcaacaucgucuccagcgugaacaugaucucccggaugcugaucaaccgcuucaccaugcggcacaagaaggccaccuacgagcccgacguggaccucgggagcggcacgcgcaacaucgggaucgaguccgagauccccaaccuggacaucaucggcaagcggaucgagaagaucaaggaggagcacgagaccagcuggcacuacgaccaggaccaccccuacaagaccugggccuaccacggcuccuacgagaccaagcagacggggagcgcguccagcauggucaacggcguggugcgccugcucaccaagccgugggacguccugcccaccgugacccagauggccaugacggacaccacccccuucgggcagcagcgcguguucaaggagaaggucgacacccggacgcaggagcccaaggagggcaccaagaagcugaugaagaucaccgccgaguggcucuggaaggagcugggcaagaagaagaccccgcgcaugugcacgcgggaggaguucacccgcaaggugcgguccaacgccgcccugggggcgaucuucaccgacgagaacaaguggaaguccgcccgcgaggccguggaggacucccgguucugggagcucgucgacaaggagcgcaaccugcaccuggagggcaagugcgagaccugcguguacaacaugauggggaagcgggagaagaagcucggcgaguucgggaaggccaagggcagccgcgccaucugguacauguggcugggcgcgcgguuccuggaguucgaggcccucggguuccugaacgaggaccacugguucucccgcgagaacagccuguccggcgucgagggggagggccuccacaagcugggguacauccugcgggacgugagcaagaaggagggcggcgccauguacgccgacgacacggcggggugggacacccgcaucacccucgaggaccugaagaacgaggagauggugaccaaccacauggagggcgagcacaagaagcuggccgaggccaucuucaagcucacguaccagaacaaggucgugcgggugcagcgccccacgccccgggggaccgucauggacaucaucagccgccgggaccagcgcggcuccggccaggugggcaccuacggccugaacacguucaccaacauggaggcccagcugauccggcagauggagggggagggcguguucaagaacauccagcaccucaccgucaccgaggaggccgcggugcagaacuggcuggcccgcguggggcgcgagcggcugagccgcauggccaucuccggcgacgacugcgucgugaagccccucgacgaccgguucgccaacgcccugacggcgcugaacgacaugggcaagauccgcaaggacauccagcagugggagccgagcaagggguggaacgacuggacccaggugcccuucugcucccaccacuuccacgagcucgucaugaaggacggccgggugcuggugguccccugccgcaaccaggacgagcugaucgggcgggcccgcaucagccagggcgccggguggucccuccgggagaccgccugccugggcaagagcuacgcccagauguggucccugauguacuuccaccgccgggaccuccgccuggcggccaacgccaucugcagcgccgugcccucccacugggugccgaccagccggacgaccugguccauccacgccaagcacgaguggaugaccaccgaggacaugcugaccgucuggaaccgcguguggauccgggagaaccccuggauggaggacaagacgcccguggagagcugggaggagauccccuaccucggcaagcgcgaggaccaguggugcgggucccugaucggccugaccagccgggcgaccugggccaagaacauccaggccgccaucaaccagguccgcucccucaucgggaacgaggaguacaccgacuacaugccgagcaugaagcgguuccgccgcgaggaggaggaggcgggcgugcugugguga

SEQ ID NO: 9178 - RNA, 9876 nt, Artificial Sequence
  derived and/or modified CDS sequence (opt1) from DENV-2__KF955401__SS-prME
agcgccgggaugaucaucaugcugauccccaccgugauggccuuccaccucaccacccgcaacggggagccccacaugaucgucgggauccaggagaagggcaagagccugcuguucaagaccgaggacggcgugaacaugugcacccucauggcgauggaccugggggagcugugcgaggacaccaucaccuacaagugcccccuccugcggcagaacgagcccgaggacaucgacugcuggugcaacagcaccagcaccugggugaccuacgggaccugcaccaccaccggcgagcaccgccgggagaagcgcagcgucgcccuggugccccacguggggaugggccucgagacccggaccgagaccuggaugagcagcgagggggccuggaagcacgcccagcgcaucgagaccuggauccugcggcacccgggcuucacgaucauggccgcgauccuggccuacaccaucgggaccacccacuuccagcgcguccucaucuucauccugcugacggccguggcccccuccaugaccaugcggugcaucggcaucagcaaccgcgacuucguggagggcgucuccgggggcagcuggguggacaucgugcucgagcacggguccugcgucaccaccauggcgaagaacaagcccacgcuggacuucgagcugaucaagaccgaggccaagcagcccgccacccuccggaaguacugcaucgaggccaagcugaccaacacgaccaccgagagccgcugccccacccagggcgagcccucccugaaggaggagcaggacaagcgguucgugugcaagcacagcaugguggaccgcggcugggggaacggcugcggccuguucggcaagggcgggaucgucacgugcgccauguucacgugcaagaagaacauggagggcaagaucgugcagcccgagaaccuggaguacaccaucguggucacgccccacuccggggaggagcacgcggugggcaacgacacggggaagcacggcauggagaucaaggugaccccgcagagcuccaucaccgaggccgagcugaccggguacggcaccgucacgauggagugcagcccccggaccggccucgacuucaacgagauggugcugcugcagauggagaacaaggccuggcucgugcaccgccagugguuccuggaccugccccuccccuggcugccgggggccgacaagcaggaguccaacuggauccagaaggagacccuggucaccuucaagaacccccacgccaagaagcaggacguggucgugcucggcagccaggagggggcgaugcacacggcccugaccggcgccaccgagauccagaugagcuccgggaaccuccuguucaccggccaccugaagugccggcugcgcauggacaagcuccagcugaagggcaugagcuacuccaugugcacggggaaguucaagguggucaaggagaucgccgagacccagcacggcaccaucgugauccgggugcaguacgagggggacggcagccccugcaagauccccuucgagaucauggaccuggagaagcgcuacguccucggccggcugaucaccgugaacccgaucgugacggagaaggacucccccgucaacaucgaggccgagccgcccuucggggacagcuacaucaucaucggcguggagccggggcagcugaagcucaacugguucaagaagggcuccagcaucgggcagauguucgagaccaccaugcgcggcgcgaagcgcauggccauccugggcgacaccgccugggacuucgggucccugggcgggguguucacgagcaucggcaaggcccuccaccaggucuucggggccaucuacggcguggcguucuccggcgugagcuggaccaugaagauccugaucggggucaucaucaccuggaucggcaugaacucccggagcaccucccugagcgugucccuggugcucgucgggaucgugacgcuguaccugggcgugaugguccaggccgacagcgggugcgugguguccuggaagaacaaggagcucaagugcggcagcggcaucuucaucaccgacaacguccacaccuggaccgagcaguacaaguuccagcccgagagccccuccaagcuggccagcgccauccagaaggcgcaggaggaggggaucugcggcauccgcuccgugacgcggcuggagaaccucauguggaagcagaucacccccgagcugaaccacauccuggccgagaacgaggugaagcucaccaucaugaccggggacaucaagggcaucaugcaggccgggaagcgcagccugcggccgcagcccacggagcugaaguacuccuggaagaccuggggcaaggccaagaugcuguucaccgagagcuacaaccagaccuuccugaucgacggccccgagacggccgagugcccgaacaccaaccgcgcguggaacucccuggaggucgaggacuacggguucggcguguucaccaccaacaucuggcucaagcugaaggagaagcaggacgccuucugcgacagcaagcugauguccgccgccaucaaggacaaccgggccgugcacgcggacaugggguacuggaucgagagcgcccucaacgacacguggaagaucgagaaggccuccuucaucgaggucaagaacugccacuggcccaagagccacacccugugguccaacggcgugcuggagagcgagaugaucauccccaagaaccucgccggccccgugucccagcacaacuaccgcccgggguaccacacccagaucgccggccccuggcaccuggggaagcuggagauggacuucgacuucugcgacggcaccaccgucaucgugacggaggacugcgggaaccggggccccagccuccgcaccaccaccgcguccggcaagcugaucacggaguggugcugccggagcugcacccugcccccgcuccgcuaccgcggggaggacggcugcugguacgggauggagauccgcccccugaaggagaaggaggagaaccuggugaacagccucgucaccgccggccacggccagguggacaacuucucccugggcgugcugggcauggcccucuuccuggaggagaugcugcggacccgcgucgggacgaagcacgccauccuccugguggcggugagcuucgucacccugaucaccggcaacauguccuucaaggaccucgggcgggugguggucauggugggcgccaccauggccgacgacaucgggaugggcgugacguaccuggcccugcucgccgcguucaagguccgccccaccuucgccgccggccugcugcuccggaagcugaccagcaaggagcugaugaugaccacgaucgggaucgugcuccugucccagagcaccauccccgagaccgugcuggagcucaccgacgcccuggcccugggcaugaugguccucaagaucgugcgcaacauggagaaguaccagcuggcggucacgaucauggccauccugugcgugccgaacgccgugauccuccagaacgccuggaaggucuccugcaccauccuggccguggugagcgucagcccccuccuccugaccagcucccagcagaagaccgacuggaucccccuggcgcucacgaucaaggggcugaaccccaccgccaucuuccugaccacccucagccgcacgaacaagaagcgguccuggccgcugaacgaggccaucauggccgugggcauggugagcauccuggcguccagccuccugaagaacgacauccccaugaccggcccccuggucgccgggggccuccugaccgugugcuacgugcugaccgggcgcuccgccgaccucgagcuggagcgggccacggacgucaagugggaggaccaggccgagaucagcggcuccagccccauccugagcaucaccaucuccgaggacgggagcauguccaucaagaacgaggaggaggagcagacccucaccauccugauccgcacgggccugcucgugaucagcggccuguucccgaucuccauccccaucaccgcggccgccugguaccugugggaggugaagaagcagcgggccgggguccucugggacgugcccuccccgccgcccaugggcaaggccgagcuggaggacggggcguaccgcaucaagcagaagggcauccugggguacucccagaucggcgccggcguguacaaggaggggaccuuccacaccauguggcacgucacccggggcgccgugcucaugcacaaggggaagcgcaucgagcccagcugggccgacgugaagaaggaccugaucuccuacggcgggggcuggaagcuggagggcgaguggaaggagggggaggagguccaggugcucgcccuggagcccggcaagaacccccgggcggugcagacgaagcccgggcuguucaagaccaacaccggcaccaucggggccgucagccucgacuucucccccggcacgagcggcucccccaucaucgacaagaaggggaagguggugggccuguacgggaacggcgucgugacccgcagcggcgccuacguguccgccaucgcccagaccgagaaguccaucgaggacaaccccgagaucgaggacgacaucuuccggaagcgccggcugaccaucauggaccugcaccccggggcgggcaagacgaagcgcuaccuccccgccaucguccgggaggccaucaagcgcgggcugcggacccugauccucgccccgacccgcgugguggcggccgagauggaggaggcccugcggggccugcccauccgcuaccagacccccgccauccgggccgagcacacggggcgcgagaucgucgaccucaugugccacgcgaccuucaccaugcgccugcugucccccgugcgggugccgaacuacaaccucaucaucauggacgaggcccacuucaccgaccccgccagcaucgccgcccgcggcuacaucuccacgcgggucgagaugggcgaggcggccgggaucuucaugaccgccacgccgcccggcagccgcgacccguucccccagagcaacgcccccaucaucgacgaggagcgggagauccccgagcgcuccuggaacagcgggcacgagugggugaccgacuucaagggcaagacggugugguucgucccguccaucaaggccgggaacgacaucgcggccugccugcggaagaacggcaagaaggugauccagcugagccgcaagaccuucgacuccgaguacgugaagacccggaccaacgacugggacuucgucgugacgaccgacaucagcgagaugggcgccaacuucaaggccgagcgcgugaucgacccccggcgcugcaugaagcccgucauccucaccgacggggaggagcgggugauccuggcgggccccaugccggugacccacuccagcgccgcccagcgccgggggcgcaucggccggaaccccaagaacgagaacgaccaguacaucuacaugggggagccccuggagaacgacgaggacugcgcccacuggaaggaggccaagaugcuccuggacaacaucaacacgcccgagggcaucaucccguccauguucgagcccgagcgcgagaaggucgacgcgaucgacggcgaguaccggcugcgcggggaggcccgcaagaccuucguggaccucaugcggcgcggcgaccugcccguguggcuggccuacaaggucgccgccgaggggaucaacuacgcggaccggcgcuggugcuucgacggcaucaagaacaaccagauccucgaggagaacguggaggucgagaucuggaccaaggagggggagcggaagaagcugaagccgcgcuggcuggacgcccggaucuacagcgacccccucgcccugaaggaguucaaggaguucgccgccggccgcaagucccugacccucaaccugaucacggagaugggccggcugcccaccuucaugacccagaagacccgcgacgcgcucgacaaccuggccgugcugcacacggccgaggccgggggccgggcguacaaccacgcccucagcgagcugcccgagacccuggagacccuccugcugcucacccugcuggccacggugaccgggggcaucuuccucuuccugauguccggccgcgggaucggcaagaugacccuggggaugugcugcaucaucaccgccagcauccuccugugguacgcccagauccagccgcacuggaucgcggccuccaucauccuggaguucuuccucaucguccugcugauccccgagcccgagaagcagcggacgccccaggacaaccagcucacguacguggugaucgccauccugaccgucguggccgccaccauggcgaacgagaugggcuuccuggagaagaccaagaaggaccucgggcugggcagcaucgccacgcagcagccggaguccaacauccuggacaucgaccuccgccccgccagcgccuggacccuguacgccguggcgaccaccuucgucacgcccaugcugcggcacuccaucgagaacagcagcgugaacgugucccucaccgccaucgccaaccaggccaccguccugaugggccuggggaagggcuggccccucagcaagauggacaucggggugccgcugcuggccaucggcugcuacucccaggugaaccccaucacccucacggcggcccugcugcuccuggucgcccacuacgccaucaucgggcccggccugcaggcgaaggccacccgcgaggcccagaagcgggccgccgcgggcaucaugaagaaccccaccguggacgggaucaccgugaucgaccucgacccgauccccuacgaccccaaguucgagaagcagcugggccaggucaugcugcucauccugugcgugacccaggugcugaugaugcgcaccaccugggcccucugcgaggcccugacccuggccacggggcccaucagcacccucugggagggcaacccggggcgguucuggaacaccaccaucgccgucuccauggcgaacaucuuccgcggcagcuaccuggccggcgccgggcuccucuucuccaucaugaagaacacgaccaacacccggcgcggcaccgggaacaucggcgagacgcugggcgagaaguggaagucccgccugaacgcccucgggaaguccgaguuccagaucuacaagaaguccggcauccaggagguggaccggacccuggccaaggaggggaucaagcgcggcgagaccgaccaccacgcggugucccgggggagcgccaagcugcgcugguucgucgagcggaacauggugacccccgagggcaagguggucgaccucggcugcgggcgcggcgggugguccuacuacugcggcgggcugaagaacgugcgggaggugaagggccugacgaagggcgggcccggccacgaggagcccaucccgaugagcaccuacggguggaaccucguccgccugcaguccggcguggacguguucuucaucccgcccgagaagugcgacacccugcucugcgacaucggggagagcucccccaacccgaccgucgaggccggccggacgcugcgcgugcugaaccucguggagaacuggcugaacaacaacacccaguucugcaucaagguccugaaccccuacaugcccagcgugaucgagaagauggaggcccugcagcggaaguacggcggggcgcucgugcgcaacccgcugucccggaacagcacccacgagauguacugggucagcaacgccuccggcaacaucgugagcuccgugaacaugaucagccgcaugcugaucaaccgguucaccaugcgccacaagaaggccaccuacgagcccgacgucgaccucggguccggcacgcggaacaucgggaucgagagcgagacccccaaccuggacaucaucggcaagcgcaucgagaagaucaaggaggagcacgagaccuccuggcacuacgaccaggaccaccccuacaagaccugggccuaccacggcagcuacgagacgaagcagaccggguccgccagcuccauggugaacggcgugguccggcugcucaccaagccgugggacgugcugcccaccgugacgcagauggcgaugaccgacaccacccccuucgggcagcagcgcgucuucaaggagaagguggacacgcgcacccaggagcccaaggagggcaccaagaagcugaugaagaucaccgccgaguggcucuggaaggagcugggcaagaagaagacgccgcggaugugcacccgcgaggaguucacccggaaggugcgcagcaacgccgcccugggggccaucuucaccgacgagaacaaguggaaguccgcgcgggaggccgucgaggacagccgcuucugggagcucguggacaaggagcggaaccugcaccuggagggcaagugcgagacgugcgucuacaacaugauggggaagcgcgagaagaagcucggcgaguucgggaaggccaagggcucccgggccaucugguacauguggcugggcgcccgcuuccuggaguucgaggcgcucggguuccugaacgaggaccacugguucagccgggagaacucccugagcggcguggagggggagggccuccacaagcugggguacauccugcgcgacguguccaagaaggagggcggcgccauguacgccgacgacaccgccgggugggacacccggaucacccucgaggaccugaagaacgaggagauggucacgaaccacauggagggcgagcacaagaagcuggcggaggccaucuucaagcucaccuaccagaacaagguggugcgcguccagcggcccacgccccgggggaccgugauggacaucaucagccggcgcgaccagcggggcagcggccagguggggacguacggccugaacaccuucaccaacauggaggcccagcugauccgccagauggagggggagggcgucuucaagaacauccagcaccucaccgugacggaggaggccgccgugcagaacuggcuggcgcgggucgggcgcgagcgccugucccggauggccaucagcggcgacgacugcguggugaagccccucgacgaccgcuucgccaacgcccugaccgcccugaacgacaugggcaagauccggaaggacauccagcagugggagccguccaagggguggaacgacuggacccagguccccuucugcagccaccacuuccacgagcucaucaugaaggacggccgcgugcuggugguccccugccggaaccaggacgagcugaucgggcgcgcgcggaucucccagggcgccggguggagccuccgcgagaccgccugccugggcaaguccuacgcccagauguggagccugauguacuuccaccggcgcgaccuccggcuggccgcgaacgccaucugcuccgccgugcccagccacugggugccgacgucccgcaccaccuggagcauccacgccaagcacgaguggaugaccaccgaggacaugcugacggucuggaaccggguguggauccgcgagaaccccuggauggaggacaagacccccguggaguccugggaggagauccccuaccucggcaagcgggaggaccaguggugcgggagccugaucggccugaccucccgcgccaccugggcgaagaacauccaggccgccaucaaccagguccggagccucaucgggaacgaggaguacacggacuacaugccguccaugaagcgcuuccggcgcgaggaggaggaggccggcgugcugugguga

SEQ ID NO: 9179 - RNA, 9876 nt, Artificial Sequence
  derived and/or modified CDS sequence (opt1) from DENV-2__JF730047__SS-prME
agcgccggcaugaucaucaugcugauccccaccgugauggccuuccaccucaccacccgcaacggggagccccacaugaucgugggcauccaggagaagggcaagagccugcuguucaagaccgaggacggcgugaacaugugcacccucauggcgauggaccugggggagcugugcgaggacaccaucaccuacaagugcccccuccugcggcagaacgagcccgaggacaucgacugcuggugcaacagcaccagcaccugggugaccuacgggaccugcaccaccaccggcgagcaccgccgggagaagcgcagcgucgcccuggugccccacguggggaugggccucgagacccggaccgagaccuggauguccagcgagggggccuggaagcacgcccagcgcaucgagaccuggauccugcggcacccgggcuucaccaucauggccgcgauccuggccuacaccaucgggaccacccacuuccagcgcgcccucaucuucauccugcugacggccgucgcgcccuccaugaccaugcggugcaucggcaucagcaaccgcgacuucguggagggcguguccgggggcagcugggucgacaucgugcucgagcacggguccugcgugaccaccauggccaagaacaagcccacgcuggacuucgagcugaucaagaccgaggccaagcagcccgccacccuccggaaguacugcaucgaggccaagcugaccaacacgaccaccgagagccgcugccccacccagggcgagcccucccugaaggaggagcaggacaagcgguucgucugcaagcacagcaugguggaccgcggcugggggaacggcugcgggcuguucggcaagggcgggaucgugacgugcgcgauguucacgugcaagaagaacauggagggcaagaucguccagcccgagaaccuggaguacaccaucguggugacgccccacuccggggaggagcacgccgucggcaacgacacggggaagcacggcaaggagaucaaggugaccccgcagagcuccaucaccgaggccgagcugaccggguacggcaccgugacgauggagugcagcccccggaccggccucgacuucaacgagaugguccugcugcagauggaguccaaggccuggcucgugcaccgccagugguuccuggaccugccccuccccuggcugccgggggccgacaagcagggcagcaacuggauccagaaggagacccuggugaccuucaagaacccccacgcgaagaagcaggacgucgugguccucgggagccaggagggcgccaugcacacggcccugaccggggccaccgagauccagauguccagcggcaaccuccuguucaccggccaccugaagugccggcugcgcauggacaagcuccagcugaaggggauguccuacagcaugugcacgggcaaguucaagguggugaaggagaucgccgagacccagcacgggaccaucgucauccgggugcaguacgagggcgacggcucccccugcaagauccccuucgagaucauggaccuggagaagcgcuacgugcucgggcggcugaucaccgucaacccgaucgugacggagaaggacagccccgugaacaucgaggcggagccgcccuucggcgacuccuacaucaucaucggggucgagccgggccagcugaagcucaacugguucaagaaggggagcuccaucggccagauguucgagaccaccaugcgcggcgccaagcgcauggccauccugggggacaccgccugggacuucggcagccucggcgggguguucacguccaucgggaaggcccuccaccagguguucggggcgaucuacggcgccgccuucagcggggucuccuggaccaugaagauccugaucggcgugaucaucaccuggaucgggaugaacagccgguccaccagccuguccgugagccugguccucgugggcaucgugacgcuguaccugggggucauggugcaggccgacuccggcugcguggucagcuggaagaacaaggagcucaagugcggcagcgggaucuucaucaccgacaacgugcacaccuggaccgagcaguacaaguuccagcccgagucccccagcaagcuggcguccgccauccagaaggcccaggaggagggcaucugcgggauccgcagcgugacgcggcuggagaaccucauguggaagcagaucacccccgagcugaaccacauccuggccgagaacgaggucaagcucaccaucaugaccggcgacaucaaggggaucaugcaggccggcaagcgcucccugcggccgcagcccacggagcugaaguacagcuggaagaccuggggcaaggcgaagaugcucuccaccgagagccacaaccagaccuuccugaucgacgggcccgagacggccgagugcccgaacaccaaccgcgccuggaacucccuggagguggaggacuacggcuucgggguguucaccaccaacaucuggcucaagcugaaggagaagcaggacgccuucugcgacagcaagcugauguccgccgcgaucaaggacaaccgggccguccacgccgacaugggcuacuggaucgagagcgcccucaacgacacguggaagaucgagaaggccuccuucaucgaggugaagaacugccacuggcccaagagccacacccugugguccaacggcgugcuggagagcgagaugaucauccccaagaaccucgcggggcccgucucccagcacaacuaccgcccgggcuaccacacccagaccgccgggcccuggcaccugggcaagcuggagauggacuucgacuucugcgacgggaccacggugaucgugaccgaggacugcggcaaccggggccccagccuccgcaccaccacggccagcgggaagcugaucaccgaguggugcugccgguccugcacccugcccccgcuccgcuaccggggcgaggacgggugcugguacggcauggagauccgcccccugaaggagaaggaggagaaccuggucaacagccucgugaccgccgggcacggccagguggacaacuucucccugggcguccuggggauggcccuguuccuggaggagaugcugcggacgcgcgugggcaccaagcacgccauccuccugguggccgucagcuucgugacccugaucaccgggaacauguccuucaaggaccucggccggguggucgugaugguggggacgaccaugaccgacgacaucggcaugggcgucaccuaccuggcccugcucgccgcguucaaggugcgccccacguucgccgccgggcugcugcuccggaagcugaccagcaaggagcugaugaugaccaccaucggcaucgugcuccugucccagagcacgauccccgagaccauccuggagcucaccgacgcccuggcccuggggaugaugguccucaagaucgugcgcgacauggagaaguaccagcuggcggugaccaucauggccauccugugcgucccgaacgccgugauccuccagaacgccuggaaggucuccugcacgauccuggccguggugagcgucagcccccugcuccugaccagcucccagcagaagaccgacuggaucccccuggcgcucaccaucaagggccugaaccccacggccaucuuccugaccacccucagccgcaccaacaagaagcgguccuggccgcugaacgaggccaucauggccgugggcauggugagcauccuggcguccagccuccugaagaacgacauccccaugacggggccccuggucgccggcgggcuccugaccgugugcuacgugcugaccggccgcuccgccgaccucgagcuggagcgggccaccgacgucaagugggaggaccaggccgagaucagcgggagcucccccauccugagcaucacgaucuccgaggacggcagcauguccaucaagaacgaggaggaggagcagacccucaccauccugauccgcaccggccugcucgugaucagcgggcuguucccgguguccauccccaucaccgcggccgccugguaccugugggaggucaagaagcagcgggccggcgugcucugggacgugcccuccccgccgcccauggggaaggccgagcuggaggacggcgcguaccgcaucaagcagaaggggauccugggcuacucccagaucggcgccggggucuacaaggagggcacguuccacaccauguggcacgugacccgcggggcggugcucaugcacaagggcaagcgcaucgagcccagcugggccgacgucaagaaggaccugaucuccuacgggggcggcuggaagcuggagggggaguggaaggagggcgaggagguccaggugcucgcccuggagcccgggaagaacccccgggcgguccagaccaagcccggccuguucaagacgaacaccgggaccaucggcgccgugagccucgacuucucccccggcaccagcgggucccccaucaucgacaagaagggcaagguggucgggcuguacggcaacggcguggugacgcgcagcggggccuacgucuccgccaucgcccagaccgagaaguccaucgaggacaaccccgagaucgaggacgacaucuuccggaagcgccggcugaccaucauggaccugcaccccggcgcggggaagaccaagcgcuaccuccccgccaucgugcgggaggccaucaagcgcggccugcggacgcugauccucgccccgacccgcguggucgcggccgagauggaggaggcccugcgggggcugcccauccgcuaccagacccccgccauccgggccgagcacaccggccgcgagaucguggaccucaugugccacgcgacguucaccaugcgccugcugucccccgugcgggucccgaacuacaaccucaucaucauggacgaggcccacuucaccgaccccgccagcaucgccgcccgcggcuacaucagcacccggguggagaugggggaggcggccggcaucuucaugacggccacgccgcccgggucccgcgacccguucccccagagcaacgcccccaucaucgacgaggagcgggagauccccgagcgcuccuggaacaccggccacgagugggugaccgacuucaaggggaagacggucugguucgugccgagcaucaaggccggcaacgacaucgcggccugccugcggaagaacggcaagaaggugauccagcugucccgcaagaccuucgacagcgaguacgucaagacccggaccaacgacugggacuucguggugacgaccgacaucuccgagaugggggccaacuucaaggccgagcgcgucaucgacccccggcgcugcaugaagcccgugauccucaccgacggcgaggagcgggugauccuggcggggcccaugccggucacccacagcuccgccgcccagcgccggggccgcaucgggcggaaccccaagaacgagaacgaccaguacaucuacaugggcgagccccuggagaacgacgaggacugcgcccacuggaaggaggccaagaugcuccuggacaacaucaacacgcccgagggcaucaucccgagcauguucgagcccgagcgcgagaagguggacgcgaucgacggggaguaccggcugcgcggcgaggcccgcaagaccuucguggaccucaugcggcgcggggaccugcccgucuggcuggccuacaagguggccgccgagggcaucaacuacgcggaccggcgcuggugcuucgacgggaucaagaacaaccagauccucgaggagaacguggaggucgagaucuggaccaaggagggcgagcggaagaagcugaagccgcgcuggcuggacgcccggaucuacuccgacccccucgcccugaaggaguucaaggaguucgccgccggccgcaagagccugacccucaaccugaucacggagauggggcggcugcccaccuucaugacccagaagacccgcgacgcgcucgacaaccuggccgugcugcacacggccgaggccggcgggcgggcguacaaccacgcccucuccgagcugcccgagacccuggagacccuccugcugcucacccugcuggccaccgucacgggcggcaucuuccucuuccugaugagcgggcgcggcaucgggaagaugacccugggcaugugcugcaucaucaccgccuccauccuccugugguacgcccagauccagccgcacuggaucgcggccagcaucauccuggaguucuuccucaucgugcugcugauccccgagcccgagaagcagcggacgccccaggacaaccagcucacguacguggucaucgccauccugaccgugguggccgccaccauggcgaacgagaugggguuccuggagaagaccaagaaggaccucggccugggcuccaucgccacgcagcagccggagagcaacauccuggacaucgaccuccgccccgccuccgccuggacccuguacgccgucgcgaccaccuucgugacgcccaugcugcggcacagcaucgagaacagcuccgugaacgucagccucaccgccaucgccaaccaggccaccgugcugauggggcugggcaagggguggccccucuccaagauggacaucggcgugccgcugcuggccaucgggugcuacagccaggucaaccccaucacccucacggcggcccugcugcuccugguggcccacuacgccaucaucggccccggccugcaggcgaaggccacccgcgaggcccagaagcgggccgccgcggggaucaugaagaaccccaccguggacggcaucaccgucaucgaccucgacccgauccccuacgaccccaaguucgagaagcagcugggccaggugaugcugcucauccugugcgugacgcagguccugaugaugcgcaccaccugggcccucugcgaggcccugacccuggccacgggccccaucuccacccucugggaggggaacccgggccgguucuggaacaccaccaucgccgugagcauggcgaacaucuuccgcggcuccuaccuggccggggccggccuccucuucagcaucaugaagaacacgaccaacacccggcgcgggaccggcaacaucggcgagacgcugggggagaaguggaagucccgccugaacgcccucggcaagagcgaguuccagaccuacaagaaguccgggauccaggagguggaccggacccuggccaaggagggcaucaagcgcggggagaccgaccaccacgcggucagccggggcuccgccaagcugcgcugguucguggagcggaacauggugacgcccgagggcaaggucguggaccucgggugcggccgcgggggcuggagcuacuacugcgggggccugaagaacgugcgggaggucaagggccugaccaagggcgggcccgggcacgaggagcccaucccgauguccaccuacggcuggaaccucgugcgccugcagagcgggguggacgucuucuucaucccgcccgagaagugcgacacccugcucugcgacaucggcgaguccagccccaacccgaccguggaggccggccggacgcugcgcgugcugaaccucgucgagaacuggcugaacaacaacacccaguucugcaucaaggugcugaaccccuacaugcccuccgugaucgagaagauggaggcccugcagcggaaguacgggggcgcgcucguccgcaacccgcugagccggaacagcacccacgagauguacuggguguccaacgccagcgggaacaucguguccagcgucaacaugaucucccgcaugcugaucaaccgguucaccaugcgccacaagaaggccacguacgagcccgacguggaccucggcagcgggacccggaacaucggcaucgaguccgagauccccaaccuggacaucaucggcaagcgcaucgagaagaucaagcaggagcacgagaccagcuggcacuacgaccaggaccaccccuacaagaccugggccuaccacggguccuacgagacgaagcagaccggcagcgccuccagcauggugaacggggucgugcggcugcucaccaagccgugggacgugcugcccaccgucacgcagauggcgaugaccgacaccacccccuucggccagcagcgcguguucaaggagaagguggacacgcgcacccaggagcccaaggagggcaccaagaagcugaugaagaucaccgccgaguggcucuggaaggagcuggggaagaagaagacgccgcggaugugcacccgcgaggaguucauccggaagguccgcuccaacgccgcccugggcgccaucuucaccgacgagaacaaguggaaguccgcgcgggaggccguggaggacucccgcuucugggagcucguggacaaggagcggaaccugcaccuggaggggaagugcgagaccugcgucuacaacaugaugggcaagcgcgagaagaagcucggggaguucggcaaggccaagggcagccgggccaucugguacauguggcugggggcccgcuuccuggaguucgaggcgcucggcuuccugaacgaggaccacugguucucccgggagaacagccuguccgggguggagggcgaggggcuccacaagcugggcuacauccugcgcgacgucagcaagaaggagggcggggccauguacgccgacgacacggccggcugggacacccggaucacccucgaggaccugaagaacgaggagauggugaccaaccacauggagggggagcacaagaagcuggcggaggccaucuucaagcucacguaccagaacaaggugguccgcgugcagcggcccacgccccggggcaccgugauggacaucaucagccggcgcgaccagcggggguccggccaggucggcaccuacgggcugaacacguucaccaacauggaggcccagcugauccgccagauggagggcgaggggguguucaagaacauccagcaccucaccgccaccgaggagguggccgucaagaacuggcuggcgcgggugggccgcgagcgccugagccggauggccaucuccggcgacgacugcguggucaagccccucgacgaccgcuucgccaacgcccugacggcccugaacgacauggggaagauccggaaggacauccagcagugggagccgagcaagggcuggaacgacuggacccaggugcccuucugcucccaccacuuccacgagcucaucaugaaggacgggcgcgugcuggucgugcccugccggaaccaggacgagcugaucggccgcgcgcggaucagccagggggccggcuggucccuccgcgagaccgccugccugggcaagagcuacgcccagauguggucccugauguacuuccaccggcgcgaccuccggcuggccgcgaacgccaucugcagcgccgugcccucccacugggucccgaccagccgcaccacgugguccauccacgccaagcacgaguggaugaccaccgaggacaugcugaccguguggaaccggguguggauccgcgagaaccccuggauggaggacaagacgcccgucgagagcugggaggagauccccuaccucgggaagcgggaggaccaguggugcggcucccugaucgggcugaccagccgcgccaccugggcgaagaacauccaggccgccaucaaccaggugcggucccucaucggcaacgaggaguacaccgacuacaugccgagcaugaagcgcuuccggcgcgaggaggaggaggccggggugcugugguga

SEQ ID NO: 9180 - RNA, 9876 nt, Artificial Sequence
  derived and/or modified CDS sequence (opt1) from DENV-2__JF730048__SS-prME
agcgccggcaugaucaucaugcugauccccaccgugauggccuuccaccucaccacccgcaacggggagccccacaugaucgugggcauccaggagaagggcaagagccugcuguucaagaccgaggacggcgugaacaugugcacccucauggcgauggaccugggggagcugugcgaggacaccaucaccuacaagugcccccuccugcggcagaacgagcccgaggacaucgacugcuggugcaacagcaccagcaccugggugaccuacgggaccugcaccaccaccggcgagcaccgccgggagaagcgcagcgucgcccuggugccccacguggggaugggccucgagacccggaccgagaccuggaugagcagcgagggggccuggaagcacgcccagcgcaucgagaccuggauccugcggcacccgggcuucaccaucauggccgcgauccuggccuacaccaucgggaccacccacuuccagcgcgcccucaucuucauccugcugacggccgucgcgcccuccaugaccaugcggugcaucggcaucagcaaccgcgacuucguggagggcguguccgggggcagcugggucgacaucgugcucgagcacggguccugcgugaccaccauggccaagaacaagcccacgcuggacuucgagcugaucaagaccgaggccaagcagcccgccacccuccggaaguacugcaucgaggccaagcugaccaacacgaccaccgagagccgcugcccgacccagggcgagcccucccugaaggaggagcaggacaagcgguucgucugcaagcacagcaugguggaccgcggcugggggaacggcugcgggcuguucggcaagggcgggaucgugacgugcgcgauguucacgugcaagaagaacauggagggcaagaucguccagcccgagaaccuggaguacaccaucguggugacgccccacuccggggaggagcacgccgucggcaacgacacggggaagcacggcaaggagaucaaggugaccccgcagagcuccaucaccgaggccgagcugaccggguacggcaccgugacgauggagugcagcccccggaccggccucgacuucaacgagaugguccugcugcagauggaguccaaggccuggcucgugcaccgccagugguuccuggaccugccccuccccuggcugccgggggccgacaagcagggcagcaacuggauccagaaggagacccuggugaccuucaagaacccccacgcgaagaagcaggacgucgugguccucgggagccaggagggcgccaugcacacggcccugaccggggccaccgagauccagauguccagcggcaaccuccuguucaccggccaccugaagugccggcugcgcauggacaagcuccagcugaaggggauguccuacagcaugugcacgggcaaguucaagguggugaaggagaucgccgagacccagcacgggaccaucgucauccgggugcaguacgagggcgacggcucccccugcaagauccccuucgagaucauggaccuggagaagcgcuacgugcucgggcggcugaucaccgucaacccgaucgugacggagaaggacagccccgugaacaucgaggcggagccgcccuucggcgacuccuacaucaucaucggggucgagccgggccagcugaagcucaacugguucaagaaggggagcuccaucggccagauguucgagaccaccaugcgcggcgccaagcgcauggccauccugggggacaccgccugggacuucggcagccucggcgggguguucacguccaucgggaaggcccuccaccagguguucggggcgaucuacggcgccgccuucagcggggucuccuggaccaugaagauccugaucggcgugaucaucaccuggaucgggaugaacagccgguccaccagccuguccgugagccugguccucgugggcaucgugacgcuguaccugggggucauggugcaggccgacuccggcugcguggucagcuggaagaacaaggagcucaagugcggcagcgggaucuucaucaccgacaacgugcacaccuggaccgagcaguacaaguuccagcccgagucccccagcaagcuggcguccgccauccagaaggcccaggaggagggcaucugcgggauccgcagcgugacgcggcuggagaaccucauguggaagcagaucacccccgagcugaaccacauccuggccgagaacgaggucaagcucaccaucaugaccggcgacaucaaggggaucaugcaggccggcaagcgcucccugcggccgcagcccacggagcugaaguacagcuggaagaccuggggcaaggcgaagaugcucuccaccgagagccacaaccagaccuuccugaucgacgggcccgagacggccgagugcccgaacaccaaccgcgccuggaacucccuggagguggaggacuacggcuucgggguguucaccaccaacaucuggcucaagcugaaggagaagcaggacgccuucugcgacagcaagcugauguccgccgcgaucaaggacaaccgggccguccacgccgacaugggcuacuggaucgagagcgcccucaacgacacguggaagaucgagaaggccuccuucaucgaggugaagaacugccacuggcccaagagccacacccugugguccaacggcgugcuggagagcgagaugaucauccccaagaaccucgcggggcccgucucccagcacaacuaccgcccgggcuaccacacccagaccgccgggcccuggcaccugggcaagcuggagauggacuucgacuucugcgacgggaccacggugaucgugaccgaggacugcggcaaccggggccccagccuccgcaccaccacggccagcgggaagcugaucaccgaguggugcugccgguccugcacccugcccccgcuccgcuaccggggcgaggacgggugcugguacggcauggagauccgcccccugaaggagaaggaggagaaccuggucaacagccucgugaccgccgggcacggccagguggacaacuucucccugggcguccuggggauggcccuguuccuggaggagaugcugcggacgcgcgugggcaccaagcacgccauccuccugguggccgucagcuucgugacccugaucaccgggaacauguccuucaaggaccucggccggguggucgugaugguggggacgaccaugaccgacgacaucggcaugggcgucaccuaccuggcccugcucgccgcguucaaggugcgccccacguucgccgccgggcugcugcuccggaagcugaccagcaaggagcugaugaugaccaccaucggcaucgugcuccugucccagagcacgauccccgagaccauccuggagcucaccgacgcccuggcccuggggaugaugguccucaagaucgugcgcgacauggagaaguaccagcuggcggugaccaucauggccauccugugcgucccgaacgccgugauccuccagaacgccuggaaggucuccugcacgauccuggccguggugagcgucagcccccugcuccugaccagcucccagcagaagaccgacuggaucccccuggcgcucaccaucaagggccugaaccccacggccaucuuccugaccacccucagccgcaccaacaagaagcgguccuggccgcugaacgaggccaucauggccgugggcauggugagcauccuggcguccagccuccugaagaacgacauccccaugacggggccccuggucgccggcgggcuccugaccgugugcuacgugcugaccggccgcuccgccgaccucgagcuggagcgggccaccgacgucaagugggaggaccaggccgagaucagcgggagcucccccauccugagcaucacgaucuccgaggacggcagcauguccaucaagaacgaggaggaggagcagacccucaccauccugauccgcaccggccugcucgugaucagcgggcuguucccgguguccauccccaucaccgcggccgccugguaccugugggaggucaagaagcagcgggccggcgugcucugggacgugcccuccccgccgcccauggggaaggccgagcuggaggacggcgcguaccgcaucaagcagaaggggauccugggcuacucccagaucggcgccggggucuacaaggagggcacguuccacaccauguggcacgugacccgcggggcggugcucaugcacaagggcaagcgcaucgagcccagcugggccgacgucaagaaggaccugaucuccuacgggggcggcuggaagcuggagggggaguggaaggagggcgaggagguccaggugcucgcccuggagcccgggaagaacccccgggcgguccagaccaagcccggccuguucaagacgaacaccgggaccaucggcgccgugagccucgacuucucccccggcaccagcgggucccccaucaucgacaagaagggcaagguggucgggcuguacggcaacggcguggugacgcgcagcggggccuacgucuccgccaucgcccagaccgagaaguccaucgaggacaaccccgagaucgaggacgacaucuuccggaagcgccggcugaccaucauggaccugcaccccggcgcggggaagaccaagcgcuaccuccccgccaucgugcgggaggccaucaagcgcggccugcggacgcugauccucgccccgacccgcguggucgcggccgagauggaggaggcccugcgggggcugcccauccgcuaccagacccccgccauccgggccgagcacaccggccgcgagaucguggaccucaugugccacgcgacguucaccaugcgccugcugucccccgugcgggucccgaacuacaaccucaucaucauggacgaggcccacuucaccgaccccgccagcaucgccgcccgcggcuacaucagcacccggguggagaugggggaggcggccggcaucuucaugacggccacgccgcccgggucccgcgacagcuucccgcaguccaacgcccccaucaucgacgaggagcgggagauccccgagcgcagcuggaacaccggccacgagugggugaccgacuucaaggggaagacggucugguucgugcccuccaucaaggccggcaacgacaucgcggccugccugcggaagaacggcaagaaggugauccagcugagccgcaagaccuucgacuccgaguacgucaagacccggaccaacgacugggacuucguggugacgaccgacaucagcgagaugggggccaacuucaaggccgagcgcgucaucgacccgcggcgcugcaugaagcccgugauccucaccgacggcgaggagcgggugauccuggcggggcccaugcccgucacccacuccagcgccgcccagcgccggggccgcaucgggcggaacccgaagaacgagaacgaccaguacaucuacaugggcgagccccuggagaacgacgaggacugcgcccacuggaaggaggccaagaugcuccuggacaacaucaacacgcccgagggcaucauccccuccauguucgagccggagcgcgagaagguggacgcgaucgacggggaguaccggcugcgcggcgaggcccgcaagaccuucguggaccucaugcggcgcggggaccugcccgucuggcuggccuacaagguggccgccgagggcaucaacuacgcggaccggcgcuggugcuucgacgggaucaagaacaaccagauccucgaggagaacguggaggucgagaucuggaccaaggagggcgagcggaagaagcugaagccccgcuggcuggacgcccggaucuacagcgacccgcucgcccugaaggaguucaaggaguucgccgccggccgcaagucccugacccucaaccugaucacggagauggggcggcugcccaccuucaugacccagaagacccgcgacgcgcucgacaaccuggccgugcugcacacggccgaggccggcgggcgggcguacaaccacgcccucagcgagcugcccgagacccuggagacccuccugcugcucacccugcuggccaccgucacgggcggcaucuuccucuuccugauguccgggcgcggcaucgggaagaugacccugggcaugugcugcaucaucaccgccagcauccuccugugguacgcccagauccagccccacuggaucgcggccuccaucauccuggaguucuuccucaucgugcugcugaucccggagcccgagaagcagcggacgccccaggacaaccagcucacguacguggucaucgccauccugaccgugguggccgccaccauggcgaacgagaugggguuccuggagaagaccaagaaggaccucggccugggcagcaucgccacgcagcagcccgaguccaacauccuggacaucgaccuccgcccggccagcgccuggacccuguacgccgucgcgaccaccuucgugacgcccaugcugcggcacagcaucgagaacuccagcgugaacgucucccucaccgccaucgccaaccaggccaccgugcugauggggcugggcaagggguggccccucagcaagauggacaucggcgugccccugcuggccaucgggugcuacucccaggucaacccgaucacccucacggcggcccugcugcuccugguggcccacuacgccaucaucggccccggccugcaggcgaaggccacccgcgaggcccagaagcgggccgccgcggggaucaugaagaaccccaccguggacggcaucaccgucaucgaccucgaccccaucccguacgaccccaaguucgagaagcagcugggccaggugaugcugcucauccugugcgugacgcagguccugaugaugcgcaccaccugggcccucugcgaggcccugacccuggccacgggccccaucagcacccucugggaggggaaccccggccgguucuggaacaccaccaucgccguguccauggcgaacaucuuccgcggcagcuaccuggccggggccggccuccucuucuccaucaugaagaacacgaccaacacccggcgcgggaccggcaacaucggcgagacgcugggggagaaguggaagucccgccugaacgcccucggcaaguccgaguuccagaccuacaagaaguccgggauccaggagguggaccggacccuggccaaggagggcaucaagcgcggggagaccgaccaccacgcggucucccggggcagcgccaagcugcgcugguucguggagcggaacauggugacgccggagggcaaggucguggaccucgggugcggccgcgggggcugguccuacuacugcgggggccugaagaacgugcgggaggucaagggccugaccaagggcgggcccgggcacgaggagcccauccccaugagcaccuacggcuggaaccucgugcgccugcaguccgggguggacgucuucuucaucccgcccgagaagugcgacacccugcucugcgacaucggcgagagcucccccaaccccaccguggaggccggccggacgcugcgcgugcugaaccucgucgagaacuggcugaacaacaacacccaguucugcaucaaggugcugaacccguacaugcccagcgugaucgagaagauggaggcccugcagcggaaguacgggggcgcgcucguccgcaacccccugagccggaacuccacccacgagauguacugggugagcaacgccuccgggaacaucgugagcuccgucaacaugaucagccgcaugcugaucaaccgguucaccaugcgccacaagaaggccacguacgagccggacguggaccucggcuccgggacccggaacaucggcaucgagagcgagauccccaaccuggacaucaucggcaagcgcaucgagaagaucaagcaggagcacgagaccuccuggcacuacgaccaggaccaccccuacaagaccugggccuaccacgggagcuacgagacgaagcagaccggcuccgccagcuccauggugaacggggucgugcggcugcucaccaagcccugggacgugcugccgaccgucacgcagauggcgaugaccgacaccacccccuucggccagcagcgcguguucaaggagaagguggacacgcgcacccaggagcccaaggagggcaccaagaagcugaugaagaucaccgccgaguggcucuggaaggagcuggggaagaagaagacgccccggaugugcacccgcgaggaguucacccggaagguccgcagcaacgccgcccugggcgccaucuucaccgacgagaacaaguggaaguccgcgcgggaggccguggaggacagccgcuucugggagcucguggacaaggagcggaaccugcaccuggaggggaagugcgagacgugcgucuacaacaugaugggcaagcgcgagaagaagcucggggaguucggcaaggccaagggcucccgggccaucugguacauguggcugggggcccgcuuccuggaguucgaggcgcucggcuuccugaacgaggaccacugguucagccgggagaacucccugagcgggguggagggcgaggggcuccacaagcugggcuacauccugcgcgacgucagcaagaaggagggcggggccauguacgccgacgacaccgccggcugggacacccggaucacccucgaggaccugaagaacgaggagauggugacgaaccacauggagggggagcacaagaagcuggcggaggccaucuucaagcucaccuaccagaacaaggugguccgcgugcagcggccgacgccccggggcaccgugauggacaucaucucccggcgcgaccagcgggggagcggccaggucggcacguacgggcugaacaccuucaccaacauggaggcccagcugauccgccagauggagggcgaggggguguucaagaacauccagcaccucaccgccacggaggagguggccgucaagaacuggcuggcgcgggugggccgcgagcgccugucccggauggccaucagcggcgacgacugcguggucaagccccucgacgaccgcuucgccaacgcccugaccgcccugaacgacauggggaagauccggaaggacauccagcagugggagcccuccaagggcuggaacgacuggacccaggugccguucugcagccaccacuuccacgagcucaucaugaaggacgggcgcgugcuggucgugcccugccggaaccaggacgagcugaucggccgcgcgcggaucucccagggggccggcuggagccuccgcgagaccgccugccugggcaaguccuacgcccagauguggagccugauguacuuccaccggcgcgaccuccggcuggccgcgaacgccaucugcuccgccgugcccagccacuggguccccaccucccgcacgaccuggagcauccacgccaagcacgaguggaugaccaccgaggacaugcugacgguguggaaccggguguggauccgcgagaacccguggauggaggacaagacccccgucgaguccugggaggagauccccuaccucgggaagcgggaggaccaguggugcggcagccugaucgggcugaccucccgcgccaccugggcgaagaacauccaggccgccaucaaccaggugcggagccucaucggcaacgaggaguacacggacuacaugcccagcaugaagcgcuuccggcgcgaggaggaggaggccggggugcugugguga

SEQ ID NO: 9181 - RNA, 9876 nt, Artificial Sequence
  derived and/or modified CDS sequence (opt1) from DENV-2__KF955402__SS-prME
agcgccgggaugaucaucaugcugauccccaccgugauggccuuccaccucaccacccgcaacggggagccccacaugaucguggggauccaggagaagggcaagagccugcuguucaagaccgaggacggcgugaacaugugcacccucauggcgauggaccugggggagcugugcgaggacaccaucaccuacaagugcccccuccugcggcagaacgagcccgaggacaucgacugcuggugcaacagcaccuccaccugggugaccuacgggaccugcaccaccaccggcgagcaccgccgggagaagcgcagcgucgcccuggugccccacguggggaugggccucgagacccggaccgagaccuggauguccagcgagggggccuggaagcacgcccagcgcaucgagaccuggauccugcggcacccgggcuucaccaucauggccgcgauccuggccuacaccaucgggaccacccacuuccagcgcguccucaucuucauccugcugacggccguggcccccuccaugaccaugcggugcaucggcaucagcaaccgcguguucgucgagggcguguccgggggcagcuggguggacaucguccucgagcacggguccugcgugaccaccauggcgaagaacaagcccacgcuggacuucgagcugaucaagaccgaggccaagcagcccgccacccuccggaaguacugcaucgaggccaagcugaccaacacgaccaccgagagccgcugccccacccagggcgagcccucccugaaggaggagcaggacaagcgguucgugugcaagcacagcauggucgaccgcggcugggggaacggcugcggccuguucggcaagggcgggaucgugacgugcgccauguucacgugcaagaagaacauggagggcaagaucgugcagcccgagaaccuggaguacaccaucgucgugacgccccacuccggggaggagcacgcggugggcaacgacacggggaagcacggcauggagaucaaggucaccccgcagagcuccaucaccgaggccgagcugaccggguacggcaccgugacgauggagugcagcccccggaccggccucgacuucaacgagauggugcugcugcagauggagaacaaggccuggcucguccaccgccagugguuccuggaccugccccuccccuggcugccgggggccgacaagcaggaguccaacuggauccagaaggagacccuggugaccuucaagaacccccacgccaagaagcaggacgucguggugcucggcagccaggagggggcgaugcacacggcccugaccggcgccaccgagauccagaugagcuccgggaaccuccuguucaccggccaccugaagugccggcugcgcauggacaagcuccagcugaagggcaugagcuacuccaugugcacggggaaguucaaggucgugaaggagaucgccgagacccagcacggcaccaucgugauccggguccaguacgagggggacggcagccccugcaagauccccuucgagaucauggaccuggagaagcgcuacgugcucggccggcugaucaccgugaacccgaucgucacggagaaggacucccccgugaacaucgaggccgagccgcccuucggggacagcuacaucaucaucggcguggagccggggcagcugaagcucaacugguucaagaagggcuccagcaucgggcagauguucgagaccaccaugcgcggcgcgaagcgcauggccauccugggcgacaccgccugggacuucgggucccugggcggggucuucacgagcaucggcaaggcccuccaccagguguucggggccaucuacggcguggcguucuccggcgucagcuggaccaugaagauccugaucggggugaucaucaccuggaucggcaugaacucccggagcaccucccugagcgugucccugguccucguggggaucgugacgcuguaccugggcgucauggugcaggccgacagcgggugcguggucuccuggaagaacaaggagcucaagugcggcagcggcaucuucaucaccgacaacgugcacaccuggaccgagcaguacaaguuccagcccgagagccccuccaagcuggccagcgccauccagaaggcgcaggaggaggggaucugcggcauccgcuccgugacgcggcuggagaaccucauguggaagcagaucacccccgagcugaaccacauccuggccgagaacgaggucaagcucaccaucaugaccggggacaucaagggcaucaugcaggccgggaagcgcagccugcggccgcagcccacggagcugaaguacuccuggaagaccuggggcaaggccaagaugcucagcaccgaguccuacaaccagaccuuccugaucgacggccccgagacggccgagugcccgaacaccaaccgcgcguggaacagccuggagguggaggacuacggguucggcguguucaccaccaacaucuggcucaagcugaaggagaagcaggacgccuucugcgacuccaagcugaugagcgccgccaucaaggacaaccgggccguccacgcggacaugggguacuggaucgaguccgcccucaacgacacguggaagaucgagaaggccagcuucaucgaggugaagaacugccacuggcccaagucccacacccuguggagcaacggcgugcuggaguccgagaugaucauccccaagaaccucgccggccccgucagccagcacaacuaccgcccgggguaccacacccagaucgccggccccuggcaccuggggaagcuggagauggacuucgacuucugcgacggcaccaccgugaucgugacggaggacugcgggaaccggggccccucccuccgcaccaccaccgcgagcggcaagcugaucacggaguggugcugccggagcugcacccugcccccgcuccgcuaccgcggggaggacggcugcugguacgggauggagauccgcccccugaaggagaaggaggagaaccuggucaacucccucgugaccgccggccacggccagguggacaacuucagccugggcguccugggcauggcccucuuccuggaggagaugcugcggacccgcguggggacgaagcacgccauccuccugguggcggucuccuucgugacccugaucaccggcaacaugagcuucaaggaccucgggcggguggucgugauggugggcgccaccauggccgacgacaucgggaugggcgucacguaccuggcccugcucgccgcguucaaggugcgccccaccuucgccgccggccugcugcuccggaagcugaccuccaaggagcugaugaugaccacgaucgggaucgugcuccugagccaguccaccauccccgagaccguccuggagcucaccgacgcccuggcccugggcaugauggugcucaagaucguccgcaacauggagaaguaccagcuggcggugacgaucauggccauccugugcgugccgaacgccgucauccuccagaacgccuggaaggugagcugcaccauccuggccguggucuccgugagcccccugcuccugaccuccagccagcagaagaccgacuggaucccccuggcgcucacgaucaaggggcugaaccccaccgccaucuuccugaccacccucucccgcacgaacaagaagcggagcuggccgcugaacgaggccaucauggccgugggcauggucuccauccuggcgagcucccuccugaagaacgacauccccaugaccggcccccugguggccgggggccuccugaccgugugcuacguccugaccgggcgcagcgccgaccucgagcuggagcgggccacggacgugaagugggaggaccaggccgagaucuccggcagcagccccauccuguccaucaccaucagcgaggacggguccaugagcaucaagaacgaggaggaggagcagacccucaccauccugauccgcacgggccugcucgugaucuccggccuguucccgaucagcauccccaucaccgcggccgccugguaccugugggaggucaagaagcagcgggccggggugcucugggacgugcccagcccgccgcccaugggcaaggccgagcuggaggacggggcguaccgcaucaagcagaagggcauccugggguacagccagaucggcgccggcgucuacaaggaggggaccuuccacaccauguggcacgugacccggggcgccgugcucaugcacaaggggaagcgcaucgagcccuccugggccgacgucaagaaggaccugaucagcuacggcgggggcuggaagcuggagggcgaguggaaggagggggaggagguccaggugcucgcccuggagcccggcaagaacccccgggcgguccagacgaagcccgggcuguucaagaccaacaccggcaccaucggggccgugucccucgacuucagccccggcacguccggcagccccaucaucgacaagaaggggaagguggucggccuguacgggaacggcguggugacccgcuccggcgccuacgucagcgccaucgcccagaccgagaaguccaucgaggacaaccccgagaucgaggacgacaucuuccggaagcgccggcugaccaucauggaccugcaccccggggcgggcaagacgaagcgcuaccuccccgccaucgugcgggaggccaucaagcgcgggcugcggacccugauccucgccccgacccgcguggucgcggccgagauggaggaggcccugcggggccugcccauccgcuaccagacccccgccauccgggccgagcacacggggcgcgagaucguggaccucaugugccacgcgaccuucaccaugcgccugcugagccccgugcgggucccgaacuacaaccucaucaucauggacgaggcccacuucaccgaccccgccuccaucgccgcccgcggcuacaucagcacgcggguggagaugggcgaggcggccgggaucuucaugaccgccacgccgcccggcagccgcgacccguucccccaguccaacgcccccaucaucgacgaggagcgggagauccccgagcgcagcuggaacuccgggcacgagugggugaccgacuucaagggcaagacggucugguucgugccgagcaucaaggccgggaacgacaucgcggccugccugcggaagaacggcaagaaggugauccagcugucccgcaagaccuucgacagcgaguacgucaagacccggaccaacgacugggacuucguggugacgaccgacaucuccgagaugggcgccaacuucaaggccgagcgcgucaucgacccccggcgcugcaugaagcccgugauccucaccgacggggaggagcgggugauccuggcgggccccaugccggucacccacagcuccgccgcccagcgccgggggcgcaucggccggaaccccaagaacgagaacgaccaguacaucuacaugggggagccccuggagaacgacgaggacugcgcccacuggaaggaggccaagaugcuccuggacaacaucaacacgcccgagggcaucaucccgagcauguucgagcccgagcgcgagaagguggacgcgaucgacggcgaguaccggcugcgcggggaggcccgcaagaccuucguggaccucaugcggcgcggcgaccugcccgucuggcuggccuacaagguggccgccgaggggaucaacuacgcggaccggcgcuggugcuucgacggcaucaagaacaaccagauccucgaggagaacgucgagguggagaucuggaccaaggagggggagcggaagaagcugaagccgcgcuggcuggacgcccggaucuacuccgacccccucgcccugaaggaguucaaggaguucgccgccggccgcaagagccugacccucaaccugaucacggagaugggccggcugcccaccuucaugacccagaagacccgcgacgcgcucgacaaccuggccgugcugcacacggccgaggccgggggccgggcguacaaccacgcccucuccgagcugcccgagacccuggagacccuccugcugcucacccugcuggccacggucaccgggggcaucuuccucuuccugaugagcggccgcgggaucggcaagaugacccuggggaugugcugcaucaucaccgccuccauccuccugugguacgcccagauccagccgcacuggaucgcggccagcaucauccuggaguucuuccucaucgugcugcugauccccgagcccgagaagcagcggacgccccaggacaaccagcucacguacguggucaucgccauccugaccgugguggccgccaccauggcgaacgagaugggcuuccuggagaagaccaagaaggaccucgggcugggcuccaucgccacgcagcagccggagagcaacauccuggacaucgaccuccgccccgccuccgccuggacccuguacgccgucgcgaccaccuucgugacgcccaugcugcggcacagcaucgagaacagcuccgugaacgucagccucaccgccaucgccaaccaggccaccgugcugaugggccuggggaagggcuggccccucuccaagauggacaucggggugccgcugcuggccaucggcugcuacagccaggucaaccccaucacccucacggcggcccugcugcuccugguggcccacuacgccaucaucgggcccggccugcaggcgaaggccacccgcgaggcccagaagcgggccgccgcgggcaucaugaagaaccccaccguggacgggaucaccgucaucgaccucgacccgauccccuacgaccccaaguucgagaagcagcugggccaggugaugcugcucauccugugcgugacgcagguccugaugaugcgcaccaccugggcccucugcgaggcccugacccuggccacggggcccaucuccacccucugggagggcaacccggggcgguucuggaacaccaccaucgccgugagcauggcgaacaucuuccgcggcuccuaccuggccggcgccgggcuccucuucagcaucaugaagaacacgaccaacacccggcgcggcaccgggaacaucggcgagacgcugggcgagaaguggaagucccgccugaacgcccucgggaaguccgaguuccagaucuacaagaaguccggcauccaggagguggaccggacccuggccaaggaggggaucaagcgcggcgagaccgaccaccacgcggucagccggggguccgccaagcugcgcugguucguggagcggaacauggugacccccgagggcaaggucguggaccucggcugcgggcgcggcggguggagcuacuacugcggcgggcugaagaacgugcgggaggucaagggccugacgaagggcgggcccggccacgaggagcccaucccgauguccaccuacggguggaaccucgugcgccugcagagcggcguggacgucuucuucaucccgcccgagaagugcgacacccugcucugcgacaucggggaguccagccccaacccgaccguggaggccggccggacgcugcgcgugcugaaccucgucgagaacuggcugaacaacaacacccaguucugcaucaaggugcugaaccccuacaugcccuccgugaucgagaagauggaggcccugcagcggaaguacggcggggcgcucguccgcaacccgcugagccggaacagcacccacgagauguacuggguguccaacgccagcggcaacaucguguccagcgucaacaugaucucccgcaugcugaucaaccgguucaccaugcgccacaagaaggccaccuacgagcccgacguggaccucgggagcggcacgcggaacaucgggaucgaguccgagacccccaaccuggacaucaucggcaagcgcaucgagaagaucaaggaggagcacgagaccagcuggcacuacgaccaggaccaccccuacaagaccugggccuaccacggcuccuacgagacgaagcagaccgggagcgccuccagcauggugaacggcgucgugcggcugcucaccaagccgugggacgugcugcccaccgucacgcagauggcgaugaccgacaccacccccuucgggcagcagcgcguguucaaggagaagguggacacgcgcacccaggagcccaaggagggcaccaagaagcugaugaagaucaccgccgaguggcucuggaaggagcugggcaagaagaagacgccgcggaugugcacccgcgaggaguucacccggaagguccgcuccaacgccgcccugggggccaucuucaccgacgagaacaaguggaaguccgcgcgggaggccguggaggacucccgcuucugggagcucgucgacaaggagcggaaccugcaccuggagggcaagugcgagacgugcguguacaacaugauggggaagcgcgagaagaagcucggcgaguucgggaaggccaagggcagccgggccaucugguacauguggcugggcgcccgcuuccuggaguucgaggcgcucggguuccugaacgaggaccacugguucucccgggagaacagccuguccggcguggagggggagggccuccacaagcugggguacauccugcgcgacgucagcaagaaggagggcggcgccauguacgccgacgacaccgccgggugggacacccggaucacccucgaggaccugaagaacgaggagauggugacgaaccacauggagggcgagcacaagaagcuggcggaggccaucuucaagcucaccuaccagaacaaggugguccgcgugcagcggcccacgccccgggggaccgugauggacaucaucagccggcgcgaccagcggggcuccgggcaggucggcacguacggccugaacaccuucaccaacauggaggcccagcugauccgccagauggagggggagggcguguucaagaacauccagcaccucaccgugacggaggaggccgccguccagaacuggcuggcgcggguggggcgcgagcgccugagccggauggccaucuccggcgacgacugcguggucaagccccucgacgaccgcuucgccaacgcccugaccgcccugaacgacaugggcaagauccggaaggacauccagcagugggagccgagcaagggguggaacgacuggacccaggugcccuucugcucccaccacuuccacgagcucaucaugaaggacggccgcgugcuggucgugcccugccggaaccaggacgagcugaucgggcgcgcgcggaucagccagggcgccggguggucccuccgcgagaccgccugccugggcaagagcuacgcccagauguggucccugauguacuuccaccggcgcgaccuccggcuggccgcgaacgccaucugcagcgccgugcccucccacugggucccgacgagccgcaccaccugguccauccacgccaagcacgaguggaugaccaccgaggacaugcugacgguguggaaccggguguggauccgcgagaaccccuggauggaggacaagacccccgucgagagcugggaggagauccccuaccucggcaagcgggaggaccaguggugcgggucccugaucggccugaccagccgcgccaccugggcgaagaacauccaggccgccaucaaccaggugcggucccucaucgggaacgaggaguacacggacuacaugccgagcaugaagcgcuuccggcgcgaggaggaggaggccggcgugcugugguga

SEQ ID NO: 9182 - RNA, 9876 nt, Artificial Sequence
  derived and/or modified CDS sequence (opt1) from DENV-2__FJ898460__SS-prME
accgccggcgugaucgucaugcugauccccaccgccaucgcguuccaccucaccacccggaacggggagccccacaugaucgugggccggcaggagaaggggaagucccugcuguucaagaccgaggacggcgugaacaugugcacccucauggccaucgaccugggggagcugugcgaggacaccaucaccuacaagugcccccuccugcggcagaacgagcccgaggacaucgacugcuggugcaacagcaccagcaccugggucaccuacgggaccugcaccaccacgggcgagcaccggcgcgagaagcgguccguggcccuggugccccacgucgggaugggccucgagacccgcaccgagaccuggaugagcagcgagggggccuggaagcacgugcagcggaucgagacguggauccugcggcacccgggcuucaccaucauggccgcgauccuggccuacaccaucgggaccacgcacuuccagcgggcccucaucuucauccugcugaccgccguggcgcccagcaugaccaugcgcugcaucggcaucuccaaccgggacuucgucgagggcgugagcgggggcuccuggguggacaucguccucgagcacgggagcugcgugaccacgauggccaagaacaagcccacccuggacuucgagcugaucaagaccgaggccaagcagcccgccacccuccgcaaguacugcaucgaggccaagcugacgaacaccaccaccgagucccggugcccgacgcagggcgagcccagccugaacgaggagcaggacaagcgcuucaucugcaagcacuccaugguggaccggggcugggggaacggcugcgggcuguucggcaagggcgggaucgugaccugcgcgauguucacgugcaagaagaacauggagggcaagguggugcagcccgagaaccuggaguacaccaucgucaucacgccccacagcggggaggagcacgccgugggcaacgacaccgggaagcacggcaaggagaucaagaucaccccgcaguccagcaucaccgaggccgagcugaccggguacggcacggugaccauggagugcagcccccggaccggccucgacuucaacgagaugguccugcugcagauggaggacaaggccuggcucgugcaccggcagugguuccuggaccugccccuccccuggcugccgggggccgacacccagggcagcaacuggauccagaaggagacgcuggugaccuucaagaacccccacgcgaagaagcaggacgucgugguccucgggucccaggagggcgccaugcacaccgcccugaccggggccacggagauccagaugagcagcggcaaccuccuguucaccggccaccugaagugccgccugcggauggacaagcuccagcugaaggggauguccuacagcaugugcaccggcaaguucaagaucgugaaggagaucgccgagacccagcacgggacgaucgugauccgcguccaguacgagggcgacggcucccccugcaagauccccuucgagaucaccgaccuggagaagcggcacgugcucgggcgccugaucaccgugaacccgaucgucaccgagaaggacagccccgugaacaucgaggcggagccgcccuucggcgacuccuacaucaucaucgggguggagccgggccagcugaagcucaacugguucaagaaggggagcuccaucggccagauguucgagacgaccaugcgcggcgccaagcggauggccauccugggggacaccgccugggacuucggcagccucggcggggucuucaccuccaucgggaaggcccuccaccagguguucggggcgaucuacggcgccgccuucaacggggugagcuggacgaugaagauccugaucggcgucaucaucaccuggaucgggaugaacucccgcagcaccucccugagcgugucccuggugcucgucggcguggugacccuguaccugggggccaugguccaggcggacagcggcugcgugguguccuggaagaacaaggagcucaagugcggcagcgggaucuucaucacggacaacguccacaccuggaccgagcaguacaaguuccagcccgagucccccagcaagcuggccagcgccauccagaaggcccacgaggagggcaucugcgggauccgguccgugacccgccuggagaaccucauguggaagcagaucacgcccgagcugaaccacauccugagcgagaacgaggugaagcucaccaucaugaccggcgacaucaaggggaucaugcaggccggcaagcggucccugcgcccgcagcccaccgagcugaaguacagcuggaagacguggggcaaggcgaagaugcucuccaccgagagccacaaccagaccuuccugaucgacgggcccgagaccgccgagugcccgaacacgaaccgggccuggaacucccuggaggucgaggacuacggcuucgggguguucagcaccaacaucuggcucaagcugcgcgagaagcaggacguguucugcgacuccaagcugaugagcgccgccaucaaggacaaccgggcgguccacgccgacaugggcuacuggaucgaguccgcccucaacgacaccuggaagauggagaaggccagcuucaucgaggugaaguccugccacuggcccaagagccacacccugugguccaacggcgugcuggagagcgagaugaucauccccaaguccuucgccgggcccgucagccagcacaacuaccgcccgggcuaccacacccagacggcggggcccuggcaccucggcaagcuggagauggacuucgacuucugcgaggggaccaccgugguggucaccgaggacugcggcaaccggggccccagccugcgcacgaccaccgccuccgggaagcucaucaccgaguggugcugccggagcugcacgcugcccccgcugcgcuaccggggcgaggacgggugcugguacggcauggagauccgcccccucaaggagaaggaggagaaccuggugaacucccuggugaccgccgggcacggccagaucgacaacuucagccucggcguccuggggauggcccuguuccucgaggagaugcugcggacccgcgugggcaccaagcacgcgauccugcucguggccgucuccuucgugacgcugaucaccgggaacaugagcuuccgggaccugggccgcgugauggucauggugggggccaccaugaccgacgacaucggcaugggcgugacguaccucgcccugcuggccgcguucaagguccgccccaccuucgccgccgggcuccugcugcggaagcucaccuccaaggagcugaugauggccaccaucggcaucgcccugcucagccaguccacgaugcccgagaccauccuggagcugaccgacgcgcucgcccuggggaugauggugcugaagaucgugcgcaacauggagaaguaccagcucgccgucaccaucauggccaucagcugcgugccgaacgccgugauccugcagaacgcguggaaggucuccugcacgauccuggccgccgugagcgucagcccccuccugcugaccagcucccagcagaaggccgacuggaucccccucgcgcugaccaucaagggccugaaccccaccgccaucuuccucacgacccugagccggaccuccaagaagcgcagcuggccgcugaacgaggccaucauggccgugggcaugguguccauccucgccagcagccugcugaagaacgacauccccaugaccgggccccucgucgcgggcgggcugcugacggugugcuacgugcucaccggccgguccgccgaccuggagcuggagcgcgccgccgacgucaagugggaggaccaggccgagaucagcggguccagccccauccucuccaucaccaucagcgaggacggcuccaugagcaucaagaacgaggaggaggagcagacccugacgauccugauccggaccggccuccuggugaucuccgggguguucccggucagcauccccaucaccgcggccgccugguaccugugggaggugaagaagcagcgcgccggcgugcucugggacguccccagcccgccgcccguggggaaggccgagcuggaggacggcgcguaccggaucaagcagcgcgggauccugggcuacagccagaucggcgccgggguguacaaggagggcaccuuccacaccauguggcacgucacgcgcggggccgugcucaugcaccgcggcaagcggaucgagcccuccugggccgacgugaagaaggaccugaucagcuacgggggcggcuggaagcuggagggggaguggaaggagggcgaggagguccaggugcucgcccuggagcccgggaagaacccccgcgcggugcagaccaagcccggcaucuucaagaccaacaccgggacgaucggcgccgucucccuggacuucagccccggcaccuccgggagccccaucguggaccggaagggcaagguggucgggcucuacggcaacggcguggugacccgcuccggggccuacgucagcgccaucgcgcagaccgagaaguccaucgaggacaaccccgagaucgaggacgacaucuuccggaagaagcgccugacgaucauggaccugcaccccggcgccgggaagaccaagcgguaccuccccgccaucgugcgcgaggccaucaagcggggccugcgcacccugauccuggccccgacccgcguggucgcggccgagauggaggaggcccuccgggggcugcccauccgcuaccagacgcccgccauccgggccgagcacaccggccgcgagaucguggaccugaugugccacgcgaccuucaccaugcggcuccugucccccgugcgcgucccgaacuacaaccugaucaucauggacgaggcccacuucacggaccccgccagcaucgccgcccggggcuacaucuccacccgcguggagaugggggaggcggccggcaucuucaugaccgccacgccgcccgggagccgggacccguucccccaguccaacgcccccaucauggacgaggagcgcgagauccccgagcggagcuggaacuccggccacgagugggugacggacuucaaggggaagaccgucugguucgugccgagcaucaaggcgggcaacgacaucgccgccugccuccgcaagaacggcaagaaggugauccagcugucccggaagaccuucgacagcgaguacgucaagacccgcgccaacgacugggacuucguggugacgaccgacaucuccgagaugggggccaacuucaaggcggagcgggucaucgacccccgccggugcaugaagcccgugauccugaccgacggcgaggagcgcgugauccucgccgggcccaugccggucacccacagcuccgccgcccagcggcgcggccgcaucgggcggaaccccaagaacgagaacgaccaguacaucuacaugggcgagccccuggagaacgacgaggacugcgcccacuggaaggaggcgaagaugcugcucgacaacaucaacacgcccgagggcaucaucccgagcauguucgagcccgagcgcgagaagguggacgccaucgacggggaguaccggcugcgcggcgaggcccggaagaccuucguggaccugaugcgccgcggggaccuccccgucuggcuggccuacaagguggccgcggagggcaucaacuacgccgaccgcaaguggugcuucgacgggaucaagaacaaccagauccuggaggagaacguggaggucgagaucuggaccaaggagggcgagcggaagaagcucaagccgcgcuggcuggacgcccggaucuacuccgacccccuggcccucaaggaguucaaggaguucgcggccggccgcaagagccugacccugaaccucaucacggagauggggcggcugcccaccuucaugacccagaaggcccgcaacgcccuggacaaccucgccgugcugcacaccgcggaggccggcgggcgggccuacaaccacgcccuguccgagcuccccgagacgcuggagacccugcuccugcugacccuccuggccaccgucacgggcggcaucuuccuguuccucaugagcgggaagggcaucgggaagaugacccugggcaugugcugcaucaucaccgcguccauccugcucugguacgcccagauccagccgcacuggaucgccgccagcaucauccuggaguucuuccugaucgugcuccugauccccgagcccgagaagcagcgcacgccccaggacaaccagcugaccuacguggucaucgccauccucacggugguggcggccaccauggccaacgagaugggguuccuggagaagaccaagaaggaccugggccucggcagcaucaccacgcaggaguccgagagcaacauccuggacaucgaccugcggccggccuccgccuggacccucuacgcggucgccaccaccuucgugacgcccaugcugcgccacagcaucgagaacuccagcgugaacgucucccugaccgccaucgccaaccaggcgaccgugcucauggggcugggcaagggguggccccugagcaagauggacaucggcgugccccuccuggccaucgggugcuacucccaggucaacccgaucacccugacggccgcccuccugcugcucguggcccacuacgcgaucaucggccccggccugcaggccaaggccacccgggaggcccagaagcgcgccgcggccgggaucaugaagaaccccaccguggacggcaucaccgucaucgaccuggagcccaucccguacgaccccaaguucgagaagcagcucgggcaggucaugcugcugauccucugcgugacgcagguccugaugaugcggaccaccugggcccugugcgaggcccucacccuggccacgggccccaucagcacccugugggaggggaaccccggccgcuucuggaacaccaccaucgcgguguccauggccaacaucuuccgcggcagcuaccucgccggggccggccugcuguucuccaucaugaagaacacgaccaacacccggcgcgggaccggcaacaucggcgagacgcucggggagaaguggaagucccggcugaacgcgcugggcaaguccgaguuccagaucuacaagaaguccgggauccaggagguggaccgcacccucgccaaggagggcaucaagcgcggggagaccgaccaccacgccgucucccgcggcagcgccaagcugcggugguucguggagcgcaacauggugaccccggagggcaaggucguggaccuggggugcggccgcggcgggugguccuacuacugcggcgggcucaagaacgugcgcgaggucaaggggcugacgaagggcggccccgggcacgaggagcccgugcccaugagcaccuacggcuggaaccuggugcggcuccagagcggggucgacguguucuucaccccgcccgagaagugcgacacccugcugugcgacaucggcgaguccagccccaaccccacgaucgaggccggccgcacccuccgggugcugaaccuggucgagaacuggcucaacaacaacacccaguucugcaucaaggugcugaacccguacaugcccuccgugaucgagaagauggagacccugcagcgcaaguacgggggcgcgcucguccggaacccccugagccgcaacuccacccacgagauguacugggugagcaacgccacggggaacaucguguccagcgucaacaugaucucccggaugcugaucaaccgcuucaccaugaagcacaagaaggccaccuacgagccggacguggaccugggcagcgggacccggaacaucggcaucgaguccgagacgcccaaccucgacaucaucggcaagcgcaucgagaagaucaagcaggagcacgagaccagcuggcacuacgaccaggaccaccccuacaagaccugggccuaccacggguccuacgagaccaagcagacgggcagcgccuccagcauggugaacggggucgugcgccugcugaccaagcccugggacguggucccgauggugacccagauggcgaugaccgacacgacccccuucggccagcagcggguguucaaggagaaggucgacacccgcacccaggagcccaaggagggcacgaagaagcucaugaagaucaccgccgaguggcuguggaaggagcuggggaagaagaagacgccccggaugugcacccgcgaggaguucacgaagaaggugcgguccaacgccgcccucggcgccaucuucaccgacgagaacaaguggaaguccgcgcgcgaggccguggaggacgggcgguucugggagcuggucgaccgcgagcggaaccugcaccucgagggcaagugcgagaccugcguguacaacaugauggggaagcgcgagaagaagcugggcgaguucggcaaggccaaggggucccgggccaucugguacauguggcugggcgcgcgcuuccucgaguucgaggcccugggguuccugaacgaggaccacugguucagccggggcaacagccucuccggggucgagggcgagggccugcaccgccugggguacauccuccgggaggugggcaagaaggagggcggcgccauguacgccgacgacaccgccgggugggacacgcgcaucacccuggaggaccugaagaacgaggagauggugaccaaccacaugaagggcgagcacaagaagcucgcggaggccaucuucaagcugaccuaccagaacaaggucgugcgggugcagcgcccgacgccccggggcaccgucauggacaucaucagccgccgggaccagcgcggguccggccagguggggaccuacggccugaacaccuucacgaacauggaggcccagcucauccgccagauggagggcgaggggaucuucaagagcauccagcaccugaccgccaccgaggagaucgccgugcagaacuggcuggcgcgggucggccgcgagcggcucucccgcauggccaucagcggggacgacugcguggugaagcccaucgacgaccgguucgccuccgcccugaccgcccugaacgacaugggcaagguccgcaaggacauccagcagugggagcccagccggggguggaacgacuggacccaggugccguucugcucccaccacuuccacgagcucgugaugaaggacggccgcguccugguggugcccugccggaaccaggacgagcugaucggccgcgcgcggaucagccagggggccggcuggucccucaaggagaccgccugccugggcaagagcuacgcccagauguggacccugauguacuuccaccgccgggaccuccgccuggccgcgaacgccaucugcuccgccguccccagccacugggugcccaccucccggaccacguggagcauccacgccaagcacgaguggaugaccaccgaggacaugcuggcgguguggaaccgcgucuggauccaggagaacccguggauggaggacaagacccccguggaguccugggaggaggugcccuaccucggcaagcgggaggaccaguggugcgggagccugaucggccugacgagccgcgccaccugggccaagaacauccagaccgccaucaaccagguccggucccucaucggcaacgaggaguacaccgacuacaugcccagcaugaagcgcuuccgccgggaggaggaggaggccggggugcugugguga

SEQ ID NO: 9183 - RNA, 9876 nt, Artificial Sequence
  derived and/or modified CDS sequence (opt1) from DENV-2__FJ882602__SS-prME
accgcgggcaugaucaucaugcugauccccaccgccauggcguuccaccucaccacccgcaacggggagccccacaugaucgugagccggcaggagaagggcaagagccugcuguucaagaccgaggacggggucaacaugugcacccucauggccauggaccugggcgagcugugcgaggacaccaucaccuacaacugcccccuccugcgccagaacgagcccgaggacaucgacugcuggugcaacagcaccuccaccugggugaccuacgggaccugcaccgccaccggcgagcaccggcgcgagaagcggagcguggcccuggucccccacgugggcauggggcucgagacccgcaccgagaccuggauguccagcgagggcgccuggaagcacgcgcagcggaucgagaccuggauccugcgccaccccggguucaccaucauggccgccauccuggccuacaccaucggcaccaccuacuuccagcgggugcucaucuucauccugcugacggcggucgcccccuccaugaccaugcgcugcaucgggaucagcaaccgggacuucguggagggcguguccggcgggagcugggucgacaucgugcucgagcacggcuccugcgugaccaccauggccaagaacaagcccacgcuggacuucgagcugaucaagaccgaggccaagcagcccgccacccuccgcaaguacugcaucgaggcgaagcugaccaacacgaccaccgccagccggugcccgacccagggggagcccucccugaacgaggagcaggacaagcgcuucgucugcaagcacagcaugguggaccggggcuggggcaacgggugcggccucuucgggaagggcgggaucgugacgugcgccauguucacgugcaagaagaacauggagggcaagaucguccagcccgagaaccuggaguacaccaucgugaucacgccccacuccggcgaggagaacgccguggggaacgacacgggcaagcacgggaaggagaucaaggucaccccgcagagcuccaucaccgaggccgagcugaccggcuacgggaccgugacgauggagugcagcccccgcaccggccucgacuucaacgagauggugcugcugcagauggagaacaaggcguggcucguccaccggcagugguuccuggaccugccccuccccuggcugccgggcgccgacacccagggguccaacuggauccagaaggagacccuggugacguucaagaacccccacgccaagaagcaggacguggucgugcucggcagccaggagggggccaugcacaccgcccugaccggcgcgaccgagauccagaugagcuccgggaaccuccuguucacgggccaccugaagugccgccugcggauggacaagcuccagcugaagggcaugagcuacuccaugugcaccgggaaguucaaggucgugaaggagaucgccgagacccagcacggcaccaucgugauccgcguccaguacgagggggacggcagccccugcaagauccccuucgagaucauggaccuggagaagcggcacgugcucggccgccugaucacggugaacccgaucgucaccgagaaggacucccccgugaacaucgaggccgagccgcccuucggggacagcuacaucaucaucggcguggagccggggcagcugaagcucuccugguucaagaagggcagcuccaucgggcagauguucgagaccaccaugcgcggcgccaagcggauggccauccugggcgacacggcgugggacuucgggagccugggcggggucuucaccuccaucggcaaggcccuccaccagguguucggggccaucuacggcgccgcguucagcggcguguccuggaccaugaagauccugaucggggucgugaucaccuggaucggcaugaacagccgcuccacgagccuguccguggcccugguccucguggggguggucacccuguaccugggcgugauggugcaggccgacagcgggugcgucguguccuggaagaacaaggagcucaagugcggcagcggcaucuucaucaccgacaacgugcacaccuggacggagcaguacaaguuccagcccgagagccccuccaagcuggccagcgccauccagaaggcgcacgaggaggggaucugcggcauccgguccgucacccgccuggagaaccucauguggaagcagaucacccccgagcugaaccacauccugagcgagaacgaggugaagcucaccaucaugacgggggacaucaagggcaucaugcaggccgggaagcggucccugcgcccgcagcccaccgagcugaaguacagcuggaagaccuggggcaaggccaagaugcucuccaccgagccccacaaccagacguuccugaucgacggcccggagaccgccgagugccccaacaccaaccgggccuggaacagccuggagguggaggacuacggguucggcgucuucaccacgaacaucuggcucaagcugaaggagcgccaggacguguucugcgacuccaagcugaugagcgcggccaucaaggacaaccgggccgugcacgccgacaugggguacuggaucgaguccgcccucaacgacaccuggaagaucgagaaggcgagcuucaucgaggucaaguccugccacuggcccaagagccacacccugugguccaacggcgugcuggagagcgagaugaucauccccaagaacuucgccggcccggugucccagcacaacuaccgccccggguaccacacccagaccgccggccccuggcaccucgggaagcuggagauggacuucgacuucugcgagggcacgaccgucguggugaccgaggacugcgggaaccggggccccagccugcgcaccacgaccgccagcggcaagcucaucaccgaguggugcugccgguccugcacccugccgccccugcgcuaccgcggggacgacggcugcugguacgggauggagauccgcccccucaaggagaaggaggagaaccuggucaacagccuggugacggcgggcuacgggcagaucgacaacuucucccucggcgugcugggcauggcccuguuccucgaggagaugcugcggacccgcgucgggaccaagcacgccgugcugcucguggccgucagcuucaugacccugaucacgggcaacauguccuuccgggaccuggggcgcgugguggucauggugggcgccgcgaugaccgacgacaucgggaugggcgugaccuaccucgcccugcuggccgccuucaagguccgccccaccuucgccgcgggccuccugcugcggaagcucacgagcaaggagcugaugaugaccaccaucgggaucgugcugcucucccagagcaccaucccggagacgauccuggagcugaccgacgcccucgcccugggcaugaugauccugaagaucgugcgcaacauggagaaguaccagcucgccgucaccaucauggccauccugugcgugcccaacgcggucauccugcagaacgccuggaagguguccugcaccauccucgccguggucagcgugagcccccugcugcucacgagcucccagcagaaggccgacuggaucccccuggcgcugaccaucaaggggcucaacccgaccgccaucuuccugaccacgcugagccggaccaacaagaagcgcuccuggccccucaacgaggccaucauggccgugggcauggucagcauccuggccuccagccugcucaagaacgacauccccaugaccggcccccugguggccggcgggcugcucaccgugugcuacguccugacggggcgguccgccgaccuggagcucgagcgcgccgccgacgugcggugggaggaccaggccgagaucagcgggagcuccccgauccugagcaucaccaucuccgaggacgggagcauguccaucaagaacgaggaggaggagcagacccugaccauccucauccgcacgggccugcuggugaucagcggccucuuccccgucuccauccccaucaccgcggccgccugguaccugugggaggugaagaagcagcgggccggggugcugugggacguccccagcccgccgcccgugggcaaggccgagcucgaggacggggcguaccgcaucaagcagaagggcauccugggguacucccagaucggcgccggcguguacaaggaggggaccuuccacaccauguggcacgucacccggggcgccgugcugaugcacaaggggaagcgcaucgagccgagcugggccgacgugcggaaggaccucaucuccuacggcgggggcuggaagcuggagggcgaguggaaggagggggaggagguccaggugcuggcccucgagcccggcaagaacccccgcgcggugcagacgaagcccgggcuguucaagaccaacaccggcaccaucggggccgucagccuggacuucuccccgggcacgagcggcucccccaucguggacaagaaggggaagguggucggccucuacgggaacggcguggugacccggagcggcaccuacgucuccgccaucgcccagaccgagaaguccaucgaggacaaccccgagaucgaggacgacaucuuccgcaagcggcgccugacgaucauggaccugcaccccggggcgggcaagaccaagcgguaccugccggccaucgugcgcgaggccaucaagcgggggcuccgcacccugauccuggcccccacccgcguggucgccgcggagauggaggaggcccuccggggccugcccauccgcuaccagacgcccgccauccgggccgagcacaccgggcgcgagaucguggaccugaugugccacgccaccuucaccaugcggcuccuguccccggugcgcguccccaacuacaaccugaucaucauggacgaggcgcacuucacggaccccgccagcaucgccgcccggggcuacaucagcacccgcguggagaugggcgaggccgcggggaucuucaugaccgccacgccgcccggcucccgggaccccuucccccagagcaacgcccccaucauggacgaggagcgcgagauccccgagcgguccuggaacagcgggcacgagugggugacggacuucaagggcaagaccgucugguucgugcccuccaucaaggccgggaacgacaucgcggccugccuccgcaagaacggcaagaaggugauccagcugagccggaagaccuucgacuccgaguacaucaagacccgcacgaacgacugggacuucgucgugaccaccgacaucagcgagaugggcgccaacuucaaggccgagcgggugaucgacccccgccggugcaugaagcccgucauccugaccgacggggaggagcgcgugauccucgccggcccgaugcccgugacgcacuccagcgcggcccagcggcgcgggcgcaucggccggaaccccaagaacgagaacgaccaguacaucuacaugggggagccccuggagaacgacgaggacugcgcccacuggaaggaggccaagaugcugcucgacaacaucaacaccccggagggcaucauccccuccauguucgagcccgagcgcgagaaggucgacgccaucgacggcgaguaccggcugcgcggggaggcgcggaagaccuucguggaccugaugcgccggggcgaccucccgguguggcuggccuaccgcgucgccgccgaggggaucaacuacgccgaccggcgcuggugcuucgacggcaucaagaacaaccagauccuggaggagaacguggaggucgagaucuggaccaaggagggggagcggaagaagcucaagccccgcuggcuggacgcgcggaucuacagcgacccccuggcccucaaggaguucaaggaguucgccgccggccgcaagucccugacgcugaaccucaucaccgagaugggccggcugcccaccuucaugacccagaaggcgcgcaacgcccuggacaaccucgccgugcugcacacggccgaggccgggggccgggcguacaaccacgcccugagcgagcucccggagacccuggagacccugcuccugcugacccuccuggccacggugaccgggggcaucuuccuguuccucauguccggcaaggggaucggcaagaugacccuggggaugugcugcaucaucaccgccagcauccugcucugguacgcccagauccagccccacuggaucgcggccuccaucauccuggaguucuuccugaucguccuccugauccccgagcccgagaagcagcgcaccccgcaggacaaccagcugacguacguggugaucgccauccucaccgucguggccgccaccauggcgaacgagaugggcuuccuggagaagaccaagaaggaccuggggcucggcagcaucgccacgcagcagcccgaguccaacauccuggacaucgaccugcggcccgccagcgccuggacccucuacgccguggcgaccaccuucaucacgcccaugcugcgccacagcaucgagaacuccagcgucaacgugucccugaccgccaucgccaaccaggccaccgugcucaugggccuggggaagggcuggccgcugagcaagauggacaucggggucccccuccuggcgaucggcugcuacucccaggugaaccccaucacccugacggccgcccuccugcugcucguggcccacuacgccaucaucgggcccggccugcaggcgaaggccacccgggaggcccagaagcgcgccgccgcgggcaucaugaagaacccgaccgucgacgggaucaccgugaucgaccuggaccccauccccuacgaccccaaguucgagaagcagcucggccaggugaugcugcugguccucugcgugacccaggugcugaugaugcgcaccaccugggcccugugcgaggcccucacccuggccacggggccgaucagcacccugugggagggcaaccccgggcgguucuggaacaccaccaucgccgucuccauggcgaacaucuuccgcggcagcuaccucgccggcgccgggcugcuguucuccaucaugaagaacacgaccaacacccggcgcggcaccgggaacacgggcgagacccucggcgagaaguggaagaaccggcugaacgcccugggcaagagcgaguuccagaucuacaagaaguccggcauccaggagguggaccgcacccucgcgaaggaggggaucaagcggggcgagaccgaccaccacgccgugagccgcggguccgccaagcugcggugguucgucgagcgcaaccuggugacgcccgagggcaagguggucgaccucggcugcgggcggggcggguggagcuacuacugcggcgggcugaagaacgugcgcgaggugaagggccugaccaagggcgggcccggccacgaggagccgauccccauguccaccuacggguggaaccucguccggcugcagagcggcguggacguguucuucacgccgcccgagaagugcgacacgcugcucugcgacaucggggaguccagcccgaaccccaccgucgaggccggccgcacccugcgggugcugaaccucguggagaacuggcugaacaacaacacccaguucugcaucaagguccugaaccccuacaugccguccgugaucgagaagauggaggcccugcagcgcaaguacggcggggcgcucgugcggaacccccugagccgcaacagcacccacgagauguacugggucuccaacgccagcggcaacaucguguccagcgugaacaugaucucccggaugcugaucaaccgcuucacgaugcgccacaagaaggccaccuacgagcccgacgucgaccucgggagcggcacccggaacaucgggaucgaguccgagacccccaaccuggacaucaucggcaagcgcaucgagaagaucaagcaggagcacgagacgagcuggcacuacgaccaggaccacccguacaagaccugggccuaccacggcuccuacgagaccaagcagaccgggagcgccuccagcauggugaacggcgugguccggcugcucacgaagcccugggacgugauccccauggugacccagauggcgaugaccgacaccacgcccuucgggcagcagcgcgucuucaaggagaagguggacacccggacccaggagccgaaggagggcaccaagaagcugaugaagaucacggccgaguggcuguggaaggagcucggcaagaagaagacgccccggaugugcacccgggaggaguucacccgcaaggugcgguccaacgccgcccugggggccaucuucacggacgagaacaaguggaaguccgcgcgcgaggccgucgaggacucccgguucugggagcugguggacaaggagcgcaaccuccaccuggagggcaagugcgagaccugcgucuacaacaugauggggaagcgggagaagaagcugggcgaguucgggaaggccaagggcagccgcgccaucugguacauguggcucggcgcgcgguuccuggaguucgaggcccugggguuccucaacgaggaccacugguucucccgcgagaacagccuguccggcguggagggggagggccugcacaagcucggguacauccugcgggacgugagcaagaaggagggcggcgccauguacgccgacgacaccgccgggugggacacccgcaucacgcuggaggaccucaagaacgaggagauggucaccaaccacauggagggcgagcacaagaagcuggcggaggccaucuucaagcugaccuaccagaacaagguggugcggguccagcgccccacgccccgggggacggugauggacaucaucagccgccgcgaccagcggggcuccggccagguggggaccuacggccucaacaccuucaccaacaugggggcccagcugauccgccagauggagggcgaggaggucuucaaggggauccagcaccugacggccaccgaggagaucgccgugcagaacuggcucgcgcgggugggccgcgagcggcugagccgcauggccaucuccggcgacgacugcgucgugaagccgcuggacgaccgguucgccagcgcccucaccgcccugaacgacauggggaaggugcgcaaggacauccagcagugggagcccucccggggcuggaacgacuggacccagguccccuucugcagccaccacuuccacgagcugaucaugaaggacgggcgcgugcucgugguccccugccggaaccaggacgagcugaucggccgcgcgcggaucucccagggggccggcuggagccugcgcgagacggccugccucggcaaguccuacgcccagauguggagccugauguacuuccaccggcgcgaccugcggcucgccgcgaacgccaucugcuccgccgugccgagccacugggugcccaccucccgcaccaccuggagcauccacgcccggcacgaguggaugaccacggaggacaugcugaccgucuggaaccgcguguggauccaggagaaccccuggauggaggacaagacccccguggaguccugggaggagaucccguaccuggggaagcgcgaggaccaguggugcggcagccucaucgggcugaccucccgggcgacgugggccaagaacauccagaccgccaucaaccagguccgcagccugaucggcaacgaggaguacaccgacuacaugcccagcaugaagcgguuccgccgggaggaggaggaggccggggugcucugguga

SEQ ID NO: 9184 - RNA, 9876 nt, Artificial Sequence
  derived and/or modified CDS sequence (opt1) from DENV-2__GQ252676__SS-prME
accgcgggcgugaucaucaugcugauccccaccgccauggcguuccaccucaccacccgcaacggggagccccacaugaucgugagcaagcaggagaagggcaagucccugcuguucaagaccgaggagggggugaacaugugcacccucauggccauggaccugggcgagcugugcgaggacaccaucaccuacaacugcccccuccugcggcagaacgagcccgaggacaucgacugcuggugcaacagcaccuccaccugggugaccuacgggaccugcaccgccaccggcgagcaccgccgggagaagcgcagcgucgcccuggugccccacgugggcauggggcucgagacccggaccgagaccuggauguccagcgagggcgccuggaagcacgcgcagcgcaucgagaccuggauccugcggcaccccggguucaccaucauggccgccauccuggccuacaccaucggcaccaccuacuuccagcgcguccucaucuucauccugcugacggcgguggcccccuccaugaccaugcggugcaucgggaucagcaaccgcgacuucguggagggcgucuccggcgggagcuggguggacaucgugcucgagcacggcuccugcgucaccaccauggccaagaacaagcccacgcuggacuucgagcugaucaagaccgaggccaagcagcccgccacccuccggaaguacugcaucgaggcgaagcugaccaacacgaccaccgccagccgcugcccgacccagggggagcccucccugaacgaggagcaggacaagcgguucgugugcaagcacagcaugguggaccgcggcuggggcaacgggugcggccucuucgggaagggcgggaucgucacgugcgccauguucacgugcaagaagaacauggagggcaagaucgugcagcccgagaaccuggaguacaccaucguggucacgccccacuccggcgaggagaacgccguggggaacgacacgggcaagcacgggaaggagaucaaggugaccccgcagagcuccaucaccgaggccgagcugaccggcuacgggaccgucacgauggagugcagcccccggaccggccucgacuucaacgagauggugcugcugcagauggagaacaaggcguggcucgugcaccgccagugguuccuggaccugccccuccccuggcugccgggcgccgacauccagggguccaacuggauccagaaggagacccuggucaccuucaagaacccccacgccaagaagcaggacguggucgugcucggcagccaggagggggccaugcacacggcccugaccggcgcgaccgagauccagaugagcuccgggaaccuccuguucaccggccaccugaagugccggcugcgcauggacaagcuccagcugaagggcaugagcuacuccaugugcacggggaaguucaagguggucaaggagaucgccgagacccagcacggcaccaucguggugcggguccaguacgagggggacggcagccccugcaagauccccuucgagaucauggaccuggagaagcgccacgugcucggccggcugaucaccgugaacccgaucgucacggagaaggacucccccgugaacaucgaggccgagccgcccuucggggacagcuacaucaucaucggcguggagccggggcagcugaagcucuccugguucaagaagggcagcuccaucgggcagauguucgagaccaccaugcgcggcgccaagcgcauggccauccugggcgacaccgcgugggacuucgggagccugggcggggucuucacguccaucggcaaggcccuccaccagguguucggggccaucuacggcgccgcguucagcggcguguccuggaccaugaagauccugaucggggucgugaucaccuggaucggcaugaacagccgguccaccagccuguccgugagccugguccucguggggguggucacgcuguaccugggcgugauggugcaggccgacuccgggugcgucgugagcuggaagaacaaggagcucaagugcggcagcggcaucuucaucaccgacaacgugcacaccuggaccgagcaguacaaguuccagcccgagucccccagcaagcuggccuccgccauccagaaggcccacgaggaggggaucugcggcauccgcagcgucacgcggcuggagaaccucauguggaagcagaucacccccgagcugaaccacauccuguccgagaacgaggugaagcucagcaucaugaccggggacaucaagggcaucaugcaggcggggaagcgcucccugcggccgcagcccaccgagcugaaguacagcuggaagacguggggcaaggccaagaugcucuccaccgagccccacaaccagaccuuccugaucgacggcccggagaccgccgagugccccaacacgaaccgcgccuggaacagccuggagguggaggacuacggguucggcgucuucaccaccaacaucuggcucaagcugaaggagcggcaggacguguucugcgacuccaagcugaugagcgccgcgaucaaggacaaccgcgccgugcacgccgacaugggguacuggaucgaguccgcccucaacgacaccuggaagaucgagaaggccagcuucaucgaggucaaguccugccacuggcccaagagccacacgcugugguccaacggcgugcuggagagcgagaugaucauccccaagaacuucgcgggcccggugagccagcacaacuaccggcccggguaccacacccagaccgccggccccuggcaccucgggaagcuggagauggacuucgacuucugcgagggcaccaccgucguggugacggaggacugcgggaaccgcggccccucccugcggaccaccaccgccagcggcaagcucaucacggaguggugcugccgcuccugcacccugccgccccugcgguaccgcggggaggacggcugcugguacgggauggagauccggccccucaaggagaaggaggagaaccuggucaacagccuggugaccgccggccacgggcagaucgacaacuucucccucggcgugcugggcauggcgcuguuccucgaggagaugcugcgcacccgggucgggacgaagcacgccgugcugcucguggccgucagcuucaugacccugaucaccggcaacauguccuuccgcgaccuggggcgggugauggugauggucggcgccgccaugaccgacgacaucgggaugggcgugacguaccucgcgcugcuggccgccuucaaggugcgccccaccuucgccgccggccuccugcugcgcaagcucaccagcaaggagcugaugaugaccacgaucgggaucguccugcucucccagagcaccaucccggagaccauccuggagcugaccgacgcgcucgcccugggcaugaugauccugaagaucgugcggaacauggagaaguaccagcucgccgucacgaucauggccauccugugcgugcccaacgccgugauccugcagaacgcguggaaggucuccugcaccauccucgccgccgugagcgugagcccccugcugcucaccagcucccagcagaaggccgacuggaucccccuggcgcugaccaucaaggggcucaacccgacggccaucuuccugaccacccugagccgcaccaacaagaagcgguccuggccccucaacgaggccaucauggccgucggcauggugagcauccuggccuccagccugcucaagaacgacauccccaugacgggcccccugguggccggcgggcugcucaccgucugcuacgugcugaccgggcgcagcgccgaccuggagcucgagcgggccgccgacgugcgcugggaggaccaggccgagaucuccgggagcuccccgauccugagcaucaccaucuccgaggacgggagcauguccaucaagaacgaggaggaggagcagacgcugaccauccucauccggaccggccugcuggucaucagcggccucuuccccguguccauccccaucaccgcggccgccugguaccugugggaggugaagaagcagcgcgccgggguccugugggacgugcccagcccgccgcccgugggcaaggccgagcucgaggacggggcguaccggaucaagcagaagggcauccugggguacucccagaucggcgccggcgucuacaaggaggggacguuccacaccauguggcacgugacccgcggcgccgugcugaugcacaaggggaagcggaucgagccgagcugggccgacguccgcaaggaccucaucuccuacggcgggggcuggaagcuggagggcgaguggaaggagggggaggagguccaggugcuggcccucgagcccggcaagaacccccgggcgguccagaccaagcccgggcuguucaagaccaacacgggcaccaucggggccgugagccuggacuucuccccgggcaccagcggcucccccaucguggacaagaaggggaaggucgugggccucuacgggaacggcguggucacccgcagcggcacguacguguccgccaucgcccagaccgagaaguccaucgaggacaaccccgagaucgaggacgacaucuuccggaagaagcgccugaccaucauggaccugcaccccggggcgggcaagaccaagcgguaccugccggccaucgugcgcgaggccaucaagcgggggcuccgcacgcugauccuggcccccacccgggucguggccgcggagauggaggaggcccuccgcggccugcccauccgcuaccagacccccgccauccgggccgagcacaccgggcgcgagaucguggaccugaugugccacgccacguucaccaugcggcuccugagcccgguccgcgugcccaacuacaaccugaucaucauggacgaggcgcacuucaccgaccccgccuccaucgccgcccggggcuacaucagcacccgcguggagaugggcgaggccgcggggaucuucaugacggccacgccgcccggcucccgggaccccuucccccagagcaacgcccccaucauggacgaggagcgcgagauccccgagcgguccuggaacagcgggcacgagugggucaccgacuucaagggcaagaccgugugguucgugcccuccaucaaggccgggaacgacaucgcggccugccuccgcaagaacggcaagaaggucauccagcugagccggaagacguucgacuccgaguacaucaagacccgcaccaacgacugggacuucguggugaccacggacaucagcgagaugggcgccaacuucaaggccgagcgggucaucgacccccgccggugcaugaagcccgugauccugaccgacggggaggagcgcgugauccucgccggcccgaugcccgucacccacuccagcgcggcccagcggcgcgggcggaucggccgcaaccccaagaacgagaacgaccaguacaucuacaugggggagccccuggagaacgacgaggacugcgcccacuggaaggaggccaagaugcugcucgacaacaucaacaccccggagggcaucauccccuccauguucgagcccgagcgcgagaagguggacgccaucgacggcgaguaccggcugcgcggggaggcgcggaagacguucguggaccugaugcgccggggcgaccucccggucuggcuggccuaccgcguggccgccgaggggaucaacuacgccgaccggcgcuggugcuucgacggcaucaagaacaaccagauccuggaggagaacgucgagguggagaucuggaccaaggagggggagcggaagaagcucaagccccgcuggcuggacgcgcggaucuacagcgacccccuggcccucaaggaguucaaggaguucgccgccggccgcaagucccugacccugaaccucaucaccgagaugggccggcugcccacguucaugacccagaaggcgcgcaacgcccuggacaaccucgccgugcugcacaccgccgaggccgggggccgggcguacaaccacgcccugagcgagcucccggagacccuggagacgcugcuccugcugacccuccuggccaccgucaccgggggcaucuuccuguuccucauguccggcaaggggaucggcaagaugacgcuggggaugugcugcaucaucaccgccagcauccugcucugguacgcccagauccagccccacuggaucgcggccuccaucauccuggaguucuuccugaucgugcuccugauccccgagcccgagaagcagcgcaccccgcaggacaaccagcugaccuacguggucaucgccauccucaccgugguggccgccacgauggcgaacgagaugggcuuccuggagaagaccaagaaggacuucgggcugggcagcaucgccacccagcagcccgagagcaacauccucgacaucgaccugcggcccgccuccgccuggacccuguacgccgucgcgacgaccuucaucacccccaugcuccgccacagcaucgagaacuccagcgugaacgugucccugaccgccaucgccaaccaggccacgguccugaugggccucgggaagggcuggccgcugagcaagauggacaucggggugccccugcucgcgaucggcugcuacucccaggugaaccccaucacccugaccgccgcccugcuccugcuggucgcccacuacgccaucaucgggcccggccuccaggcgaaggccacccgggaggcccagaagcgcgccgccgcgggcaucaugaagaacccgacgguggacgggaucaccgugaucgaccuggaccccauccccuacgaccccaaguucgagaagcagcugggccaggucaugcuccuggugcugugcgugacccagguccucaugaugcggaccacgugggcccugugcgaggcccugacccucgccaccgggccgaucagcacccugugggagggcaaccccgggcgcuucuggaacacgaccaucgccguguccauggcgaacaucuuccgcggcagcuaccuggccggcgccgggcuccuguucuccaucaugaagaacaccaccaacacgcggcgcggcaccgggaacaccggcgagacccugggcgagaaguggaagaaccggcucaacagccuggggaaguccgaguuccagaucuacaagcgcagcggcauccaggagguggaccggacgcuggccaaggaggggaucaagcgcggcgagaccgaccaccacgcggucucccgggggagcgccaagcuccgcugguucguggagcggaaccuggugacccccgagggcaaggucguggaccugggcugcgggcgcggcgggugguccuacuacugcggcgggcucaagaacgugcgggaggucaagggccugaccaagggcgggcccggccacgaggagccgauccccaugagcacguacggguggaaccuggugcgccuccaguccggcguggacgucuucuucacgccgcccgagaagugcgacacccugcugugcgacaucggggagagcagcccgaaccccaccguggaggccggccggacgcuccgcgugcugaaccuggucgagaacuggcucaacaacaacacccaguucugcaucaaggugcugaaccccuacaugccguccgugaucgagaagauggagacccugcagcggaaguacggcggggcccugguccgcaacccccucagccggaacuccacccacgagauguacugggugagcaacgccuccggcaacaucgugagcuccgucaacaugaucagccgcaugcugaucaaccgguucaccaugcgccacaagaaggcgacguacgagcccgacguggaccugggguccggcacccgcaacaucgggaucgagagcgagacccccaaccucgacaucaucggcaagcggaucgagaagaucaagcaggagcacgagaccuccuggcacuacgaccaggaccacccguacaagacgugggccuaccacggcagcuacgagaccaagcagaccggguccgccagcuccauggugaacggcgucgugcgccugcugaccaagcccugggacgugauccccauggucacgcagauggccaugaccgacaccacccccuucgggcagcagcggguguucaaggagaagguggacacgcgcacccaggagccgaaggagggcaccaagaagcucaugaagaucaccgccgaguggcuguggaaggagcugggcaagaagaagacgccccggaugugcacccgcgaggaguucgcgcggaagguccgcagcaacgccgcccucggggccaucuucaccgacgagaacaaguggaaguccgcccgggaggcgguggaggacagccgcuucugggagcuggucgacaaggagcggaaccugcaccucgagggcaagugcgagaccugcguguacaacaugauggggaagcgcgagaagaagaucggcgaguucgggaaggccaagggcucccgggccaucugguacauguggcugggcgcccgcuuccuggaguucgaggcgcucggguuccugaacgaggaccacugguucagccgggagaacagccuguccggcguggagggggagggccuccacaagcugggguacauccugcgcgaggucagcaagaaggagggcggcgccauguacgccgacgacacggccgggugggacacccggaucacccucgaggaccugaagaacgaggagauggugaccaaccacauggagggcgagcacaagaagcuggccgaggcgaucuucaagcucacguaccagaacaaggugguccgcgugcagcggcccacgccccgcgggaccgugauggacaucaucucccggcgcgaccagcgcggcagcgggcaggucggcaccuacggccugaacacguucaccaacaugggggcccagcugauccggcagauggagggcgaggggguguucaagggcauccagcaccucaccgccaccgaggagguggccguccaggacuggcuggcccgcgugggccgggagcgccugucccggauggcgaucagcggggacgacugcguggucaagccgcucgacgaccgcuucgccuccgcccugacggcccugaacgacaugggcaaggugcggaaggacauccagcagugggagcccagccgcggguggaacgacuggacccaggugcccuucugcucccaccacuuccacgagcucaucaugaaggacggccggguccugguggugcccugccgcaaccaggacgagcugaucgggcgggcccgcaucagccagggcgcgggcuggucccuccgggagaccgccugccugggcaagagcuacgcccagauguggucccugauguacuuccaccgccgggaccuccgccuggccgccaacgcgaucugcagcgccgucccgucccacugggugcccaccagccggacgaccugguccauccacgcccgccacgaguggaugaccaccgaggacaugcugaccguguggaaccgggucuggauccaggagaaccccuggauggaggacaagacgcccguggagagcugggaggagaucccguaccucggcaagcgcgaggaccaguggugcgggagccugaucggccugaccucccgcgccaccugggcgaagaacauccagaccgccaucaaccaggugcggagccucaucggguccgaggaguacacggacuacaugcccagcaugaagcgcuuccggcgcgaggaggaggaggccggcguccugugguga

SEQ ID NO: 9185 - RNA, 9876 nt, Artificial Sequence
  derived and/or modified CDS sequence (opt1) from DENV-2__GQ252677__SS-prME
accgcgggcgugaucaucaugcugauccccaccgccauggcguuccaccucaccacccgcaacggggagccccacaugaucgugagcaagcaggagaagggcaagucccugcuguucaagaccgaggagggggugaacaugugcacccucauggccauggaccugggcgagcugugcgaggacaccaucaccuacaacugcccccuccugcggcagaacgagcccgaggacaucgacugcuggugcaacagcaccuccaccugggugaccuacgggaccugcaccgccaccggcgagcaccgccgggagaagcgcagcgucgcccuggugccccacgugggcauggggcucgagacccggaccgagaccuggauguccagcgagggcgccuggaagcacgcgcagcgcaucgagaccuggauccugcggcaccccggguucaccaucauggccgccauccuggccuacaccaucggcaccaccuacuuccagcgcguccucaucuucauccugcugacggcgguggcccccuccaugaccaugcggugcaucgggaucagcaaccgcgacuucguggagggcgucuccggcgggagcuggguggacaucgugcucgagcacggcuccugcgucaccaccauggccaagaacaagcccacgcuggacuucgagcugaucaagaccgaggccaagcagcccgccacccuccggaaguacugcaucgaggcgaagcugaccaacacgaccaccgccagccgcugcccgacccagggggagcccucccugaacgaggagcaggacaagcgguucgugugcaagcacagcaugguggaccgcggcuggggcaacgggugcggccucuucgggaagggcgggaucgucacgugcgccauguucacgugcaagaagaacauggagggcaagaucgugcagcccgagaaccuggaguacaccaucguggucacgccccacuccggcgaggagaacgccguggggaacgacacgggcaagcacgggaaggagaucaaggugaccccgcagagcuccaucaccgaggccgagcugaccggcuacgggaccgucacgauggagugcagcccccggaccggccucgacuucaacgagauggugcugcugcagauggagaacaaggcguggcucgugcaccgccagugguuccuggaccugccccuccccuggcugccgggcgccgacauccagggguccaacuggauccagaaggagacccuggucaccuucaagaacccccacgccaagaagcaggacguggucgugcucggcagccaggagggggccaugcacacggcccugaccggcgcgaccgagauccagaugagcuccgggaaccuccuguucaccggccaccugaagugccggcugcgcauggacaagcuccagcugaagggcaugagcuacuccaugugcacggggaaguucaagguggucaaggagaucgccgagacccagcacggcaccaucguggugcggguccaguacgagggggacggcagccccugcaagauccccuucgagaucauggaccuggagaagcgccacgugcucggccggcugaucaccgugaacccgaucgucacggagaaggacucccccgugaacaucgaggccgagccgcccuucggggacagcuacaucaucaucggcguggagccggggcagcugaagcucuccugguucaagaagggcagcuccaucgggcagauguucgagaccaccaugcgcggcgccaagcgcauggccauccugggcgacaccgcgugggacuucgggagccugggcggggucuucacguccaucggcaaggcccuccaccagguguucggggccaucuacggcgccgcguucagcggcguguccuggaccaugaagauccugaucggggucgugaucaccuggaucggcaugaacagccgguccaccagccuguccgugagccugguccucguggggguggucacgcuguaccugggcgugauggugcaggccgacuccgggugcgucgugagcuggaagaacaaggagcucaagugcggcagcggcaucuucaucaccgacaacgugcacaccuggaccgagcaguacaaguuccagcccgagucccccagcaagcuggccuccgccauccagaaggcccacgaggaggggaucugcggcauccgcagcgucacgcggcuggagaaccucauguggaagcagaucacccccgagcugaaccacauccuguccgagaacgaggugaagcucagcaucaugaccggggacaucaagggcaucaugcaggcggggaagcgcucccugcggccgcagcccaccgagcugaaguacagcuggaagacguggggcaaggccaagaugcucuccaccgagccccacaaccagaccuuccugaucgacggcccggagaccgccgagugccccaacacgaaccgcgccuggaacagccuggagguggaggacuacggguucggcgucuucaccaccaacaucuggcucaagcugaaggagcggcaggacguguucugcgacuccaagcugaugagcgccgcgaucaaggacaaccgcgccgugcacgccgacaugggguacuggaucgaguccgcccucaacgacaccuggaagaucgagaaggccagcuucaucgaggucaaguccugccacuggcccaagagccacacgcugugguccaacggcgugcuggagagcgagaugaucauccccaagaacuucgcgggcccggugagccagcacaacuaccggcccggguaccacacccagaccgccggccccuggcaccucgggaagcuggagauggacuucgacuucugcgagggcaccaccgucguggugacggaggacugcgggaaccgcggccccucccugcggaccaccaccgccagcggcaagcucaucacggaguggugcugccgcuccugcacccugccgccccugcgguaccgcggggaggacggcugcugguacgggauggagauccggccccucaaggagaaggaggagaaccuggucaacagccuggugaccgccggccacgggcagaucgacaacuucucccucggcgugcugggcauggcgcuguuccucgaggagaugcugcgcacccgggucgggacgaagcacgccgugcugcucguggccgucagcuucaugacccugaucaccggcaacauguccuuccgcgaccuggggcgggugauggugauggucggcgccgccaugaccgacgacaucgggaugggcgugacguaccucgcgcugcuggccgccuucaaggugcgccccaccuucgccgccggccuccugcugcgcaagcucaccagcaaggagcugaugaugaccacgaucgggaucguccugcucucccagagcaccaucccggagaccauccuggagcugaccgacgcgcucgcccugggcaugaugauccugaagaucgugcggaacauggagaaguaccagcucgccgucacgaucauggccauccugugcgugcccaacgccgugauccugcagaacgcguggaaggucuccugcaccauccucgccgccgugagcgugagcccccugcugcucaccagcucccagcagaaggccgacuggaucccccuggcgcugaccaucaaggggcucaacccgacggccaucuuccugaccacccugagccgcaccaacaagaagcgguccuggccccucaacgaggccaucauggccgucggcauggugagcauccuggccuccagccugcucaagaacgacauccccaugacgggcccccugguggccggcgggcugcucaccgucugcuacgugcugaccgggcgcagcgccgaccuggagcucgagcgggccgccgacgugcgcugggaggaccaggccgagaucuccgggagcuccccgauccugagcaucaccaucuccgaggacgggagcauguccaucaagaacgaggaggaggagcagacgcugaccauccucauccggaccggccugcuggucaucagcggccucuuccccguguccauccccaucaccgcggccgccugguaccugugggaggugaagaagcagcgcgccgggguccugugggacgugcccagcccgccgcccgugggcaaggccgagcucgaggacggggcguaccggaucaagcagaagggcauccugggguacucccagaucggcgccggcgucuacaaggaggggacguuccacaccauguggcacgugacccgcggcgccgugcugaugcacaaggggaagcggaucgagccgagcugggccgacguccgcaaggaccucaucuccuacggcgggggcuggaagcuggagggcgaguggaaggagggggaggagguccaggugcuggcccucgagcccggcaagaacccccgggcgguccagaccaagcccgggcuguucaagaccaacacgggcaccaucggggccgugagccuggacuucuccccgggcaccagcggcucccccaucguggacaagaaggggaaggucgugggccucuacgggaacggcguggucacccgcagcggcacguacguguccgccaucgcccagaccgagaaguccaucgaggacaaccccgagaucgaggacgacaucuuccggaagaagcgccugaccaucauggaccugcaccccggggcgggcaagaccaagcgguaccugccggccaucgugcgcgaggccaucaagcgggggcuccgcacgcugauccuggcccccacccgggucguggccgcggagauggaggaggcccuccgcggccugcccauccgcuaccagacccccgccauccgggccgagcacaccgggcgcgagaucguggaccugaugugccacgccacguucaccaugcggcuccugagcccgguccgcgugcccaacuacaaccugaucaucauggacgaggcgcacuucaccgaccccgccuccaucgccgcccggggcuacaucagcacccgcguggagaugggcgaggccgcggggaucuucaugacggccacgccgcccggcucccgggaccccuucccccagagcaacgcccccaucauggacgaggagcgcgagauccccgagcgguccuggaacagcgggcacgagugggucaccgacuucaagggcaagaccgugugguucgugcccuccaucaaggccgggaacgacaucgcggccugccuccgcaagaacggcaagaaggucauccagcugagccggaagacguucgacuccgaguacaucaagacccgcaccaacgacugggacuucguggugaccacggacaucagcgagaugggcgccaacuucaaggccgagcgggucaucgacccccgccggugcaugaagcccgugauccugaccgacggggaggagcgcgugauccucgccggcccgaugcccgucacccacuccagcgcggcccagcggcgcgggcggaucggccgcaaccccaagaacgagaacgaccaguacaucuacaugggggagccccuggagaacgacgaggacugcgcccacuggaaggaggccaagaugcugcucgacaacaucaacaccccggagggcaucauccccuccauguucgagcccgagcgcgagaagguggacgccaucgacggcgaguaccggcugcgcggggaggcgcggaagacguucguggaccugaugcgccggggcgaccucccggucuggcuggccuaccgcguggccgccgaggggaucaacuacgccgaccggcgcuggugcuucgacggcaucaagaacaaccagauccuggaggagaacgucgagguggagaucuggaccaaggagggggagcggaagaagcucaagccccgcuggcuggacgcgcggaucuacagcgacccccuggcccucaaggaguucaaggaguucgccgccggccgcaagucccugacccugaaccucaucaccgagaugggccggcugcccacguucaugacccagaaggcgcgcaacgcccuggacaaccucgccgugcugcacaccgccgaggccgggggccgggcguacaaccacgcccugagcgagcucccggagacccuggagacgcugcuccugcugacccuccuggccaccgucaccgggggcaucuuccuguuccucauguccggcaaggggaucggcaagaugacgcuggggaugugcugcaucaucaccgccagcauccugcucugguacgcccagauccagccccacuggaucgcggccuccaucauccuggaguucuuccugaucgugcuccugauccccgagcccgagaagcagcgcaccccgcaggacaaccagcugaccuacguggucaucgccauccucaccgugguggccgccacgauggcgaacgagaugggcuuccuggagaagaccaagaaggacuucgggcugggcagcaucgccacccagcagcccgagagcaacauccucgacaucgaccugcggcccgccuccgccuggacccuguacgccgucgcgacgaccuucaucacccccaugcuccgccacagcaucgagaacuccagcgugaacgugucccugaccgccaucgccaaccaggccacgguccugaugggccucgggaagggcuggccgcugagcaagauggacaucggggugccccugcucgcgaucggcugcuacucccaggugaaccccaucacccugaccgccgcccugcuccugcuggucgcccacuacgccaucaucgggcccggccuccaggcgaaggccacccgggaggcccagaagcgcgccgccgcgggcaucaugaagaacccgacgguggacgggaucaccgugaucgaccuggaccccauccccuacgaccccaaguucgagaagcagcugggccaggucaugcuccuggugcugugcgugacccagguccucaugaugcggaccacgugggcccugugcgaggcccugacccucgccaccgggccgaucagcacccugugggagggcaaccccgggcgcuucuggaacacgaccaucgccguguccauggcgaacaucuuccgcggcagcuaccuggccggcgccgggcuccuguucuccaucaugaagaacaccaccaacacgcggcgcggcaccgggaacaccggcgagacccugggcgagaaguggaagaaccggcucaacagccuggggaaguccgaguuccagaucuacaagcgcagcggcauccaggagguggaccggacgcuggccaaggaggggaucaagcgcggcgagaccgaccaccacgcggucucccgggggagcgccaagcuccgcugguucguggagcggaaccuggugacccccgagggcaaggucguggaccugggcugcgggcgcggcgggugguccuacuacugcggcgggcucaagaacgugcgggaggucaagggccugaccaagggcgggcccggccacgaggagccgauccccaugagcacguacggguggaaccuggugcgccuccaguccggcguggacgucuucuucacgccgcccgagaagugcgacacccugcugugcgacaucggggagagcagcccgaaccccaccguggaggccggccggacgcuccgcgugcugaaccuggucgagaacuggcucaacaacaacacccaguucugcaucaaggugcugaaccccuacaugccguccgugaucgagaagauggagacccugcagcggaaguacggcggggcccugguccgcaacccccucagccggaacuccacccacgagauguacugggugagcaacgccuccggcaacaucgugagcuccgucaacaugaucagccgcaugcugaucaaccgguucaccaugcgccacaagaaggcgacguacgagcccgacguggaccugggguccggcacccgcaacaucgggaucgagagcgagacccccaaccucgacaucaucggcaagcggaucgagaagaucaagcaggagcacgagaccuccuggcacuacgaccaggaccacccguacaagacgugggccuaccacggcagcuacgagaccaagcagaccggguccgccagcuccauggugaacggcgucgugcgccugcugaccaagcccugggacgugauccccauggucacgcagauggccaugaccgacaccacccccuucgggcagcagcggguguucaaggagaagguggacacgcgcacccaggagccgaaggagggcaccaagaagcucaugaagaucaccgccgaguggcuguggaaggagcugcggaagaagaagacgccccgcaugugcacccgggaggaguucgcgcgcaagguccggagcaacgccgcccucggcgccaucuucaccgacgagaacaaguggaaguccgcccgcgaggcgguggaggacagccgguucugggagcuggucgacaaggagcgcaaccugcaccucgaggggaagugcgagaccugcguguacaacaugaugggcaagcgggagaagaagaucggggaguucggcaaggccaaggggucccgcgccaucugguacauguggcugggcgcccgguuccuggaguucgaggcgcucggcuuccugaacgaggaccacugguucagccgcgagaacagccuguccgggguggagggcgaggggcuccacaagcugggcuacauccugcgggaggucagcaagaaggagggcggcgccauguacgccgacgacacggccggcugggacacccgcaucacccucgaggaccugaagaacgaggagauggugaccaaccacauggagggggagcacaagaagcuggccgaggcgaucuucaagcucacguaccagaacaaggugguccgggugcagcgccccacgccccggggcaccgugauggacaucaucucccgccgcgaccagcgggggagcggccaggucgggaccuacggccugaacacguucaccaacaugggcgcccagcugauccgccagauggagggggagggcguguucaaggggauccagcaccucaccgccaccgaggagguggccguccaggacuggcuggcccgggugggccgcgagcggcugucccgcauggcgaucagcggcgacgacugcguggucaagccgcucgacgaccgguucgccuccgcccugacggcccugaacgacauggggaaggugcgcaaggacauccagcagugggagcccagccggggcuggaacgacuggacccaggugcccuucugcucccaccacuuccacgagcucaucaugaaggacgggcgcguccugguggugcccugccggaaccaggacgagcugaucggccgcgcccggaucagccagggggcgggcuggucccuccgcgagaccgccugccugggcaagagcuacgcccagauguggucccugauguacuuccaccggcgcgaccuccggcuggccgccaacgcgaucugcagcgccgucccgucccacugggugcccaccagccgcacgaccugguccauccacgcccggcacgaguggaugaccaccgaggacaugcugaccguguggaaccgcgucuggauccaggagaaccccuggauggaggacaagacgcccguggagagcugggaggagaucccguaccucgggaagcgcgaggaccaguggugcggcagccugaucgggcugaccucccgggccaccugggcgaagaacauccagaccgccaucaaccaggugcgcagccucaucggcuccgaggaguacacggacuacaugcccagcaugaagcgguuccgccgggaggaggaggaggccgggguccugugguga

SEQ ID NO: 9186 - RNA, 9876 nt, Artificial Sequence
  derived and/or modified CDS sequence (opt1) from DENV-2__FJ898438__SS-prME
accgugggcgucaucgugaugcugauccccaccgccauggccuuccaccucaccacccgcaacggggagccgcacaugaucgugggccggcaggagaagggcaagagccugcuguucaagaccgaggacggcgucaacaugugcacccucauggcgaucgaccugggggagcugugcgaggacaccaucaccuacaagugcccccuccugcgccagaacgagcccgaggacaucgacugcuggugcaacagcaccagcaccugggugaccuacgggaccugcuccaccaccggcgagcaccggcgcgagaagcggagcguggcccuggucccccacguggggaugggccucgagacccgcaccgagaccuggauguccagcgagggggccuggaagcacgugcagcggaucgagaccuggauccugcgccacccgggcuucacgaucauggccgccauccuggcguacaccaucgggaccacccacuuccagcgggcccucaucuucauccugcugacggccgucgcccccuccaugaccaugcgcugcaucggcaucagcaaccgggacuucguggagggcguguccgggggcagcugggucgacaucgugcucgagcacggguccugcgugaccaccauggcgaagaacaagcccacgcuggacuucgagcugaucaagaccgaggccaagcagcccgccacccuccgcaaguacugcaucgaggccaagcugaccaacacgaccaccgagagccggugcccgacccagggcgagcccucccugaacgaggagcaggacaagcgcuucaucugcaagcacagcauggucgaccggggcugggggaacggcugcgggcuguucggcaagggcgggaucgugacgugcgccauguucacgugcaagaagaacauggagggcaaggugguccagcccgagaacuucgaguacaccaucgugaucacgccccacuccggggaggagcacgcggugggcaacgacacggggaagcacggcaaggagaucaagaucaccccgcagagcuccaucaccgaggccgagcugaccggguacggcaccgucacgauggagugcagcccccgcaccggccuggacuucaacgagauggugcuccugcagauggaggacaaggccuggcuggugcaccggcagugguuccucgaccugccccugcccuggcucccgggggccgacacccagggcuccaacuggauccagaaggagacccuggucacguucaagaacccccacgccaagaagcaggacguggucgugcuggggagccaggagggcgcgaugcacaccgcccucaccggggccaccgagauccagaugagcuccggcaaccugcuguucacgggccaccucaagugccgccugcggauggacaagcugcagcucaaggggaugagcuacuccaugugcaccggcaaguucaagaucgugaaggagaucgccgagacccagcacgggaccaucgucauccgcgugcaguacgagggcgacggcagccccugcaagauccccuucgagaucacggaccuggagaagcggcacgugcuggggcgccucaucaccgucaacccgaucgugaccgagaaggacucccccgugaacaucgaggccgagccgcccuucggcgacagcuacaucaucaucggggucgagccgggccagcugaagcugaacugguucaagaagggguccagcaucggccagauguucgagaccacgaugcgcggcgcgaagcggauggccauccucggggacaccgccugggacuucggcucccucggcgggguguucaccagcaucgggaaggcccugcaccagguguucggggccaucuacggcgcggccuucuccggggucagcuggaccaugaagauccucaucggcgugaucaucacguggaucgggaugaacucccgcagcaccucccugagcgugucccugguccuggugggcguggucacccucuaccugggggccauggugcaggccgacagcggcugcguggucuccuggaagaacaaggagcugaagugcggcagcgggaucuucaucaccgacaacgugcacacguggaccgagcaguacaaguuccagcccgagagccccuccaagcucgcgagcgccauccagaaggcccacgaggagggcaucugcgggauccgguccgugacccgccuggagaaccugauguggaagcagaucacccccgagcucaaccacauccugagcgagaacgaggucaagcugacgaucaugaccggcgacaucaaggggaucaugcaggccggcaagcggucccuccgcccgcagcccaccgagcugaaguacagcuggaagaccuggggcaaggccaagaugcuguccacggagagccacaaccagaccuuccucaucgacgggcccgagaccgcggagugcccgaacuccaaccgggccuggaacagccuggagguggaggacuacggcuucgggguguucaccacgaacaucuggcugaagcuccgcgagaagcaggacgucuucugcgacuccaagcugaugagcgccgccaucaaggacaaccgggccgugcacgcggacaugggcuacuggaucgaguccgcccugaacgacaccuggaagauggagaaggccagcuucaucgaggugaaguccugccacuggcccaagagccacacccucugguccaacggcguccuggagagcgagaugaucauccccaagaacuucgccgggcccgugagccagcacaacuaccgcccgggcuaccacacccagaccgccgggcccuggcaccugggcaagcucgagauggacuucgacuucugcgaggggacgaccguggucgugaccgaggacugcggcaaccggggccccucccugcgcaccacgaccgcgagcgggaagcugaucaccgaguggugcugccgguccugcacccucccgccccugcgcuaccggggcgaggacgggugcugguacggcauggagauccgcccccugaaggagaaggaggagaaccucgugaacagccuggucacggccgggcacggccagaucgacaacuucucccugggcgugcucgggauggcccuguuccuggaggagaugcuccggacccgcaucggcaccaagcacgccauccugcugguggcggccagcuucgucacccucaucacggggaacauguccuuccgggaccugggccgcgugauggugauggucggggccaccaugaccgacgacaucggcaugggcgugaccuaccuggcccuccuggccgcguucaaggugcgccccacguucgccgccgggcugcuccugcggaagcugaccagcaaggagcucaugauggccaccaucggcaucgcccugcugucccagagcaccauccccgagacgauccucgagcugaccgacgcgcuggcccucgggaugaugguccugaagaucgugcgcaacauggagaaguaccagcuggccgugaccaucauggccaucuccugcguccccaacgccgugauccuccagaacgcguggaaggugagcugcaccauccuggccgccgucuccgugagcccccugcuccugacguccagccagcagaaggccgacuggaucccccuggcgcucaccaucaagggccugaaccccaccgccaucuuccugaccacgcucucccggaccagcaagaagcgcuccuggccgcugaacgaggccgucauggccgugggcauggugagcauccuggccagcucccuccugaagaacgacauccccaugaccgggccccuggucgcgggcgggcuccugaccgugugcuacgugcugacgggccggagcgccgaccucgagcuggagcgcgccgccgacgucaagugggaggaccaggccgagaucuccgggagcucccccauccugagcaucaccaucuccgaggacggcagcauguccaucaagaacgaggaggaggagcagacccucaccauccugauccggacgggccugcucgugaucagcgggguguucccggucuccauccccaucaccgcggccgccugguaccugugggaggugaagaagcagcgcgccggcgugcugugggacguccccuccccgccgcccguggggaaggccgagcucgaggacggcgcguaccggaucaagcagcgcgggauccugggcuacucccagaucggcgccgggguguacaaggagggcaccuuccacaccauguggcacgucacccgcggggccgugcugaugcaccgcggcaagcggaucgagcccagcugggccgacgugaagaaggaccucaucuccuacgggggcggcuggaagcuggagggggaguggaaggagggcgaggagguccaggugcuggcccucgagcccgggaagaacccccgcgcggugcagacgaagcccggcaucuucaagaccaacaccgggaccaucggcgccgucagccuggacuucucccccggcacgagcgggucccccaucguggaccggaagggcaagguggucgggcuguacggcaacggcguggugacccgcagcggggccuacgucagcgccaucgcgcagaccgagaaguccaucgaggacaaccccgagaucgaggacgacaucuuccggaagaagcgccucaccaucauggaccugcaccccggcgccgggaagacgaagcgguaccugcccgccaucgugcgcgaggccaucaagcggggccuccgcacccugauccuggccccgacccgcguggucgcggccgagauggaggaggcccugcgggggcuccccauccgcuaccagacccccgccaucaagacggagcacaccggccgggagaucguggaccugaugugccacgccaccuucaccaugcgccugcucagccccgugcgggucccgaacuacaaccugaucaucauggacgaggcgcacuucacggaccccgccuccaucgccgcccgcggcuacaucagcacccggguggagaugggggaggccgcgggcaucuucaugaccgccacgccgcccgggucccgcgacccguucccccagagcaacgcccccaucauggacgaggagcgggagauccccgagcgcuccuggaacagcggccacgagugggugacggacuucaaggggaagaccgucugguucgugccguccaucaaggccggcaacgacaucgcggccugccugcggaagaacggcaagaaggugauccagcucagccgcaagaccuucgacuccgaguacgucaagacccgggccaacgacugggacuucguggugacgaccgacaucagcgagaugggggccaacuucaaggccgagcgcgucaucgacccccggcgcugcaugaagcccgugauccugaccgacggcgaggagcgggugauccuggcggggcccaugccggucacccacuccagcgccgcccagcgccggggccgcaucgggcgcaaccccaagaacgagaacgaccaguacaucuacaugggcgagccccucgagaacgacgaggacugcgcccacuggaaggaggccaagaugcugcuggacaacaucaacacgcccgagggcaucaucccguccauguucgagcccgagcgggagaagguggacgcgaucgacggggaguaccgccuccggggcgaggcccgcaagaccuucguggaccugaugcggcgcggggaccugcccgucuggcucgccuacaagguggccgccgagggcaucaacuacgcggaccggaaguggugcuucgacgggaucaagaacaaccagauccuggaggagaacauggagguggagaucuggaccaaggagggcgagcgcaagaagcugaagccgcgguggcucgacgcccgcaucuacagcgacccccuggcccugaaggaguucaaggaguucgccgcgggccggaagucccucacccugaaccugaucacggagauggggcgccuccccaccuucaugacccagaaggcccggaacgcccuggacaaccuggccguccuccacaccgccgaggcgggcgggcgcgccuacaaccacgcccugagcgagcugcccgagacgcucgagacccugcugcuccugacccugcucgccaccgugacgggcggcaucuuccuguuccugauguccgggaagggcaucgggaagaugacccucggcaugugcugcaucaucaccgccagcauccugcugugguacgcgcagauccagccgcacuggaucgccgccagcaucauccucgaguucuuccugaucguccugcucauccccgagcccgagaagcagcggacgccccaggacaaccagcugaccuacguggugaucgccauccugacggucguggccgcgaccauggccaacgagaugggguuccucgagaagaccaagaaggaccugggccugggcuccaucaccacgcaggagagcgaguccaacauccucgacaucgaccugcgcccggccagcgccuggacccuguacgccguggcgaccaccuucgucacgcccaugcuccggcacuccaucgagaacagcuccgugaacgugagccugaccgccaucgccaaccaggccaccguccugauggggcucggcaagggguggccccuguccaagauggacaucggcgugccccugcucgcgaucgggugcuacagccaggugaacccgaucacccugacggccgcccugcuccugcuggucgcccacuacgccaucaucggccccggccuccaggcgaaggccacccgcgaggcccagaagcgggccgccgcggggaucaugaagaaccccaccguggacggcaucaccgugaucgaccuggagcccaucccguacgaccccaaguucgagaagcagcuggggcaggucaugcuccugauccugugcgugacccaggugcucaugaugcgcaccaccugggcccugugcgaggcccugacccucgccacgggccccaucuccacccugugggaggggaaccccggccgguucuggaacaccaccaucgccgucagcauggcgaacaucuuccgcggcuccuaccuggccggggccggccuccuguucagcaucaugaagaacacgaccaacacccgccgggggaccggcaacaucggcgagacgcugggggagaaguggaagucccgccucaacgcccugggcaagagcgaguuccagaucuacaagaaguccgggauccaggagguggaccggacccuggcgaaggagggcaucaagcgcggggagaccgaccaccacgccgugagccggggcuccgccaagcuccgcugguucgucgagcggaacauggugaccccggagggcaagguggucgaccuggggugcggccgcgggggcuggagcuacuacugcgggggccugaagaacgugcgggaggugaagggccucacgaagggcgggcccgggcacgaggagcccauccccaugagcaccuacggcuggaaccugguccgccugcaguccgggguggacguguucuucaccccgcccgagaagugcgacacccuccugugcgacaucggcgagagcucccccaaccccacgaucgaggccggccggacccugcgcguccucaaccugguggagaacuggcugaacaacaacacccaguucugcaucaaggugcucaacccguacaugcccagcgucaucgagaagauggagacccugcagcggaaguacgggggcgcccuggugcgcaacccccucucccggaacagcacccacgagauguacuggguguccaacgcgacggggaacaucgucagcuccgugaacaugaucagccgcaugcugaucaaccgguucaccaugaagcacaagaaggccaccuacgagccggacguggaccugggcuccgggacccgcaacaucggcaucgagagcgagauccccaaccuggacaucaucggcaagcggaucgagaagaucaagcaggagcacgagacguccuggcacuacgaccaggaccaccccuacaagaccugggccuaccacgggagcuacgagaccaagcagaccggcuccgccagcuccauggucaacgggguggugcgccuccugacgaagcccugggacgucgugccgauggugacccagauggccaugaccgacaccacgcccuucggccagcagcgcgucuucaaggagaagguggacacccggacccaggagcccaaggagggcaccaagaagcugaugaagaucacggcggaguggcucuggaaggagcuggggaagaagaagacgccccggaugugcacccgggaggaguucacccgcaaggugcggagcaacgccgcccugggcgccaucuucacggacgagaacaaguggaaguccgcccgcgaggcggucgaggacgggcgguucugggagcucguggaccgcgagcggaaccugcaccuggagggcaagugcgagaccugcguguacaacaugauggggaagcgcgagaagaagcucggcgaguucggcaaggccaaggggagccgggccaucugguacauguggcugggcgcccgcuuccuggaguucgaggcgcucggguuccugaacgaggaccacugguucagccggggcaacucccugagcggggucgagggcgagggccuccaccgccugggguacauccugcgggacgugggcaagaaggagggcggcgccauguacgccgacgacaccgccgggugggacacccgcaucacgcucgaggaccugaagaacgaggagauggucaccaaccacaugaagggcgagcacaagaagcuggccgaggcgaucuucaagcucaccuaccagaacaagguggugcggguccagcgcccgacgccccggggcaccgugauggacaucaucucccgccgggaccagcgcgggagcggccagguggggaccuacggccugaacaccuucaccaacauggaggcccagcugauccgccagauggagggcgaggggaucuucaaguccauccagcaccucacggccaccgaggagaucgccguccagaacuggcuggcccgggugggccgcgagcggcugagccgcauggcgaucuccggggacgacugcguggucaagcccaucgacgaccgguucgccagcgcccucaccgcccugaacgacaugggcaaggugcgcaaggacauccagcagugggagcccucccggggguggaacgacuggacccaggugccguucugcagccaccacuuccacgagcuggucaugaaggacggccgcgugcucgugguccccugccggaaccaggacgagcugaucggccgcgcccggaucucccagggggcgggcuggagccugaaggagacggccugccucgggaaguccuacgcccagauguggacccugauguacuuccaccgccgggaccugcgccucgccgccaacgcgaucugcagcgccgugcccucccacugggugcccaccagccggaccaccugguccauccacgccaagcacgaguggaugacgaccgaggacaugcuggccgucuggaaccgcguguggauccaggagaacccguggauggaggacaagacccccguggagagcugggaggagguccccuaccugggcaagcgggaggaccaguggugcgggagccucaucggccugaccucccgcgcgacgugggccaagaacauccagaccgccaucaaccaggugcggagccugaucggcaacgaggaguacaccgacuacaugcccuccaugaagcgcuuccgccgggaggaggaggaggccggggugcucugguga

SEQ ID NO: 9187 - RNA, 9876 nt, Artificial Sequence
  derived and/or modified CDS sequence (opt1) from DENV-2__GQ199893__SS-prME
accgcgggcgugaucgucaugcugauccccaccgccauggcguuccaccucaccacccgcaacggggagccccacaugaucgugggccggcaggagaaggggaagucccugcuguucaagaccgaggacggcgugaacaugugcacccucauggccaucgaccugggggagcugugcgaggacaccaucaccuacaagugcccccuccugcgccagaacgagcccgaggacaucgacugcuggugcaacagcaccagcaccugggucacguacgggaccugcaccaccacgggcgagcaccggcgcgagaagcgguccguggcccuggugccccacgucgggaugggccucgagacccgcaccgagaccuggaugagcuccgagggggccuggaagcacgugcagcggaucgagacguggauccugcgccacccgggcuucaccaucauggccgcgauccuggccuacaccaucgggaccacgcacuuccagaaggcccucaucuucauccugcugaccgccguggcgcccagcaugaccaugcggugcaucggcaucuccaaccgcgacuucgucgagggcgugagcgggggcuccuggguggacaucguccucgagcacgggagcugcgugaccacgauggccaagaacaagcccacccuggacuucgagcugaucaagaccgaggccaagcagcccgccacccuccggaaguacugcaucgaggccaagcugacgaacaccaccaccgagucccgcugccccacgcagggcgagcccagccugaacgaggagcaggacaagcgguucaucugcaagcacuccaugguggaccgcggcugggggaacggcugcgggcuguucggcaagggcgggaucgugaccugcgcgauguucacgugcaagaagaacauggagggcaagguggugcagcccgagaaccuggaguacaccaucgucaucacgccccacagcggggaggagcacgccgugggcaacgacaccgggaagcacggcaaggagaucaagaucaccccgcaguccagcaucaccgaggccgagcugaccggguacggcacggugaccauggagugcagcccccggaccggccucgacuucaacgagaugguccugcugcagauggaggacaaggccuggcucgugcaccgccagugguuccuggaccugccccuccccuggcugccgggggccgacacccagggcagcaacuggauccagaaggagacgcuggugaccuucaagaacccccacgcgaagaagcaggacgucgugguccucgggucccaggagggcgccaugcacaccgcccugaccggggccacggagauccagaugagcagcggcaaccuccuguucaccggccaccugaagugccggcugcgcauggacaagcuccagcugaaggggauguccuacagcaugugcaccggcaaguucaagaucgugaaggagaucgccgagacccagcacgggacgaucgugauccggguccaguacgagggcgacggcucccccugcaagauccccuucgagaucaccgaccuggagaagcgccacgugcucgggcggcugaucaccgugaacccgaucgucaccgagaaggacagccccgugaacaucgaggcggagccgcccuucggcgacuccuacaucaucaucgggguggagccgggccagcugaagcucaacugguucaagaaggggagcuccaucggccagauguucgagacgaccaugcgcggcgccaagcgcauggccauccugggggacaccgccugggacuucggcagccucgggggcgucuucaccuccaucgggaaggcccuccaccagguguucggcgcgaucuacggcgccgccuucagcgggguguccuggacgaugaagauccugaucggcgucaucaucaccuggaucgggaugaacagccgguccaccagccuguccgugagccuggugcucgucggcguggugacccuguaccugggggccaugguccaggcggacuccggcugcguggugagcuggaagaacaaggagcucaagugcggcuccgggaucuucaucacggacaacguccacaccuggaccgagcaguacaaguuccagcccgagagccccagcaagcuggccuccgccauccagaaggcccacgaggagggcaucugcgggauccgcagcgugacccggcuggagaaccucauguggaagcagaucacgcccgagcugaaccacauccuguccgagaacgaggugaagcucaccaucaugaccggcgacaucaaggggaucaugcaggccggcaagcgcagccugcggccgcagcccaccgagcugaaguacuccuggaagacguggggcaaggcgaagaugcucagcaccgagucccacaaccagaccuuccugaucgacgggcccgagaccgccgagugcccgaacacgaaccgcgccuggaacagccuggaggucgaggacuacggcuucgggguguucaccaccaacaucuggcucaagcugcgggagaagcaggacguguucugcgacuccaagcugaugagcgccgccaucaaggacaaccgcgcgguccacgccgacaugggcuacuggaucgaguccgcccucaacgacaccuggaagauggagaaggccagcuucaucgaggugaaguccugccacuggcccaagagccacacccugugguccaacggcgugcuggagagcgagaugaucauccccaagaacuucgccgggcccgucucccagcacaacuaccggccgggcuaccacacgcagaccgcggggcccuggcaccucggcaagcuggagauggacuucgaccugugcgaggggaccaccgugguggucacggaggacugcggcaaccgcggccccagccuccggaccaccaccgccagcgggaagcugaucacggaguggugcugccgcuccugcacccugcccccgcuccgguaccgcggcgaggacgggugcugguacggcauggagauccggccccugaaggagaaggaggagaaccuggugaacagccucgugaccgccgggcacggccagaucgacaacuucucccugggcguccuggggauggcccucuuccuggaggagaugcugcgcacccggaucggcacgaagcacgcgauccuccugguggccgugagcuucgucacccugaucaccgggaacauguccuuccgcgaccucggccgggugauggugauggucggggccaccaugacggacgacaucggcaugggcgugaccuaccuggcccugcucgccgcguucaaggugcgccccaccuucgccgccgggcugcugcuccgcaagcugaccagcaaggagcugaugauggccacgaucggcaucgcccuccugucccagagcaccauccccgagaccauccuggagcucaccgacgcgcuggcccuggggaugaugguccucaagaucgugcggaacauggagaaguaccagcuggccgugacgaucauggccaucuccugcgucccgaacgccgugauccugcagaacgcguggaaggugagcugcaccauccucgccgccgucuccgugagcccccugcugcucaccuccagccagcagaaggccgacuggaucccccuggcgcugaccaucaagggccucaaccccacggccaucuuccugaccacccugucccgcaccagcaagaagcgguccuggccgcucaacgaggccaucauggccgucggcauggugagcauccuggccuccagccugcucaagaacgacauccccaugacggggccccugguggcgggcgggcugcucaccgucugcuacgugcugaccggccgcagcgccgaccuggagcucgagcgggccgccgacgugaagugggaggaccaggccgagaucuccgggagcucccccauccugagcaucaccaucuccgaggacggcagcauguccaucaagaacgaggaggaggagcagacgcugaccauccucauccgcaccggccugcuggucaucagcgggguguucccgguguccauccccaucaccgcggccgccugguaccucugggaggucaagaagcagcgggccggcgugcugugggacgugcccagcccgccgcccgucgagaaggccgagcuggaggacggggcguaccgcaucaagcagcggggcauccucggguacucccagaucggcgccggcguguacaaggaggggaccuuccacacgauguggcacgugacccgcggcgccguccugaugcaccgggggaagcgcaucgagcccagcugggccgacgugaagaaggaccugaucuccuacggcgggggcuggaagcucgagggcgaguggaaggagggggaggaggugcagguccuggcccuggagcccggcaagaacccccgggcggugcagaccaagcccgggaucuucaagaccaacacgggcaccaucggggccgugagccucgacuucucccccggcaccagcggcucccccaucgucgaccgcaaggggaagguggugggccuguacgggaacggcgucgugacccggagcggcgccuacguguccgccaucgcgcagacggagaaguccaucgaggacaaccccgagaucgaggacgacaucuuccgcaagaagcggcugaccaucauggaccuccaccccggggccggcaagaccaagcgcuaccugcccgccaucguccgggaggccaucaagcgcgggcugcggacccugauccucgccccgacgcgcgugguggcggccgagauggaggaggcccugcgcggccugcccauccgguaccagacccccgccaucaagaccgagcacaccgggcgcgagaucgucgaccucaugugccacgccacguucaccaugcggcugcugagccccgugcgcgugccgaacuacaaccucaucaucauggacgaggcgcacuucaccgaccccgccuccaucgccgcccggggcuacaucagcacccgcgucgagaugggcgaggccgcggggaucuucaugacggccacgccgcccggcucccgggacccguucccccagagcaacgcccccaucauggacgaggagcgcgagauccccgagcgguccuggaacagcgggcacgagugggugaccgacuucaagggcaagaccgugugguucgucccguccaucaaggccgggaacgacaucgcggccugccugcgcaagaacggcaagaaggugauccagcugagccggaagacguucgacuccgaguacgugaagacccgcgccaacgacugggacuucgucgugaccaccgacaucagcgagaugggcgccaacuucaaggccgagcgggugaucgacccccgccggugcaugaagcccgucauccucacggacggggaggagcgcgugauccuggcgggccccaugccggugacccacuccagcgccgcccagcggcgcgggcggaucggccgcaaccccaagaacgagaacgaccaguacaucuacaugggggagccccuggagaacgacgaggacugcgcccacuggaaggaggccaagaugcuccuggacaacaucaacacccccgagggcaucaucccguccauguucgagcccgagcgcgagaaggucgacgcgaucgacggcgaguaccggcugcgcggggaggcccggaagaccuucguggaccucaugcgccggggcgaccugcccguguggcuggccuacaaggucgccgccgaggggaucaacuacgcggaccgcaaguggugcuucgacggcaucaagaacaaccagauccucgaggagaacaucgagguggagaucuggacgaaggagggggagcggaagaagcugaagccgcgcuggcuggacgcccggaucuacagcgacccccucgcccugaaggaguucaaggaguucgccgcgggccgcaagucccugacccucaaccugaucaccgagaugggccggcugcccaccuucaugacgcagaaggcccgcaacgcccucgacaaccuggccgugcugcacaccgccgaggccgggggccgggccuacaaccacgcccucagcgagcugcccgagacccuggagacccuccugcugcucacgcugcuggccaccgucaccgggggcaucuuccucuuccugauguccggcaaggggaucggcaagaugacccuggggaugugcugcaucaucaccgccagcauccuccugugguacgcgcagauccagccgcacuggaucgccgccuccaucauccuggaguucuuccucaucgugcugcugauccccgagcccgagaagcagcgcacgccccaggacaaccagcucaccuacgucgugaucgccauccugaccguggucgccgcgaccauggccaacgagaugggcuuccuggagaagacgaagaaggaccucgggcugggcagcaucaccacccaggagagcgaguccaacauccuggacaucgaccuccggccggccagcgccuggacccuguacgccguggcgacgaccuucgugacccccaugcugcgccacuccaucgagaacagcuccgucaacgugagccucaccgccaucgccaaccaggccacggugcugaugggccuggggaagggcuggccccucuccaagauggacaucggggucccccugcuggcgaucggcugcuacagccaggugaacccgaucacccucaccgccgcccugcugcuccugguggcccacuacgccaucaucgggcccggccugcaggcgaaggccacccgggaggcccagaagcgcgccgccgcgggcaucaugaagaaccccacggucgacgggaucaccgugaucgaccucgagcccaucccguacgaccccaaguucgagaagcagcugggccaggugaugcugcucauccugugcgucacccaggugcugaugaugcggaccacgugggcccucugcgaggcccugacccuggccaccgggcccaucuccacccucugggagggcaaccccgggcgcuucuggaacacgaccaucgccgugagcauggcgaacaucuuccggggcuccuaccuggccggcgccgggcuccuguucagcaucaugaagaacaccaccaacacgcgccgcggcaccgggaacaucggcgagacccugggcgagaaguggaagucccggcugaacgcccucggcaagagcgaguuccaggucuacaagaaguccggcauccaggagguggaccgcacccuggcgaaggaggggaucaagcggggcgagacggaccaccacgccgugagccgcggguccgccaagcugcggugguucgucgagcgcaacauggugaccccggagggcaagguggucgaccucggcugcgggcggggcggguggagcuacuacugcggcgggcugaagaacgugcgcgaggugaagggccugaccaagggcgggcccggccacgaggagcccauccccauguccaccuacggguggaaccucguccggcugcagagcggcguggacguguucuucacgccgcccgagaagugcgacacccugcucugcgacaucggggagagcucccccaaccccaccaucgaggccggccgcacccugcggguccugaaccucguggagaacuggcugaacaacaacacccaguucugcaucaaggugcugaacccguacaugcccagcgucaucgagaagauggaggcccuccagcgcaaguacggcggggcgcuggugcggaacccccugucccgcaacagcacgcacgagauguacuggguguccaacgccaccggcaacaucgucagcuccgugaacaugaucagccggaugcugaucaaccgcuucaccaugaagcacaagaaggccaccuacgagccggacguggaccucggguccggcacgcggaacaucgggaucgagagcgagauccccaaccuggacaucaucggcaagcgcaucgagaagaucaagcaggagcacgagaccuccuggcacuacgaccaggaccaccccuacaagaccugggccuaccacggcagcuacgagaccaagcagacgggguccgccagcuccauggucaacggcguggugcggcugcucaccaagcccugggacgucgugccgauggugacccagauggcgaugaccgacacgacccccuucgggcagcagcgcgucuucaaggagaagguggacacccgcacccaggagcccaaggagggcacgaagaagcugaugaagaucaccgccgaguggcuguggaaggagcucggcaagaagaagacgccccggaugugcacccgcgaggaguucacgcggaaggugcgcagcaacgccgcccugggggccaucuucaccgacgagaacaaguggaaguccgcgcgggaggccgucgaggacggccgcuucugggagcugguggaccgggagcgcaaccuccaccuggaggggaagugcgagaccugcguguacaacaugaugggcaagcgggagaagaagcugggggaguucggcaaggccaagggcagccgcgccaucugguacauguggcucggggcgcgguuccuggaguucgaggcccugggcuuccucaacgaggaccacugguucucccgcgggaacagccugagcggcgucgagggggagggccugcaccggcucggcuacauccugcgcgacguggggaagaaggagggcggggccauguacgccgacgacaccgccggcugggacacgcggaucacccuggaggaccucaagaacgaggagauggucaccaaccacaugaagggggagcacaagaagcuggcggaggccaucuucaagcugaccuaccagaacaagguggugcgcguccagcggccgacgccccgcggcaccgugauggacaucaucucccggcgcgaccagcggggcagcgggcaggucggcaccuacgggcucaacaccuucacgaacauggaggcccagcugauccgccagauggagggcgagggcaucuucaaguccauccagcaccugaccgccaccgaggagaucgccguccagaacuggcucgcgcgcguggggcgggagcgccugagccggauggccaucuccggcgacgacugcguggucaagcccaucgacgaccgcuucgccagcgcccugaccgcccucaacgacauggggaaggugcggaaggacauccagcagugggagcccucccgcggcuggaacgacuggacccaggugccguucugcagccaccacuuccacgagcuggucaugaaggacgggcgggugcuggugguccccugccgcaaccaggacgagcucaucggccgggcgcgcaucucccagggcgccggguggagccugaaggagaccgccugccugggcaaguccuacgcccagauguggacccucauguacuuccaccggcgcgaccugcggcuggccgcgaacgccaucugcagcgccgugccgccccacugggugccgaccucccgcaccacguggagcauccacgccaagcacgaguggaugaccaccgaggacaugcucgcggucuggaaccggguguggauccaggagaaccccuggauggaggacaagacccccguggaguccugggaggagguccccuaccuggggaagcgcgaggaccaguggugcggcagccugaucgggcucacgucccgggccaccugggccaagaacauccagaccgccaucaaccaggugcgcagccugaucggcaacgaggaguacaccgacuacaugccgagcaugaagcgguuccgccgcgaggaggaggaggccggcgugcugugguga

SEQ ID NO: 9188 - RNA, 9876 nt, Artificial Sequence
  derived and/or modified CDS sequence (opt1) from DENV-2__GQ199894__SS-prME
accgccggcgugaucgucaugcugauccccaccgccauggcguuccaccucaccacccgcaacggggagccccacaugaucgugggccggcaggagaaggggaagucccugcuguucaagaccgaggacggcgugaacaugugcacccucauggccaucgaccugggggagcugugcgaggacaccaucaccuacaagugcccccuccugcgccagaacgagcccgaggacaucgacugcuggugcaacagcaccagcaccugggucacguacgggaccugcaccaccacgggcgagcaccggcgcgagaagcgguccguggcccuggugccccacgucgggaugggccucgagacccgcaccgagaccuggaugagcuccgagggggccuggaagcacgugcagcggaucgagacguggauccugcgccacccgggcuucaccaucauggccgcgauccuggccuacaccaucgggaccacgcacuuccagaaggcccucaucuucauccugcugaccgccguggcgcccagcaugaccaugcggugcaucggcaucuccaaccgcgacuucgucgagggcgugagcgggggcuccuggguggacaucguccucgagcacgggagcugcgugaccacgauggccaagaacaagcccacccuggacuucgagcugaucaagaccgaggccaagcagcccgccacccuccggaaguacugcaucgaggccaagcugacgaacaccaccaccgagucccgcugccccacgcagggcgagcccagccugaacgaggagcaggacaagcgguucaucugcaagcacuccaugguggaccgcggcugggggaacggcugcgggcuguucggcaagggcgggaucgugaccugcgcgauguucacgugcaagaagaacauggagggcaagguggugcagcccgagaaccuggaguacaccaucgucaucacgccccacagcggggaggagcacgccgugggcaacgacaccgggaagcacggcaaggagaucaagaucaccccgcaguccagcaucaccgaggccgagcugaccggguacggcacggugaccauggagugcagcccccggaccggccucgacuucaacgagaugguccugcugcagauggaggacaaggccuggcucgugcaccgccagugguuccuggaccugccccuccccuggcugccgggggccgacacccagggcagcaacuggauccagaaggagacgcuggugaccuucaagaacccccacgcgaagaagcaggacgucgugguccucgggucccaggagggcgccaugcacaccgcccugaccggggccacggagauccagaugagcagcggcaaccuccuguucaccggccaccugaagugccggcugcgcauggacaagcuccagcugaaggggauguccuacagcaugugcaccggcaaguucaagaucgugaaggagaucgccgagacccagcacgggacgaucgugauccggguccaguacgagggcgacggcucccccugcaagauccccuucgagaucaccgaccuggagaagcgccacgugcucgggcggcugaucaccgugaacccgaucgucaccgagaaggacagccccgugaacaucgaggcggagccgcccuucggcgacuccuacaucaucaucgggguggagccgggccagcugaagcucaacugguucaagaaggggagcuccaucggccagauguucgagacgaccaugcgcggcgccaagcgcauggccauccugggggacaccgccugggacuucggcagccucggcggggucuucaccuccaucgggaaggcccuccaccagguguucggggcgaucuacggcgccgccuucagcgggguguccuggacgaugaagauccugaucggcgucaucaucaccuggaucgggaugaacagccgguccaccagccuguccgugagccuggugcucgucggcguggugacccuguaccugggggccaugguccaggcggacuccggcugcguggugagcuggaagaacaaggagcucaagugcggcuccgggaucuucaucacggacaacguccacaccuggaccgagcaguacaaguuccagcccgagagccccagcaagcuggccuccgccauccagaaggcccacgaggagggcaucugcgggauccgcagcgugacccggcuggagaaccucauguggaagcagaucacgcccgagcugaaccacauccuguccgagaacgaggugaagcucaccaucaugaccggcgacaucaaggggaucaugcaggccggcaagcgcagccugcggccgcagcccaccgagcugaaguacuccuggaagacguggggcaaggcgaagaugcucagcaccgagucccacaaccagaccuuccugaucgacgggcccgagaccgccgagugcccgaacacgaaccgcgccuggaacagccuggaggucgaggacuacggcuucgggguguucaccaccaacaucuggcucaagcugcgggagaagcaggacguguucugcgacuccaagcugaugagcgccgccaucaaggacaaccgcgcgguccacgccgacaugggcuacuggaucgaguccgcccucaacgacaccuggaagauggagaaggccagcuucaucgaggugaaguccugccacuggcccaagagccacacccugugguccaacggcgugcuggagagcgagaugaucauccccaagcacuucgccgggcccgucucccagcacaacuaccggccgggcuaccacacgcagaccgcggggcccuggcaccucggcaagcuggagauggacuucgaccugugcgaggggaccaccgugguggucacggaggacugcggcaaccgcggccccagccuccggaccaccaccgccagcgggaagcugaucacggaguggugcugccgcuccugcacccugcccccgcuccgguaccgcggcgaggacgggugcugguacggcauggagauccggccccugaaggagaaggaggagaaccuggugaacagccucgugaccgccgggcacggccagaucgacaacuucucccugggcguccuggggauggcccucuuccuggaggagaugcugcgcacccggaucggcacgaagcacgcgauccuccugguggccgccagcuucgugacccugaucaccgggaacauguccuuccgcgaccucggccgggucauggugauggugggggccaccaugacggacgacaucggcaugggcgucaccuaccuggcccugcucgcggccuucaaggugcgccccaccuucgccgccgggcugcugcuccgcaagcugaccagcaaggagcugaugauggccacgaucggcaucgcgcuccugucccagagcaccauccccgagaccauccuggagcucaccgacgcccuggcccuggggaugauggugcucaagaucguccggaacauggagaaguaccagcuggccgugacgaucauggccaucuccugcgugccgaacgcggucauccugcagaacgccuggaaggugagcugcaccauccucgccgccguguccgucagcccccugcugcucaccuccagccagcagaaggcggacuggaucccccuggcccugaccaucaagggccucaaccccacggccaucuuccugaccacccugucccgcaccagcaagaagcgguccuggccgcucaacgaggccaucauggccgugggcauggucagcauccuggcguccagccugcucaagaacgacauccccaugacggggccccugguggccggcgggcugcucaccgugugcuacguccugaccggccgcagcgccgaccuggagcucgagcgggccgccgacgugaagugggaggaccaggcggagaucuccgggagcucccccauccugagcaucaccaucuccgaggacggcagcauguccaucaagaacgaggaggaggagcagacgcugaccauccucauccgcaccggccugcuggugaucagcggggucuucccgguguccauccccaucaccgccgccgccugguaccucugggaggugaagaagcagcgggccggcguccugugggacgugcccagcccgccgcccguggagaaggcggagcuggaggacggggccuaccgcaucaagcagcggggcauccucggguacucccagaucggcgccggcgucuacaaggaggggaccuuccacacgauguggcacgugacccgcggcgccgugcugaugcaccgggggaagcgcaucgagcccagcugggccgacgucaagaaggaccugaucuccuacggcgggggcuggaagcucgagggcgaguggaaggagggggaggagguccagguccuggcgcuggagcccggcaagaacccccgggccguccagaccaagcccgggaucuucaagaccaacacgggcaccaucggggccgugagccucgacuucucccccggcaccagcggcucccccaucguggaccgcaaggggaaggucgugggccuguacgggaacggcguggucacccggagcggcgccuacguguccgcgaucgcccagacggagaaguccaucgaggacaaccccgagaucgaggacgacaucuuccgcaagaagcggcugaccaucauggaccuccaccccggggccggcaagaccaagcgcuaccugcccgccaucgugcgggaggccaucaagcgcgggcugcggacccugauccucgcgccgacgcgcgucguggccgccgagauggaggaggcccugcgcggccugcccauccgguaccagacccccgccaucaagaccgagcacaccgggcgcgagaucguggaccucaugugccacgcgacguucaccaugcggcugcugagccccguccgcgugccgaacuacaaccucaucaucauggacgaggcccacuucaccgaccccgccuccaucgccgcccggggcuacaucagcacccgcguggagaugggcgaggcggccgggaucuucaugacggccacgccgcccggcucccgggacccguucccccagagcaacgcccccaucauggacgaggagcgcgagauccccgagcgguccuggaacagcgggcacgagugggucaccgacuucaagggcaagaccgugugguucgugccguccaucaaggcggggaacgacaucgccgccugccugcgcaagaacggcaagaaggucauccagcugagccggaagacguucgacuccgaguacgugaagacccgcgccaacgacugggacuucguggucaccaccgacaucagcgagaugggcgccaacuucaaggcggagcgggugaucgacccccgccggugcaugaagcccgugauccucacggacggggaggagcgcgucauccuggccggccccaugccggugacccacuccagcgccgcccagcggcgcgggcggaucggccgcaaccccaagaacgagaacgaccaguacaucuacaugggggagccccuggagaacgacgaggacugcgcccacuggaaggaggcgaagaugcuccuggacaacaucaacacccccgagggcaucaucccguccauguucgagcccgagcgcgagaagguggacgccaucgacggcgaguaccggcugcgcggggaggcccggaagaccuucgucgaccucaugcgccggggcgaccugcccguguggcuggccuacaagguggccgcggaggggaucaacuacgccgaccgcaaguggugcuucgacggcaucaagaacaaccagauccucgaggagaacaucgaggucgagaucuggacgaaggagggggagcggaagaagcugaagccgcgcuggcuggacgcccggaucuacagcgacccccucgcccugaaggaguucaaggaguucgcggccggccgcaagucccugacccucaaccugaucaccgagaugggccggcugcccaccuucaugacgcagaaggcccgcaacgcccucgacaaccuggccgugcugcacaccgcggaggccgggggccgggccuacaaccacgcccucagcgagcugcccgagacccuggagacccuccugcugcucacgcugcuggccaccgugaccgggggcaucuuccucuuccugauguccggcaaggggaucggcaagaugacccuggggaugugcugcaucaucaccgcgagcauccuccugugguacgcccagauccagccgcacuggaucgccgccuccaucauccuggaguucuuccucaucguccugcugauccccgagcccgagaagcagcgcacgccccaggacaaccagcucaccuacguggucaucgccauccugaccgugguggcggccaccauggccaacgagaugggcuuccuggagaagacgaagaaggaccucgggcugggcagcaucaccacccaggagagcgaguccaacauccuggacaucgaccuccggccggccagcgccuggacccuguacgcggucgccacgaccuucgugacccccaugcugcgccacuccaucgagaacagcuccgugaacgucagccucaccgccaucgccaaccaggcgacggugcugaugggccuggggaagggcuggccccucuccaagauggacaucggggugccccugcuggccaucggcugcuacagccaggucaacccgaucacccucaccgccgcccugcugcuccugguggcccacuacgcgaucaucgggcccggccugcaggccaaggccacccgggaggcccagaagcgcgccgcggccggcaucaugaagaaccccacgguggacgggaucaccgucaucgaccucgagcccaucccguacgaccccaaguucgagaagcagcugggccaggugaugcugcucauccugugcgugacccagguccugaugaugcggaccacgugggcccucugcgaggcccugacccuggccaccgggcccaucuccacccucugggagggcaaccccgggcgcuucuggaacacgaccaucgcggugagcauggccaacaucuuccggggcuccuaccuggccggcgccgggcuccuguucagcaucaugaagaacaccaccaacacgcgccgcggcaccgggaacaucggcgagacccugggcgagaaguggaagucccggcugaacgcgcucggcaagagcgaguuccagguguacaagaaguccggcauccaggaggucgaccgcacccuggccaaggaggggaucaagcggggcgagacggaccaccacgccgugagccgcggguccgccaagcugcggugguucguggagcgcaacauggucaccccggagggcaaggugguggaccucggcugcgggcggggcggguggagcuacuacugcggcgggcugaagaacguccgcgaggugaagggccugaccaagggcgggcccggccacgaggagcccauccccauguccaccuacggguggaaccucgugcggcugcagagcggcgucgacguguucuucacgccgcccgagaagugcgacacccugcucugcgacaucggggagagcucccccaaccccaccaucgaggccggccgcacccugcgggugcugaaccucgucgagaacuggcugaacaacaacacccaguucugcaucaaggugcugaacccguacaugcccagcgugaucgagaagauggaggcgcuccagcgcaaguacggcggggcccugguccggaacccccugucccgcaacagcacgcacgagauguacuggguguccaacgccaccggcaacaucgugagcuccgucaacaugaucagccggaugcugaucaaccgcuucaccaugaagcacaagaaggccaccuacgagccggacguggaccucggguccggcacgcggaacaucgggaucgagagcgagauccccaaccuggacaucaucggcaagcgcaucgagaagaucaagcaggagcacgagaccuccuggcacuacgaccaggaccaccccuacaagaccugggccuaccacggcagcuacgagaccaagcagacgggguccgcgagcuccauggugaacggcgucgugcggcugcucaccaagcccugggacguggucccgauggugacccagauggccaugaccgacacgacccccuucgggcagcagcgcguguucaaggagaaggucgacacccgcacccaggagcccaaggagggcacgaagaagcugaugaagaucaccgccgaguggcuguggaaggagcucggcaagaagaagacgccccggaugugcacccgcgaggaguucacgcggaaggugcgcagcaacgccgcccugggggcgaucuucaccgacgagaacaaguggaaguccgcccgggaggccguggaggacggccgcuucugggagcuggucgaccgggagcgcaaccuccaccuggaggggaagugcgagaccugcguguacaacaugaugggcaagcgggagaagaagcugggggaguucggcaaggccaagggcagccgcgcgaucugguacauguggcucggggcccgguuccuggaguucgaggcccugggcuuccucaacgaggaccacugguucucccgcgggaacagccugagcggcguggagggggagggccugcaccggcucggcuacauccugcgcgacgucgggaagaaggagggcggggccauguacgccgacgacaccgcgggcugggacacgcggaucacccuggaggaccucaagaacgaggagauggugaccaaccacaugaagggggagcacaagaagcuggccgaggccaucuucaagcugaccuaccagaacaaggucgugcgcgugcagcggccgacgccccgcggcaccgucauggacaucaucucccggcgcgaccagcggggcagcggccaggugggcaccuacgggcucaacaccuucacgaacauggaggcccagcugauccgccagauggagggcgagggcaucuucaaguccauccagcaccugaccgccaccgaggagaucgcggugcagaacuggcucgcccgcgucgggcgggagcgccugagccggauggccaucuccggcgacgacugcguggugaagcccaucgacgaccgcuucgccagcgcccugaccgcgcucaacgacauggggaagguccggaaggacauccagcagugggagcccucccgcggcuggaacgacuggacccaggugccguucugcagccaccacuuccacgagcuggugaugaaggacgggcggguccugguggugcccugccgcaaccaggacgagcucaucggccgggcccgcaucucccagggcgccggguggagccugaaggagaccgccugccugggcaaguccuacgcccagauguggacccucauguacuuccaccggcgcgaccugcggcuggcggccaacgccaucugcagcgccgugccgccccacugggugccgaccucccgcaccacguggagcauccacgcgaagcacgaguggaugaccaccgaggacaugcucgccguguggaaccgggucuggauccaggagaaccccuggauggaggacaagacccccguggaguccugggaggaggugcccuaccuggggaagcgcgaggaccaguggugcggcagccugaucgggcucacgucccgggccaccugggccaagaacauccagaccgccaucaaccagguccgcagccugaucggcaacgaggaguacaccgacuacaugccgagcaugaagcgguuccgccgcgaggaggaggaggcgggcgugcugugguga

SEQ ID NO: 9189 - RNA, 9876 nt, Artificial Sequence
  derived and/or modified CDS sequence (opt1) from DENV-2__FJ898439__SS-prME
accgccggggugaucgucaugcugauccccaccgccauggcguuccaccucaccacccggaacggggagccccacaugaucgugggccggcaggagaaggggaagucccugcuguucaagaccgaggacggcgugaacaugugcacccucauggccaucgaccugggggagcugugcgaggacaccaucaccuacaagugcccccuccugcggcagaacgagcccgaggacaucgacugcuggugcaacagcaccagcaccugggucaccuacgggaccugcuccaccaccggcgagcaccggcgcgagaagcggagcguggcccuggugccccacgucgggaugggccucgagacccggaccgagaccuggaugagcagcgagggggccuggaagcacgugcagcggaucgagaccuggauccugcggcacccgggcuucacgaucauggccgcgauccuggccuacaccaucgggaccacccacuuccagcgggcccucaucuucauccugcugacggccguggcgcccagcaugaccaugcgcugcaucggcaucagcaaccgggacuucgucgagggcguguccgggggcagcuggguggacaucguccucgagcacggguccugcgugaccaccauggccaagaacaagcccacgcuggacuucgagcugaucaagaccgaggccaagcagcccgccacccuccgcaaguacugcaucgaggccaagcugaccaacacgaccaccgagagccggugcccgacccagggcgagcccucccugaacgaggagcaggacaagcgcuucaucugcaagcacagcaugguggaccggggcugggggaacggcugcggccuguucggcaagggcgggaucgucacgugcgcgauguucacgugcaagaagaacauggagggcaagguggugcagcccgagaaccuggaguacaccaucgucaucacgccccacuccggggaggagcacgccgugggcaacgacacggggaagcacggcaaggagaucaagaucaccccgcagagcuccaucaccgaggccgagcugaccggguacggcaccgugacgauggagugcagcccccgcaccggccucgacuucaacgagaugguccugcugcagauggaggacaaggccuggcucgugcaccggcagugguuccuggaccugccccuccccuggcugccgggggccgacacccagggcuccaacuggauccagaaggagacccuggugacguucaagaacccccacgcgaagaagcaggacgucgugguccucgggagccaggagggcgccaugcacaccgcccugaccggggccaccgagauccagaugagcuccggcaaccuccucuucacgggccaccugaagugccgccugcggauggacaagcuccagcugaaggggaugagcuacuccaugugcaccggcaaguucaagaucgugaaggagaucgccgagacccagcacgggaccaucgugauccgcguccaguacgagggcgacggcagccccugcaagauccccuucgagaucacggaccuggagaagcggcacgugcucgggcgccugaucaccgugaacccgaucgucaccggcaaggacucccccgugaacaucgaggcggagccgcccuucggggacagcuacaucaucaucggcguggagccggggcagcugaagcucaacugguucaagaagggcuccagcaucggccagauguucgagaccacgaugcgcggggccaagcggauggccauccugggcgacaccgccugggacuucgggucccugggcggggucuucaccagcaucggcaaggcccuccaccagguguucggcgcgaucuacggggccgccuucuccggcgugagcuggaccaugaagauccugaucggggucaucaucacguggaucggcaugaacucccgcagcaccucccugagcgugucccuggugcucgucgggguggugacccuguaccugggcgccaugguccaggcggacagcggcugcgugguguccuggaagaacaaggagcucaagugcgggagcggcaucuucaucaccgacaacguccacacguggaccgagcaguacaaguuccagcccgagagccccuccaagcuggccagcgccauccagaaggcccacgaggaggggaucugcggcauccgguccgugacccgccuggagaaccucauguggaagcagaucacccccgagcugaaccacauccugagcgagaacgaggugaagcucacgaucaugaccggggacaucaagggcaucaugcaggccggcaagcggucccugcgcccgcagcccaccgagcugaaguacagcuggaagaccugggggaaggcgaagaugcucuccacggagagccacaaccagaccuuccugaucgacggccccgagaccgccgagugcccgaacaccaaccgggccuggaacucccuggaggucgaggacuacggguucggcguguucacgaccaacaucuggcucaagcugcgcgagaagcaggacguguucugcgacagcaagcugauguccgccgccaucaaggacaaccgggcgguccacgccgacaugggcuacuggaucgagagcgcccucaacgacaccuggaagauggagaaggccuccuucaucgaggucaagagcugccacuggcccaagucccacacccuguggagcaacggggugcuggaguccgagaugaucauccccaagaacuucgccggccccgugagccagcacaacuaccgcccgggguaccacacccagacggcgggccccuggcaccucgggaagcuggagauggacuucgaccugugcgagggcaccaccgugguggucaccgaggacugcggcaaccgggggcccagccuccgcacgaccaccgccuccggcaagcugaucaccgaguggugcugccggagcugcacgcugcccccgcuccgcuaccgcggggaggacggcugcugguacgggauggagauccgcccccugaaggagaaggaggagaaccuggugaacucccucgugaccgccggccacggccaggucgacaacuucagccugggggugcugggcauggcccucuuccuggaggagaugcugcggacccgcaucgggaccaagcacgcgauccuccugguggccgccuccuucgucacgcugaucaccggcaacaugagcuuccgggaccucgggcgcgugauggugauggucggcgccaccaugaccgacgacaucggcaugggggugacguaccuggcccugcucgcggccuucaaggugcgccccaccuucgccgccggccugcugcuccggaagcugaccuccaaggagcugaugauggccaccaucgggaucgcgcuccugagccaguccacgauccccgagaccauccuggagcucaccgacgcccuggcccugggcaugaugguccucaagaucgugcgcaacauggagaaguaccagcuggccgugaccaucauggccaucagcugcgucccgaacgcggugauccugcagaacgccuggaagguguccugcacgauccucgccgccgucagcgugagcccccugcugcucaccagcucccagcagaaggcggacuggaucccccuggcccugaccaucaagggccucaaccccaccgccaucuuccugacgacccugagccggaccuccaagaagcgcagcuggccgcucaacgaggccgucauggccguggggaugguguccauccuggcgagcagccugcucaagaacgacauccccaugaccggcccccuggucgccgggggccugcucacggugugcuacgugcugaccgggcgguccgccgaccuggagcucgagcgcgccgccgacgucaagugggaggaccaggcggagaucagcggcuccagccccauccuguccaucaccaucagcgaggacggcuccaugagcaucaagaacgaggaggaggagcagacccugacgauccucauccggaccgggcugcuggugaucuccggcguguucccggucagcauccccaucaccgccgccgccugguaccucugggaggugaagaagcagcgcgccggggugcugugggacguccccagcccgccgcccguggagaaggcggagcuggaggacggcgccuaccggaucaagcagcgcgggauccucggcuacagccagaucggcgccgggguguacaaggagggcaccuuccacaccauguggcacgucacgcgcggggccgugcugaugcaccgcggcaagcggaucgagcccuccugggccgacgugaagaaggaccugaucagcuacgggggcggcuggaagcucgagggggaguggaaggagggcgaggagguccaggugcuggcgcuggagcccgggaagaacccccgcgccgugcagaccaagcccggcaucuucaagaccaacaccgggacgaucggcgccgucucccucgacuucagccccggcaccuccgggagccccaucguggaccggaagggcaagguggucgggcuguacggcaacggcguggugacccgcuccggggccuacgucagcgcgaucgcccagaccgagaaguccaucgaggacaaccccgagaucgaggacgacaucuuccggaagaagcgccugacgaucauggaccuccaccccggcgccgggaagaccaagcgguaccugcccgccaucgugcgcgaggccaucaagcggggccugcgcacccugauccucgcgccgacccgcguggucgccgccgagauggaggaggcccugcgggggcugcccauccgcuaccagacgcccgccaucaagaccgagcacaccggccgggagaucguggaccucaugugccacgcgaccuucacgaugcgccugcugucccccgugcgggucccgaacuacaaccucaucaucauggacgaggcccacuucaccgaccccgccagcaucgccgcccgcggcuacaucuccacccggguggagaugggggaggcggccggcaucuucaugaccgccacgccgcccgggagccgcgacccguucccccaguccaacgcccccaucauggacgaggagcgggagauccccgagcgcagcuggaacuccggccacgagugggugaccgacuucaaggggaagaccgucugguucgugccgagcaucaaggcgggcaacgacaucgccgccugccugcggaagaacggcaagaaggugauccagcugucccgcaagaccuucgacagcgaguacgucaagacgcgggccaacgacugggacuucguggugaccaccgacaucuccgagaugggggccaacuucaaggcggagcgcgucaucgacccccggcgcugcaugaagcccgugauccucaccgacggcgaggagcgggugauccuggccgggcccaugccggucacgcacagcuccgccgcccagcgccggggccgcaucgggcgcaaccccaagaacgagaacgaccaguacaucuacaugggcgagccccuggagaacgacgaggacugcgcccacuggaaggaggcgaagaugcuccuggacaacaucaacacccccgagggcaucaucccgagcauguucgagcccgagcgggagaagguggacgccaucgacggggaguaccgccugcggggcgaggcccgcaagaccuucguggaccucaugcggcgcggggaccugcccgucuggcuggccuacaagguggccgcggagggcaucaacuacgccgaccggaaguggugcuucgacgggaucaagaacaaccagauccucgaggagaacauggagguggagaucuggaccaaggagggcgagcgcaagaagcugaagccgcgguggcuggacgcccgcaucuacuccgacccccucgcccugaaggaguucaaggaguucgcggccggccgcaagagccugacgcucaaccugaucaccgagauggggcgccugcccaccuucaugacccagaaggcccggaacgcccucgacaaccuggccguccugcacacggcggagaccggcgggaaggccuacaaccacgcccucuccgagcugcccgagacccuggagacccuccugcugcucacgcugcuggccaccgugaccggcggcaucuuccucuuccugaugagcgggaagggcaucgggaagaugacccugggcaugugcugcaucaucaccgccuccauccuccugugguacgcgcagauccagccgcacuggaucgccgccagcaucauccuggaguucuuccucaucguccugcugauccccgagcccgagaagcagcgcacgccccaggacaaccagcucaccuacguggugaucgccauccugaccgucguggccgcgaccauggccaacgagaugggguuccuggagaagacgaagaaggaccucggcuucggcagcaucaccacccaggaguccgagagcaacauccuggacaucgaccugcggccggccuccgccuggacccucuacgccguggcgacgaccuucgucacccccaugcugcgccacagcaucgagaacuccagcgugaacgugucccugaccgccaucgccaaccaggccacgguccucauggggcugggcaagggguggccccugagcaagauggacaucggcgugccccuccuggcgaucgggugcuacucccaggugaacccgaucacccugaccgccgcccuccugcugcucgucgcccacuacgccaucgugggccccggccugcaggcgaaggccacccgggaggcccagaagcgcgccgccgcggggaucaugaagaaccccacgguggacggcaucaccgucaucgaccuggagcccaucccguacgaccccaaguucgagaagcagcucggccaggugaugcugcugauccucugcgugacccagguccugaugaugcggaccacgugggcccugugcgaggcccucacccuggccaccggccccaucagcacccugugggaggggaaccccggccgcuucuggaacacgaccaucgccguguccauggcgaacaucuuccggggcagcuaccucgccggggccggccugcuguucuccaucaugaagaacaccaccaacacgcgccgcgggaccggcaacaucggcgagacccucggggagaaguggaagucccggcugaacgcccugggcaaguccgaguuccagaucuacaagaaguccgggauccaggagguggaccgcacccucgcgaaggagggcaucaagcgcggggagacggaccaccacgccgucucccgcggcagcgccaagcugcggugguucguggagcgcaacauggugaccccggagggcaaggucguggaccuggggugcggccgcggcgggugguccuacuacugcggcgggcucaagaacgugcgcgaggucaaggggcugaccaagggcgggcccgggcacgaggagcccauccccaugagcaccuacggcuggaaccuggugcggcuccagagcgggguggacgucuucuucacgccgcccgagaagugcgacacccugcugugcgacaucggcgaguccagccccaaccccaccaucgaggccggccgcacccuccgggugcugaaccugguggagaacuggcucaacaacaacacccaguucugcaucaagguccugaacccguacaugcccuccgugaucgagaagauggagacgcugcagcgcaaguacgggggcgcccucgugcggaacccccugagccgcaacuccacccacgagauguacugggucagcaacgcgaccgggaacaucguguccagcgugaacaugaucucccggaugcugaucaaccgcuucaccaugaagcacaagaaggccacguacgagccggacgucgaccugggcagcgggacccggaacaucggcaucgaguccgagauccccaaccucgacaucaucggcaagcgcaucgagaagaucaagcaggagcacgagaccagcuggcacuacgaccaggaccaccccuacaagaccugggccuaccacggguccuacgagacgaagcagaccggcagcgccuccagcauggugaacggggugguccggcugcugaccaagcccugggacguggugccgauggucacccagauggccaugacggacaccacccccuucggccagcagcgcguguucaaggagaagguggacacccgcacgcaggagcccaaggagggcaccaagaagcucaugaagaucaccgcggaguggcuguggaaggagcuggggaagcggaagacgccccggaugugcacgcgggaggaguucacccgcaagguccgguccaacgccgcccucggcgccaucuucaccgacgagaacaaguggaaguccgcccgcgaggcgguggaggacgggcgguucugggagcugguggaccgcgagcggaaccugcaccucgagggcaagugcgagaccugcgucuacaacaugauggggaagcgcgagaagaagcugggcgaguucggcaaggccaaggggucccgggccaucugguacauguggcugggcgcccgcuuccucgaguucgaggcgcugggguuccugaacgaggaccacugguucagccggggcaacagccucuccgggguggagggcgagggccugcaccgccugggguacauccuccgggacgucggcaagaaggagggcggggccauguacgccgacgacacggccgggugggacacccgcaucacccuggaggaccugaagaacgaggagauggugaccaaccacaugaagggcgagcacaagaagcucgccgaggcgaucuucaagcugacguaccagaacaaggugguccgggugcagcgcccgacgccccggggcaccgugauggacaucaucagccgccgggaccagcgcggguccggccaggucgggaccuacggccugaacacguucaccaacauggaggcccagcucauccgccagauggagggcgaggggaucuucaagagcauccagcaccugaccgccaccgaggagguggccgugcagaacuggcuggcccgggucggccgcgagcggcucucccgcauggcgaucagcggggacgacugcguggugaagcccaucgacgaccgguucgccuccgcccugacggcccugaacgacaugggcaagguccgcaaggacauccagcagugggagcccagccggggguggaacgacuggacccaggugccguucugcucccaccacuuccacgagcucgugaugaaggacggccgcguccugguggugcccugccggaaccaggacgagcugaucggccgcgcccggaucagccagggggcgggcuggucccucaaggagaccgccugccugggcaagagcuacgcccagauguggacccugauguacuuccaccgccgggaccuccgccuggccgccaacgcgaucugcuccgccguccccagccacugggugcccaccucccggacgaccuggagcauccacgccaagcacgaguggaugaccaccgaggacaugcuggccguguggaaccgcgucuggauccaggagaacccguggauggaggacaagacgcccguggaguccugggaggaggugcccuaccucggcaagcgggaggaccaguggugcgggagccugaucggccugaccagccgcgcgaccugggccaagaacauccagaccgccaucaaccagguccggucccucaucggcaacgaggaguacacggacuacaugcccagcaugaagcgcuuccgccgggaggaggaggaggccggggugcugugguga

SEQ ID NO: 9190 - RNA, 9876 nt, Artificial Sequence
  derived and/or modified CDS sequence (opt1) from DENV-2__GQ868588__SS-prME
accgcgggcaugaucaucaugcugauccccaccgugauggccuuccaccucaccacccggaacggggagccccacaugaucgugagccggcaggagaagggcaagucccugcuguucaagaccaaggacgggaccaacaugugcacccucauggcgcuggaccugggcgagcucugcgaggacaccaucaccuacaagugccccuuccugaagcagaacgagcccgaggacaucgacugcuggugcaacagcaccuccacgugggugaccuacgggaccugcaccacgaccggcgagcaccgccgggagaagcgcagcguggcccuggucccccacgugggcauggggcucgagacccggaccgagacguggauguccagcgagggcgccuggaagcacgcccagcgcaucgagaccuggauccugcggcaccccggguucaccaucauggccgcgauccuggccuacaccaucggcacgacccacuuccagcgcgugcucaucuucauccugcugaccgccaucgcccccuccauggcgaugcggugcaucgggaucagcaaccgcgacuucgucgagggcguguccggcgggagcuggguggacaucguccucgagcacggcuccugcgugaccacgauggccaagaacaagcccacccuggacuucgagcugaucaagaccgaggccaagcagcccgccacccuccggaaguacugcaucgaggccaagcugacgaacaccaccaccgacagccgcugccccacgcagggggagcccacccugaacgaggagcaggacaagcgguucgugugcaagcacuccauggucgaccgcggcuggggcaacgggugcggccucuucgggaagggcgggaucgugaccugcgcgauguucacgugcaagaagaacauggagggcaagaucgugcagcccgagaaccuggaguacacggucgugaucacgccccacagcggcgaggagcacgccguggggaacgacaccggcaagcacgggaaggaggucaagaucaccccgcaguccagcaucaccgaggccgagcugacgggcuacgggaccgugaccauggagugcagcccccggaccggccucgacuucaacgagauggugcugcugcagauggaggacaaggccuggcucguccaccgccagugguuccuggaccugccccuccccuggcugccgggcgccgacacgcaggggagcaacuggauccagaaggagacccuggugaccuucaagaacccccacgcgaagaagcaggacguggucgugcucggcucccaggagggggccaugcacaccgcccugacgggcgccaccgagauccagaugagcagcgggaaccuccuguucaccggccaccugaagugccggcugcgcauggacaagcuccagcugaagggcauguccuacagcaugugcaccgggaaguucaagaucgucaaggagaucgccgagacgcagcacggcaccaucgugauccgggugcaguacgagggggacggcucccccugcaagauccccuucgagaucauggaccuggagaagcgccacguccucggccggcugaucaccgugaacccgaucgugaccgagaaggacagccccgucaacaucgaggcggagccgcccuucggggacuccuacaucaucaucggcguggagccggggcagcugaagcucgacugguuccgcaagggcagcuccaucgggcagauguucgagacgaccaugcgcggcgccaagcggauggccauccugggcgacaccgccugggacuucgggagccugggcgggguguucaccuccaucggcaaggcccuccaccaggucuucggggcgaucuacggcgccgccuucagcggcguguccuggacgaugaagauccugaucggggugaucaucaccuggaucggcaugaacagccgcuccaccagccuguccgucagccuggugcucguggggaucgucacccuguaccugggcgugauggugcaggccgacuccgggugcgucgugagcuggaagaacaaggagcucaagugcggcuccggcaucuucgugacggacaacguccacaccuggaccgagcaguacaaguuccagcccgagagccccagcaagcuggcguccgccauccagaaggcccacgaggaggggaucugcggcauccggagcgugacccgccuggagaaccucauguggaagcagaucacguccgagcugaaccacauccugagcgagaacgaggugaagcucaccaucaugaccggggacaucaagggcaucaugcaggucgggaagcggucccugcgcccccagccgaccgagcugcgguacagcuggaagacguggggcaaggccaagaugcucuccaccgagcugcacaaccagaccuuccugaucgacggccccgagaccgccgagugccccaacacgaaccgcgcguggaacagccucgagguggaggacuacggguucggcguguucaccaccaacaucuggcugcggcugcgcgagaagcaggacgucuucugcgacuccaagcucaugagcgccgccaucaaggacaaccgggccgugcacgccgacaugggguacuggaucgaguccgcgcugaacgacaccuggaagaucgagaaggccagcuucaucgaggugaaguccugccacuggcccaagagccacacccugugguccaacggcguccucgagagcgagauggugauccccaagaacuucgccggccccgugucccagcacaacaaccgccccggguaccacacgcagaccgccggcccguggcaccuggggaagcuggagauggacuucgacuucugcgagggcaccaccgucguggugacggaggagugcgggaaccggggccccagccuccgcaccaccaccgccagcggcaagcugaucacggaguggugcugccgguccugcacccugccgccccugcgcuaccgcggggaggacggcugcugguacgggauggagauccgcccgcugaaggagaaggaggagaaccuggucagcucccucgugaccgcgggccacgggcagaucgacaacuucagccugggcauccugggcauggcccucuuccuggaggagaugcugcggacccgcguggggacgaagcacgccauccuccuggucgccguguccuucgugacccugaucaccggcaacaugagcuuccgcgaccucgggcgggucauggugauggugggcgcgaccaugacggacgacaucgggaugggcgucaccuaccuggcccugcucgccgccuucaaggugcgccccaccuucgccgcgggccugcugcuccggaagcugaccuccaaggagcugaugaugacgaccaucgggaucgugcuccugagccaguccagcauccccgagaccauccuggagcucaccgacgcccuggcccugggcaugaugguccucaagauggugcgcaacauggagaaguaccagcuggccgugacgaucauggccauccugugcguccccaacgcggugauccuccagaacgccuggaaggucuccugcaccauccuggccguggugagcgucuccccgcugcuccugaccagcucccagcagaaggccgacuggaucccccuggcccucaccaucaaggggcugaaccccacggcgaucuuccugaccacccucagccggaccuccaagaagcgcagcuggccccugaacgaggccaucauggccgugggcaugguguccauccuggccagcagccuccugaagaacgacaucccgaugacgggcccccuggucgccgggggccuccugaccgugugcuacgugcugaccgggcgguccgccgaccucgagcuggagcgcgccaccgacgucaagugggacgaccaggccgagaucagcggcuccagccccauccuguccaucacgaucagcgaggacggguccaugagcaucaagaacgaggaggaggagcagacccucaccauccugauccggaccggccugcucgugaucuccggccuguuccccgugagcaucccgaucaccgccgcggccugguaccugugggaggucaagaagcagcgcgccggggugcucugggacauccccagcccgccgcccgugggcaaggccgagcuggaggacggggccuaccggaucaagcagaagggcauccugggguacagccagaucggcgcgggcgucuacaaggaggggacguuccacaccauguggcacgugacccgcggcgccgugcucaugcacaaggggaagcggaucgagcccuccugggccgacgucaagaaggaccugaucagcuacggcgggggcuggaagcuggagggcgaguggaaggagggggaggagguccaggugcucgcccuggagcccggcaagaacccgcgcgccguccagaccaagcccgggcuguuccggacgaacaccggcaccaucggggcggugucccucgacuucagccccggcaccuccggcagccccaucguggacaagaaggggaaggucgugggccuguacgggaacggcguggucacgcgcuccggcgccuacgugagcgccaucgcccagaccgagaaguccaucgaggacaacccggagaucgaggacgacaucuuccggaagcgccggcugaccaucauggaccugcaccccggggccggcaagaccaagaaguaccuccccgcgaucgugcgcgaggccaucaagcgggggcugcgcacgcugauccucgcccccacccgcgucguggccgcggagauggaggaggcccugcggggccugccgauccgcuaccagacccccgccauccgggccgagcacaccgggcgcgagaucguggaccucaugugccacgccacguucaccaugcggcugcugucccccauccgcguccccaacuacaaccucaucaucauggacgaggcgcacuucaccgacccggccagcaucgccgcccggggcuacaucuccacccgcguggagaugggcgaggccgcggggaucuucaugacggccacgccgcccggcagccgggaccccuucccgcaguccaacgcccccaucauggacgaggagcgcgagauccccgagcggagcuggaacuccgggcacgagugggugaccgacuucaagggcaagaccgucugguucgugcccagcaucaagacggggaacgacaucgccgccugccugcgcaagaacggcaagcgggugauccagcugucccgcaagaccuucgacagcgaguacgucaagacccggaccaacgacugggacuucguggugacgaccgacaucuccgagaugggcgcgaacuucaaggccgagcgcgucaucgacccgcggcgcugcaugaagcccgugauccucaccgacggggaggagcgggugauccuggccggccccaugcccgucacccacagcuccgccgcgcagcgccgcgggcggaucggccgcaacccgcggaacgagaacgaccaguacaucuacaugggggagccccuggagaacgacgaggacugcgcccacuggaaggaggccaagaugcuccuggacaacaucaacacgcccgagggcaucauccccagcauguucgagccggagcgcgagaagguggacgccaucgacggcgaguaccggcugcgcggggaggcccggaagaccuucguggaccucaugcgccggggcgaccugcccgucuggcuggcguacaagguggccuccgaggggaucaacuacgccgaccgccgguggugcuucgacggcacccgcaacaaccagauccucgaggagaacguggaggucgagaucuggaccaaggagggggagcggaagaagcugaagccccgcuggcuggacgcccggaucuacagcgacccgcucgcccugaaggaguucaaggaguucgcggccggccgcaagucccugacgcucaaccugaucaccgagaugggccggcugcccaccuucaugacccagaaggcccgcgacgcccucgacaaccuggccgugcugcacacggcggaggccgggggcaaggccuacaaccacgcccucagcgagcugcccgagacccuggagacccuccugcugcucacccugcuggcgaccgucaccgggggcaucuuccucuuccugauguccggccgggggaucggcaagaugacccuggggaugugcugcaucaucaccgccagcauccuccugugguacgcccagauccagccccacuggaucgccgccagcaucauccuggaguucuuccucaucgugcugcugaucccggagcccgagaagcagcgcacgccccaggacaaccagcucacguacgugaucaucgcgauccugaccgucguggccgccaccauggccaacgagaugggcuuccuggagaagaccaagaaggaccucgggcugggccacaucgccacgcagcagcccgaguccaacauccuggacaucgaccuccggccggcgagcgccuggacccuguacgccguggccaccaccuucaucacgcccaugcugcgccacuccaucgagaacagcuccgucaacgugagccucaccgccaucgcgaaccaggccaccgugcugaugggccuggggaagggcuggccccucuccaagauggacaucggggucccccugcuggccaucggcugcuacagccaggugaacccgaucacccucacggccgcccugcugcuccugguggcgcacuacgccaucaucgggcccggccugcaggccaaggccacccgcgaggcgcagaagcgggccgccgccggcaucaugaagaaccccaccgucgacgggaucaccgugaucgaccucgaccccaucccguacgaccccaaguucgagaagcagcugggccaggugaugcugcucguccugugcgugacccaggugcugaugaugcgcaccaccugggcccucugcgaggcgcugacccuggccacggggcccgucuccacccucugggagggcaaccccgggcgguucuggaacaccaccaucgccgugagcauggccaacaucuuccgcggcuccuaccuggccggcgcggggcuccucuucagcaucaugaagaacacgaccuccacccggcgcggcaccgggaacaucggcgagacgcugggcgagaaguggaagucccggcugaacgcccucggcaagagcgaguuccagaucuacaagaaguccgggauccaggagguggaccgcacccuggccaaggaggggaucaagcggggcgagaccgaccaccacgccgucucccgcgggagcgccaagcugcggugguucguggagcgcaaccucgugaccccggagggcaaggucguggaccugggcugcgggcggggcgggugguccuacuacugcggcgggcugaagaacgugcgcgaggucaagggccucacgaagggcgggcccggccacgaggagcccauccccaugagcaccuacggguggaaccuggugcggcugcagagcggcguggacgucuucuucgugccgcccgagaagugcgacacccuccugugcgacaucggggaguccagccccaaccccaccguggaggcgggccgcacccugcggguccucaaccugguggagaacuggcugaacaacaacacgcaguucugcgugaagguccugaacccguacaugcccuccgugaucgagcgcauggagacccuccagcggaaguacggcggggcccuggugcgcaacccccugagccgcaacuccacccacgagauguacugggucagcaacgccuccggcaacaucgugagcuccgugaacaugaucagccggaugcucaucaaccgcuucaccaugcggcacaagaaggccacguacgagccggacgucgaccugggguccggcacccgcaacaucgggaucgagagcgagacccccaaccuggacaucaucggcaagcggaucgagaagaucaagcaggagcacgaggcguccuggcacuacgaccaggaccaccccuacaagaccugggccuaccacggcagcuacgagacgaagcagaccggguccgccagcuccauggugaacggcgugguccgccuccugaccaagcccugggacguggugccgauggucacccagauggccaugacggacaccacccccuucgggcagcagcggguguucaaggagaagguggacacccgcacgcaggagcccaaggagggcaccaagaagcugaugaagaucaccgccgaguggcucuggaaggagcugggcaagaagaagacgccccggaugugcacgcgcgaggaguucaccaagaagguccggagcaacgcggcccugggggccaucuucaccgacgagaacaaguggaaguccgcccgcgaggccguggaggacaaccgguucugggagcucgucgacaaggagcgcaaccugcaccuggagggcaagugcgagaccugcaucuacaacaugauggggaagcgggagaagaagcucggcgaguucgggaaggcgaagggcagccgcgccaucugguacauguggcugggcgcccgguuccuggaguucgaggcccucggguuccugaacgaggaccacugguucagccgcgagaacucccugagcggcguggagggggagggccuccacaagcugggguacauccugcgggagguguccaagaaggagggcggcgccauguacgcggacgacacggccgggugggacacccgcaucaccaucgaggaccucaagaacgaggagaugaucaccaaccacauggccggcgagcacaagaagcuggccgaggcgaucuucaagcugacguaccagaacaaggucgugcgggugcagcgcccgacgccccgcgggaccgucauggacaucaucagccggcgcgaccagcggggcuccggccagguggggaccuacggccucaacaccuucaccaacauggaggcccagcugauccgccagauggagggggagggcaucuucaagagcauccagcaccugaccgccuccgaggagaucgccgugcaggacuggcucguccggguggggcgcgagcggcugagccgcauggccaucuccggcgacgacugcguggucaagccccuggacgaccgguucgcgcgcgcccucaccgcccugaacgacaugggcaaggugcggaaggacauccagcagugggagcccagccgcggguggaacgacuggacccaggugccguucugcucccaccacuuccacgagcugaucaugaaggacggccggauccucgucgugcccugccgcaaccaggacgagcugaucgggcgggcccgcaucagccagggcgccggguggucccugcgggagaccgcgugccucggcaagagcuacgcccagauguggucccugauguacuuccaccgccgggaccugcgccucgccgccaacgccaucugcagcgcggugcccucccacuggguccccaccagccgcaccaccuggagcauccacgccucccacgaguggaugacgaccgaggacaugcugaccguguggaaccggguguggauccuggagaacccguggauggaggacaagacccccgucgagagcugggaggagauccccuaccucggcaagcgcgaggaccaguggugcgggucccugaucggccugacgagccgggccaccugggccaagaacauccagaccgccaucaaccaggugcgcucccucaucgggaacgaggaguacaccgacuacaugcccagcaugaagcgguuccgccgggaggaggaggaggcgggcgugcugugguga

SEQ ID NO: 9191 - RNA, 9876 nt, Artificial Sequence
  derived and/or modified CDS sequence (opt1) from DENV-2__GQ868590__SS-prME
accgcgggcaugaucaucaugcugauccccaccgugauggccuuccaccucaccacccggaacggggagccccacaugaucgugagccggcaggagaagggcaagagccugcuguucaagaccaaggacgggaccaacaugugcacccucauggcgauggaccugggcgagcugugcgaggacaccaucaccuacaagugccccuuccucaagcagaacgagcccgaggacaucgacugcuggugcaacagcaccuccaccugggugaccuacgggaccugcaccacgaccggcgagcaccggcgggagaagcgcagcguggcccuggugccccacgugggcauggggcuggagacccggaccgagacguggauguccagcgagggcgccuggaagcacgcccagcggaucgagaccuggauccuccggcacccgggguucaccaucauggccgcgauccuggccuacaccaucggcacgacccacuuccagcgcgugcugaucuucauccuccugaccgccaucgcccccuccaugaccaugcggugcaucgggaucagcaaccgcgacuucgucgagggcguguccggcgggagcuggguggacaucguccuggagcacggcuccugcgugacgaccauggcgaagaacaagcccacccucgacuucgagcugaucaagaccgaggccaagcagcccgccacgcugcggaaguacugcaucgaggccaagcucaccaacaccaccacggacagccgcugccccacccagggggagcccacccugaacgaggagcaggacaagcgguucgugugcaagcacuccauggucgaccgcggcuggggcaacgggugcggccuguucgggaagggcgggaucgugaccugcgccauguucacgugcaagaagaacauggagggcaagaucgugcagcccgagaaccucgaguacaccgucgugaucacgccccacagcggcgaggagcacgcgguggggaacgacaccggcaagcacgggaaggaggucaagaucaccccgcaguccagcaucacggaggccgagcugaccggcuacgggaccgugaccauggagugcagcccccggacgggccuggacuucaacgagauggugcuccugcagauggaggacaaggccuggcugguccaccgccagugguuccucgaccugccccugcccuggcucccgggcgccgacacccaggggagcaacuggauccagaaggagacccuggugaccuucaagaacccccacgccaagaagcaggacguggucgugcugggcucccaggagggggcgaugcacacggcccucaccggcgccaccgagauccagaugagcagcgggaaccugcuguucaccggccaccucaagugccggcugcgcauggacaagcugcagcucaagggcauguccuacagcaugugcacggggaaguucaagaucgucaaggagaucgccgagacccagcacggcaccaucgugauccgggugcaguacgagggggacggcucccccugcaagauccccuucgagaucauggaccuggagaagcgccacguccugggccggcucaucaccgugaacccgaucgugacggagaaggacagccccgucaacaucgaggccgagccgcccuucggggacuccuacaucaucaucggcguggagccggggcagcugaagcuggacugguucaagaagggcagcuccaucgggcagauguucgagaccaccaugcgcggcgcgaagcgcauggccauccucggcgacaccgccugggacuucgggagccugggcgggauguucacguccaucggcaaggcccugcaccagguguucggggccaucuacggcgcggccuucagcggcgucuccuggaccaugaagauccucaucggggugaucaucaccuggaucggcaugaacagccgguccaccagccuguccgugagccugguccugguggggaucgugacgcucuaccugggcgucauggugcaggccgacuccgggugcguggucagcuggaagaacaaggagcugaagugcggcuccggcaucuucgugaccgacaacgugcacaccuggaccgagcaguacaaguuccagcccgagagccccagcaagcucgccuccgcgauccagaaggcccacgaggaggggaucugcggcauccgcagcgucacgcggcuggagaaccugauguggaagcagaucacccccgagcucaaccacauccuguccgagaacgaggugaagcugaccaucaugaccggggacacgaagggcaucaugcaggucgggaagcgcagccuccggccgcagcccaccgagcugcgcuacuccuggaagaccuggggcaaggccaagaugcugcccaccgagcuccacaaccagacguuccugaucgacggcccggagaccgccgagugccccaacaccaaccgggccuggaacagccuggaggucgaggacuacggguucggcguguucaccaccaacaucuggcuccgccugcgggagaagcaggacguguucugcgacuccaagcugaugagcgcggccaucaaggacaaccgcgccguccacgccgacaugggguacuggaucgaguccgcccucaacgacacguggaagaucgagaaggcgagcuucaucgaggugaaguccugccacuggcccaagagccacacccugugguccaacggcgugcuggagagcgagauggucauccccaagaaccucgccggcccggugucccagcacaacaaccggcccggguaccacacccagaccgccggccccuggcaccuggggaagcuggagauggacuucaacuucugcgagggcacgaccguggucgugaccgaggagugcgggaaccgcggccccagccuccggaccacgaccgccuccggcaagcugaucaccgaguggugcugccgcagcugcacccugccgccccuccgguaccgcggggaggacggcugcugguacgggauggagauccggccccugaaggagaaggaggagaaccuggugagcucccucgucacggccggccacgggcagaucgacaacuucagccugggcauccugggcauggcccuguuccuggaggagaugcugcgcacccggguggggaccaagcacgccauccuccugguggccgucuccuucgugacccugaucacgggcaacaugagcuuccgcgaccucgggcgcgugauggucauggugggcgccaccaugaccgacgacaucgggaugggcgugaccuaccuggcgcugcucgccgccuacaagguccggcccacguucgccgccggccugcugcuccgcaagcugaccuccaaggagcugaugaugaccaccaucgggaucgugcuccugagccaguccagcaucccggagacgauccuggagcucaccgacgcgcuggcccugggcaugauggugcucaagaugguccggaacauggagaaguaccagcuggccgugaccaucauggccauccugugcgugcccaacgccgucauccuccagaacgcguggaagguguccugcaccauccuggccgucgugagcgugagcccccugcuccugacgagcucccagcagaaggccgacuggaucccccuggcccucaccaucaaggggcugaacccgaccgccaucuuccugaccacgcucagccgcaccuccaagaagcggagcuggccccugaacgaggcgaucauggccgucggcaugguguccauccuggccagcucccuccugaagaacgacauccccaugaccggcccccugguggccgggggccuccugaccgucugcuacgugcugacggggcgcagcgcggaccucgagcuggagaaggccaccgacgugaagugggacgaccaggccgagaucagcggcuccagcccgauccuguccaucaccaucagcgaggacggguccaugagcaucaagaacgaggaggaggagcagacccucaccauccugauccggacgggccugcucgucaucuccggccuguuccccgugagcauccccaucaccgccgccgcgugguaccugugggaggugaagaagcagcgcgccgggguccucugggacgugcccuccccgccgcccgugggcaaggccgagcuggaggacggggccuaccggaucaagcagaagggcauccugggguacagccagaucggcgccggcgucuacaaggaggggaccuuccacaccauguggcacgugacgcgcggcgcggugcucaugcacaaggggaagcggaucgagccguccugggccgacgucaagaaggaccugaucagcuacggcgggggcuggaagcuggagggcgaguggaaggagggggaggagguccaggugcucgcccuggagcccggcaagaacccccgcgccguccagaccaagcccgggcuguuccggaccaacaccggcacgaucggggccgugucccucgacuucagcccgggcaccuccggcagccccaucguggacaagaaggggaaggucgugggccuguacgggaacggcguggucacccgcuccggcgcguacgugagcgccaucgcccagaccgagaaguccaucgaggacaaccccgagaucgaggacgacaucuuccggaagcgccggcugacgaucauggaccugcaccccggggccggcaagaccaagaaguaccucccggccaucgugcgcgaggcgaucaagcgggggcugcgcacccugauccucgcccccacccgggucguggccgccgagauggaggaggcgcugcgcggccugcccauccgcuaccagacgcccgccauccgggccgagcacaccgggcgcgagaucguggaccucaugugccacgccaccuucaccaugcggcugcugagcccgauccgcguccccaacuacaaccucaucaucauggacgaggcccacuucacggaccccgcgagcaucgccgcccggggcuacaucuccacccgcguggagaugggcgaggccgccgggaucuucaugaccgcgacgccgcccggcagccgggaccccuucccccaguccaacgcccccaucauggacgaggagcgcgagauccccgagcggagcuggaacuccgggcacgagugggugacggacuucaagggcaagaccgucugguucgugcccagcaucaagaccgggaacgacaucgccgccugccugcgcaagaacggcaagcgggugauccagcugucccgcaagaccuucgacagcgaguacgucaagacgcggaccaacgacugggacuucguggugaccaccgacaucuccgagaugggcgccaacuucaaggcggagcgcgucaucgacccccggcgcugcaugaagcccgugauccucacggacggggaggagcgggugauccuggccggcccgaugcccgucacccacagcuccgccgcccagcgccgggggcgcaucggccgcaacccccggaacgagaacgaccaguacaucuacaugggggagccccuggagaacgacgaggacugcgcgcacuggaaggaggccaagaugcuccuggacaacaucaacaccccggagggcaucauccccagcauguucggccccgagcgcgagaagguggacgccaucgacggggaguaccggcugcgcggcgaggcccggaagaccuucguggagcucaugcgccgcggggaccugccggucuggcuggccuacaagguggcguccgagggcaucaacuacgccgaccgccgguggugcuucgacgggacgcgcaacaaccagauccucgaggagaacguggaggucgagaucuggaccaaggagggcgagcggaagaagcugaagccccgcuggcuggacgcccggaucuacagcgacccccucgcccugaaggaguucaaggaguucgccgcgggccgcaagucccugacccucaaccugaucaccgagauggggcggcugcccacguucaugacccagaaggcccgcgacgcccucgacaaccuggccgugcugcacaccgccgaggcgggcgggaaggccuacaaccacgcccucagcgagcugccggagacccuggagacccuccugcugcucacgcugcuggccaccgucaccggcggcaucuuccucuuccugauguccgggcggggcaucgggaagaugacccugggcaugugcugcaucaucacggcgagcauccuccugugguacgcccagauccagccccacuggaucgccgccuccaucauccuggaguucuuccucaucgugcugcugauccccgagcccgagaagcagcgcaccccgcaggacaaccagcucaccuacgugaucaucgccauccugaccgucguggcggccacgauggccaacgagaugggguuccuggagaagaccaagaaggaccucggccugggccacaucgccacccagcagcccgagagcaacauccuggacaucgaccuccggcccgccagcgcguggacccuguacgccguggccacgaccuucaucacccccaugcugcgccacuccaucgagaacagcuccgucaacgugagccucaccgccaucgccaaccaggcgacggugcugauggggcugggcaagggguggccgcucuccaagauggacaucggcgucccccugcuggccaucgggugcuacagccaggugaaccccaucacccucaccgccgcccugcugcuccugguggcccacuacgcgaucaucggccccggccugcaggccaaggccacccgggaggcccagaagcgcgcggccgccgggaucaugaagaacccgacggucgacggcaucaccgugaucgaccucgaccccauccccuacgaccccaaguucgagaagcagcugggccaggugaugcugcucguccugugcgugacccaggugcugaugaugcgcaccacgugggcccucugcgaggcccugacccuggcgaccgggccggucuccacccucugggaggggaaccccggccgguucuggaacacgaccaucgccgugagcauggccaacaucuuccgcggcuccuaccuggccggggccggccuccucuucagcaucaugaagaacaccaccuccacgcggcgcgggaccggcaacaucggcgagacccugggggagaaguggaagucccggcugaacgcgcucggcaaguccgaguuccagaucuacaagaaguccgggauccaggagguggaccgcacccuggccaaggagggcaucaagcgcggggagacggaccaccacgccgucucccgcggcagcgccaagcugcggugguucguggagcgcaaccucgugacccccgagggcaaggucguggaccuggggugcggccgcggcgggugguccuacuacugcggcgggcugaagaacgugcgcgaggucaaggggcucaccaagggcggccccgggcacgaggagccgauccccaugagcaccuacggcuggaaccuggugcggcugcaguccgggguggacgucuucuucaucccgcccgagaagugcgacacccuccugugcgacaucggcgagagcagcccgaaccccacgguggaggccggccgcacccugcgggugcucaaccuggucgaguccuggcugaacaacaacacccaguucugcgugaaggugcugaaccccuacaugccgagcgucaucgagcgcauggagacccuccagcggaaguacgggggcgcgcuggugcgcaacccccugucccggaacagcacgcacgagauguacuggguguccaacgccagcgggaacgucguguccagcgugaacaugaucucccgcaugcucaucaaccgcuucaccaugcggcacaagaaggccaccuacgagcccgacgucgaccugggcagcgggacccgcaacaucggcaucgaguccgagacgcccaaccuggacaucaucggcaagcggaucgagaagaucaagcaggagcacgaggccagcuggcacuacgaccaggaccacccguacaagaccugggcguaccacggguccuacgagaccaagcagaccggcagcgccuccagcauggugaacggggugguccgccuccugacgaagcccugggacguggugcccauggucacccagauggccaugaccgacaccacgcccuucggccagcagcggguguucaaggagaagguggacacccgcacccaggagccgaaggagggcaccaagaagcugaugaagaucacggccgaguggcucuggaaggagcuggggaagaagaagacgccccggaugugcacccgcgaggaguucaccaagaagguccgguccaacgccgcgcugggcgccaucuucacggacgagaacaaguggaaguccgcccgcgaggccguggaggacaaccgguucugggagcucgucgacaaggagcgcaaccugcaccuggaggggaagugcgagaccugcguguacaacaugaugggcaagcgggagaagaagcucggggaguucggcaaggccaagggcucccgcgcgaucugguacauguggcugggggcccgguuccuggaguucgaggcccucggcuuccugaacgaggaccacugguucagccgcgagaacagccuguccgggguggagggcgaggggcuccacaagcugggcuacauccugcgggaggucagcaagaaggagggcggggccauguacgccgacgacaccgcgggcugggacacccgcaucacgaucgaggaccucaagaacgaggagaugaucaccaaccacauggccggggagcacaagaagcuggccgaggccaucuucaagcugaccuaccagaacaagguggugcggguccagcgccccacccccaucggcacggugauggacaucaucucccggcgcgaccagcgcgggagcggccaggugggcaccuacgggcucaacaccuucaccaacauggaggcgcagcugauccggcagauggagggcgaggggaucuucaaguccauccagcaccugacggccagcgaggagaucgccguccaggacuggcucgugcgcgugggccgggagcgccugucccggauggccaucagcggcgacgacugcgucgugaagccgcuggacgaccgcuucgcccgggcgcucaccgcccugaacgacauggggaaggugcgcaaggacauccagcagugggagcccucccggggcuggaacgacuggacccagguccccuucugcagccaccacuuccacgagcugaucaugaaggacgggcgcacccucguggugcccugccggaaccaggacgagcugaucggccgcgcccggaucucccagggggccggcuggagccugcgcgagaccgccugccucggcaaguccuacgcgcagauguggagccugauguacuuccaccggcgcgaccugcggcucgccgccaacgccaucugcuccgccgucccgagccacugggugcccacgucccgcaccaccuggagcauccacgcgagccacgaguggaugaccacggaggacaugcugaccguguggaaccgggucuggauccuggagaaccccuggauggaggacaagacccccguggaguccugggaggagaucccguaccucgggaagcgcgaggaccaguggugcggcagccugaucgggcugaccucccgcgccacgugggccaagaacauccagaccgccaucaaccaggugcggagccucaucggcaacgaggaguacaccgacuacaugcccuccaugaagcgcuuccggcgcgaggaggaggaggccgggguccugugguga

SEQ ID NO: 9192 - RNA, 9876 nt, Artificial Sequence
  derived and/or modified CDS sequence (opt1) from DENV-2__GQ868497__SS-prME
accgccagcgugaucgucaugcugauccccaccgugauggccuuccaccucaccacccgcaacggcgagccccacaugaucguggggcggcaggagaagggcaagucccugcuguucaagaccgaggacggggucaacaugugcacccucauggcgaucgaccugggcgagcugugcgaggacaccaucaccuacaagugcccccuccugcgccagaacgagcccgaggacaucgacugcuggugcaacagcaccuccaccugggugaccuacgggaccugcagcaccaccggcgagcaccggcgcgagaagcgguccguggcccuggucccccacgugggcauggggcucgagacgcgcaccgagaccuggaugagcuccgagggcgccuggaagcacgugcagcggaucgagaccuggauccugcgccacccgggguucacgaucauggccgccauccuggcguacaccaucggcaccacccacuuccagcgggcccucaucuucauccugcugacggccgucgcccccagcaugaccaugcgcugcaucgggaucuccaaccgggacuucguggagggcgugagcggcggguccugggucgacaucgugcucgagcacggcagcugcgugaccaccauggcgaagaacaagcccacgcuggacuucgagcugaucaagaccgaggccaagcagcccgccacccuccgcaaguacugcaucgaggccaagcugaccaacacgaccaccgagucccggugcccgacccagggggagcccagccugaacgaggagcaggacaagcgcuucaucugcaagcacuccauggucgaccggggcuggggcaacgggugcggccucuucgggaagggcgggaucgugacgugcgccauguucacgugcaagaagaacauggagggcaaggugaugcagcccgagaaccuggaguacaccaucgucaucacgccccacagcggcgaggagcacgcgguggggaacgacacgggcaagcacgggaaggagaucaagaucaccccgcaguccagcaucaccgaggccgagcugaccggcuacgggaccgugacgauggagugcagcccccggaccggccucgacuucaacgagaugguccugcugcagauggaggacaaggccuggcucgugcaccggcagugguuccuggaccugccccuccccuggcugccgggcgccgacacccaggggagcaacuggauccagaaggagacccuggugacguucaagaacccccacgccaagaagcaggacgucgugguccucggcagccaggagggggcgaugcacaccgcccugaccggcgccaccgagauccagauguccagcgggaaccuccuguucacgggccaccugaagugccgccugcggauggacaagcuccagcugaagggcauguccuacagcaugugcaccgggaaguucaagaucgugaaggagaucgccgagacccagcacggcaccaucgugauccgcguccaguacgagggggacggcucccccugcaagauccccuucgagaucacggaccuggagaagcggcacgugcucggccgccugaucaccgugaacccgaucgucaccgagaaggacagccccgugaacaucgaggccgagccgcccuucggggacuccuacaucaucaucggcguggagccggggcagcugaagcucaacugguucaagaagggcagcuccaucgggcagauguucgagaccacgaugcgcggcgcgaagcggauggccauccugggcgacaccgccugggacuucgggagccugggcggggucuucaccuccaucggcaaggcccuccaccagguguucggggccaucuacggcgcggccuucagcggcguguccuggaccaugaagauccugaucggggucaucaucacguggaucggcaugaacagccgcuccaccagccuguccgugagccuggugcucgucgggguggugacccuguaccugggcgccaugguccaggccgacuccgggugcguggugagcuggaagaacaaggagcucaagugcggcagcggcaucuucaucaccgacaacguccacacguggaccgagcaguacaaguuccagcccgagucccccagcaagcuggcguccgccauccagaaggcccacgaggaggggaucugcggcauccggagcgugacccgccuggagaaccucauguggaagcagaucacccccgagcugaaccacauccuguccgagaacgaggugaagcucacgaucaugaccggggacaucaagggcaucaugcaggccgggaagcggagccugcgcccgcagcccaccgagcugaaguacuccuggaagaccuggggcaaggccaagaugcucagcacggagucccacaaccagaccuuccugaucgacggccccgagaccgcggagugcccgaacaccaaccgggccuggaacagccuggaggucgaggacuacggguucggcguguucacgaccaacaucuggcucaagcugcgcgagaagcaggacguguucugcgacuccaagcugaugagcgccgccaucaaggacaaccgggccguccacgcggacaugggguacuggaucgaguccgcccucaacgacaccuggaagauggagaaggccagcuucaucgaggugaaguccugccacuggcccaagagccacacccugugguccaacggcgugcuggagagcgagaugaucauccccaagaacuucgccggccccgucagccagcacaacuaccgcccgggguaccacacccagacggccggccccuggcaccucgggaagcuggagauggacuucgacuucugcgagggcaccaccgugguggucaccgaggacugcgggaaccggggccccucccugcgcacgaccaccgcgagcggcaagcucaucaccgaguggugcugccgguccugcacgcugcccccgcugcgcuaccgcggggaggacggcugcugguacgggauggagauccgcccccucaaggagaaggaggagaaccuggugaacagccuggugaccgccggccacgggcagaucgacaacuucucccucggcguccugggcauggcccuguuccucgaggagaugcugcggacccgcaucgggaccaagcacgccauccugcucguggcggccagcuucgugacgcugaucaccggcaacauguccuuccgggaccuggggcgcgucauggugauggugggcgccaccaugaccgacgacaucgggaugggcgucacguaccucgcccugcuggccgcguucaaggugcgccccaccuucgccgccggccuccugcugcggaagcucaccagcaaggagcugaugauggccaccaucgggaucgcccugcucucccagagcacgauccccgagaccauccuggagcugaccgacgcgcucgcccugggcaugauggugcugaagaucguccgcaacauggagaaguaccagcucgccgugaccaucauggccaucuccugcgugccgaacgccgucauccugcagaacgcguggaaggugagcugcacgauccuggccgccguguccgucagcccccuccugcugaccuccagccagcagaaggccgacuggaucccccucgcgcugaccaucaaggggcugaaccccaccgccaucuuccucacgacccugucccggaccagcaagaagcgcuccuggccgcugaacgaggccgugauggccgucggcauggugagcauccucgccagcucccugcugaagaacgacauccccaugaccggcccccucguggccggcgggcugcugacggucugcuacgugcucaccgggcggagcgccgaccuggagcuggagcgcgccgccgacgugaagugggaggaccaggccgagaucuccgggagcucccccauccucagcaucaccaucuccgaggacgggagcauguccgucaagaacgaggaggaggagcagacccugacgauccugauccggaccggccuccuggugaucagcggcguguucccggucuccauccccaucaccgcggccgccugguaccugugggaggugaagaagcagcgcgccggggugcucugggacguccccuccccgccgcccguggagaaggccgagcuggaggacggcgcguaccggaucaagcagcgcgggauccugggcuacucccagaucggggccggcguguacaaggagggcaccuuccacaccauguggcacgucacgcgcggggcggugcucaugcaccggggcaagcggaucgagcccagcugggccgacgugaagaaggaccugaucuccuacgggggcggguggaagcuggagggcgaguggaaggagggcgaggagguccaggugcucgcccuggagcccgggaagaacccccgcgcggugcagaccaagcccggcaucuucaagaccaacaccgggacgaucggcgccgucagccuggacuucucccccgggaccagcggcucccccaucguggaccggaagggcaagguggucgggcucuacggcaacgggguggugacccgcagcggcgccuacgucagcgccaucgcgcagaccgagaaguccaucgaggacaaccccgagaucgaggacgacaucuuccggaagaagcgccugacgaucauggaccugcaccccggcgccgggaagaccaagcgguaccuccccgccaucgugcgcgaggccaucaagcggggccugcgcacccugauccuggccccgacccgcguggucgcggccgagauggaggaggcccuccgggggcugcccauccgcuaccagacgcccgccaucaagaccgagcacaccggccgggagaucguggaccugaugugccacgccaccuucacgaugcgccuccugagccccgugcgggucccgaacuacaaccugaucaucauggacgaggcgcacuucaccgaccccgccuccaucgccgcccgcggguacaucagcacccggguggagaugggcgaggccgcgggcaucuucaugaccgccacgccgcccgggucccgcgacccguucccccagagcaacgcccccaucauggacgaggagcgggagauccccgagcgcuccuggaacagcggccacgagugggugaccgacuucaaggggaagaccgucugguucgugccguccaucaaggccggcaacgacaucgcggccugccuccggaagaacgggaagaaggugauccagcugagccgcaagaccuucgacuccgaguacgucaagacgcgggccaacgacugggacuucguggugaccaccgacaucagcgagaugggcgccaacuucaaggccgagcgcgucaucgacccccggcgcugcaugaagcccgugauccugaccgacggcgaggagcgggugauccucgcggggcccaugccggucacgcacuccagcgccgcccagcgccggggccgcaucgggcgcaaccccaagaacgagaacgaccaguacaucuacaugggcgagccccuggagaacgacgaggacugcgcccacuggaaggaggccaagaugcugcucgacaacaucaacacccccgaggggaucaucccguccauguucgagcccgagcgggagaagguggacgcgaucgacggcgaguaccgccugcggggcgaggcccgcaagaccuucguggaccugaugcggcgcggggaccuccccgucuggcuggccuacaagguggccgccgagggcaucaacuacgcggaccggaaguggugcuucgacgggaucaagaacaaccagauccuggaggagaacauggagguggagaucuggaccaaggagggcgagcgcaagaagcucaagccgcgguggcuggacgcccgcaucuacagcgacccccuggcccucaaggaguucaaggaguucgccgcggggcggaagucccugacgcugaaccucaucaccgagaugggccgccugcccaccuucaugacccagaaggcccggaacgcccuggacaaccucgccguccugcacacggccgaggcgggcgggcgcgccuacaaccacgcccugagcgagcuccccgagacccuggagacccugcuccugcugacccuccuggccacggugaccggcgggaucuuccuguuccucauguccggcaagggcaucgggaagaugacccugggcaugugcugcaucaucaccgccagcauccugcucugguacgcgcagauccagccgcacuggaucgccgccagcaucauccuggaguucuuccugaucguccuccugauccccgagcccgagaagcagcggacgccccaggacaaccagcugacguacguggugaucgccauccucaccgucguggccgcgaccauggccaacgagaugggguuccuggagaagaccaagaaggaccugggccucggguccaucacgacccaggagagcgaguccaacauccuggacaucgaccugcgcccggccagcgccuggacccucuacgccguggcgaccacguucgucacccccaugcugcggcacuccaucgagaacagcuccgugaacgugagccugaccgccaucgccaaccaggccaccguccucaugggccugggcaagggguggccccuguccaagauggacaucggcgugccccuccuggcgaucgggugcuacagccaggugaacccgaucacgcugaccgccgcccuccugcugcucgucgcccacuacgccaucaucggccccgggcugcaggcgaaggccacccgcgaggcccagaagcgggccgccgcgggcaucaugaagaaccccaccguggacggcaucacggugaucgaccuggagcccaucccguacgaccccaaguucgagaagcagcucgggcaggucaugcugcugauccucugcgugacccaggugcugaugaugcgcaccaccugggcccugugcgaggcccucacgcuggccaccggccccaucuccacccugugggaggggaaccccggccgguucuggaacaccacgaucgccgucagcauggcgaacaucuuccgcggguccuaccucgccggcgccggccugcuguucagcaucaugaagaacaccaccaacacccgccgggggacgggcaacaucggggagacccucggcgagaaguggaagucccgccugaacgcccugggcaagagcgaguuccagaucuacaagaaguccgggauccaggagguggaccggacccucgcgaaggagggcaucaagcgcggggagaccgaccaccacgccgugagccggggcuccgccaagcugcgcugguucgucgagcggaacauggugacgccggaggggaagguggucgaccugggcugcggccgcgggggcuggagcuacuacugcgggggccucaaggacgugcgggaggugaaggggcugaccaagggcggccccgggcacgaggagcccauccccaugagcaccuacggcuggaaccugguccgccuccaguccgggaucgacguguucuucaccccgcccgagaagugcgacacgcugcugugcgacaucggcgagagcucccccaaccccaccaucgaggccgggcggacccuccgcgugcugaaccuggucgagaacuggcucaacaacaacacccaguucugcaucaaggugcugaacccguacaugcccagcgugaucgagaagauggagacccugcagcggaaguacggcggcgcccucguccgcaacccccugucccggaacagcacgcacgagauguacuggguguccaacgcgaccgggaacaucgugagcuccgucaacaugaucagccgcaugcugaucaaccgguucaccaugaagcacaagaaggccaccuacgagccggacguggaccugggcuccgggacgcgcaacaucggcaucgagagcgagauccccaaccucgacaucaucgggaagcggaucgagaagaucaagcgcgagcacgagaccuccuggcacuacgaccaggaccaccccuacaagaccugggccuaccacggcagcuacgagaccaagcagacgggcuccgccagcuccauggugaacggggucgugcgccugcugaccaagcccugggacguggucccgauggugacccagauggccaugaccgacacgacccccuucggccagcagcggguguucaaggagaaggucgacacccgcacccaggagcccaaggaggggacgaagaagcucaugaagaucaccgcggaguggcuguggaaggagcugggcaagaagaagacgccccggaugugcacccgcgaggaguucacgcggaaggugcgcagcaacgccgcccucggcgccaucuucaccgacgagaacaaguggaaguccgcccgggaggcgguggaggacgggcgcuucugggagcuggucgaccgggagcgcaaccugcaccucgagggcaagugcgagaccugcguguacaacaugauggggaagcgggagaagaagcugggcgaguucgggaaggccaagggcagccgcgccaucugguacauguggcugggcgcccgguuccucgaguucgaggcgcugggguuccugaacgaggaccacugguucagccgcggcaacucccucagcgggguggagggcgaggggcugcaccggcugggcuacauccuccgcgacgucggcaagaaggagggcggcgccauguacgccgacgacaccgccgggugggacacgcggaucacccuggaggaccugaagaacgaggagauggugaccaaccacaugaagggcgagcacaagaagcucgccgaggcgaucuucaagcugaccuaccagaacaaggucgugcgcgugcagcggccgacgccccgcgggaccgucauggacaucaucucccggcgcgaccagcgcggcagcggccagguggggaccuacggccugaacaccuucacgaacauggaggcccagcucauccggcagauggagggggagggcaucuucaaguccauccagcaccugaccgccaccgaggagaucgccgugcagaacuggcuggcccgcgucggccgggagcgccucagccggauggcgaucuccggggacgacugcguggugaagcccaucgacgaccgcuucgccagcgcccugaccgcccugaacgacaugggcaagguccggaaggacauccagcagugggagcccucccgcggguggaacgacuggacccaggugccguucugcagccaccacuuccacgagcucgugaugaaggacggccggguccugguggugcccugccgcaaccaggacgagcugaucgggcgggcccgcaucucccagggcgcgggcuggagccucaaggagaccgccugccuggggaaguccuacgcccagauguggacccugauguacuuccaccggcgcgaccuccggcuggccgccaacgcgaucugcagcgccguccccucccacugggugcccaccagccgcaccacgugguccauccacgccaagcacgaguggaugaccaccgaggacaugcuggccguguggaaccgggucuggauccaggagaacccguggauggaggacaagacccccguggagagcugggaggaggugcccuaccucggcaagcgcgaggaccaguggugcgggagccugaucggccugacgucccgggcgaccugggccaagaacauccagaccgccaucaaccagguccgcagccucaucgggaacgaggaguacaccgacuacaugcccuccaugaagcgcuuccggaaggaggaggaggaggccggcgugcugugguga

SEQ ID NO: 9193 - RNA, 9876 nt, Artificial Sequence
  derived and/or modified CDS sequence (opt1) from DENV-2__GU131959__SS-prME
accgcgggcgugaucgucaugcugauccccaccgugauggccuuccaccucaccacccgcaacggggagccccacaugaucgugggccggcaggagaagggcaagagccugcuguucaagaccgaggacggcgucaacaugugcacccucauggcgaucgaccugggggagcugugcgaggacaccaucaccuacaagugcccccuccugcgccagaacgagcccgaggacaucgacugcuggugcaacagcaccagcaccugggugaccuacgggaccugcuccaccaccggcgagcaccggcgcgagaagcggagcguggcccuggucccccacguggggaugggccucgagacccgcaccgagaccuggauguccagcgagggggccuggaagcacgugcagcggaucgagaccuggauccugcgccacccgggcuucaccaucauggccgccauccuggcguacaccaucgggaccacccacuuccagcgggcccucaucuucauccugcugacggccgucgcccccuccaugaccaugcgcugcaucggcaucagcaaccgggacuucguggagggcguguccgggggcagcugggucgacaucgugcucgagcacggguccugcgugaccaccauggcgaagaacaagcccacgcuggacuucgagcugaucaagaccgaggccaagcagcccgccacccuccgcaaguacugcaucgaggccaagcugaccaacacgaccaccgagagccggugcccgacccagggcgagcccucccugaacgaggagcaggacaagcgcuucaucugcaagcacagcauggucgaccggggcugggggaacggcugcgggcuguucggcaagggcgggaucgugacgugcgccauguucacgugcaagaagaacauggagggcaaggugguccagcccgagaaccuggaguacaccaucgugaucacgccccacuccggggaggagcacgcggugggcaacgacacggggaagcacggcaaggagaucaagaucaccccgcagagcuccaucaccgaggccgagcugaccggguacggcaccgucacgauggagugcagcccccgcaccggccucgacuucaacgagauggugcugcugcagauggaggacaaggccuggcucgugcaccggcagugguuccuggaccugccccuccccuggcugccgggggccgacacccagggcuccaacuggauccagaaggagacccuggucacguucaagaacccccacgccaagaagcaggacguggucgugcucgggagccaggagggcgcgaugcacaccgcccugaccggggccaccgagauccagaugagcuccggcaaccuccuguucacgggccaccugaagugccgccugcggauggacaagcuccagcugaaggggaugagcuacuccaugugcaccggcaaguucaagaucgugaaggagaucgccgagacccagcacgggaccaucgucauccgcgugcaguacgagggcgacggcagccccugcaagauccccuucgagaucacggaccuggagaagcggcacgugcucgggcgccugaucaccgucaacccgaucgugaccgagaaggacucccccgugaacaucgaggccgagccgcccuucggcgacagcuacaucaucaucggggucgagccgggccagcugaagcucaacugguucaagaagggguccagcaucggccagauguucgagaccacgaugcgcggcgcgaagcggauggccauccugggggacaccgccugggacuucggcucccucggcgggguguucaccagcaucgggaaggcccuccaccagguguucggggccaucuacggcgcggccuucuccggggucagcuggaccaugaagauccugaucggcgugaucaucacguggaucgggaugaacacccgcuccaccagccuguccgugagccugguccucgugggcguggucacccuguaccugggggccauggugcaggccgacuccggcugcguggucagcuggaagaacaaggagcucaagugcggcuccgggaucuucaucacggacaacgugcacaccuggaccgagcaguacaaguuccagcccgagagccccagcaagcuggcguccgccauccagaaggcccacgaggagggcaucugcgggauccggagcgugacccgccuggagaaccucauguggaagcagaucacgcccgagcugaaccacauccuguccgagaacgaggucaagcucaccaucaugaccggcgacaucaaggggaucaugcaggccggcaagcggagccugcgcccgcagcccaccgagcugaaguacuccuggaagacguggggcaaggccaagaugcucagcaccgagucccacaaccagaccuuccugaucgacgggcccgagaccgcggagugcccgaacacgaaccgggccuggaacagccuggagguggaggacuacggcuucgggguguucaccaccaacaucuggcucaagcugcgcgagaagcaggacgucuucugcgacuccaagcugaugagcgccgccaucaaggacaaccgggccgugcacgcggacaugggcuacuggaucgaguccgcccucaacgagaccuggaagauggagaaggccagcuucaucgaggugaaguccugcuacuggcccaagagccacacccugugguccaacggcguccuggagagcgagaugaucauccccaagaacuucgccgggcccgugucccagcacaacuaccgcccgggcuaccacacgcagaccgccgggcccuggcaccucggcaagcuggagauggacuucgaccugugcgaggggaccaccguggucgugacggaggacugcggcaaccggggccccagccuccgcaccaccaccgcgagcgggaagcugaucacggaguggugcugccgguccugcacccugcccccgcuccgcuaccggggcgaggacgggugcugguacggcauggagauccgcccccugaaggagaaggaggagaaccuggugaacagccucgucaccgccgggcacggccagaucgacaacuucucccugggcgugcuggggauggcccucuuccuggaggagaugcugcggacccgcaucggcacgaagcacgccauccuccugguggcggccagcuucgucacccugaucaccgggaacauguccuuccgggaccucggccgcgugauggugauggucggggccaccaugacggacgacaucggcaugggcgugaccuaccuggcccugcucgccgcguucaaggugcgccccaccuucgccgccgggcugcugcuccggaagcugaccagcaaggagcugaugauggccacgaucggcaucgcccuccugucccagagcaccauccccgagaccauccuggagcucaccgacgcgcuggcccuggggaugaugguccucaagaucgugcgcaacauggagaaguaccagcuggccgugacgaucauggccaucuccugcgucccgaacgccgugauccugcagaacgcguggaaggugagcugcaccauccucgccgccgucuccgugagcccccugcugcucaccuccagccagcagaaggccgacuggaucccccuggcgcugaccaucaagggccucaaccccacggccaucuuccugaccacccugucccggaccagcaagaagcgcuccuggccgcucaacgaggccgucauggccgugggcauggugagcauccuggccuccagccugcucaagaacgacauccccaugacggggccccuggucgcgggcgggcugcucaccgugugcuacgugcugaccggccggagcgccgaccuggagcucgagcgcgccgccgacgucaagugggaggaccaggccgagaucuccgggagcucccccauccugagcaucaccaucuccgaggacggcagcauguccaucaagaacgaggaggaggagcagacgcugaccauccucauccggaccggccugcuggugaucagcgggguguucccggucuccauccccaucaccgcggccgccugguaccucugggaggugaagaagcagcgcgccggcgugcugugggacguccccagcccgccgcccguggagaaggccgagcuggaggacggggcguaccggaucaagcagcgcggcauccucggguacucccagaucggcgccggcguguacaaggaggggaccuuccacacgauguggcacgucacccggggcgccgugcugaugcaccgcgggaagcggaucgagcccagcugggccgacgugaagaaggaccugaucuccuacggcgggggcuggaagcucgagggcgaguggaaggagggggaggagguccaggugcuggcccuggagcccggcaagaacccccgcgcggugcagaccaagcccgggaucuucaagaccaacacgggcaccaucggggccgucagccucgacuucucccccggcaccagcggcucccccaucguggaccggaaggggaagguggucggccuguacgggaacggcguggugacccgcagcggcgccuacgucuccgccaucgcgcagacggagaaguccaucgaggacaaccccgagaucgaggacgacaucuuccggaagaagcgccugaccaucauggaccuccaccccggggccggcaagaccaagcgguaccugcccgccaucgugcgcgaggccaucaagcgggggcugcgcacccugauccucgccccgacgcgcguggucgcggccgagauggaggaggcccugcggggccugcccauccgcuaccagacccccgccaucaagaccgagcacaccgggcgggagaucguggaccucaugugccacgccacguucaccaugcgccugcugagccccgugcgggucccgaacuacaaccucaucaucauggacgaggcgcacuucaccgaccccgccuccaucgccgcccgcggcuacaucagcacccggguggagaugggcgaggccgcggggaucuucaugacggccacgccgcccggcucccgcgacccguucccccagagcaacgcccccaucauggacgaggagcgggagauccccgagcgcuccuggaacagcgggcacgagugggugaccgacuucaagggcaagaccgucugguucgugccguccaucaaggccgggaacgacaucgcggccugccugcggaagaacggcaagaaggugauccagcugagccgcaagacguucgacuccgaguacgucaagacccgggccaacgacugggacuucguggugaccaccgacaucagcgagaugggcgccaacuucaaggccgagcgcgucaucgacccccggcgcugcaugaagcccgugauccucacggacggggaggagcgggugauccuggcgggccccaugccggucacccacuccagcgccgcccagcgccgggggcgcaucggccgcaaccccaagaacgagaacgaccaguacaucuacaugggggagccccuggagaacgacgaggacugcgcccacuggaaggaggccaagaugcuccuggacaacaucaacacccccgagggcaucaucccguccauguucgagcccgagcgggagaagguggacgcgaucgacggcgaguaccgccugcgcggggaggcccgcaagaccuucguggaccucaugcggcgcggcgaccugcccgucuggcuggccuacaagguggccgccgaggggaucaacuacgcggaccggaaguggugcuucgacggcaucaagaacaaccagauccucgaggagaacauggagguggagaucuggacgaaggagggggagcgcaagaagcugaagccgcgguggcuggacgcccgcaucuacagcgacccccucgcccugaaggaguucaaggaguucgccgcgggccggaagucccugacccucaaccugaucaccgagaugggccgccugcccaccuucaugacgcagaaggcccggaacgcccucgacaaccuggccguccugcacaccgccgaggccggcgggcgcgccuacaaccacgcccucagcgagcugcccgagacccuggagacccuccugcugcucacgcugcuggccaccgugaccggcgggaucuuccucuuccugauguccgggaaggggaucggcaagaugacccuggggaugugcugcaucaucaccgccagcauccuccugugguacgcgcagauccagccgcacuggaucgccgccuccaucauccuggaguucuuccucaucguccugcugauccccgagcccgagaagcagcggacgccccaggacaaccagcucaccuacguggugaucgccauccugaccgucguggccgcgaccauggccaacgagaugggcuuccuggagaagacgaagaaggaccucgggcugggcagcaucaccacccaggagagcgaguccaacauccuggacaucgaccuccgcccggccagcgccuggacccuguacgccguggcgacgaccuucgucacccccaugcugcggcacuccaucgagaacagcuccgugaacgugagccucaccgccaucgccaaccaggccacgguccugaugggccuggggaagggcuggccccucuccaagauggacaucggggugccccugcuggcgaucggcugcuacagccaggugaacccgaucacccucaccgccgcccugcugcuccuggucgcccacuacgccaucaucgggcccggccugcaggcgaaggccacccgcgaggcccagaagcgggccgccgcgggcaucaugaagaaccccacgguggacgggaucaccgugaucgaccucgagcccaucccguacgaccccaaguucgagaagcagcugggccaggucaugcugcucauccugugcgugacccaggugcugaugaugcgcaccacgugggcccucugcgaggcccugacccuggccaccgggcccaucuccacccucugggagggcaaccccgggcgguucuggaacacgaccaucgccgucagcauggcgaacaucuuccgcggcuccuaccuggccggcgccgggcuccuguucagcaucaugaagaacaccaccaacacgcgccggggcaccgggaacaucggcgagacccugggcgagaaguggaagucccgccugaacgcccucggcaagagcgaguuccagaucuacaagaaguccggcauccaggagguggaccggacccuggcgaaggaggggaucaagcgcggcgagacggaccaccacgccgugagccggggguccgccaagcugcgcugguucgucgagcggaacauggugaccccggagggcaagguggucgaccucggcugcgggcgcggcggguggagcuacuacugcggcgggcugaaggacgugcgggaggugaagggccugaccaagggcgggcccggccacgaggagcccauccccauguccaccuacggguggaaccucguccgccugcagagcggcaucgacguguucuucacgccgcccgagaagugcgacacccugcucugcgacaucggggagagcucccccaaccccaccaucgaggccggccggacccugcgcgugcugaaccucgucgagaacuggcugaacaacaacacccaguucugcaucaaggugcugaacccguacaugcccagcgugaucgagaagauggagacgcuccagcggaaguacggcggggcccugguccgcaacccccugucccggaacagcacccacgagauguacuggguguccaacgcgaccggcaacaucgugagcuccgucaacaugaucagccgcaugcugaucaaccgguucaccaugaagcacaagaaggccacguacgagccggacguggaccucggguccggcacccgcaacaucgggaucgagagcgagauccccaaccuggacaucaucggcaagcggaucgagaagaucaagcaggagcacgagaccuccuggcacuacgaccaggaccaccccuacaagaccugggccuaccacggcagcuacgagacgaagcagaccggguccgccagcuccauggugaacggcgucgugcgccugcucaccaagcccugggacguggucccgauggugacccagauggccaugacggacaccacccccuucgggcagcagcgcguguucaaggagaaggucgacacccggacgcaggagcccaaggagggcaccaagaagcugaugaagaucaccgcggaguggcuguggaaggagcucggcaagaagaagacgccccggaugugcacgcgggaggaguucacccgcaaggugcggagcaacgccgcccugggggccaucuucaccgacgagaacaaguggaaguccgcccgcgaggcgguggaggacggccgguucugggagcuggucgaccgcgagcggaaccuccaccuggaggggaagugcgagaccugcguguacaacaugaugggcaagcgcgagaagaagcugggggaguucggcaaggccaagggcagccgggccaucugguacauguggcucggggcccgcuuccuggaguucgaggcgcugggcuuccucaacgaggaccacugguucucccgggggaacagccugagcggcguggagggggagggccugcaccgccucggcuacauccugcgggacgucgggaagaaggagggcggggccauguacgccgacgacacggccggcugggacacccgcaucacccuggaggaccucaagaacgaggagauggugaccaaccacaugaagggggagcacaagaagcuggccgaggcgaucuucaagcugacguaccagaacaaggucgugcgggugcagcgcccgacgccccggggcaccgucauggacaucaucucccgccgggaccagcgcggcagcggccaggugggcaccuacgggcucaacacguucaccaacauggaggcccagcugauccgccagauggagggcgagggcaucuucaaguccauccagcaccugaccgccaccgaggagaucgccgugcagaacuggcucgcccgggucgggcgcgagcggcugagccgcauggcgaucuccggcgacgacugcguggugaagcccaucgacgaccgguucgccagcgcccugacggcccucaacgacauggggaagguccgcaaggacauccagcagugggagcccucccggggcuggaacgacuggacccaggugccguucugcagccaccacuuccacgagcuggugaugaaggacgggcgcguccugguggugcccugccggaaccaggacgagcucaucggccgcgcccggaucucccagggcgcgggguggagccugaaggagaccgccugccugggcaaguccuacgcccagauguggacccucauguacuuccaccgccgggaccugcgccuggccgccaacgcgaucugcagcgccguccccucccacugggugcccaccagccggacgaccugguccauccacgccaagcacgaguggaugaccaccgaggacaugcucgccguguggaaccgcgucuggauccaggagaacccguggauggaggacaagacgcccguggagagcugggaggaggugcccuaccuggggaagcgggaggaccaguggugcggcucccugaucgggcucaccagccgcgcgaccugggccaagaacauccagaccgccaucaaccagguccggagccugaucggcaacgaggaguacacggacuacaugcccuccaugaagcgcuuccgcaaggaggaggaggaggccggcgugcugugguga

SEQ ID NO: 9194 - RNA, 9876 nt, Artificial Sequence
  derived and/or modified CDS sequence (opt1) from DENV-2__GQ868515__SS-prME
accgcgggcgugaucgucaugcugauccccaccgugauggccuuccaccucaccacccgcaacggggagccccacaugaucgugggccggcaggagaaggggaagucccugcuguucaagaccgaggacggcgucaacaugugcacccucauggcgaucgaccugggggagcugugcgaggacaccaucaccuacaagugcccccuccugcgccagaacgagcccgaggacaucgacugcuggugcaacagcaccagcaccuggaucaccuacgggaccugcuccaccaccggcgagcaccggcgcgagaagcggagcguggcccuggugccccacgucgggaugggccucgagacccgcaccgagaccuggaugagcagcgagggggccuggaagcacgugcagcggaucgagaccuggauccugcgccacccgggcuucaccaucauggccgccauccuggcguacaccaucgggaccacccacuuccagcgggcccucaucuucauccugcugacggccguggcccccagcaugaccaugcgcugcaucggcaucagcaaccgggacuucgucgagggcguguccgggggcagcuggguggacaucguccucgagcacggguccugcgugaccaccauggcgaagaacaagcccacgcuggacuucgagcugaucaagaccgaggccaagcagcccgccacccuccgcaaguacugcaucgaggccaagcugaccaacacgaccaccgagagccggugcccgacccagggcgagcccucccugaacgaggagcaggacaagcgcuucaucugcaagcacagcaugguggaccggggcugggggaacggcugcgggcuguucggcaagggcggcaucgucacgugcgccauguucacgugcaagaagaacauggagggcaagguggugcagcccgagaaccuggaguacaccaucgucaucacgccccacuccggggaggagcacgcggugggcaacgacacggggaagcacggcaaggagaucaagaucaccccgcagagcuccaucaccgaggccgagcugaccggguacggcaccgugacgauggagugcagcccccgcaccggccucgacuucaacgagaugguccugcugcagauggaggacaaggccuggcucgugcaccggcagugguuccuggaccugccccuccccuggcugccgggggccgacacccagggcuccaacuggauccagaaggagacccuggugacguucaagaacccccacgccaagaagcaggacgucgugguccucgggagccaggagggcgcgaugcacaccgcccugaccggggccaccgagauccagaugagcuccggcaaccuccuguucacgggccaccugaagugccgccugcggauggacaagcuccagcugaaggggaugagcuacuccaugugcaccggcaaguucaagaucgugaaggagaucgccgagacccagcacgggaccaucgugauccgcguccgguacgagggcgacggcagccccugcaagauccccuucgagaucacggacuccgagaagcgccacgugcuggggcgccucaucaccgugaacccgaucgucaccgagaaggacagccccgugaacaucgaggccgagccgcccuucggcgacuccuacaucaucaucgggguggagccgggccagcugaagcugaacugguucaagaaggggagcuccaucggccagauguucgagaccacgaugcggggcgcgaagcgcauggccauccucggggacaccgccugggacuucggcagccucgggggcgucuucaccuccaucgggaaggcccugcaccagguguucggcgccaucuacggcgcggccuucagcgggguguccuggaccaugaagauccucaucggcgucaucaucacguggaucgggaugaacagccgguccaccagccuguccgugagccuggugcuggucggcguggugauccucuaccugggggccaugguccaggccgacuccggcugcguggugagcuggaagaacaaggagcugaagugcggcagcgggaucuucaucaccgacaacguccacaccuggacggagcaguacaaguuccagcccgagucccccagcaagcucgcguccgccauccagaaggcccacgaggagggcaucugcgggauccgcagcgugacccggcuggagaaccugauguggaagcagaucacccccgagcucaaccacauccuguccgagaacgaggugaagcugaccaucaugacgggcgacaucaaggggaucaugcaggccggcaagcgcagccuccggccgcagcccaccgagcugaaguacuccuggaagaccuggggcaaggccaagaugcugagcaccgagucccacaaccagacguuccucaucgacgggcccgagaccgcggagugcccgaacaccaaccgcgccuggaacagccuggaggucgaggacuacggcuucgggguguucaccacgaacaucuggcugaagcuccgggagaagcaggacguguucugcgacuccaagcugaugagcgccgccaucaaggacaaccgcgccguccacgcggacaugggcuacuggaucgaguccgcccugaacgacaccuggaagauggagaaggccagcuucaucgaggugaaguccugccacuggcccaagagccacacccucugguccaacggcgugcuggagagcgagaugaucauccccaagaacuucgccgggcccgucagccagcacaacuaccggccgggcuaccacacccagaccgccgggcccuggcaccugggcaagcucgagauggacuucgaccugugcgaggggacgaccgugguggucaccgaggacugcggcaaccgcggccccucccugcggaccacgaccgcgagcgggaagcucaucaccgaguggugcugccgcuccugcacccugcccccgcugcgguaccgcggcgaggacgggugcugguacggcauggagauccggccccucaaggagaaggaggagaaccuggugaacagccuggugacggccgggcacggccagaucgacaacuucucccucggcguccuggggauggcccuguuccucgaggagaugcugcgcacccggaucggcaccaagcacgccauccugcucguggcggccagcuucgugacccugaucacggggaacauguccuuccgcgaccugggccgcgucauggugauggugggggccaccaugaccgacgacaucggcaugggcgucaccuaccucgcccugcuggccgcguucaaggugcggcccacguucgccgccgggcuccugcugcgcaagcucaccagcaaggagcugaugauggccaccaucggcaucgcccugcucucccagagcaccauccccgaguccauccuggagcugacggacgcgcucgcccuggggaugauggugcugaagaucguccggaacauggagaaguaccagcucgccgugaccaucauggccaucagcugcgugccgaacgccgucauccugcagaacgcguggaagguguccugcaccauccuggccgccgugagcgucagcccccuccugcugaccagcucccagcagaaggccgacuggaucccccucgcgcugacgaucaagggccugaaccccaccgccaucuuccucaccacccugagccgcacguccaagaagcggagcuggccgcugaacgaggccgugauggccgucggcauggugagcauccucgccuccagccugcugaagaacgacauccccaugaccgggccccucguggcgggcgggcugcugaccgucugcuacgugcucaccggccgcuccgccgaccuggagcuggagcgggccgccgacgugaagugggaggaccaggccgagaucagcggguccagccccauccucuccaucacgaucagcgaggacggcuccaugagcaucaagaacgaggaggaggagcagacccugaccauccugauccgcaccggccuccuggucaucuccgggguguucccggugagcauccccaucacggcggccgccugguaccugugggaggucaagaagcagcgggccggcgugcucugggacgugcccagcccgccgcccgucgagaaggccgagcuggaggacggggcguaccgcaucaagcagcggggcauccugggguacagccagaucggcgccggcguguacaaggaggggaccuuccacaccauguggcacgugacccgcggcgccguccucaugcaccgggggaagcgcaucgagcccuccugggccgacgugaagaaggaccugaucagcuacggcgggggcuggaagcuggagggcgaguggaaggagggggaggaggugcagguccucgcccuggagcccggcaagaacccccgggcggugcagaccaagcccgggaucuucaagacgaacaccggcaccaucggggccgugucccuggacuucagccccggcaccuccggcagccccaucgucgaccgcaaggggaagguggugggccucuacgggaacggcgucgugacgcggagcggcgccuacguguccgccaucgcgcagaccgagaaguccaucgaggacaaccccgagaucgaggacgacaucuuccgcaagaagcggcugaccaucauggaccugcaccccggggccggcaagaccaagcgcuaccuccccgccaucguccgggaggccaucaagcgcgggcugcgcacgcugauccuggccccgacccgggugguggcggccgagauggaggaggcccuccgcggccugcccauccgguaccagacccccgccaucaagaccgagcacacggggcgcgagaucgucgaccugaugugccacgccaccuucaccaugcggcuccugucccccgugcgcgugccgaacuacaaccugaucaucauggacgaggcgcacuucaccgaccccgccagcaucgccgcccggggcuacaucuccacgcgcgucgagaugggcgaggccgcggggaucuucaugaccgccacgccgcccggcagccgggacccguucccccaguccaacgcccccaucauggacgaggagcgcgagauccccgagcggagcuggaacuccgggcacgagugggugaccgacuucaagggcaagacggugugguucgucccgagcaucaaggccgggaacgacaucgcggccugccuccgcaagaacggcaagaaggugauccagcugucccggaagaccuucgacagcgaguacgugaagacccgcgccaacgacugggacuucgucgugaccacggacaucuccgagaugggcgccaacuucaaggccgagcgggugaucgacccccgccggugcaugaagcccgucauccugaccgacggggaggagcgcgugauccucgcgggccccaugccggugacccacagcuccgccgcccagcggcgcgggcgcaucggccggaaccccaagaacgagaacgaccaguacaucuacaugggggagccccuggagaacgacgaggacugcgcccacuggaaggaggccaagaugcugcucgacaacaucaacacccccgagggcaucaucccgagcauguucgagcccgagcgcgagaaggucgacgcgaucgacggcgaguaccggcugcgcggggaggcccggaagacguucguggaccugaugcgccggggcgaccuccccguguggcuggccuacaaggucgccgccgaggggaucaacuacgcggaccgcaaguggugcuucgacggcaucaagaacaaccagauccuggaggagaacauggagguggagaucuggaccaaggagggggagcggaagaagcucaagccgcgcuggcuggacgcccggaucuacuccgacccccuggcccucaaggaguucaaggaguucgccgcgggccgcaagagccugacccugaaccucaucaccgagaugggccggcugcccacguucaugacccagaaggcccgcaacgcccuggacaaccucgccgugcugcacaccgccgaggccgggggccgggccuacaaccacgcccuguccgagcuccccgagacccuggagacgcugcuccugcugacccuccuggccaccgucaccgggggcaucuuccuguuccucaugagcggcaaggggaucggcaagaugacgcuggggaugugcugcaucaucaccgccagcauccugcucugguacgcgcagauccagccgcacuggaucgccgccuccaucauccuggaguucuuccugaucgugcuccugauccccgagcccgagaagcagcgcacgccccaggacaaccagcugaccuacgucgugaucgccauccucaccguggucgccgcgacgauggccaacgagaugggcuuccuggagaagaccaagaaggaccuggggcucggcagcaucaccacccaggaguccgagagcaacauccuggacaucgaccugcggccggccuccgccuggacgcucuacgccguggcgaccaccuucgugacccccaugcugcgccacagcaucgagaacuccagcgucaacgugucccugacggccaucgccaaccaggccaccgugcucaugggccuggggaagggcuggccccugagcaagauggacaucggggucccccuccuggcgaucggcugcuacucccaggugaacccgaucacccugaccgccgcccuccugcugcucguggcccacuacgccaucaucgggcccggccugcaggcgaaggccacgcgggaggcccagaagcgcgccgccgcgggcaucaugaagaaccccaccgucgacgggaucaccgugaucgaccuggagcccaucccguacgaccccaaguucgagaagcagcucggccaggugaugcugcugauccucugcgucacccaggugcugaugaugcggacgaccugggcccugugcgaggcccucacccuggccaccgggcccaucagcacgcugugggagggcaaccccgggcgcuucuggaacaccaccaucgccguguccauggcgaacaucuuccgcggcagcuaccucgccggcgccgggcugcuguucuccaucaugaagaacaccacgaacacccggcgcggcaccgggaacaucggcgagacccucggcgagaaguggaagucccggcugaacgcccuggggaaguccgaguuccagaucuacaagaaguccggcauccaggaggucgaccgcacgcucgcgaaggaggggaucaagcggggcgagaccgaccaccacgccgugucccgcgggagcgccaagcugcggugguucguggagcgcaacauggucaccccggagggcaaggugguggaccugggcugcgggcggggcggguggagcuacuacugcggcgggcucaaggacguccgcgaggugaagggccugaccaagggcgggcccggccacgaggagcccauccccauguccacguacggguggaaccuggugcggcuccagagcggcaucgacgucuucuucaccccgcccgagaagugcgacacccugcugugcgacaucggggaguccagccccaaccccaccaucgaggccggccgcacgcuccgggugcugaaccugguggagaacuggcucaacaacaacacccaguucugcaucaagguccugaacccguacaugcccuccgugaucgagaagauggagacccugcagcgcaaguacggcggggcccucgugcggaacccccugagccgcaacuccacccacgagauguacugggucagcaacgcgaccggcaacaucguguccagcgugaacaugaucucccggaugcugaucaaccgcuucacgaugaagcacaagaaggccaccuacgagccggacgucgaccuggggagcggcacccggaacaucgggaucgaguccgagauccccaaccucgacaucaucggcaagcgcaucgagaagaucaagcaggagcacgagaccagcuggcacuacgaccaggaccaccccuacaagacgugggccuaccacggcuccuacgagaccaagcagaccgggagcgccuccagcauggugaacggcgugguccgccugcugaccaagcccugggacguggugccgauggucacgcagauggccaugaccgacaccacccccuucgggcagcagcggguguucaaggagaagguggacacgcgcacccaggagcccaaggagggcaccaagaagcucaugaagaucaccgcggaguggcuguggaaggagcugggcaagaagaagacgccccggaugugcacccgcgaggaguucacccggaagguccgcuccaacgccgcccucggggccaucuucaccgacgagaacaaguggaaguccgcccgggaggcgguggaggacggccgcuucugggagcugguggaccgggagcgcaaccugcaccucgaggggaagugcgagacgugcgucuacaacaugaugggcaagcgggagaagaagcugggggaguucggcaaggccaagggcagccgcgccaucugguacauguggcugggggcccgguuccucgaguucgaggcgcugggcuuccugaacgaggaccacugguucucccgcgggaacagccucuccggcguggagggggagggccugcaccggcugggcuacauccuccgcgacguggggaagaaggagggcggggccauguacgccgacgacaccgccggcugggacacccggaucacccuggaggaccugaagaacgaggagauggucacgaaccacaugaagggggagcacaagaagcucgccgaggcgaucuucaagcugaccuaccagaacaaggugguccgcgugcagcggccgacgccccgcggcaccgugauggacaucaucagccggcgcgaccagcgcggcuccgggcaggucggcacguacgggcugaacaccuucaccaacauggaggcccagcucauccggcagauggagggcgagggcaucuucaagaacauccagcaccugaccgccacggaggagaucgccgugcagaacuggcuggcccgcguggggcgggagcgccucagccggauggcgaucuccggcgacgacugcgucgugaagcccaucgacgaccgcuucgccagcgcccugaccgcccugaacgacauggggaaggugcggaaggacauccagcagugggagcccucccgcggcuggaacgacuggacccaggucccguucugcagccaccacuuccacgagcucgugaugaaggacgggcgggugcuggucgugcccugccgcaaccaggacgagcugaucggccgggcccgcaucucccagggcgcgggguggagccucaaggagaccgccugccugggcaaguccuacgcccagauguggacgcugauguacuuccaccggcgcgaccuccggcuggccgccaacgcgaucugcagcgccgugcccucccacuggguccccaccagccgcaccaccugguccauccacgccaagcacgaguggaugaccacggaggacaugcuggccguguggaaccggguguggauccaggagaacccguggauggaggacaagacccccgucgagagcugggaggaggugcccuaccucgggaagcgcgaggaccaguggugcggcagccugaucgggcugaccucccgggcgaccugggccaagaacauccagacggccaucaaccaggugcgcagccucaucggcaacgaggaguacaccgacuacaugcccuccaugaagcgcuuccggaaggaggaggaggaggccggcguccugugguga

SEQ ID NO: 9195 - RNA, 9876 nt, Artificial Sequence
  derived and/or modified CDS sequence (opt1) from DENV-2__GQ868516__SS-prME
accgcgggcgugaucgucaugcugauccccaccgugauggccuuccaccucaccacccggaacggggagccccacaugaucgugggccggcaggagaagggcaagagccugcuguucaagaccgaggacggcgucaacaugugcacccucauggcgaucgaccugggggagcugugcgaggacaccaucaccuacaagugcccccuccugcgccagaacgagcccgaggacaucgacugcuggugcaacuccaccagcaccuggaucaccuacgggaccugcuccaccaccggcgagcaccggcgcgagaagcggagcguggcccuggugccccacgucgggaugggccucgagacccgcaccgagaccuggauguccagcgagggggccuggaagcacgugcagcggaucgagaccuggauccugcgccacccgggcuucaccaucauggccgccauccuggcguacaccaucgggaccacccacuuccagcgggcccucaucuucauccugcugacggccguggcccccuccaugaccaugcgcugcaucggcaucagcaaccgggacuucgucgagggcguguccgggggcagcuggguggacaucguccucgagcacggguccugcgugaccaccauggcgaagaacaagcccacgcuggacuucgagcugaucaagaccgaggccaagcagcccgccacccuccgcaaguacugcaucgaggccaagcugaccaacacgaccaccgagagccggugcccgacccagggcgagcccucccugaacgaggagcaggacaagcgcuucaucugcaagcacagcaugguggaccggggcugggggaacggcugcgggcuguucggcaagggcgggaucgucacgugcgccauguucacgugcaagaagaacauggagggcaagguggugcagcccgagaaccuggaguacaccaucgucaucacgccccacuccggggaggagcacgcggugggcaacgacacggggaagcacggcaaggagaucaagaucaccccgcagagcuccaucaccgaggccgagcugaccggguacggcaccgugacgauggagugcagcccccgcaccggccucgacuucaacgagaugguccugcugcagauggaggacaaggccuggcucgugcaccggcagugguuccuggaccugccccuccccuggcugccgggggccgacacccagggcuccaacuggauccagaaggagacccuggugacguucaagaacccccacgccaagaagcaggacgucgugguccucgggagccaggagggcgcgaugcacaccgcccugaccggggccaccgagauccagaugagcuccggcaaccuccuguucacgggccaccugaagugccgccugcggauggacaagcuccagcugaaggggaugagcuacuccaugugcaccggcaaguucaagaucgugaaggagaucgccgagacccagcacgggaccaucgugauccgcguccaguacgagggcgacggcagccccugcaagauccccuucgagaucacggaccuggagaagcggcacgugcucgggcgccugaucaccgugaacccgaucgucaccgagaaggacucccccgugaacaucgaggccgagccgcccuucggcgacagcuacaucaucaucgggguggagccgggccagcugaagcucaacugguucaagaagggguccagcaucggccagauguucgagaccacgaugcgcggcgcgaagcggauggccauccugggggacaccgccugggacuucggcucccucggcggggucuucaccagcaucgggaaggcccuccaccagguguucggggccaucuacggcgcggccuucuccggggugagcuggaccaugaagauccugaucggcgucaucaucacguggaucgggaugaacucccgcagcaccucccugagcgugucccuggugcucgucggcguggugauccuguaccugggggccaugguccaggccgacagcggcugcgugguguccuggaagaacaaggagcucaagugcggcagcgggaucuucaucaccgacaacguccacaccuggacggagcaguacaaguuccagcccgagagccccuccaagcuggcgagcgccauccagaaggcccacgaggagggcaucugcgggauccgguccgugacccgccuggagaaccucauguggaagcagaucacccccgagcugaaccacauccugagcgagaacgaggugaagcucaccaucaugacgggcgacaucaaggggaucaugcaggccggcaagcggucccugcgcccgcagcccaccgagcugaaguacagcuggaagaccuggggcaaggccaagaugcucuccaccgagagccacaaccagacguuccugaucgacgggcccgagaccgcggagugcccgaacaccaaccgggccuggaacucccuggaggucgaggacuacggcuucgggguguucaccacgaacaucuggcucaagcugcgcgagaagcaggacguguucugcgacagcaagcugauguccgccgccaucaaggacaaccgggccguccacgcggacaugggcuacuggaucgagagcgcccucaacgacaccuggaagauggagaaggccuccuucaucgaggucaagagcugccacuggcccaagucccacacccuguggagcaacggcgugcuggaguccgagaugaucauccccaagaacuucgccgggcccgugagccagcacaacuaccgcccgggcuaccacacccagaccgccgggcccuggcaccucggcaagcuggagauggacuucgaccugugcgaggggacgaccgugguggucaccgaggacugcggcaaccggggccccagccuccgcaccacgaccgcguccgggaagcugaucaccgaguggugcugccggagcugcacccugcccccgcuccgcuaccggggcgaggacgggugcugguacggcauggagauccgcccccugaaggagaaggaggagaaccuggugaacucccucgugacggccgggcacggccagaucgacaacuucagccugggcguccuggggauggcccucuuccuggaggagaugcugcggacccgcaucggcaccaagcacgccauccuccugguggcggccuccuucgugacccugaucacggggaacaugagcuuccgggaccucggccgcgucauggugauggugggggccaccaugaccgacgacaucggcaugggcgucaccuaccuggcccugcucgccgcguucaaggugcgccccacguucgccgccgggcugcugcuccggaagcugaccuccaaggagcugaugauggccaccaucggcaucgcccuccugagccaguccaccauccccgagagcauccuggagcucacggacgcgcuggcccuggggaugauggugcucaagaucguccgcaacauggagaaguaccagcuggccgugaccaucauggccaucuccugcgugccgaacgccgucauccugcagaacgcguggaaggugagcugcaccauccucgccgccguguccgucagcccccugcugcucaccuccagccagcagaaggccgacuggaucccccuggcgcugacgaucaagggccucaaccccaccgccaucuuccugaccacccugucccggacgagcaagaagcgcuccuggccgcucaacgaggccgugauggccgucggcauggugagcauccuggccagcucccugcucaagaacgacauccccaugaccgggccccugguggcgggcgggcugcucaccgucugcuacgugcugaccggccggagcgccgaccuggagcucgagcgcgccgccgacgugaagugggaggaccaggccgagaucuccgggagcucccccauccugagcaucacgaucuccgaggacggcagcauguccaucaagaacgaggaggaggagcagacccugaccauccucauccggaccggccugcuggucaucagcgggguguucccgguguccauccccaucacggcggccgccugguaccucugggaggucaagaagcagcgcgccggcgugcugugggacgugcccagcccgccgcccgucgagaaggccgagcuggaggacggggcguaccggaucaagcagcgcggcauccucggguacucccagaucggcgccggcguguacaaggaggggaccuuccacaccauguggcacgugacccggggcgccguccugaugcaccgcgggaagcggaucgagcccagcugggccgacgugaagaaggaccugaucuccuacggcgggggcuggaagcucgagggcgaguggaaggagggggaggaggugcagguccuggcccuggagcccggcaagaacccccgcgcggugcagaccaagcccgggaucuucaagacgaacaccggcaccaucggggccgugagccucgacuucucccccggcaccagcggcucccccaucgucgaccggaaggggaagguggugggccuguacgggaacggcgucgugacgcgcagcggcgccuacgugagcgccaucgcgcagaccgagaaguccaucgaggacaaccccgagaucgaggacgacaucuuccggaagaagcgccugaccaucauggaccuccaccccggggccggcaagaccaagcgguaccugcccgccaucguccgcgaggccaucaagcgggggcugcgcacgcugauccucgccccgacccgcgugguggcggccgagauggaggaggcccugcggggccugcccauccgcuaccagacccccgccaucaagaccgagcacacggggcgggagaucgucgaccucaugugccacgccaccuucaccaugcgccugcugagccccgugcgggugccgaacuacaaccucaucaucauggacgaggcgcacuucaccgaccccgccuccaucgccgcccgcggcuacaucagcacgcgggucgagaugggcgaggccgcggggaucuucaugaccgccacgccgcccggcucccgcgacccguucccccagagcaacgcccccaucauggacgaggagcgggagauccccgagcgcuccuggaacagcgggcacgagugggugaccgacuucaagggcaagacggugugguucgucccguccaucaaggccgggaacgacaucgcggccugccugcggaagaacggcaagaaggugauccagcugagccgcaagaccuucgacuccgaguacgugaagacccgggccaacgacugggacuucgucgugaccacggacaucagcgagaugggcgccaacuucaaggccgagcgcgugaucgacccccggcgcugcaugaagcccgucauccucaccgacggggaggagcgggugauccuggcgggccccaugccggugacccacuccagcgccgcccagcgccgggggcgcaucggccgcaaccccaagaacgagaacgaccaguacaucuacaugggggagccccuggagaacgacgaggacugcgcccacuggaaggaggccaagaugcuccuggacaacaucaacacccccgagggcaucaucccguccauguucgagcccgagcgggagaaggucgacgcgaucgacggcgaguaccgccugcgcggggaggcccgcaagacguucguggaccucaugcggcgcggcgaccugcccguguggcuggccuacaaggucgccgccgaggggaucaacuacgcggaccggaaguggugcuucgacggcaucaagaacaaccagauccucgaggagaacauggagguggagaucuggaccaaggagggggagcgcaagaagcugaagccgcgguggcuggacgcccgcaucuacagcgacccccucgcccugaaggaguucaaggaguucgccgcgggccggaagucccugacccucaaccugaucaccgagaugggccgccugcccacguucaugacccagaaggcccggaacgcccucgacaaccuggccgugcugcacaccgccgaggccgggggccgcgccuacaaccacgcccucagcgagcugcccgagacccuggagacgcuccugcugcucacccugcuggccaccgucaccgggggcaucuuccucuuccugauguccggcaaggggaucggcaagaugacgcuggggaugugcugcaucaucaccgccagcauccuccugugguacgcgcagauccagccgcacuggaucgccgccagcaucauccuggaguucuuccucaucgugcugcugauccccgagcccgagaagcagcggacgccccaggacaaccagcucaccuacgucgugaucgccauccugaccguggucgccgcgacgauggccaacgagaugggcuuccuggagaagaccaagaaggaccucgggcugggcuccaucaccacccaggagagcgaguccaacauccuggacaucgaccuccgcccggccagcgccuggacgcuguacgccguggcgaccaccuucgugacccccaugcugcggcacuccaucgagaacagcuccgucaacgugagccucacggccaucgccaaccaggccaccgugcugaugggccuggggaagggcuggccccucuccaagauggacaucggggucccccugcuggcgaucggcugcuacagccaggugaacccgaucacccucaccgccgcccugcugcuccugguggcccacuacgccaucaucgggcccggccugcaggcgaaggccacgcgcgaggcccagaagcgggccgccgcgggcaucaugaagaaccccaccgucgacgggaucaccgugaucgaccucgagcccaucccguacgaccccaaguucgagaagcagcugggccaggugaugcugcucauccugugcgucacccaggugcugaugaugcgcacgaccugggcccucugcgaggcccugacccuggccaccgggcccaucuccacgcucugggagggcaaccccgggcgguucuggaacaccaccaucgccgugagcauggcgaacaucuuccgcggcuccuaccuggccggcgccgggcuccuguucagcaucaugaagaacaccacgaacacccgccggggcaccgggaacaucggcgagacccugggcgagaaguggaagucccgccugaacgcccucggcaagagcgaguuccagaucuacaagaaguccggcauccaggaggucgaccggacgcuggcgaaggaggggaucaagcgcggcgagaccgaccaccacgccgugagccggggguccgccaagcugcgcugguucguggagcggaacauggucaccccggagggcaaggugguggaccucggcugcgggcgcggcggguggagcuacuacugcggcgggcugaaggacguccgggaggugaagggccugaccaagggcgggcccggccacgaggagcccauccccaugagcacguacggguggaaccucgugcgccugcaguccggcaucgacgucuucuucaccccgcccgagaagugcgacacccugcucugcgacaucggggagagcucccccaaccccaccaucgaggccggccggacgcugcgcgugcugaaccucguggagaacuggcugaacaacaacacccaguucugcaucaagguccugaacccguacaugcccagcgugaucgagaagauggagacccuccagcggaaguacggcggggcccuggugcgcaacccccugucccggaacagcacccacgagauguacugggucuccaacgcgaccggcaacaucgugagcuccgugaacaugaucagccgcaugcugaucaaccgguucacgaugaagcacaagaaggccaccuacgagccggacgucgaccucggguccggcacccgcaacaucgggaucgagagcgagauccccaaccuggacaucaucggcaagcggaucgagaagaucaagcaggagcacgagaccuccuggcacuacgaccaggaccaccccuacaagacgugggccuaccacggcagcuacgagaccaagcagaccggguccgccagcuccauggugaacggcgugguccgccugcucaccaagcccugggacguggugccgauggucacgcagauggccaugaccgacaccacccccuucgggcagcagcgcguguucaaggagaagguggacacgcggacccaggagcccaaggagggcaccaagaagcugaugaagaucaccgcggaguggcuguggaaggagcucggcaagaagaagacgccccgcaugugcacccgggaggaguucacccgcaagguccggagcaacgccgcccugggggccaucuucaccgacgagaacaaguggaaguccgcccgcgaggcgguggaggacggccgguucugggagcugguggaccgcgagcggaaccuccaccuggaggggaagugcgagacgugcgucuacaacaugaugggcaagcgcgagaagaagcugggggaguucggcaaggccaagggcagccgggccaucugguacauguggcucggggcccgcuuccuggaguucgaggcgcugggcuuccucaacgaggaccacugguucagccgggggaacucccugagcggcguggagggggagggccugcaccgccucggcuacauccugcgggacguggggaagaaggagggcggggccauguacgccgacgacaccgccggcugggacacccgcaucacccuggaggaccucaagaacgaggagauggucacgaaccacaugaagggggagcacaagaagcuggccgaggcgaucuucaagcugaccuaccagaacaaggugguccgggugcagcgcccgacgccccggggcaccgugauggacaucaucucccgccgggaccagcgcggcagcgggcaggucggcacguacgggcucaacaccuucaccaacauggaggcccagcugauccgccagauggagggcgagggcaucuucaagaacauccagcaccugaccgccacggaggagaucgccgugcagaacuggcucgcccggguggggcgcgagcggcugucccgcauggcgaucagcggcgacgacugcgucgugaagcccaucgacgaccgguucgccuccgcccugaccgcccucaacgacauggggaaggugcgcaaggacauccagcagugggagcccagccggggcuggaacgacuggacccaggucccguucugcucccaccacuuccacgagcuggugaugaaggacgggcgcgugcuggucgugcccugccggaaccaggacgagcucaucggccgcgcccggaucagccagggcgcgggguggucccugaaggagaccgccugccugggcaagagcuacgcccagauguggacgcucauguacuuccaccgccgggaccugcgccuggccgccaacgcgaucugcuccgccgugcccagccacuggguccccaccucccggaccaccuggagcauccacgccaagcacgaguggaugaccacggaggacaugcucgccguguggaaccgcguguggauccaggagaacccguggauggaggacaagacccccgucgaguccugggaggaggugcccuaccuggggaagcgggaggaccaguggugcggcagccugaucgggcucaccagccgcgcgaccugggccaagaacauccagacggccaucaaccaggugcggucccugaucggcaacgaggaguacaccgacuacaugcccagcaugaagcgcuuccgcaaggaggaggaggaggccggcguccugugguga
